United States Patent 7,482,117 (GENETIC POLYMORPHISMS ASSOCIATED WITH MYOCARDIAL INFARCTION, METHODS OF DETECTION AND USES THEREOF) - sequence listing, part 11

SEQ ID NO: 17915 - DNA, 44413 bp, Homo sapiens
aactttaaagttcagtccacatggtggcacacgcctgtaattccagctactcgggaggctgaggcaggagaatcgcttgaagctgggaggcagaggttacagtgaggtgaaatcaagccttagcactccagcctgtgtgacagagtgagactccatctcaataaataaataaataaataaataaataaagttcagtccatacagactattgaggcaggattattatgaactggagaaagaatgaacatgattcagagatcctggacttgttgctggatgaagttactgatgaggatttgagataatttctttttggggggtagaaggtgagtatagtgagtacaatttaggttataaaagggagggttgtttcagtttggagttttgttttgttttttgaagtgtaagtagagaaagaagggtgtatttcgatgtcaggcagtcacaagtgtttattatagtggacacctatcattcttattgtacactcagaatctgtaacccctttgtatgtttggacaatatcccaaacataagagacagagagacaagacagtgagcacgcaccttacactatcaaagctggcagtgctcactgtcactttccgcgtgtagcagactcagccaattccattctctttaatttggattccctaacacaagtaagttagggaaaggagaaaagctaacttgggtttgttaatgagtggttactgctatggataactgggcttaggccctctaggggccctcaaaaacaccgtgaaatgcatctgtgttcctctcaggggcaaacaagctgaagtatttgctgttagatctggctatgagacaggaagcagggtatgctttgtgggttccttagaaaatgtcagctttcccatttcaaacgctgcacattccccttcctctttccttgtcccttaaacctgatttgatggcactagggctgcaacagccaacttgcaaccacaagggtaaggtgaagtgaattgcagaaatatcagctctgacattactgagccagtaaaactgcctaccttcatttttcttgtatgtgagaaaaactgactttaaaaaggtgactacagtcaagttttctgttatctgtgggcaaaagcattcacattcgtaactgatttatttggtctcatttacagccaagggcacaggcccaattttgcttttgtgggtttttttatttaaaatttttttccttgagatgaggtctcactatgttgcttaggctggtcttgaactcttgggctcaagtgttcctaccaccccagcctcccagaatgctgggaaatacaggcatgagccaccacacctggcctaactttgagtccaaaggtcgcaatacaggccaggtgcagtggctcatgcctgtaatcccagcactttggggaggccaaggcaggaggattgcttgaggccgggagttcctgaccagcctgggcaacatagcaagattccagctctacaaaaaatacaaaaagtagctagtcatggtggcatgtgcctgtagtcccaggtactcctccggaggctgaggtgggaggatcacttgaatccaggagttcaaggctgcagtgagttatgattacaccactgcactccagcctggctaagagcaagattctgtcttaaaaaaaaaaaaaaaaaaaaaaaaaaaagaaggccgggtacggtggctcacacctgtaatcccagcactttgggaggctcaggcgggcagatcacatggtcaggagtttgagaccagcctgaccaatgtggtgaaaccccccttcactaaaaatacaaaaattagcctggcatggtggtgtgtgcctataatcccagctactctggaggctggggcaggagaatcgcttgaacctgggtggtggaggttgcagtgagctgagatcatgccactgcactccagtctgggtgatagagcaggactctgtctcaaaaaaaaaaaagaaaaaaaaagttagcaatacaaagaagcaggaactgtgggaaaactttctggggatggggacagtagtagtagttctggtggcaccatccagtatgttgacactttagatcttattttgctttctgatggcctttgccagggaaacagacaagagattctctatacttaataataattgttactactcattgagtgtttactgtgagccaagtgttttattagttttctgtcctaattcctatcaaccatttaagacggctattaatatattctctgaggttaaatgaggataactccaagatcacacagttggcagagttgggattcagtttcagagtgaccccaaagccagatcttaatcatatttctatattgcggctatttcttttgccaactcctaatttttgggcctgatcccctatctgaggctgaaatctggggccatacccttggaggggaagaaagatagggtcacatagactgttgtctgtcattagcccgtttggcagggggatataggctctgcccaaacgtagacaggctctgagccaggttgcacagatgcaggcagtcctctgagtcaggctgggaaaggctccagatgaaccgccagacttctgtgtctgaaaccctgagagataaagaggaaacttgggtggctccctcagagacaaagtgattctgcaggttcagaatgtgctgaaatccaggccataagaaagtggcaataatacatgaagagggggaatgtgtgagaatcaatcaactctctgctggcaattcttgcttgtaaattgattaattgaattctttcttctccttctcttcccaggctggattttgaggactgaggctcaaaacccccaaacccagatccaatcctttttacaccttccatttccccacatgccaagtctcagagccaacttggcccctctcacccttttcatttagtcaatttttactataaatacttattatcaattttgtgccagacaaacaaggacttattgggaggaagcaacttacaggagaggaagctattaaaagataagtgcacaaataatgaatgaggattgtaatacctgccaggaaggaaaagcagtattgaatgagaatgtgtcttaattcattcctgctgctataacaaaatacctagactgggtaatttataaataatacaaatttctttctttttctttcttttttttctgagacggagtcttgctgtgtcacccaggctggagtgcagtggcgtgatctcagctcactgcaacctccacctcctgggttcaagtgattctcctgcctcagcagattcgagtagctgggtttacggccacgtagctgggactacaggtgcccaccaccatgcctggctaatttttgtatttttagtcgagatgaggtttcgccatgttggccaggctggtctcgaactcctgacctcaggtgatccgcccacctcggcctcccaaaatgctgggattacaggtgtgaaccaccgcgcctggccgattcagattcttattagatctttgtgcttatcttctagcagttctccctgcctcttttgttgcccactgaaggccatgccctacactgtagctagatttttatttctaaaatacagtatgactagtgcctcctcgctttcacattaaggtttgacctctcttgcctagcatagtttgctcaacctccttttcttcagccttatctcctacttttctcctgcaggaacctctcacctcagtccagcacagattcccatctccactactgttcattcatgtttgctctgcaaggatctatctgtccatctctgcctaggaaatgactattctgaattcaaggcactcactgaacatgtgctagatgagaactcaccatggatgaagcactgggtactggacaaggggcaagatcagcgaggaggaaaaagctggaagacagaaggcagcgtatcttctgatgaccactccaaatggaaatatcatttccaaaatagactgtaagctccatgagagcagtaacagggtctgacttgtccactgctggatccctagttgtgcttggtacaaagtagcatagcaattattgaactcttccaataattgctactatgtagctcaatagttttttttcagtgcataaatacatgtgacagatattcttttatttatttttttgagacagagtctcactctgtcgccaggctagagtagagaagcacgatctcagcttactgcaacctctgcctcccgggttcaagcgattctcctgcctcagcctcccaaatagctgggactacaggcgcatgccaccacgcccagctaatttttgtattttttagtagagacggggtttcaccatattggccaggctggtcttgatctcttgacctcgttatctgcccgcctcggcctcccaaaatgctgggattacaggtgtgagccaccgcgcccagcccttcatgtgacggatattcttaaactatcttcccatctcctactggagttacaaatgcatggatctagacttcttaaaagactggacattccttagggcaggggttgtaacttaagtcgtgtgtgcattctttataatgaagcattttacaaagtggtttcacatacattactgcttccgtttctcattacagccccattaatattccccacctgatgaggaaactttcttcattctccttcctgcttcctcttctctctcctcttcctctagaatgcgtgtatggtctatgttccttctgtctctaatccagaaagagatttagaataactaaatgcagagtcaaagattatgtccaaataaagttagagtttgtgtgtgtgtgagacagtgtttttagttaaatgtcaatatttaaaatatactatgacttttataccatattttttcatgttgtcatgttcttttaaacatgctgggagccataaagttaggaagaggcccagtaacccgtccaaagtaacctgaccaaagtctgacccctagtagagggcctatgccagcactggaacccagtgtctccagatccagaggcattcaccacctcaaatctgcctcaaatgtctgcagtatggtctatcacaggggctaattaagctcatgggatttagagtcagacagatgtgtttccttcaaagtttcaacagttactttctgaccttggcaagttattcagcttcctcatttgaaaactagagggcataatggtacctaccaccgagagttgctattaggagtaaatgaaaatacgcttgaagaactcagcatgggcctggcaagtagtcagcgtgcagtaaattgtagctgttattttaagaactttatttgttgaatgattgactctggcacataacgcctgcattcaacttgaaacacggagctgtcacagtcgttcagctgaaggggcgggaactgtggcacttgccaattttttctagaaataaatctttgtgggaggataatgaccggttggagagtgtgagtcttgagggaacaaagatcggatctcccggcccaaggagtacggaagcgaagcctcccctgcgcgcggcagccaccgtgcgtaacctcccctgaaccgagtagcagccgcctgagcccacccagccctgggcgaggctgcctcagaagccggatttcagcagagtgggtgcaggatctgctttaattctgctcatcttattctcggggaccacaccctgcgcgccgggaggaagggctccaaaaccacagggcggaggcttccgcgcggccccagacttgaccatctatggtcacagaacacaccgaccaaacaggaagtggggtgagagcggagggttccctaccttcccagccccgcgactgccagccgggctggggctgacccaccgcgccctcactgacccccacgccctgcgcccagtctccgcaagtcctcccacaacaatgtccagactaattgccttcccacgtcacaaacggggaaaccgaggtatgcacgcccagagacaggcggagcgtggcctcgatcaccaccgagagctgacggccgcccggattcccgccctcagagaatcctggcccccagtcgttccaagaccctttacggactgcagcttaaaggaaccggcctctgccattgagaccaaactgacagaggaactggtcactcttctgttctttccagagaggagcttagccagggacttctgcccttcctgggcccgggcctcgggggcgattccgggtaggtaaagcggaacgagggcgtggcctctcttgtgagcccgccctccccgtgtcgctcccgccttgagggcggggctctttcccaagtgccctctgtgagagccgggccgctctctccggggcgtggcgaagaggggcggagtcacgagcggggcggtgagacttcctgcccagtcgcgggccagcctagcgcttcagccggcggctcatttccggtgggggcgccgcgcccagtgagggcccggaagtgggtcgcgcggagattgctgggcggttcttgccggaagcggagagcggctgatcgcagtccggaggtgaggcggaactctgaggtgagggtgtgcagcttggtagggattggggtcccttccggggcccatcggcccctggtgktgttaatggcccttctggcctacgcgcgtgtcatgaaccctgccgagagggccggggctgaggccctcaggccgacccggactcttgggcgcggtctcttgaggtggggccggggtgagcagctgagtccgggtgccccggggaggcccctctgcccgatttcgcagcgctgcccatcagcttcagcggaggcctgattcctgaggtgctctgactggaaggaacctccgagatcggagagtcttccctgtctcctgttgatgctcccattgcactgataggtaaattgatccctagagaagaggctagtctgagatatatagcgagtgaggaaaagaatcggaatcatgatcctggtgccttagataaccagccccagttcttcccgtgttgctcggaacctctctaacttgggatggtcttccggtcggtgttgccccgcaggctgctgcaggttaaaggccagcgctgcgtggaacttttttttttctctcctcccaaattgagccgtttgaaatgcctagggagtttttaaaagaaaggcgggcacatccttgtatttacaggcagatatcctccctttcctcctcggctgctgctcttactttgamaagscaggctaacattgaaggtrtgtacttctggacctgaaatcagacggctcaggtttggtctggcctcagtgctaagtgtctgtggccataggtgccttaaacttctttcagcctccttttgttcatcttttaagtggagatctctgctgaccccacaagattaaattcagcgtaacaaattgtgtttattctgtgccagcattttcccagatgcggggaatgcagctttaaaacaaaacaatgtagaccctgcccgcgtggagctagcagtgtttgcagggatgtttaagaagtaattataaatgttgatgagtgttaggaaagaacagggtgctctgaaagtatgtaacagggggttcaggaaaagcccttctgaagaagcagagtttttaagatgaattttgaaggataaataggaatgcgttcgaagagtggaatgagaacatttgagacaggttagcatcagaactgtgtcagttgaagctctttgtggggctctctcttcaagagaaaatccgggggcatatcagcacatttatcatttaccagacttttatttawtttatttatttgtatttttagtagagatggggtttcgccgtgaaggccaggctgctctcgaactcctaacctcaggtgatccccccacctcggcctcccaaagtgctgggattacgggcatgatccaccgtgcccggccccaccagacgtttattaagaccttaatatgtatgaggcacattttaatgagatagcctttgtggcaaagaatacagttcttctggagtttacagtgggagaggaaatagacaagtaaatgagggatggcttacagtgtcatagtgcatagcacagggctacaagagcacagtggagaaatacctgagccaggtgcccagggttccaggaggaaatgggaggctaactcttgaaatatttatttagctacatagggaatccggaaaagggatttccaggcagagactactacaggtgcaaggacctggagaaccggacagctgaaagaccatgacgagttcagtgtgactggaattctagtaatggctggggaagtggaggaagtgagatgtggtcaggtcagtcatatgtggaggacattgtaagtcatgctaaggaatttggatttttaccctgaaagctatggagatgctttgaagggttttatgcaggaaaatgatgtcgtcagatttatatttcagaaagttcattctgtcaagtaggaggggaccagccctgtggggaagtaaaacagtgtttggaagctcttgctgtagacatggcctgaactaagacagtggaaatgggaatggagaggaggcatcagatgtgagcaatattaagaagatagaatccatagaattggaggctgattatgggaatgaagaggtaagaatagcgcgattgcctggctttctggcttagggaactgaatgggtagtaccattcagatagagagtatgagaggtaaattagggaagtgacatgggaaaaaatgcattttgaatgtttttagtttgaggtgtttgtagcacatccaggcaaagatgtctaataaggtgggtcagctaaaggaaagagcaagagtaaagatacggaggcaggagagggcctaaattgttcagtgatactggggcctggagttttgcagaagaccagactgcaaaaaaggttagatgtcggccaagttgtgaagggctttttgtttgtttgtttgttttgagacggagtcttgctctgttgcccaggctggtgtgcagtggcacaatctcgggtcactgaaacctccacctcccaggttcaaggaattctcctgcctcagcctcctgagaaactgggattacaggcgtgcgccaccacgcccggctaatttttgtatttttagtagagacgggattttaccatgctggccaggctggtctcgaactcctgacctcgtgatccgcctgcctcgccctcccaaagtgttgtgattacaggtgtgagcctccgcacccggygtgaagggcttttaatgccttgttgaatttgtttggatttgattttgtgggtggcagtttgctaattgatttgcccaggtccagcataaagaaatttctgggctgggcacagtgactcacgcctgtaatcctgacactttgggaggctgaggtgggcaaatcacttgagatcaggagttcaagaccatcctagccaacatggtgaaacaccatcactactaaaaatacaaaaattagctgggcgtggttgtgcatgcctgtagtcccagctacttgggaggctgaggcaggagactcgcttgaacccgggaggcggaggttgcagtgagctgagattgcactgctgcactccagcctgggtgatagtgagactctgtctcaaaaaaaaaagaaaagaaaaaagaaatttctcgctttttccagaaatacttcctcaattgggtaggcataattgatatctcagagaagtttaaataaaatggtagcagcaaaagtactttgtagaatacagcctgatgtgcaaaccaaaagtggtgatattgttaagattcagtgagtatatttttgctttggagtttagctattgagtctgtaaaatgttttgtttccaacctagggatgatcttttattctcaccctttttcctggttgcagttatttttttagcttttaaaaagtgactttcttgaggctgagttagagactagcctggtcaacatagtgagacccctgtctctaccagaaaaaaaaaaggtgacttcctcctttcagttttttgtgaagcattgtgaatcaaatttttttttacttaagcaaatgcaatgtgtcactggaagccgaacctctggtttgaaatttaatgctgagatttgaaatatgagagttctcgagcggtatcttacccaattttagtgattattactttgaaatgttgacatcagtttctttctttatttgtgctaacctggctttcatgacctatacttcagtttctctatgacaaccagacaaatctttttaaagttctctaagaagaagcatttttcatcttgttagtcttcactgacttcatatttacaaagaataaattctgaactcttttttccatcttacagaattctctacagtttagacccttatcttaatttttattagatgatacaggttgactttctaatttagaaagtcgtgaactagcattttacttaaccttttgcacctccctatgctccttattaaattagaacagggtttctcaacgttggcacaattgacattttgggccatataattcttttttttttttttttgagacagagtctctatctgtcacccaggctggagtgcagtggcacaatctcggctcactgcaagctcagcctcccgggttcacgccattcacctgcttcagcctcccgagtagctgrgactacaggcgccckccaccaggcccagctaattttttgtatttttagtatagacggggtttcactgtggtcttgatctcctgatctcgtgatctgctcgcctcggcctcccaaggtgctgggattacaggtgtgagccaccgcgcctggccatataattctttattatggagttgtcctgtgcactgtgggatgttaagcagcatctgtctctacccagtagatgccaataagacttcctcagttgtgacaaccaaaaatgtcttcagacattgccatatgtctcctggaggacaaaattgcccctggttgagaattgctgcgttagaaagtatcgtagctatgattgtacaatgtccccaactaaattctgtgagggcaggccycatagccatacttagcacagtcgatggtacatgataagcactcagtatcctacartgaatgaatcatttgtttctgttgaagcttcaagaaattactgttccttcaaggaatttctgggtgggcaggttggagtacaatggtgcaatcayggctgattgcaacctccaacttttgggctcaagtaatcttctcgcttcagcctcctgagtagctgggactacagttctttttctttcttttgttttttgtttttttgagatggagttttgctcggtcrcccaggctggagtgcagtggcgtgatcttggctcactgcaacctccccctcccgggttcaagcagttctcctgcctcagcctcctgagtagctgggactagaggcacacaccaccacactcagctaatttttgtatttttagtagggacagggttttgccatgttggccaggctggtctcgaactcctcaagggaaccacccacctcagcctctcaaagtgctgggattacaggcatgagccaccaygcgctcggccaaatgtttgatttttttcagagacagggtcttgctatgttgcctgggctggtcttaaacccctggcctcaggtgattctctggcctcagtctcctgagtcactgggattacaggcatgagccaccacacctggcagatgtgatcttaagagaagtgccattggtttgagtactagaagcaagcttcttgttgatggtgtaagtcagcagatttccctctctattgaaaattgtgtgaattcctgttttgtttgtgttccttgtatttagagtgcttggttttagtggacagggactatcatttattttaaagttgcatataggctgggcgtggtgattcacgcctgtaatcccagcattttgggaggccaaggcgggtggatcacctgaggtcaggagttcgagaccagcctggccaacatggtaaaaccccgtccctactaaaattacaaaaatttgctgggtgtggtggcatgtaccgtaatcccaactactagggaggctgaggcaggagaatcacttgaacccggggaggtggaggttgcagtgagctaagatcgtgccactgcatgatctgcgccagcttgggtgacagagcaagactccgtctcaaaaaaacaaaacaaaacaaaaaaaacaaacaaacactaaagttgcatatagtttatggagttattcacatttattttagttgataaaattatacagtcatgtgttgcttaatgacaggtacattytgagaaatttgtcattaggtgatttcatcattgtgggaacatcatagagtgtacttgcacaaatttagatgatactgcacatggtgtaacttattactcctgggctacaaacctgtatagtatgttactgtatctaatactgtaggcagtttgtaacacagtgtaagtatttgtttatttaaactttttttttttttttttgagacggagtctcactctgtcgcccaggctggagtgcagtggcacgatcttggctcactgcaacccccgcctcctgggttcaagcaattcttctgcctcagcctcctgagtagctggtactacaggtgygcaccaccacgcccagctaatttttgtatttttagtagagatggggtttaactatattggccaggctggtctcaaactcctgaccttgtgttctgctagccttggcctcccaaagtgctgggattacaggcatgagccatcgcgcccggccacatttttaaagtacagtaaaaatagggtattataatcttatgggattttgtgttgattaatccccatataatcccatataatcttatgggaccactgttgattttgtggtccatccattgaccaaaatgtcattatgtaatgcatgactgtagtttcataattttaaattaatgcagctacagcattcaccatgaaattatttcttgatgtactatatgttaacctgataaaaacaaagttctaaaaatatgcctcagctacagtgctgctttgtttgccttgtattaccagaccttttgtgccaaacttttccatttggctggaaaatagttgaaatgtttaatggaaggagcagacttgctttgttttgttttgttttttcctccagagggcattgaaattcctatactttagttaattatagacttacagtctttccatattcctacttgtagatgaatcatggctaaggacaaacgtcatccttgaatccatctttatatattagagtgggaaatgctgttttattaaagcaactattcaggctgaaatcagccaatgcagttttcccttacaygctataaaacatgtagaagtagaaagggactgccgagtgctctgtgcaatkagtcttcataatattctttgaacgtaggagagaagagaacccatgaccacacaaagttacctgtttgctccagacattgaaacagctagttcccaagtctaatttcactttatacactaactttactcactcctggagtttcaggtagaggacatgtgtaaggagggaacaggagacaggtgttgatgttgggttggattccttccctccgtagaagataggcctttcttttaaaatctaaacctcgggtggcagtgactcaggcactaaatgtcattggtttaatcagtgaaaccaaatgcttagagaagaacagtggctcctgatttgggttagayttagatggcatcttttttttttttttgagatggtgtcttgctctgtcttggctcaccgtaacctccgcctcccgggttcaagcagttctcctgcctcagcctcctgagtagctgggattacaggcatgagccattgcacccacccaccatcacgcctggctaatttttttatttttgtatttttagtagagacggggttttgccatgttggccaggctggtctcgaactcctgacctcaggtgatctgcccttctcagcctcccaaagcgctgggattacaggcatgagccattgcacctggccttacaggcatgagccattgcacctggcctaaatggcatctttactggggcamagtggtgcctgttatttggtttctgtgttaaacaagccaacttgtatcttctggtagcatgtgtaggttttacttygtgacatgttaaaacctcgtgataagaattcattagaagtagaactaactactacatagtttagtggtaatttagaagggatagtcaagtagagatttttattattattataaaatattatatgttaaaagaaagtttggaaaacaggtagaaattgtcaaaaacccatcacccaaatgtgacaaataytgtaaattttgcgwtcaagtttttttccacactkcatttagctattcccctataattagaagtccaagatagatatagatagatcaatagatmtaacattgcagcaaacatctccatgcttatcacttttctcacattatgatttactttcttaggataaaacctcaggaacaggattacaaaattaagagaagcattttgaagcaaatcaaytgggctaccatagtagacaggctgatttgtatgggtgctttattttcaattttacctaaggatgatgacttagaaaaacaactgtgggacaaagtagaaaacatttcaagcatagcaacttcctactcaagtagaaattcatgctactgtcttaattgcctggtgggatgcaacaagaactgcacgcataacctggttccatttacttctgaatgacttccttgaataggcagaaggaattgggttaagttgttagaagtataagagtgtgaagcagctttggcaggaatcactagccatttctaattttttttttttttttttttttttttgagacagagtgtctctctgtcgcccaggctggagtgcagtggcgcgatctcggctcactgcaaayctccgcctcctggattcaagagattcttgtgcctcagttctggcagaaggtggtgtttttacaagatgatttctaggattacaggcatgcaccaccatgcctggytaatttttgtatttttagtagagacgaggtttcgccattttagccaggctggtctcgaactcttgacctcaggttatcyacccgcctcagcctccctaagtgctgagattacaggcctgagccactgcgccaggcctggttttttggtttcaaaccacaatagacattgctggagaatcaagctcatagtttctttttactctgcatgatatccctccaaaagcttgtctattctcatgacttcatgacagttctttgccaatgatttgcaaacattatctccagtcttgattctttccyaggctttatttctaaatactcactagtcatttccacttagaagctttgtmttcttttcaaactcagcatatccaaaactgacctcatcttgttgccctaactagaacatgccacaacccatttctgcctataatgtcattattctcttaaggcccccatatttgcaaatcaggagtcatctttgcctcccttctctgaatgctgctgtgctcacagtcagtaccatacagttagtacttgttctcagtttaatgcacacttgtttcatatgacctcctagggcagaaccaagattcgtgggtggaagttgcagggaggcagatttgcctccatataaggaagaactttttaatactttgagctgtctgaatggaatggactgcctccagaagtctcgggttctccatcactgaaggtgtttgagcagaggctgcctgactaattgctaattgaaaggactgttctggcataagatggtgtttttacaagatgatttctagaatccctctaatcctgagagccagtgagtcgatagaaggtagctttgtctctcctgctagactcccttaggacagggagactattttacctttcttttatattctgtacagcacttaattcaggtgctggtctcttaattgcctaaagatgattatttacaggttaattgattcttttcattttgttccaatatttggttaaacaccaaatattgtggatttttttcctttgaaatatcttggggagaccaaggcaggtggatcacctgagatcaggagttcgagaccagccaggccaacatggcgaaaccttgtctctactaaaaatacaaaaattcgccgggcgtggtggtgcatgcctgtagttccagctactcgggaggctgaggcaggagaatcgcttgaacctggaaggtggaggttgcagtgagctgagatcatgccatcacactccagcctgggcaacagagtgagactccatctcaaaaaattacagtaataataaataaatacaaatatcttttgtagtagcattattttagatgaatarcagcttttaacctaactttctagaccctaatatcatcacttgtctccacatcccattctgtttatcagacagtacttgtaagctctttgctttcatcatattattctttcactcaaaacccttgaatggcttcacattgatcacaacgtcaaatttaaattttccctggctttcagtgccctccatcatctggcccagcttgctcatgcatccttgttccctataatactccatgttccatgcaggctaacccactcacattttctgtacatagcctgcttggtctccttttttgcttttgacttgctctggaatggcttcccttttttctcttgcctcttcaagatgcctcacttccctcctgaaaccaagctaccgccagtcctcattgatttcctctgaactctcagagcatgtagtaatttatgtaattcagaaccgtagcaacaacattctgtgaagaaaaatctgcaagaataggctgataatttaactttccctaatccaactggatattcccataataaaacttttaaaaatataggctggctgtcatggttcacatctgtaatcccagcattttgggaggctgaggcaagaggactgtttgagcccaggagtttgagactagcctgagcaacatagtgagactctgtctctatcacacacatacacacacacacacaaaaagccaggcatggtggcatgtagttatagtcccagtagtcccagctactcaggaggctgaagccaggaggtcaaggctgcagtgagctgtgaacacaccattgccctccagcctggtcaatagagccagaccctgttttttgtttgtttgggktttttttgttttgtttttttgttttttgagatggagtctcactctgtcgcccaggctggmgtgcagtggcgcgatcttggctcaccgcaagctccgcctcccgggttcatgccattctcctgcctcagcctcctgagtagctgggactataggcccctgccaccgtgcctggctaattttttttattagagacggggtttcacagtgttagctaggatggtctcgatytcctgaccttgtgatccgcctgcctcggcctcccaaagtgctgggattacaggcgtgagccaccgcgcccagcctgtttttttttgttttgttttgttttttaaataaaagcmgaaaaactttaacaaatataatctacagtatttattccattcacattttattttgttgtcttaaccaatatgagtgcttctggaggggagggaccatgtgtcttctatttcttcagtaggcccacaatgctaagcactttgattttattagcatcttctgtgtgcctagtttttctaggtgctgggagatagagtcagtgcaggaggtagaatggataaattcccatccttcttgagcctatattctagtacgtaatatgtagtgctaacattttacatttgaattgcattttaaggcttctgaagtgattactcgtatctatgaaatcacctcctttgatccttatatctgtgtatgctagatgaggattataatccattatgtgactgtgtaaagttgcacagttagtatgtacagcttgggactcaggcctcagtcttctaattttatttggacttgtgtaattttgaccacctgtgtttctgaagcttttatgatgaatgcttaagtagttgggaatccggacattcatttatggaggtttacgtatagttcttggttattgacaattagaaatggcaaggagcaagattaggcagacatacagttctctgctctgatacttctgtgtttgggagaagccttatttatttatttatttaaataaaagagatgagattttgctatgttgcccaggctggtcttgaacttctggccttaagccatcctcctgccttggcctcccaaagtgctgggattataggtgtgagctatcatgcctggcctgagaagccttattttaaacatttgctttccaaatatgtctcatctatcctgaatgtgattgaaaaaaagttggcctccatggagaaaattgaaagcagaaaaatggaagatgctggccaggcgcggtggctcacgcctgtaatcccagcactttgggaggccgaggcaggtggatcaccaggtcaggagattgagaccatcctggctaacacggtgaaaccccgtctctaataaaaatacaaaaaattggccaggcatggtggctcacgcctgtaatcccagcactttgggaggccaaggcgggcggatcaccaggtcaggagatcgagaccatcctggccaacatggtgaaaccccgtctctactaaaaatacaaaaaattagccgggcgtggtggcaggtgcctgtagtcccagctactcgggaagctgaggcaggagaattgcttgaacccgggaggtggaggttgcagtgatctgagatcgtgccactgtacagccagcctgggtgacagagggagactccatctcaaaaaaaagaaaaatggaagatgataataatgtaactaaagacaccataaagagaccttgagcccatagtgctgtgcaaacaagttggggctggatactgtgattaaccatatagtcacttaatttgttaaaagccattgtggagtagcaagaagagctgcagagtaggattcagaatatttgtaytctaggcctaggttctttactcactagttgtttgacctctggcaagtttttttttttgagacggagttttgctcttgttgcccaggctggagtgtaatggcgtgaactcggctcactgcaatctccgcctcccaggttccagcaattctgccttagcttcccaagtagctgggattacaggcatgcaccgctactccaggctaattttgtatttttagtaaagacggggtttctccatgttggtcaggctggtctcgaactcccgacctcaggtgacccactcacctcagcctcccaaagtgctgtgattacaggcatgagccaccgtgcctggccatctggcaagcttttaactgctgtgaatgtcagttcagtttcttcattctaaaaatagggatcaatgtctgcgtaacataccttgcagaattattttaagtctccaaagaatcaacagattaataatgttaagcatttacaactatacagaattactatatttaattgatattatatattctaagaagagtactttccttatggtacttagtttgaagatctctatatcagtgtgattcgtggctgagaaggcaacatttatttgaaagacaggagggtttgtaaggtcctgcaaaagcagataagcaaaaaattaaaacaaaacaaaacaaaacacttctccatggattcgatagagaagatagccacactgtgttgaggggagagtgagtaagagcctttatttatttattttcttactcaaacacctttattagcccactgttcttttttttttttttggaaacataatctcrctctgttgtccaagctggagtgcagtggcgcaatctcagcttactgcaacctccacctctcaggttcaagcaattctcatgcctcagcctcccaagtagctgggactacaggcgcataccaccaygcctggctaagtagagacgaggtttcactgtgcttcccagctggtctcgaactcctgagctcaggcartccacccgtctcggcctcccaaagtgctaggattacaggcgtgagccaatgtacagtgtttttaatgcctcctatgtttatagtagtggaattacagtggcaagacatggtccttgccttagggtggctagttgcctgttgactgttagaggagatcagatgcattcaggggattatggccataaactcttagactctgaaggctattaaataaattattttatttttttattactaatgtcttgagacagaatcttgctctgtcacccaggctggagtgcagtggtactatctcggctcactgcaacctccacttcccaggttcaagccattcttgtgcttcagccactgtagtagctgagatcatagcatgcgccaccatgcccaggtaatttttgtatgtttagtagagatgggatttagtagagacggggttttgccatgttggccaggctgatctcaaactcctggcctcaagtgattgcctgtgttgccctcccaaagtgctgggattacaggcgtgagccaccatgcccggccaaataaatgattttaaaccagtgtgtgcagtgttgtgacacagataagtgcacagtgttgtggtagcacatactagaaatacttccccaggaggtgataacttagctgagacttaaatgacaataggagttctagaggggcagatgggaaagggaaaacatctaagcagagtggatagcattataaaggctcagaagtgagagaaagcatggctttttctggaaaacgcaagtagtcccgggttgctgtagtgtgctaaggaaaggtgtagcaagagataaaacaggagtggtagaaggttaaacaggactagatgagagaaacccttgtttggactttaccctgaacgctctggggtatgtgtcaaatgcaactctaatatatcttaaatgcaaatataattataaatatttctttaataccattcagtactctgggaagtgttgagatagatcactctgactataatatggagaatggatgaacaaagtttattactgtaactaggggagactagccaagaagtcattgcagtaatcttggtgaagtcttgatatcctttttttttgagacaggatcttgctttgttgcccaggctggagtgcagtggtactcatggcttactgaagcctctaccttctgggcctaagccatcctcccacctcagtctcccaggtagctgggaccacagctgtacaccaccatgcttggaaaaattttaaattatttttgtagagacaaggtctccctrtgttgccccggctagtcttgaactcctgacctcaagcaaccctcctgtcttggcctcccaaagtgctgggattagaggagtgagccactgtgcccagccagtatcctaactcttatcagtcaggatggaggcaagrggcatctattcatgagatacactaaatagagcctatggattttgatgactgataagatgttgtgggggagtttatggaatccttactattttccaggactgtgccaagcacttctacatggattccttcatttattctcactgaagccctttggatttttgtgctattattgtcttcattataaagataaggaaattgagtctcagaaagtttgataactgcttatagtcacaaagccastgcatattgttattcaaacctccaatctctctgatttctctaaagaacactcttatccactatataatactgcccaacagtttccagttactgacttgatcaatcaggtgattgatagcagtgctggagcaatgttagggaatatgatttctgcttttggacatttcaggttgcctttgggacatccaggtagtgatgtctaggtgaaagctggatttttttttttttttggagacagggtctcactctgtcacccaggctggagtgcatggtacaatcactactcattgcatcctcgacctcctgggctcaggtaatcctcacacctcagcctcctgggtagctgggactacaggtgtgtaccatcatgcccggctaatttttttattttctgtagagatggaattttgccatgttgtccaggctggtcgtggactcctgagctcaaacacttcctcccatcttggcattccagagtgctgggattgtagttgtgagccacagtacttggcctgaatctaaaatttaatcccagatgaatggcctgagctagatggatatgctgctctggtagtctttagtctataggtggttatggtggtaccacctcgcaaataggctgggtgttactacaacaagggtagtcagaggctttaggagtgtacatgaccaccggaagaatgtacgtgtgtrtagagaataagaaaaggtgtgtctttcacacaactgaatctcattctctacacacacatacaatgtcatacttaaattctggacattattttccataacatctcaaatctcatcttactcccaccaagagcaaaaaaaacagtttctgttcttttgtatttggttaatggtagaatgagattagctataaatggtagctgtattgtcctttttcattctgcttaagtcagacagcggaactttagcttgtttagcagtgaaagcctataaatacaaatgaaatatggaaaaagggagccaaagtcccatgaagctctattattaagcatttaagattggtaaatgttcacaaactctggcagcctctagcaatacatgtactgtgtctccatgttaacagtggtctcaacctgaaacatccatgtatgaaggaacatgttttaataacagaactgagtggtatctgttcatggaaggtagcttaggagtttattgcgttccttgccttttcccctggacttayagtgtggtggattgtatatatatgtgagtctgtctcttgatcagtatgcataatggaacagggcaggaattcagatatcagttgatagtgtcataacattagggaaagtatgttgactgcttatggtctgctctatttgagagtaggacatagacctggaggcttctgctgctgctgcaggccaaggaatggaaaggtttgtttggttctcattctcattttttttctttgcttctcttttaaacaacactctctgacaagtgattgggcccacagagaccagagcctgtacacagagaatggacaragactatattgtcttccttactttatcttgtgagctgcttatctcttccgcagggaggacaatgtgttaaattgagataattctggcatgctgtcatctttgggggaatcataattgctgttgtcattttaggcagcttcaagggagttgagttcattcagcttcagttacctgaactgaattcagttgcctgaattgacgcttttgtgaaatggaatctttccaagtcaaagcttggattgaaatttcactgactggtttttatgagatcacttagggtctcaaatactttatgtagaggtgcattgatcatattttacacttatgtgtgacttatgggcaacttttagcacccttatccctctggagttttggaatgctatttgtgaggtttataacttcataaatatttattgaacatctactacctgccaggtagtagtctagatggtagagtatacagtaaggaacaagctatataaggtcctttctctgttggagcttactttctttgggatattagacattgaattaggctatttcagataagatagtacttgtgaaagatctataacaaattcttttggatgtgtctagtgtccttccctactgcatgtccagatctttctcatcttcatttgaaggctggctcaaatggcagcttctccatcatatccttatctgatccttccagctgatatattactcccctctttgaaatctcatgcctctctatcagcaactttcttatgtcaccttaacatttttttctatttgtttcatagttgttagtgcatatgttaagtctccccattagactataaattactgagggcaggccgggcacagtggctcacgcctgtaatcctagcactttgggaggccaaggcgggtggattacttgaggtcaagagttcaagaccatcctagccaacacagtgaaaccctgtcgctactaaaactacaaaaaattagctgggcatggtggcgcacacctataaccctagctacttgggaggcaggagaatcccttgaacccaacagggtggagcttgcagtgagctgagatcctgccactgcactccagcctgggtgacattgtaagactttgtctgaaaaaaaaaaaattattgagggaagagtaaacatcctattcatcttggtttgggatatttcacatgcaggcagcaggatgttgtaggaaaaaaacacactgaacttagaaccagaaggatcagataaggatatgatggagtactggcttctctattcactggccgtgtgactagacaagtcatttagcttcactraaactaagttttctatctctaagcgtgtagtaatcatccttctattcctgaatagttgtcgggaggctcaaactgagataatgtatgtgactatcctttgcwaattctaactttctacacacagtatcatagtaaatattgagtatttgaatgagtaagcatttactttagtgaacaccttttcctgagcagttctcttgcttaatgaggtcttttgattttgtaaatatgctacttttttatctgatatttttgtattgttccattttgcagatgayatctaattttattaaattattctgttcctgagaattggcatcctcttcatccacctggggatgaccaggaattttctgtttttttctctgtaggtgctatttaatatttaaataacaaatgacatttgatctgtttcagcaggtggtccattatggctgacatgcaaaatctggtagaaagattggagagggcagtgggccgcctggaggcagtatctcatacctctgacatgcaccgtgggtaygcagacagtccttcaaaaggtaagcagtccacagcccagcagaatgctttctttgagcgtcttggcctgaaaattttctattattctctcctttggcgctaacttcccaaaacttaatctagaaagtttaccttttgtaatttgtattgctgtgaacagataagagaggaaatgacttgtacagggaggcctgtggttaagttattttaacacaagaacttcctgcttgtgcaatatttcctgctctttctttagcagaatgactccaatgtaagtcaaatgacaagtgataataaaattcctctctccaaacaattggcaaattggacattttgcacatgcaccagttggaacatagaatgttagcactaaaaaaaaccttggaggatcattttgtttattttcattttatagataaagaaaattaagctcagagaggaaaaggaatttagtcagggtcacacaaccagttagtggtgatactggacctggaacccaggtttccttactcctgttctgtatcctgttgactgtattaccttgcctccccactttcatgtagaagcacgttttaaagaagcctccttctgatgcatggctgattctttgtggtgtgtttgtctttagcaggagcagctccatatgtgcaggcatttgactcgctgcttgctggtcctgtggcagagtacttgaagatcagtaaagagattgggggagacgtgcagaaacatgtaaggatgttttgcctttttccccttcttttaaggactaacagctttcttcagtcagccaaggtcctcatccttggtttaagagctccttgagaagttcctcttggtttggggcattacacatgttctttctcttttgcctgtactgagsagttcagtccagccacagaaacgattcctcatttttttctaggccccttgcttttatcacgtatttatacagaaagcttgcttggtacataaaatatggttctgttcatctttgtagtgaagaatatgcaccagtttgatcccaacatattacataatcaaacctacagtggcttatttaaaggagtcattatcatgacttagcatttataaaactatgcttgatagttattagttatgctaatgtgggttattttcacacttaacccacagcaagaatatgaagtaggcaatgacaggtgcctttcctcccaccttcctttatgcctcctacgtcatcaccaccaccccccacccccaccccacactcacatatacattctacctctatttttgggacccaaaaaccttcctgctagctcaccgaattataaacagtaaccatgcttgggaacttcttcacctaaacctttctcgaagactggttgcttggcttttggaaaatctattttgagcctctcaaataccatctgttgccaatggttttagctctagagagtgggactgggactttaataagggtgtggaggcttgcatttttacttaatacagttctgtaacatttgaaaaaactttaaaacatttatcatttgtattttaaaaatgcaaatccagaaaaaatagattgctttctttgaatttttgtattttaatagtgcttacagtctcatgtttcttaaattcttttgactgcgaatgacccttagaaagaaagaacatattcgtaactgagataaaagtttcacaagatgatatttatactacttctgctgtacttttttttttttttaactttttatttggaaataacttgaagttggtgcactgcactcatacttttgttccattaagctcactaaattgatttaattatttattaatgggtcatggtatctggcatttgagagatagctttaatctaaaggagtaaataccttgagaattttcagcagaaatttargcctttgcctttactcctgtctccaatttttgagaaaagaaaggtgtttttttggttgctgtttgttttattttgctgatgtgaaataggaaggatttttcagtgcacggtatcacaatgcatgtgtaagatgctaacatgacttcatgtaagctaggtgattatccaattaacttcacttccaactctggatatatatccctgatgagttccaataggaacagtagtgtatgtaattctgctctcagtccctggaatctggaatacatgaggaggataacatgaagtgcctgggttgctatcagagtacatggaagtagaggtttcaggttattcttatcaagacttctctagttataatgtgtcatcaatagctgattcttctttctggcaggcrgagatggtccacacaggtttgaagttggagcgagctctgttggttacagcttctcagtgtcaacagccagcagaagtaagttcactactagctggtttcattttggtttgatgctcaggacgagttgagagatttatgtcaagctattataacattttaaaatagacctactaggcttttgataatatatgttcataccaagtcccagaggtagagccatacttcaagtgccttaatgggaaggtactattgggtacttaatggtctctactggctttttctctgtcattttgcataggactgtggttatccctgggactttgcttgcctgcctctttgctgagtccacattcatcatagtgtctccaaagccctttaaagatgattctcttgcttcactgtggatgggctttagtagtgctcctgtggagatcttaaaactcctacagtattgcttctctcctcatccttcactggttgggagactctctctttamttttactcccacctcaaaattttatggtgcaagatgtgaaaagttgaattagagaaaatttagatttctcttggagtcaaagaatataggtttccttcttttgcatttggttttcctagttacagaggaataataaagcaagttgtcctaaatgctgtattaaaacccttgaccctcagcatgcctagataatataaaaatagtgcaagataatgtcaaatatattagattctggttaagtgtgctggctcattcctgtaatcccagcactttgggaggctgaggcaggaggatcacttgaggccaggagtttgagaccagcctgggcaacatagcaagacctcgtctctattaaaaattaaaaaaataaaataaataaaaatagccaggcaaggtggtgcatgcgtatagtcccagctacttgagaggctgaaatgggaggaagatttgggcctgaaagtttgaggatgcagtgagccatgaacacaccactgcactccagcctgggcgacagagcaagaccttctctcaaaaaacattgtgtgtgtgtgtgtgtgtgtgtgtgtgtgtatagatgccatctaattctaatatgtagaattagattttaattcttaatctgtcctgaatggttaagatctgagaattgagatgttcaggaaatggagctttggaggaagggtgcaaacacaaacaaarttcatccattttgccaaggtgcctayttgaatgctaagcccctaattgttttttattttatttaygtttaaaaaaaaattttttttttkagacagggtgttgttttgtcacccagactggagggtagtggtgcaatcacagctcactgaagccttgacctcccaggtgtaatgatcctcccacctcagcctcctgagtagccttgactacagtgtgcaccaccatgcctggcttgcttatttacttacttatttatttatttatttttgagatggagtttctctctgtcgcccaggctggagtgcagtggcaggatctcggctcactgaaacctccacctcccaggctcaagtgattctcccacctcagcctcctgaatagctgggactacaggcatgcgccaccatgcccagctgatttttgtattttyatagagatggggtttccccatgttgcccaggctgatcttaaactcctggactcaagcgatctgcccaccttggcctcccaaagtgctgggattacaggcgtgagccaccatgcctggccctaattctttttattatttgtagagacaaagttgtgctgtgttgttcagtctgtcttgaactcctggtctcaagcagttctcctgccttggcctcccaaagtgctgggattacaggcgtgggtcaccatgcccagactaagccccctaattgcatttgattcatcagttctttacagcagctactatatggctggcaatgcattgggggctttcatgatgataaaagagctcgtctttgaagaattaatgagaaagtaaaacatattcacatgggtccattaatagtttgtattggtgagtgataaaatgccaagattggttatgctgacaacaaatgctgtaggaggctggtgtggctgggttggagggccctcatgaagcatgaggaaaatttggattcatgggaaaaaaagagaacatcatgagtaaggcacaggaatgatgtcctgagtgtatgtcctctgagtggaacaaaaaagagacaggtggctgaaatggaggttctgtggtatagctgaagtatgggtcctgatcatgaagaaccatcaggtgcagcctgaggagttggaactctacgaggagagtgagatgatgagcagtattttagccttaggaatcaggacaggactcatgcagtttatttgggtgctcactagagtccatagagaattcttgccttcaggatcagaaggcatagacacctttgtggaaagatgttaacctgaatcttttcttgtatcttttcctagaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggtgagcagcgcagattccagggctgggggtgggtatagattttaagagggaaggcaatatagttggagaggtcctgagtcactgacagcttgtctctctctaggctcccaagcctggcccttatgtgaaagaaatgaatgatgccgccatgttttatacaaaccgagtcctcaaagagtacaaagatgtgtaagttcagccttttctctctttttttcttttctgagacagtgtcttgcgttgtcacccaggctgaagtacagtggcacaatcacagctcattgcagcctcaacctcccagstcaaacaatcctcccacctcagtcctccaagtagctgggacttcaggcacgctccaccatgcctggctaattttctaattttttcgtagagatgaggtctcactgtttcccaggctggtctctaatgattctcctgccttggtctccccaragtgctgggattacaggtgtgagccactgtgcccagccaagttcagctttttctcaaggggtaaaggataaacccatttggttacttgctggagtagcactttggagttactgagggctgcccttagccactgtgctggttttatctcagggctgctttctggagagctttacagatattgtctcacagctgcatttgcaagcaggaaatacttctgcttccacttctgctttctctccttttttggtagaggcccttttagtcttctgatccttacccttctgggtttaggaagttttgctggcagtaacatggactratgccctttatataagattttgttcctttgttgagaatttgttactggcccaatggcaaagggttcaataggacttaatagaaatttttcatgaagtcagttaaagtgagagtaaggctgcctagccaatgcaggtattacgtagggcagtcattgcatgtctaaccacatacgtctaccagttctgacttctccattgctggttttgagctggaatgattgcaggcaaaatttattaagttgcatatctacacaagcctttcctttcttccatccttcrtcaatcaacaaacatttattaactactctttttaaggaaaactacaccttcctgtgagtgaaatgtgtcccagaacaacaggcacttccttatccttctagcaacatggaattaagcatgacagtgttttgatatatcccaccattatcccatcactttacagttgaggaaactaggtcttaggctaaataaccttcccagttaatacataagaagagaggggacttgaaccgtaggcacaatgctatttctataatttaaggctgattgtttccccctaagggaaagtttttaagtttgcttttggtcagggtgggcatattttgacataaggcattgtctcataaggcagttaagtttcttagtctttagagttccacagtgatacttaagagctctcctctctaccatggttttatgcacagaatgtctgcttttatcagttttacatattagattgtgtttaaggtctactttgaaaaaagtttcaataagcagcaagtggtcaaaagaaaaaaaaaagttttggtacttaaaacagtttgagaaacattgctatgagagatagagatagaatccagagtctctatcttagtggagtttggtctgattagggtaatagactaggttgtatatacatagaagctggtgatgatagaaaagctgccattgagcggagcctaagaaacaccacgggtaggagaatgtgagcccataggaaagaagggttctggagtcaccactgttatgtacccrgatcacctgtgacaagttcttctttaatcctcccagggataagaagcatgtagactgggtcaaagcttatttaagtatatggacagagctgcaggcttacattaaggagttccataccaccggactggcctggagcaaaacggttagtgaatccttcctccctccctccctccctccyactttctctctccagcatggggtccacaggtttcttagacttcagcactaccaaagtctgtgagggaatgctagttttttcagtggaagggaggaagaaaaggaggagaaagaaagggtaaaaagagtagaggaagcaaggatcagaggagaaggaatattcagtggtattcaatttcaataaatatgttagggacagtgattggtgctggagcaggagacacacacaaatgagttacactatcccagcctttaaggagcttaaaaataagaatgcaaaaccccaatacaaatcaccaagccaaatgctataataaagatacagactagagtatgaggaagagaagagtgcttctcactagaagagattgtactttgaaggtatatactcttctgtgagacttgaaagtagtatagggcagtgagaagtgggatactacaaaaggcacagcttaaacaaaatacatgcagagtaaatgtagagattggtcatctctggcttcaataaggggaaatgatcagaattttaggagaaaaggctggaaaggaaggtaggctgagactttgggatgaggtatttgagcaagggagtgataatgattcaatttgtctttaaaagagtctcagtgtataggttagggataaggactcatgctcagattatgaaagtggtcatggtgtttgggggatagtagaaaaacatttgcaggagatagcaccaagataatagagatttgataaggtcgaagaagttggaatcctcaaagaagattgaatagtcagtcttggatagtaacatctttcactgaaatagggacaaggggatgattgtacagggagaggagcggcaggaaatgatgaaatcagttttgaatctgttgaatcagaggtactggtaacacactaaggaagatgtcaagtagatttgtggaaatagtttttagagctggaatcaggtgagttcaaaggcaaaatgtgatggtcaagaaatagaactgagagctggatccttgggaaagggtgagaaggcataaagccaagttgggtatgggtaggacacattaatcattgcctcaaaggctgtggtggggaccccatgtgcactggcccatgtagggcactactgggaatggtacagaggggagcagagaggatgatgatgttacctgcacttattgttccaggggcctgtggcaaaagaactgagcggactgccatctggaccctctgccggatcaggtcctcctccccctccaccaggcccccctcctcccccagtctctaccagttcaggctcagatgagtctgcttcccgctcagcactgttcgcrcagattaatcagggggagagcattacacatggtgagtgagcacttggacacgaacagtaggtacaacaagttgtgtgggccagacsccaccaaccagaaccgtctgtaaactacaaccctggcttgtgtggtggagactcgtttggtgtgtcctgttcctttaagggacggcaaagctggcttaaatggaaattgaaaatgatgatcacagttggaggaagccatctgccccatgggaaagtgacttaatattaggtagcatatatagaggaccctcttgtgccaaggcacagagctggcggttttccccagagctttttccgtggcaccacatggcctctgggaaggcattgtgttagggagttaacttcctcagaagatgcatactggttacatggaaaatttgcatgagagtgacctaatgttggtataaagtagatacccttaacacagctggtggaagtctgagttgtccagccacttctaggaatctatgatcatagtagctaaaaatggtgtaacaacctaaatccaacwgtaagagaaatggctaactaccacatgtcctcttgatgaaatgttttttatttttttattttttttgagacggagttttgctcgtttcccagcctggagtgcaatggcgcgatctcggctcaccrcarcctccacctcccaggttcaagcaattctcctgcctcagcctcccgagtacctgggattacagccatgcgtcaccatgcctggctaattttttttttttgtatttttagtagagatggggtttctccatgttggtcagcctggtctcaaactcctgacctcaggtgatctgcccacctcggcctcccaaagtgctgggattacaggtgtgagccaccacgcccggcctcttgatgaaatgttgtgccaccattacatgtttttctacagtgaaccatgtaatgtttaagaaaaaaaaaatctagtatgtaaattacaaccacaaggaatggtggagataaaaaggccattcagtatttgttatacagttaacatagatctggccatgttcaaagcgaggcgtgtgtcagcctgctgtgggagatgatgaattatttttcccttaaaacataaaagaaatatatttttacttttattttttattttattttattttttttgagatgggagtctcactttgttgctcaggctggagtgcagtggcgtgatcttggctcactgcaatctctgcctcccaggttcaagcagttctcctgcctcagcctcctaaatagctgggactacagcacctgccaccacacccggctaatttttttgtacttttagtagagactaaaaatacaccatggtagccaggctggttttgaactcctaacttcaggtgatccgcctgccttggcctcccagagtgtgggattacaggcatgagccacagcgcctggcctagaaagatattaaactacaggttaacatgagaaagwttttaagtgtcaatagttgaactaaatttgttaacaatctgtatgattataaccaacaaaaccaaatatatgtagaaaacaatattgtagagttgcaaatgccaacactgactgaggaggtgggggaagtagggttagctgtggggagtgagggtatttttttyttttccttttaccaaattttctttactaccactcatttttctttattgctttaaaaattayatatttgtgcacatacatttgatatgtctttctagacatagaggataaggatttacatatccttatcctcacccacaatatacacacattccatgttgttgttaayggaaccatataatttaatcttggggagaagagaaatgataaaagtacttttccaaaactgcttgcaagagaacatctcaaaggctctggttttggctttgaattttctgttaaggatgtttaacatgacgatagcagctcaaaggtctggtatgaaggacaggaacaaggtagctgttgttcttacagccctgaaacatgtatctgatgacatgaagactcacaagaaccctgccctgaaggctcagagtggtccagtacrcagtggccccaaaccattctctgcacctaaaccccaaaccagcccatcccccaaacgagccacaaagaaggagccagctgtacttgaactggagggcaagaagtggagagtggtgagttaaaaatacctagacaggggcaggtatttttattattttatttttttgagatggagtttcactttgtcrcccaggctggagtgcagtggcgcratttcggcttaccgcaacctccgcctcccggggaaaaggagtaggaacaggaggttaaatggagcttagctagatgagggcagagttctggcttcaattgcaagaacaaaaagtttgggatagcctggttattttttgttcggtgtgtgctttgtgatgagaatcctgggatctctctctaacaggaaaatcaggaaaatgtttccaacctggtgattgaggacacagagctgaaacaggtggcttacatatacaagtgtgtcaacacgacattgcaaatcaagggcaaaattaactccattacagtaggtgagtctttgtcgctgtcccacgcaagccccgtcccagagcccgagaaggctaataccattttacctaccctatccttaaagattcctaaatgtatattactttcctttaaagttacactgttgacacactccctttcttctcctagataactgtaagaaacttggcctggtattcgatgacgtggtgggcattgtggagataatcaacagtaaggatgtcaaagttcaggtaactcgatattttggctccttctttttgtccctgaggaattaattcaaagagacatggtagacccacagatgttgctttggtgggaatctgattctacaaagtctgtaagctgagctgctttggacgtggcagaagaagggttggctcttcaagcaagttcttttcaggacccatcccaacccacccgagtatccagtgtcttgcgcatctgtgagcttttcatgtagttgctgagtcacgtgaaacaggaaaccttttcctgcgacttactgttgtccttcccaaccactgggactcagttctctttgtttactctgcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttgtaagtttcttgatctctttagtatgatgttaaaaacagaagggactgaagatttctggcattgaagaaagctattttatgaacattctgcactgagcaggtaaaaacccaataatgcacaccaaaagtacacagaaatgaggtagtcccatgtagtggagccccaaaggtaggtgctttctgcctaagtggagctcaaggtagcaaaaaataatggggatgagccatggcaccttgtcaggctggtgctataaagccatatgtactgttatttacaccccatagacttaatagtctgtccaagatcgctgaacactagaacatagcatggctctgtgggtttgtctcttgctacattgtaccgtgctcctggggttaagtggaagcaagcattgggagaaatgtgtgagatttagccccagctgttctttagctcagatttaaacctgctgtctcttctttatttgcagaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaacaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctgrttttaggtcttgaattatgtaagaatcttgcacagcactgctaatgtaaatttcagttgttyttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttgcttagttgtttacctgtgatattggctgtacagaaatgcaaaaaatactgaaaacaccaaggataagaaactactctttattttagacaacctcataaaattattttcacatcccccccaacttcttgctcttaatcctcatcttttagttgaagaataaggcttaagagagagaaaggaaaaaccataatggctaaacttagcagcaccaacacggttctttcatcaaggcgtagctcatcatttctccaaactgacatgctacagaaatgtcttccaaaaagcgttaagttttcacagagtggggactatgatttccatgctcaaatagtgtaggaaatggtagattacgttagttttgtttactgtaacaggaattctcaggagtccttagacactctaatgtgggttgatctccagaaggagaaagggagtgtgtagtattttccaagctttttgagcaaacaatccttttctcatggaacacatcagaaacagtttggagtatgctggtaaatgtgttttggggatggaagtcagaaagcctgatctttttcatatggttcctcctattctctgctaaagccagcaacagagtaagttgactctagcatcaagaccactagtcatattaagaaagggcaggttggtcgagaatggaataggaagaactagctgcctcacttttcactttcgcgcctacattttcttcgctccctaagttatacaagatgtacatttcctctcttaagcaatttaatttgggtgctacttccctccttttgtgacagcaactaattcatcactacctgaggagacaaagtgggtgctgcagaagcaagactgtaggccagtgggatttgtctaataattgatgataagatgatagcacagagggcaacgtactgagagaggaaggcagccttaagaaatgatgcagaaatagccaagcaagatttttccaagcactggttaaatcaccagcaaaacaaagcatttatgtgagtacctcaggcctgggcacctctttgcttgaaatatggcaagacttggaaaaatgtttgcccttagaatctatctcactactttagttagttgtctcctttgggcctgggcacagttctggcactgatctggaacagactcccttttctaaaactgaacttgaccacatcaaaagtttgtaaaacaatctccatggtaattaaacttgcattcaacaccatatggtaacagaagatggcaaaggataagattcagatcttagatctttccaagtagggcatgttagatgatagaaggattagttgcaagctggatctgagctcaggcttgggcatgaaggaaactgtctcccatgtggtttggaagagttaggggctccctgagctctattgtgaactatacgggtttcatccaaggaatggtatgatgtgggcataaaaccattcttcagacaactgaagatggtccccttctgtagccagaaacactagctgtcctgcattgtccatttcctttagccccaggcggtcctgcagaaggaaaggccataattaattaaaaagcttaatgaagttttggagtaaaatggtaagtacgttaacttgagatatattttcaaaatgcagtttgtcctgagtattaaaattgaggtgtattttcaaaaatgccaaaaagaatatctcctacttctttttctttctcttttttctttttctttctttctctttcttcctttcttttctttcttctctcctccccctcctcctgtcccccccccttcttcttcttcttcctctctctctctctgtctctctttctctttctttctttcaagacggagtcttgctcggttgcttaggctggagtgcagtggtgcgatctcggctcactgcaacctccacttctctggctcaagcgattctcctgcctctgcctcatgagtagctggaattacaggcgcatgccaccatgcctgggtaatttcttgtatttttagtagagatggggtttcactgtgttagctaggatggtcttgatctcctgacctcaggtgatccacgtgcctcggcctcccaaagtgctgggattacaggcgtgagccaccacacccggccagttttttctaagtattaaaaatagatatgcaattgagattgctctatacagtgttctagattctgatttttgaaaagctcagagtcagaggactacctataggtgggcaagccatagacgacactgcctcagaatgccataggtaagtgggactgagccaaagacagaacattagctaggtaacttaaaaaacatccaacccaggacaggcgcggtggctcacgcctataatcccagcactttggatggccaaggcaggcggatcacctgtggtcaggagttcaagaccagcctgaccaatatgatgacactttgtctctactaaaaatacaaaaattagctgggcatggtggcgggcacctgtaatcctagctacttgggaggctgagacaggagaattcgcttgaacccgggaggcggaggttgcagtgagctgagatcatgccattgcactccagcctgggcaatgagcaaaactgtctcaaaagaacaaaacagaaaaaccatatccaaccgttaggtaacaaaccctggacactttcatattctggagttgaaaatgtcattacccatagcctagatgctggagaacaacctctggttgggaagataagcagttacgacagtgccagaatggtgcttctgccgtggccaacatcattttgagttttcacagtaaggaagttcttagctgtaatttctgaagccttttttttttttttttctcaaatcagattctagcttccctttttacctcaccacccaagttgaggcacccagtgcaaaagaaaagccaagccaagaggagacaaatgacctctgaaataacatggaggaattctagtagacggtgattggttcagatgtagtacttagcattttggagagtctgtctccaatataaaatccttagggctgggcgtggtggctcacacctgtaatcccagcactcttgaaggctgaggcaggtggatcacctgaggtcaggagttgaagaccagcctggccaacatggtgaaaccccgtctctactaacaaaacaaagtattaggcatggtggcgtgtgcctgtaatcccagctactagtgaggctgaggcaggataatcgcttgaacccaggaggtggaggctgcagtgagctgagatcacaccattgcactccagcctgggtgacaaagcaagactgtctcaaaaaaaaaaaaaaaaaaaaaaaaaaaaaaaaatccttaaagtgtagaaggccccagaactggaggtggcaaattactgcaacttctgcttaagatacaggacctactgctaaacaaaattcaaaactctagtcccactcaacctcctgcaggagcctcccttgtcagtgcgtaatttagaaacaggatttcacatctattaatgtttaaaagtaatgtcccttggccaggcgcactggctcacgcctgtaatcccagcactttgggaggctgaggtgggtggatcacctgaggtcaggagttcaagaccagcctggccaacatggtgaaactccatctctcctaaaaatacaaaaattagccaggtgtgatggcacacacctgtaatcccagctactaagggggctgaggcaggagaattgcttgaatctgggaggcaggggttgcagtgagccaagattgctccactgcactccagcctgggtgacagagcgagaccccgtctcaaagaaaaaaaaaggaatgcccctcatcatgcatggaggcttcctggatttgtagcagactgtacctcagccaaggcagctagttttaaaacctttttatcaaaagaagggaatcagacatgaggtttctcttgttgtttggaaaccataaggtttcaggatgtagtggatttttgtaacccagtgcctaataagctagagcacataatcaagagcctaacaagcttcacccatattggacatgagtcaggtgtttcaggagtacctagtgctctgaggtgtaaaggaaagggctccagcaccaaagaacatagcagcttcaggaactgggagctgaaaaaacaccaacctcccaagatagactccctgccagttacctgtgtgtacagggaggtctcctgtaagggaatggtttccttggcttggccacttctgtaaaatccaaaccactgcagaagaagcaaaggaaagaagctcagatatgacacacagcacatactgccaaaataatttgagactggttagaagctaaaactgccaacaaagtgaacatcataaagctgtaggaagaaggaaaaatggatagggtgcgtctgagtcatctcttcttaagggtggagcccgagggatgagttaatctttctgagaggccgctttccacttccccagaatttctgcttcctaaaattattaagcaataaatgtgaaaaattcctgtgctgagctctagacattcaaggatgaatacataatctgtttccaaaaagctcccagtcttgcaaggcacggaaacaattcactcttgagtacagaggtcagcaaacgtttttgtaaaggccagatacaaaatattttaggctttaagggccatatggttgtaactactcattgctgccactgtaacaaatgcagccacagacagtatgtaaaaagtaactaaaactgttccaataaggacactgaaatttaaattttacataatctttatatgtccaaatacttgatatgtctaaataaattttacataatctttatatgtccaattctttcccccaaccattaaaaaatgttaaaaacattcttttatgttagtgtttggtgttactcgtgggtagcaccaaaacgggtagcaggatggactgggcctgtgggccacaatcggccaatccctggtggtgtgacataacgtgatgagtgttttaacagaggctgatgattctaaaaaagcgatcacattctgcttggaatggggatggcatccttgccttgacagacgaatagaaattgttaggtggagaagccaaggaagggcattctagagacagaaatatatgaaccaaggcatacgagagaaaaagcacaagtagtacaatatggcttgatcaagagtgtatgaagcgtgcagacaaggcagattaggctggaaaatggggtgaagccagatcaaggcagaccttggaggccaagcttaggaatttatatattttgggctagtgattctgaacattttttgggtctctgatctctggaaaatggattaaaattatagatccttccccagagaatgtaattacataattttgcatagaattttggggttgggggattgattacaatcttcagtgtcccatttatggacctcaggtgaagaactgttttatacaaaagttggtggaagggactgaaggttttttccccagcaggcagctgtattttttcatttcatttcaatttcattttatgttctttttgagacagagtctcgctctgtcacccaggctggggtgcagtggcacgatcttggctcactgcaagctctgcctcctgggttcaagtaattctcctgcctcagcttcccaagcagctgggattacagatggctgtcaccatacccggctaatttctttttgtattttgagtagcgatggggtttcaccaagttggccaggctggtcttgaactcctgacctcaggtgatccacccgccttggcctcccagagtgctgggattacaggcatgagccaccgtgcccggccagcagccctattttaatgccatttactctcctggcatgtggcctaagtagtgtctcacctccgaatctacagggtccacaatggaatcattgaggaatttcaccatcacaaacttcttcagggccatcaggtttttcttgtaggactca

SEQ ID NO: 17916 - DNA, 12405 bp, Homo sapiens
atagagggacagtgaggcctgaggctgcagagggattcaaatcccctggccaggtgtggtggctcacgcatgtaatcccagcactttgggaggatcacctgaggccaggagttcaagactatcctggccaacatggcaaaaccccatctctactaaaaatataaaaattatccaggcatgggggcggggcgcctataatcccagctactctggaggttaaggcaagagaattgcttgaaccaaagaggcggaggttgcagtgaactgagattgtatcactgcactccagcatgggtgacaaagtgagactgtctcaaaaaaaaaaaagaaaaggcagatgactccaaagactctctcaggtgctccgggcctggcacctgctccccaatgctctccacagggctcacctggcagaaggtggggctgtggacagctgacagcgcccggcacagagcgtccacatcgttgaagccaggtggcaggcggtccacacagaggcagcgggagtggagaagggcaggcgtcagttgcccggcatccgtccagtgcacgtagagggtgcgtggtcccagcggcttgcccagcaggtccgacttggcacgggcagccgagtccttcttcatgtactcagcaaagccatagcccttggattggccagtgcgctcactgtagaccaggaagcagcgctccaggctgccgaagggccgcaccagctcctcgaactgctgctgtgtgaggctggggggcaggttggccacacacagcagggcatccgtgggctgcagctgcaccgacagttcacgctcccgcaggcggctctggtggaaagcattgattgcggcctcggcctgctccccattcagcagggtcacgaaggctgcggtgggaggagggcagtgcgaggtcagccgggccctgagggcctgcccctccaccccgccaccctgcaaaccaggtgggacctccaaatgctgggcatctcaggtgcctgctgatctgagcagttgccagccttggcgactcacacaggcgagagcgcctgccattgactctaggctccacgaagcccactccctctcccagccctgcgtccacctgcacccacagcagcgctcaccaactgtgggcctggctctgtcctaagaacgctgtgggtcactcgggtgataccaagggcagtggttaagcccatgctcactggggcccagatttaagccccaagccccaggtggctttgggggtatcagtttcctcatctctcaaatggatataacttaatcatcacaatcaccattttgccagagaggaaacgggcccagagcagcacccctgtgccccgagtaggggagcctggacttgaacccaggcagccggactccagaggcccactctacacactgcccacccctgccacctttccaggccaccagtgcccctgaaccctgctgccacgtgctgccccagatttgcgatccacccagcggccgcaggaagctttgttcaaaacgatcacgccacatccatcttgtggcttctagctgcagggtgcagtgcagcctgtgcgggctcgctgacctcccctcccatctcaccgctgccacccggaccacgccaggcacactccagaggggcctttgcagctgctgtttcttgagcatggaacactgagccccacctcctcacctggttaacctggacccacccaggtagaaaccctgtctctactaaaaatacaaaaattagccgggcatggtggcacatgcctgtaatcccagctactcgggaggctgaagcaggggaatgggctgaacccaggaggcggaggttgcagcgagccgagctcgcgccactgcactccagcctggcgacagagcaagactccatctcaaaaaaaaaaaaaaaaagaccacacaagcaggggtgactggctgagtgaggcaagaggggtaagaagagaatgaacccacggccaaacgttgtcaagaattagctcaatgccaagcgagtggagtaggaagagaatcagcccgatgcccagtgttctccaaggagaacatgaaggctgtcccaagatgacaggatgacaggcagattggggcaacctgccatgttggcctggggggcaatactgggcctgaagctcagagcagcagacagtgagccaggccctcccatcttcagggatggtcactccctgccctggcccgccccatggccccacaaacctgtccctttgtatttgtccacaaaacagtatttgagctcatagtcactgagcaggtcatgtacttcctgtggagatacaagacaaaagacagggagttactggagatggaagggggcaacccagtgccgcttcatagctgccaccagctatgaaggcaggtcaattaccaccccccattttaccaatgaggaaactgaggctcgatgcagtaattttgtcaaggtcattctgctcatacctggcagagatgggattcagaacctagctgcagactgtgctattacccaggcaacatgctcttagagggtatacctttagctggctgggcggggtggctcacgcttataatcccagcattttgggaggccgaggcgggtgaatcacctgaggtcaggagttcgagaccagcctggccaacatggtgaaaccttgtctctactaaaaatacaaaaattagccaggagtggtggcgcacacctgtaatcctagctactcgggaggctgaggtaggagaactgcttgcacccaggaggcagaggttgcagtgtgccactgcactccagcctgggtgacaaagggagacactgtcaacaacaataacaacaaggccgggcgcggtggctcacgcctgtaatcccagcactttgggaggccgaggcgggtggatcacgaggtcaggagatcgagaccatcctggctaacaaggtgaaaccccgtctctactaaaaatacaaaaaaattagccgggcgcggtggcaggcgcctgtattcccagctactcgggaggctgaggcaggagaatggcgtgaacccgggaagcagagcttgcagtgagccgagattgcgccactgcagtccgcagtccagcctgggcgacagagcgagactccgtctcaaaaaaaaaaaaaaaaaaaaaaaaaaataacaacaacaaaaaaaaaaaaaaaaaaagaggccgggctcacgcctgtaattccagcactttggaggctgaggcaggcgggtcacaagatcaagagatcgagaccatcctggccaggaaggtgaaaccccatctttactaaaaatacaaaaatcagctggctgtggtggcgtgcacctgtagtcctagctactcgggagactgaggcaagacaattgcttgaacccgaggggtgaaggttgcagtgagcagacatcaagccactgcactctagcctggcgacagagtgagactccgtctcaaaaaaaaaaaaaaaaaaaaaaaagagtatgcctttagggaagccatttaacctgcatgaacctccttttgcaagattcactgtttccaacaactctgtaagtgaagtattaacaaactcatgttgtatatgagaaaacttaggctaggagaagtgaagagatctgctggaggccatgcagttgggcagcgcagccacccatgggtacctgactggggagcccaccttctagtaagccccacgttgtgtgggttcacatgcctcccaatttcctcctgctgataaagctgccctcttccaagccagctcatttatttttcttttttttagagatagtgtcttgttctgtcacctaggctagagtgtagtagcacaatcatagctcactgcagcctcaacctcctaggctcaagtgatcctcccacctcagcctcctgcgtagctgggactacaggcacgcaccaccatgcctggctaatttttaaaaattttttgtagagatgagggtttcactataccgcccaggctagtctcgaacccttgggctcaatacagcctcttgcctcagcctctcaaagtgctgggattaaagggatgagccaccatgcccagcctctcaagccagctttgaaggcaaagtgctggcgcctgctgggaccagacacactgtgcatcttgcaggagagacaatgtgttcccagctgagagactgcagacactgagaggaagacccagaaagaaacctgaccatccttaatgatccctgtcccgatctgtccccaaattcagcccctcccaacatccctggggttccactagccacgtgcccacccggtgtgctggtgggccggagagcagggaatctcagcagcaggaagcgagaacctatttcaccgccatagggcagggcagtatagatgccatttccctgggtccaaagagcattgggaagcgctgccccatgctggccccatgagaagggcactcctagcaggaagattagccacgaggggctccatagaacacaggcctcgcttccttcctgtaggtctgtaggctggtggcagaagaccccattttcccaaattaatcctgaggttttgggggctgagacccaggggctgctgttaacttccggatttatctctgagagcagtgaataaacgcgtgatatggaggggcgtactctccgcagtcctgaaacttctggatgtgaggtcccgccaccctgtggtagagtgggtggagaaaagcatcatccaagcagggggcaactggtggtccaatgtaccagcccattcacaattccccaacaggaccaaagctgtccgcccccttccattccccgcccgcttccatcacttggtgtcgcccaagcctgtggtcgcccctagcaacgccctccctcacttcgcagtcggtttcccctttcatcatcgcccccccacgtcccgctcttggtctctcccgatcccgcgtggatccggtgcttgggcgcccccgccaacgacccccgcgcacctcagcgttggtgtcgcccggttccccccgcgcacgcgcaccgtggtatttcccgccacgctcctacaccgccccccccaatacctggttggtcacgtcccccgggaggccccggatcagtatcttgcggcggttacggaactggcgctcggtgtgttccaggcgtttccggatctcttctggatctagaggcggcagctcttcttccggcgcccggcgctccgcggcatcgccggcttcgacttcggccccagacttagggctcagcgggggccggtgagtaacggacacgtccgccgccatcttgggaaacccggcgccttctgggaccagcgagccggggcggagcggcatagagcggcaacgagggcgcgcccgtcgattggctgggagaaaccccacctccttcccgccccccttgccccgttggctaagccccagcccacctctcaagagttcaagctgcgtctgcgcgccacaggccccgcccccttccgtcgcagcgacgctactcagtggatgtgcacctgggtgggagagacttgcagcgcgggtggaatcaaaccacagattagggagtttgaaggctttattggtgcggaatctgagggcacagccaagcccccgccaactttgatcccggatcccagcgtcactcagctctggacggttcttcccccattgcttctgtcggctgcatagacgtgaggggcagataggtgctctcctccctaacatggtaactgccgctccgttggtgctccctgaagacgtacattaaggccagtacgatagtcaccacgcccagggtcagtaacaccgccacgaagacggggacaaagtgggagctcccagctgtgcagagaaagcgctaagtcaatatgcgtcccttctgtctccaacccccccgccccccggcttaccggtccagacccgcagccccgtattagctcaccctcaatgtccatcaccacgaccagggtgtatttgcctcgtgagctggacgcttggcactgataagtaccattatgtgttacgttgacgaagaacgggatccccaccggcacctcccggctggagccttccttcaaacaccgcagctcggggtacgggttgcccctggcttggcactgcaggacgtgtctcgttttatctttccatttcaagtgctgggggcatgtggctcggtcaattttgggaccatctgtggaaccaccatgtgtgatcagacacccaacacacccgaggcacagtggtgcagaggagcgtctaatctttccagggmaggggtggagggattaaaggtcagggtgaccgactcacacaggactcgcagctggacgctactgttcctgtgcaagaactcgccgtccacctcgagagtggcactgcagaagaagctgcgtccgtcgtcactctcggtagcatttagctgaagttgagctggctgccccggggccgcggccggaactccgtccagcgtgacctggactcgagccccagccatgcaactcacggtcactgtggacccctcatgggcggtgggctcgctgaggttcacaatgggtcctaggaagcctaaaggcggggcattgcccaggagcttaatgaacaggaccttcctgtgggtcaagccgctccctccgccctcccctttcctctcgggatatccgggccacgctttcggccgttcaagcctcgccctctttccgcgctgtgtccagcttcgggcactcaggcccaacccacgttgcaactgctattggggcaagccaggccccaccttttcggctagtctccgccccctctgccacgcccccagactgctgaggccgcgcccccttcccacgcctcctcttactaaagaccgtcaagttctcccgggcctcccgtctctcgccccctagggtcacgttgcagacgatctcccgggcaccctcctgatccgcgcgcgccgtggctgtggctgtggccgttagcgtgtccccgtggttcatgactgtcgcattcagcatctggtcccccagcgccaggtagacctgggcctctgaggctggaaaaagcccgtctagggtgcagtccaccggccacgacgtttccacctccaagaaccggggggccacgaggcgcgggggggtcacgggcaggactggggagaaaggtgggcatagtacaacccccaggactgtgccttccccaggacaccctcatcccccccagtcaggatatcttgctgactgggtcacccttcttcacaggacacacacacagggccatgaaaacggccttcttcaaagatcccacggctcgggcctcccttccggggccaccttgcccagtggccgggggctttccttcccagaagcctgtgaggtccggggtaccccactctcaggaaccccaaggtcagggcaccgtctaccctggctcagctcgtcacccaccgtctgaagccccttctctcaccaaaggttcggagctggcggggggctgaggtgttcacgaacagtcccagcccctggggctgcatgtccagttctgtgcggcatgagaaaggggctccgtggtcgtctctgctggccagcacagtggcagtgacctccgctggctcctccactgcgggctgccggctcagctcctcctcccagcgaagcagcaccaccgtgaggctggtccggggcgacccatcctccacttggcagcgcagggtgaagttctggcccaccggctgccaaggaggcaggggtgccagctccacacgctccgggagccctgagagaggaggggaggatggcacttagcgggtcctgcaaacccacccactcaccccagggactggggaggagacagggtggtcctgccgagaactgtgagctttgagttaataaacttagagggcttagagctgggccagtcgaagcgtttgctattatcattagcgcagtgattatcatttcctgtgttgtcagataccttgcaaggcgctaaacaaaactttctgttctcaaagatggcacaataaaaaaaaatgaggatggaagggatgaacgtttatgactatgatatgaatattaaaaattcctgtttatggccagacgtggtggctcacgcctgtaatcccagagctttgggaggccggggtgggtggatcaaaaggtcaggattattcagttctctccaatcaggttcagacactcagggctttcctggttcaccagccctgtggcagcctctcaagatactccggcacagtcacaggagacttgacactcccaggctgggtgccctccccagtacacctacaaaacgctgggcctcaggccgggcactgtggctcatgcctgtaatcccagcactttgggaggccaaggtggacggatcacctgagaccaggagttcaagaccagccttgccaacatggtgaaaccccatctctactaaaaatacaaaaattagccaggcatggtagcacgtgcctgtaatcccagctactcaggaggctgaggcacaagaatcgcttgaacccaggaggcaaaatttgcagtgagctgagatagtgccactgcactccagcctggcgacagagagagactctatgtcaaaaaaaaaaaaaaaaaaaaaaaggctgggcaaggtgactcatgcctgtaatcccaccactttgggaggccgagggaggcggatcacttgaggtcaggagtttgagaccaacctggcccatatggcaaaaccctgtctctactaaaaatacaaaaattagccgggcatggtgtcacacgcctgtaatcccagctactaaggaggctaagacaggagaatcacttgaacccaggaggcggaggttgcaatgagctgacatcgcgccattgtactccagcatgggggacaatagcaagactgcgtctcaaagaaaaaaaaagtcaaaaagtaggccaggcatggtggctcacgcttataatcccagcactttgggaggccaaggcgggcagatcatttgaggccaggagtttgagaccagcctgggcaacatggtgaaatcctgtccctactaaaaatacaaaaattagctgggcgtgttggcatgcgcctgtaatcccagctactcaggaggctgaggcaggagaatcgcttgaacccgggaggcagaggttgcagtgagccaagattgcgccactgcactctagcctgggggacagagtgagactctgtctcaaaaaaaaaaaaaaagaaaagaaaagaaaaaaaaaagtagccaggtacagtggctcaggcctgcaatcccagctactggagagactgaagtgggaggattgcctgagcccaggagtttgagaccaacctaggcaacatagggagatcctgtctctaaaataaaggtataaaaaagtgtaaatgtaaaacctccatttgcctactgctgactgaaaggggtacccccttttttgcttaagagacaagggtcttgcttttttgcacaggctggagtgcagtggtgcaattatagctcactacagccttgaactcctgggctcaagcgattctcccaccttggtcccccaagtagctgggacttcaggcatgtgccaccatgcccagctaatattttttatttatttttgtagagacggggtgtccctatattgctctgcctggtcttaaatttccggactcaagcaatcctcctgccttggcctcccaaagtgttgggattattgttggggccaggcgcagtggctcacacttgtaatcccagcactttgagaggctgatgtgggcggaacaccccgtctctactaaaaatacaaaacttagctgggcattagctggacctgggaggcagaggtcgcagtgagccgagattgcaccactgcactccagcctgggctacagagtaagagacgccatctcaaaaaaaaaaaaaagcttgttggggccgggcgcagtggcccatgcctgtaatcccagcactttgggaggctgaggtgggcggatcgcctgaggtcaggagttcaagaccagactggccaacatggtgaaatgccatctcaactaaaaatacaaaatttgctgggtgtggtggcgtgcatgtgtaatctcagccactcgggaggctgaggcaggagaatcacttgaacccaggaggcgaaggttgcagtgagccgacatcgtgccactgcactccagcctaggcaaaaagagcgaaactctgtctcaaaaaaaaaaaaaaaatgcttgttggggcccaagttaattgatttcacaactgctgccttggcatgagattgagatgcgtctctatatctctgtctctgtctctgtgtctctgtctctgtctatctttgtatctcacacacaaatgtccaggtctgagctctgggtcagaactgtggtccattctttgcaaactgagggtccccactctcctgagccattggccacttgcccacaccactacccaagaccagtcccacctccggacacgtcgactcactgtacacggtgatgttagaggagcctgttatctgggagccattgcagtacactgagcagaggatccgactgttgccagtcacgttgctgagattgaaggctgcccagcccatgccactggccaccagctcctttgatagggacgtctccaaggcgattttctcagagctgggacaatcagtactgcagttcacaaacagggaccctccagcagagagcacagggttctggggctccacccgcaaaaggaactcctgcccctggacaccttcaggaacatgaagaagtcctggtgtttgtttccttgtcccccaacccacgcatcaacaggccccaccatttaacacctctctccttgtgccgagacagaagggttcctgccttcatggtccagtgggaaaggtagaatccatcagagaccggggagaactcagaaggaggccagaagaggctctgatccagcataggaggaggtgagtcagggaaggcttcctggaagcggggaccattgcagcccgaaactgaaggctaagtaggagttagcaagtgaaagggacaggtgatcctggcagagggaagcacatacgcaaagggcaaatttcaggagttcagatggagcaggaagcatgaggggtgtgtgtgtgtgtgttaggggagagggatggcgtacaagcctatgctggggcctgaccacctgaaggctgaactaaggaaccagaactttctcccgaggatacagagtcagcggccaggtcgcagtgtggcaggatgtgaacagcgttgcgttctattcctctaccctctactgatccccaaaacgcagccctctccagccctccccggcttgactggtctcacctggggtcagcagacagcagaccagcagagtccagcaggccctgggccacaacacggatggtaccatggtggccattctgacagaggaaggtgccttcctgaggtgcccgaagggcaggcaggggaaaaggcggggcctcccactgcgacggaagcacagcggttaagattgcagaagtctggggactgcaccttgcccaggcctgtgggtggaaggggatgctgtggcccttgggggccagggtgggggacccagacggggctctgcaaagtggccagcactgctgagtctcccccagggaatgggctggtcccagttgcactgctggcccccatttgaattcacaggaaatgctaactaaactggtttcttttgttctcagcactgggaagcctgggtgggggggatgaggcatctccttctggctgaacttaggtgggtaggggaatattctgtccccagagaggaagttaatggggaaaactgtaggcaccattgtgtagatgttaaggtgggatttcgaggaaacattaaaaaacaaaaacaaaaacagaaacagaagcagagtcttgctatgttgccccgactggtcttgaactcctggccttaagatggcctcctctcatcttgacctcccaaagtgttgcgattacaggcgtgagccaccacgcctggccacctttgaagatcttgaggatacctccctatctttgaagatcttggggatcccccatcccctgcacaaagagctaaggtaggtgatttggggacagctgagtccctgagccactgtctatccaggattctacttggtttttgtttgtttgttttgagacagagtctcactctgtcacccaggctggagtgcagtggcgggatctcggctcactgcagcctctgcctcccgggttcaaacgattttcctgcctcagcctcccgagtagctgggattacaggcatgtgccaccacgcccggctaatttttgtactttttggtagagacggggtttcaccatgttggccaagctggtctcaaacttctgacctcaagtgagctgcccgccttggcctcccaaagtgttggg

SEQ ID NO: 17917 - DNA, 14529 bp, Homo sapiens
  misc_feature (1)...(14529): n = A,T,C or G, or insertion/deletion polymorphism (see Tables 1-2)
gaaaagaatgaacaatatttttgttgtttgtttctttaaagaacatgggtctaaaagtctttaccaatctccattaccgaaaaccagaagtatgtgtgatggagagaaggctgccactccctaagccgctttatctggaaacagaaaattatggtccaatgcatagtgttccgtctagaattgcatgtaggtaatcttacatttttttgttgggggatgaccaaaccgctttgtggaatttagtgtatttgggataaatgatgcaattttggaattttatgtgtgaattatgccatgtttttggctacaattagacatcctatagttggataaagcagaataagacagactagacatgcttttggctataacaagaaattagcttcagatgtgagatgtagtttatttttattgataaaatacaatgtcagaaatacaatcatgcttcacttagtgatggagaatttgttctgaaaaatgcattgttaggtgatattgttgtgcgaacatcatagagtgtacttacgcaaacctagatgctgtagcctgcaacacacctatgctatgtggtacagcccatttttcctaggctacaaacctccgcagcatgtgactatactgaatactgtaggcagttgtaccacgatgataactatttgtgtatctaatcattgctaaacatggaaaaggcacagtgaacatgtggtatacaagataaaaaaaagttatacttttatatagagcacttcccatgaatggagcttgcaaggttaaaagttactctgagtgagtcagggtacaaatatattttctttgtttacattcttattctataagctttttcctatttttaaattttctttaacttttatacttttttgtttaaaacgaagatgcaaacacacacattaatctaggcctatacaaggtcaggatcatcaatatcactgtcttctacctccacatcttgtaccgctgaaagttcttctggggcaataacatgcatggagctgtcatcatctatgatagcaatgccttcttctggaacatctcctgaaggacctgcctgaagctgttttgcagttaatttttttgataagtaagaacagtacactctaaacagtaaacagtatagtatagtaagcacaaaaaccggtaacatagtcatcattatcaagtattatgtactgtacaaaattgtgtctgctatatttttataggactggcagtgcagtaggtttgtttacaccagcattaccacaaacccatgaccaatgcattgcactacaacgttatgatggctttgatgtcaataagtggtaggaatttttcagctccattctaactttatgggaccactgtagtctaagtggtctgtcattgatcacagtgtcattatgtggtacctgactgtgtaggggaacaggcaatgtatggtgatacaggaaaacagtcatagtaagtgactgtgatacaggaaagtgaggtgttttatggagaccttacaccctgataatatatagactataatttgcagagtccaaggtctgaataaggtacttcttcctttttttttttagctagtggaatcagaggggagaatgctgactatgtagaacaggctataattcaaacagtaagaacaaacttcccagagacatggatgtgggacctcgtcagtgtcgagtgagttttaaccattttctctcctatgtgtctttatttctattttctttttctttcttcaggtttattcctgggtatataaaacagtaccatatttgtaaaatatgtatcattgatttgcatgtacttatcatacattttattttatttttttctctagcattgttttcccttcaccaagagtttctcttctattcattttatgcagacagatttaacctgccccaattaaaaaaaaatgtggcgtttaaagaaaaatgacctttctatactcaaattttataaaaatccagctctcattatttttatctaatgccccatccaaacaatataactcacttttgagcttcagtcaatacttttctgcttgctctgcacttaattttaagttcttggttcagacaaagaatgtgttttaccgataacctcttcttccagttcctcaggctctgccaatctttcgttcctcattcctgatacgataacccaatgggaggcaagtggcttttgtgtgaatggcgacgttggatttggcatttcctctacaaccactctagaagtctcccaacctttctttattgaaattgcctcacccttttcggttgttcaaaatgaacaatttgatttgattgtcaatgccttcagctacctgaatacatgtgtagaggtgagttgttctgtttgatctggaggcaaaaatctaacaaagctaaaatatttcttaatatttccatattctctttatcctcaagtgcaaaatgctactataaaggtataagacttaggtccatattcctcaaacaaatacaattgctttcattcacagtgacagtttaaacagtgtattgagcatggtgtttcatagtgatgtgtgttccagtgctatcctcattgccatgattgttttcttagatttctgttcaagtggaggagtctcagaattatgaagcaaatattaatacctggaaaatcaatggcagtgaggttattcaagctggagggaggaaaacaaacatctggactattatacctaagaaattgggtaagcagctatctgtctacaccagtcactcatggaaaaaccagcccatatttattgtctccatttactttccttaaattgtctatacaaacgtgattttctccctcacatttttaaaattcttattgtaaattctccattagaaattctaatctatagtaatctaatttctggttgttaatgctgtgtagatcaaaaccaccattcatttttacaagagcataatgtaattaaaatacaatataaatgctaactggcatgacctatcatggactatatgtttggcatatgccatatcccaaatgaaggccatgctatcattaatgccaccttaattatttgacttctcgctgggtccttcacctaccatcatgaacccaggccaccttcaagaaaattgctgctccatcacaatgaccaatgagggaattgtcaggtttgtaaatttactagatgtgccatggggataccaaaatcactaaatgattggattgagataaaaaactgagaatattgtcttagtgcctatgctatctgcaagatggaaaaataaacttgtctcctattgaaatattgaaaatacatggaatggaaaaagtttaaaattctagtaaacaaggaatgctagatacgatgtgcgtgacacttttaatcactacttttaaaaaatggccattcaaatgttctttaatgtactatattcattgtattattttaacagcaaataatatatctatgagattattttagctcagttgtgatgctgttctcagactatttttctattagatttgaagtttctcaatatttctactgcacaagatcttcaaaatcctaccttggcaattgagacagaatactgtaccaacttgtatagttttatgacattaagtcgaagacacagttttaagagtgaaatagcaagcttcctgagacagagaaacactaaaacacaacaacaacaacaacaacaaaaagaacaatatattggttatgtatattggtatatagtcacgtaaataataataaccttaaaagaatgattgttttcaatcctgtaattttcacaagcaaggaaactggagatcagttctaattacataatgtgaaatcaggaagtttaaaaacaatggattccttgctaggacattatttcaatccagtgcctatctactatatcatattttactatgcttgcttgattttgggaagttaggagccctagttcgctgacattattagcctatattgtcataagtaacctttataaacaatcaatatcaagaaattgactcagacaactttgtaaaatgttacttttcctaaaatttcttaagttttaattaagtaaatttatcatttaatgtaaggaatcatgaaaatcatggaacaggtgaaatggaagataccacattatacctaggaaggagaagaaataagttattttgttctaagcattaacttaatgatagaatttggttaatccaattcaagacatggttcacagactctagtcatttctcattacagaagggaccaatgatcaatttaatttatatttgggaatgtcttccaggtaaagtgaatatcactgtagttgctgagtccaaacaaagcagtgcttgcccaaatgaaggaatggagcagcaaaagctaaactggaaagacactgtggtcaaaagcttcttagtagaggtatggatatgcaaacagtcaagcttttcctgaaaagaaacagacatctaagaggttttgtattaaaagatcttctcattgaagagacttaattagttgacaacatttacttttgacacaagacatgccattttaaatgaattaaaacagcataaagttcatcctttctttaattaatacctcacccaggatagtaaaacttaacatttgaaatagacttgacaattttttgtttgtttctgagtcaagatgtttcctgtacacctatttctcttccttctctttttccgattctcaaattcaagagacaaatctacttgtcctacactcccgtgcagttcccgtcatcctcaacaagaatcagcacttgtcagaggaacactcttgatttgcctcttggcaatccctgctccacaaagcacttttagttgtttactggagatgctatacaggatcagaggagctgagagtgtcccacagtgacatcaagataatgcctgtccaagctacagaacgcagaggctaaaatgggtaccggtgatgtcccgtgccttccagatatgaacaaaaggggaagatgagttggatcttctctcagggataaacttgcaccagccatgcttgagtgagctggtgcttaatcacttttccttcatggacagaggatctagactcattcttctgtgcttgtttgtgttattctttgacagcctgaaggtattgaaaaggaaaggacccagagtttccttatctgtacagaaggtaagaggatcttttagggagtcaaattagtcctaaataaaattcaccaaaagaatcagttcatgtcctctccttccacatgagtccatgtgccctgtgatttcactttaaataactcatggaggattcttgtgtttcatgctttatctttatggtataagtttatccatcaaaaagaatattcaggaggtggtttttagttcactttctgaggctggtctgctcctatctatttttttttccatcatgtgtattcttagctcctcttatgatatggttgtcacacaatattggacaatgagatattaggattgaggcccaatagcacataatataatcttggcttttgtactcttaggagaaaataacccatagatacatcactgcccctgcccctcagtctccggttttatggccatgaggggtattattttacctggttgatggtgatctgattatactccttcatctgagtcttcaagctttaccttttgtgtgtgttgttttatgtgttacagtcagtgtagtttttacattttttcatacataaatagttcaggcactaaaccagtgaagaacgggggccacaatctaacacacagatttatatgccattttctgaatgtactattatcctaaactgggtcaaaactccaaattcatctcctctaataaacaacttgtaaaataaaaataagtaatggaatcttatttccaatatgtttatcccccaaatctgctgatataaagaagccatcacattttttaaatcagtattttcattctaggtgccaaagcctccaagcagggagttttggacttgccaaatgatgtaghagaagggtcagccagaggctttttcactgttgtgggtaagttgawyaaattttgtgtttcactatgatttgaaaatcttggttgaggtggtctttaaaaatccttaaaataayagaatrgagagatyttcctaagctatcaattggagggaattattgwtcagatcatcctctakgtttcctgatgggatctaaagggattacagtaccgtttccggacctgtattcccaggaaaccttagcttgggtagatggtaactagtgttcagaaagcaagaggttctttataatcattaatctgaaatatgaaattcacctcttggagaatcgaattaacgttgcctgttaatgatgttgggagttttctcaataaaaggagaaatgtttgttgttgatacgaaaggcaaacttctttgtctgttattaacatgaacatctcttggaagggatggattacactttgtaattcataggrttgattgattaaaaaaaaaactagcaaacaagcaaacaaatgcattctcctaacttcctcctctctctagtaatgagattttcagaaatatttttcatagcagtttaacttcacccttcatggctgtctcttctttcaaattgcttcataaaactttctttgtttccaccatttagactcaattttaaatgttacctatttcactatgcctcttttgtctatagttattaatgctgagatggcaactataaacaatacagctttccgcttttcctgtttttaggggatattctaggacttgccatgcagaatctggttgttctccaaatgccctatggaggtggagagcagaatgctgccctactagcatctgatacttatgttctggactatctgaaatctactgagcaactgacagaggaagttcaatctaaggctttctttctcttatctaatggtgagaagawttaagtaatttctgcccataattkttgaaagcaattgttactcrtaccaagaygtcataagctgtttttatgcagtagtctggtgaaagaaaagtgaacctgaaccgaggaactctcagtcctagcgctgttttccgtctgacttcaaaatctgtgtggtcagctagcktcataatttacagctgcaaagttttcaagctatgcacttaatttttttttaatgtctggtattttgcaagctaccttgtttattgttgttattattgttgtttttgttaggagttgttgtcagtggttcatctatcarcgtctgtatttgtttgctcagctgtggtctgttgcagtgaagtgattggctttgtatacasaaagagggccaatgttgtgaamtgtgaggttaaggamaagtccaggagcataaaataatcttctttggtttttcttctcagaaagataacactgaaataaaatgaccttaggggaaatatactgaatagttagtaggtaccaatgacgaggcaattactgagccagacatatccatgtgtattatcttgtgatcaaaatcctataaagtaagagttattttttctcccttatgaatacagaacctgagtttcagaagttcaaatggaaatgatcatcctagtgatttgtgtctaacaccaatacctagggcttgcactgcactattctttctcttctaactttcttaggttaaaaaataatttcctacaatgttctattttaggttatcaaaggcaattatctttcaaaaactctgatggttcctatagtgtgttttggcagcagartcagaaaggaagcmtatggtgagacataaaaattttattttatataatataggaattacctgaggagggcttgcaaggaggtgaaggaggatagagttcagtggggatttagaagcaaagtgggtttcaaagtcaatttacrgaagagaaatagataaaactaaagatttagtgattccaattctaatgcaacaatgttccttcagtctcatgacgatttgcttagcagtctgatcccttcatgacagcccctakacatgcaccgctggttaactccaccgaagagggcacggcacgtcttactctgtgcttctcagagtcccatatagattcgggaaagtgaaattagaaggacccaaaatacctaattacatcatttctctctccatgtgcagataatctaatgggctatatacaacaggacctttgggtgcaaacatgctgaaaattacctactctaatttccacttattgctagtcataatattttcctgacccaaaggaaagggccactaacaataaagatggtttacagtagatgagttgaatgcatcctttactcaaagggaacartggtgatgaamctgtggaattgctgacattgtcacttcctctttatctaacttttgctttggtgatttgtattacagrctcagtgctcttacttttaagacaytggagagaatgaaaaaatwtgtattcattgatgaaaatgttcaaaaacagaccttaatctggctttcaagccaacagaaaacaagcggctgctttaagaatgatggccagcttttcaaccacgcctgggaggtgagagaggagaagcaccaggctttccttgttcctgggcattgcctgccttgccctgcctctggctttcctgatctggaatatgaatattcttcctgtgcctatgaaaccttctgaggcactgcagtcctgggcctgtggtgggttggtcagcagcaccattcctgctttgtgcatgtttaactacagcctggatgtgactccttctgagtctcttgtctgccttattcagtctctagtccttcccgagtcagtcctcttcagaaattaaactagaaatagaagggaggggagagaaagggaacctagaaaagaaactttcataaatttggagacagtcaatgtataaagggagggggctgtgagtgtatgaggaaggaaagtttattcctgtccatgaatggcaagaaagttctggggagaatatctagtaattcatattgtttcaatgaagcaagtttttctaagaccctctcaaggaaaaattcaaaggccaagcttgccccggggccaaagtacaaatgaggtgaagtatatccttggcaaaatccaacccttttcctgtccatatttacgtaaatccctcccttccaacttcctttctttgcagatacctgtccatctccagcccattttctatctcctttcccctcctttttttccctgtggttgctcaaaatctcctatcatggcattttagcatgctctgatggcccctgaaataccctgagcttttcttcagcatccttcctcataatcatcactcctgttcttgaaacccagaatgcatatctaatccacacactctgatatttaatttgcatgcaaattgtattcaaattgctttgtggtatttttaatgtattccaaacttattccttacaacaggaggaccctgatggagatgagctcttactccttcatagaaaaatcaaaaactttcccacgttctcttctaaaacatcttcacatctttcttcttattggattcattactggtgaatcattgctgattactgctacagtttgtctgatcttacctagtattttctctataattaaatatctgtgtgggtgggtgtctgtgtgtgttttgagttgagagaaataaaaatgcaagggaaaaatcaaagcttacactgcagaggaatggtgatcccacttgctgtaatttagatgtactgacagtcctcgtacctcatgttagtgtctaccatatgctgttatttccatcttaaacacttggtttctcagaagtatttcttttctgaagaagacaggagttgtcctttgcttaaatagataaaatgggaagcttcacaannnnnnnnnnnnnnnnnnnnacggtcctggaggaagaaaatgatattactttcaatatgacagaaggtggacacgcccccactgatattgtttctaattgcaaggtgggagaggaggatatgacacgcgatatcgcagggagtagaaacacccctgtgatactgttcttaatattcagggaggaagaggatgatattactcccaatacagatgggtgtacgccctctgtacactgagggtgtacacccgtctgtgaaacagttcataatctccggaggtctccagagggggagatgatattactcacaatatggtaaacaggctgtgagtccaccgtggatcctaagagccagggggggaagaggggctggctctcagtcaccacagcatggggggcctttatgttcaggttttgcccaagagtcagcttatttgcttctagtactagcagggtagttgctgccaaggccctccaacaggggggccatcttttagaaaccctgtctagttgtttagagacgtaggccactggcctcagccaggtccccacagtttgggttaaaagtccagctgccatcttttctctctctgaagcatacaatggaaaaggctttgtcacatcgggtagccccagggctggggctgccagaagtttttcctttaactcatgaaagccttcctgttgttgggatccccattggaaagctttccggtccccaccccctttgtgacctcatacaaaggcttggctaatactgcaaagtttggaatccacagtctacaaaaccccacagctcctaagaattctctaacctgccttctgcccttaggctccggtagattgcaaacgacctgctttctttctgatcccgggctgcgttcggacccctgtcgtatagaaaatcccaagtaaggtacctgccgtcggcagatctgagctttcttcttggacacctaatacccacagtcctccaggtgggtcctaaggatcttaggatccgcaatgggggtcttagccagtgggggaagaggggctggctctcagtccgtgcctcacggggggtgcctcccccgcctgcgatgggggtcctaagagccaggggggaaagaggggctttctctcagtctctgcctcgcggggggtgcatccccccactgcgatgggggtcctaagagtcagggggcgaagacgggctggctctcagtccccgcctcgcggggggggggcctcccccccgggatgggtgtcccaaaagccagtgggggaagaggggctgactctccgtccccgcctcgtggtgtgtacctccccccactgcgatggtggtcccaagagccaggggggaagtggggctggctctcagtccccgcctcgcatggggtgcctcctcctccctgcgatgggggccgaagagcgagaggtgaagaggggctggctctcagtccctgcctcacggggggtacctcccccgctgcgatggctgtcctaagacacgggggggaagaggagctggctctcagtacctgcctcgcgtggggtgccaagcgcctgcgatgggggtcctaagagccacggggggaagaggggcaggctctccgtccctgcctcgcggggggtgcctctccccgctgtgatgggggtcctaatagccagggggcgcagaggggctggctctcagtccccgcctcgtgtggggtgcctcccccccccgcaatgggggtcctaagagccaggggaggaagagaggctggctctcagtccctgcctcgcggggggtgcctccctcaccagcaatgggtgtcctaagagccagaggggaaggggggctggctccggtacattgcaaatgacctgctttttttctgatcccgagctgcgttcagacccctgtcggatagtaaatcccaagtaaggcaccttctgctggaagatctgagctttcttcttggacacctaaaacccacagtcctccaggtgggtgctaaggatcttagaatccgcggtgggggtcctcagccagagggggaagagggggctggctctcagtccccgcctcgtgggggatgcctccccccctgccatgggggtcctaagagccaggttgaaagaggggctggctctcagtcccagcctcgtagggggtgcctcaccccctgcgttgggtgtcttaatagccagcggggggagaggggctggctctcagtcccagccttctggggtgtgtctcaccctcctgcgatgggggtcctaatagccccggggggaaaggcgctggctctcagtccccgccccgtggggggtgcttccctcccgcgatgggggacctaagagccaggtggggaagaggggctgcctctcagtccccgcctcgcggggggtgcctcccccgcctgcgatgggggtcccaagagccggggggaaagaggggctttctctcagtctctgcctcgcggggggtgcatccctccactgcgatgggggttctaagagccagaggggaagaggggctggctctcagaacctggctcgcggggggtgcctcccgcccctgcgatgggggtcccaagagcccggggcagaagagttgctggctgtcagtccccgcctcgctgggggtgcctccccccatcgcgatgggggtcccaaaagccagtgggggaagaggggctgacactctgtccccgcctcgcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17918 - DNA, 45517 bp, Homo sapiens
tcataaactgcaaaattgagggtaagggtagtagccgagtggctgaggaatcttgactgtggcacctttagccacccacttcttcaaggtcaaggatttacagggtgacagaagctgctttttggtcaattaaggggtgcaaaggagagccaaccgcacagtgcaggggtaatgggggccttctgcactgtggatgggacgtcaaagaagcttgttttgagagtcttacattcttttaatccttggggcaacgtcaggaagtagacagttctcatcatccctactgcacagaaaggaaagtgaagctaacttttccaaggccacacaagcatccctgccccttaacctctattctaccaacctctactgagtcaattagaggagaagggagccatttgcttccactccaaggaccctcctctgtactaggccagctttccttctagaagattcttcatgcaaataggggatgtaacagggaaccacagacctctgctcaaaaccccactacccaaatcccaaactgcctgatcccaactcccctgatggacaaggacagacacttatttgcaaaccacatccccaatcaggtgccatgaccatagtagttggctgccagctctgggctctgctgcactatcgctgcaacctgcccaacagcctggctggggtcctagctgaaggtcccagcctctctggaactccgacctctcctgcacaggcttccagaatcaatccagctatgacagtcaagtttccatgtaacttttgagcaacctgcactttggagttcattacaggcaaattttttttttttttctttctgagatgaagttttgctcttgttgcccaggctggagtgcaatggcgccatcttggctcactggctcactgcaacctcctcctcccaggttcaagccattctcctgtctcagcctctggagtagctgggattacaggcatgggccaccatgcccagctaattttgtatttttagtagagatggggtttcaccatgttagtcaggctggtctccaactcctgatctcaggtgatcctcctgcctgggcctcccaaagtcctaggattacaggcatgagccaccacgccctgcccagacaaatctttttaagcacaaaagggcctacatgtatttaatctacaggacaaagtaaaagtcttatccatgttaacttagtaaccaagaagacctgcccttcactatggtaagcaaattattttcacaaaaacagttcttctagccctgtagctaaatgtacagccaaggttccaaacttttatctttgatcactaggataaattctaattttaagtctcaagattataagccagctcccaaaggtacagcctggataaacacaaacatcacttttttattcaatgagtactttctaagtacctatttattaaaacttaccatgtaccaacaacttctctaaatgctttataggtattaaactcatttaattctaacaaccttatgagttaggtgacattactaccccaatatacagaagctaaggcacagaggtaaattgcatgacccagtgatgcacagaggaggcagcaccgtgcttaggctctggagctaccatccacagcgagcttacaaatatacccaacttgccctgcacttcgccagcaaacactcgcagcacctactcaaaccatctgcctcttcacaaccagtctctttagaaaggagacttaatcaagaaaaatgccaccaatggagagagcaggcttaattatagcaaactaagggaaggaaaaaccaaacaaatcatataaatgtagtaagcccccctttgaaaggcccacttatagaacaactatgctttcttgcctacaaagcaaggtgggtcttccaacactaatgcacatccttctcccactttgcataatcttttaaaagacaccacccttctgcccagggcagggtcaggttcctctactcaggagcctccactcggtcagcttctcacagggccattgccattgaccccccaaagcagtaagttagtaactggtgaggacaaaggtctatggcacaggctgtgtttttggtcaggagctatttccctcacaacattggcaggcttaaggctccacctccttcaagtctttgcccgtaagtcacttttacaaagactatgactcccatatttaaaattgcagccaccataccacagaaactcctgtccctcttttctgctctggtgttctctttgtgcttcccaccagctcacaatgtgtttcacctatttaaatgtctgtctctacccatcagtatgcaagtttcatgagggtagggatttgggctgttttgttcactattagactctcagagctttgaagattgcctggcttaggggacacatacagctacttgttgagtaagtgaataaatacccacaaagaacagatacttgtctctaactctcagaccttcccccggttgtcaaattcaggctgcaaacttagaattccccgtgagggagaaaaggggctgttacttccaaagaaagataatttggcaactaaatccatcatgtaagtacccagtttcccacagagtagagcaggtagagaaggaatctggaatgctgaactttgttgatgtccgagctcccaggaaggcataaaaggagaataataatagaagaggacgagtcagggatagcattctcagcagggtgggaaacatgctaatgagaggaagactgtaaagaaaaagcaaagcgccagcgggggcgcagtggctcacacctgtaatcctagcactttaggaggtggaggtggacagatcacttgaggtcaggagttcaagaccagcttgaccaacatggcgaaaccccatctctactaaaaattcaaaaattagccgggcatagtagtgcatgcccgtagtcccagctacctgggaggctgaggcaggagaatcgtttgaacccaggaagtggaggttacagtgagacaacatcgtgccattgcactccagcctgagcaacagagcaagaccttgtctgaaaaataaaaagaaagaaagaaagaaaagaaaaagaaaagcttacgaaattccttttagcaagtagtaagtgctggttagaatgaaaaacatcatatactgggtgaagaccttagttttagttgagccattgccattcacccttggacaaatcacatcacttttctggcctcaaatgatttcctaatccgcaggatggaatgtgggaagtgggctggatttttaagaaattctaggaccggtgcagtggctcatgcctgtaatcccagcactttgggaggccgaggtgggtggatcacatggggtcaggagttacagaccagcctgaccaacatggtgaaagcccgtctctactaaaaatacaaaaattagccggacggggtggcacacacctgtagtctcagctactcgggaggctgaggcaggagaatcgcttgaacctgggaggtggaggttgcagtgagccaagatcatgccattgcactccagcctgggcaacaagagtgaaactctgtctcaaacaaacaaacaaactagctggacatggtggcggacgcctgtaatcccagctacttgggaggctgaggcaggagaatcgcttgaacccaggaggcagaggttgcagtgagccgagatcacgccattgtactccagtctgggcgacgagtgaaactccatctcaaaaaaaaaaattagctaggcgtgatggcgggcacctgtaatcccaggtactcaggaggctgatatgagagaattgcttgtatgcaggaggcagaggttgcagtgagccaagattggacacagcaagacttcatctcaaaaaaaaaaatagatctcaaggcagcagctaccatgtaaaaaaaaaaaaagataatgaatcattcatatatacattaactaattactgattattaatacaacatatatcgaatacttattatgtgccaggaagaattataaatgatcatctgttaggaacccatttaattctactaacatcccaatgacctagacattacttttacttaacatttgaggaaactttggcacagaaaggttaattaatttgcttaaaaccacacaagtagtaaggcaggaaacagggtttccaggtgtttaggatatagacaaaaataagacaatacatgtatttgcccttatggagttgataaacatatttaatttgctctccaattaacgaaagtatattcagtgagcacctattctcagtactggcccagatgcattattattgtactaaattatctgcactattattatgcactaaattatctcttcacaatcagtctttctaaaaggaagatttttatattaaaacaaaaagccactggaaaaggaagtaagtttgaatacaagcaaacaaaaacagaaagtaaagcagaaatacagtttagcaagccacatgttgaaaagcactaagcagtaagtattgtgatttctttttttttttttcttagacggagtttcgctcttgttgcccaggctggagtgcaatggcgcatctcagctcactgcaacctctgccccccaggttcaagtgattctcctgcctcagcctcccaagtagctgggattacagatgcctgccaccacactcggctaattttttgtatttttagtagagatggggtttcaccattttggataggctggtcttgaactccagacctcaggtgatccacccacctcggcctcccaaagtgctgggattacaggcatgagccactgggcccggacttttcaccaccgatgactttgtaattcactcaaaaacctattacaaagttaggagttacaggacaattacaatttagtaactgctgtggctggcaacagttacttacataacgggtgatgtgaaaggtcccaagagcaaactcagtaaggtcacacagaatatatctttccctccttcatctactagagggaatatatttttccctcttccttctactctcatttttcctcaccagtcacctcccagacaaaaagcagccagtgttacttcctgggagtaaagctggcaacgatacccactaattaagcattcagatgtcccgcaagggtagaacaggcagaggtcaagtggaatgcagaatattctcaggactcaggagccaaattacgtttcaagtaactctaggaccagggcagagagatggctgttagagagaagcacgagattgaagagaaaggaaaaatgtattagatttcacttagcgtatgataagactatggtatagtgggaaaagctatgagctggaaggaccctctgtcattatcagccttgtagtcttgtcaagccttgtcacctcactagtctccatctactcacctccaaattaacgggaattaagtagattggatttctgagttctgactaggggggctccaggaagccgcaactacccactctcccggcagaaagtcaccagcagctgcgcgtttgggagcatagtcggcacaggacttttccccgaagcacaggagccagcggctacagccactaggcagtccacttgcaaacgcaggttgtgcccgggttctctttctttggctgcaggtcttcaggtgttatgggcctaactcttccgctacaagtgtccctcccgcaaaaaatgggtccgggggacctgcacaccctcagagccctcgtccacagccccacactcaacaacaatgtcaggtgcttacgcggagatctccttcccgttcaggatttctgctggcgccatggcctttattagtccgctgcccacgatggacaccaccaatatcgaggttccactccctccgcagccaagcaggacaacccaacccacgtgcttagggactggccaggggatcacactactgcgcctgcgcccctgcccgcttctccccctgcagacgcggtggcgcatgcgcagttcggaaggacccgagtcccttaactaaccgagagctaacaggtcggggactgcgggacggaagagggaggggaagatgaagaaaatcggtgatgaatggctggcggaaatgattggcggaaagaaagagccagttcacagtgcgcctttgtattcggcgggaaacccggccgaagagggagctggaaaggactccggaatscggccgtaattccagccmatcagggagtagagttgcggggcggggttggggcggggmagtctcgcgggagatagtttcgcgggttcgggaggcgagwctccggtttccgcccagtctctggggacgcggtggcggggtctgaatcgcctggcttccagggagttttgggcgggtccccgcacgggagcgtggcaggcgctggactcgacagcagatgtggaactggagagcttggcgcgccctcatactttgtcacacacctacgccaccagactggggtcgggcccctccgcgttctgctctggagggcctgggtctgggcccagcatagcgcttttagaatctcctcagctgaatctgacgctcagccgtaggtgaagcttagcccgctgtttcaggccccgccgatctggaaggagtgtcagagctggagcgcgcgtggcctcatcggtgttggggtcaccccggggttgccagggctcatggagggtcgtagtctggattttgtcacccccacgtccccgccccgcagcaagtctggggttggagaactcacgcggtcttcgtaagctacatgccagttgaccctcgaggagggatgctccctccccttaagcgtccacgctggagaaggagtaagatggacaattgcctggggagcctgacagggcggtggcagctgggatgctggagaggactggccccttgtgttactgagtccaaggaatatgcttgctctgctctaggaaccgcgttcaggttacagtcatcccagtagagtcctgaagatgcgtggttcaggtcacttaggacttgaccagataccgggtttcttttacaagccgtttactactggcagagctcatctaaaactttttttgtttgtttgtttgagacggagtctcattctgtcgcccaggctggagtgcagtggcacgattttggctcactgcaacctccgcttcccgggttcaagcagttctctgcctcagcctcccgagtagctgggattacaggcaccacctaattagcccgccaccacgcccggctaatttttgtatttttagtagagacggggtttcaccatcttggcyaggmtggtcttgaactcctgacctcgtgatccacccgcctcggcctcccagagtgctgggattacaggcgtgagccaccgcacctggcctaaaactgattttttattaattttggggcttttaatatttttttcttatttctaaattctgaggttatttatagtagccccatatacgggattagataatctcttgtgattttctatttctggtaattatttctaatatatgtttttttgtttttgagacggagtctcgctatgtcgctcagggtggagtgcagtggcatgatctccgctctttgtagcctctgcctcccgggttcaaatgatcctcccacctcagccccccgagtagcttggaccacaggtgcatgccaccacgccggctaatttttctatttttggtagagttggggtttcactatgttgaccagactggtctagatctcaagggattagtctcccttggcctcccaaaatgctgggataatgggcatgagccaccgtgcgtggccttaaagttactattcttaaagtttgcacaagtgatatgttaaaggcacagacttagtaatataatgtcattataataataaccctaaaacacattgtctcatattgtgttgtacctaaacaagtgaaattaagaagaaaattgaaggaaatgtttctggtaaattgcagatagtgaatcttttgtcttatactatcaaataggtattgactattccagctttcttatttgttgaggaagatggcagaaatcccrttttacagagggatagactttgaaggataatacccaaagctgcatagctgtggctggtataggccccaaacctgatgtttcttctctaaatctactgcctttgccatctcaacagcctggtttttgacagttatctatgtatgagttgcataaatcgttcattcatggagcaaataattattgagtggccactatgccaacagcactgctatagatgctagagataccctagtgaaccagcaaagtttctgctctcagctcatattctggtggaggagacaacgatcaagttaaagaaatacataggctaattttagagattatgacatgctatattttaaaaataggcaagctaagaggataggcagtgatgctgggaggtgggaaagttttgtctcagaaatgtggtaagagatttctttgggcatctgacttcagcagaaaccttaatgaagagaggaacttggaatgtaaaagaaagaaagcagggatttgctctgagcaactggaaagatggaattgccattcgctgagttgaaataaagtaaaatgtaggactaggttttggggttaagattatgaattcggctttagacatttttagatttctcttagacatccaaatggagagaagatatttaaatccatgggattgaatgagatccaaccaagggtattgtaggtagagagaggaccaaagactgacacctagaacctttcagtgttcagaatgcaaggagacaggaggaaccaagagggaagattgaaaaggagagtccagctgggagctgtggctacacctttactaatcccagcactttgggagaccaaatacaggaagatcacttgaatccaggagtttgtagaacagccttagcaacatagcaagaccctgtctctacaaaaataaaaattaaaaaatttgcctgtaatccgagcattttggaggccgaggtgggtggatcagctgaggtcaggagtttgagaccaacttggccaacacagtgaaaccccgtctctactaaaaatacaaaaattagctgggcgtgatggctggcacctgtaatcccagctactcgggaggccgaggcaggagaatcccttgaacctaggaggcagaggttgcagtgagccgagatcacgccactgcactccagcctgggagacagagcgagactccatctcaaaataaataaataaataaaaatttaaaaagttagctgggcgtggtggcatgtacctgtagtcccagttactcagaaggctgaggtgggaggatcctgtgagcctaggagttggaaacttcagtaagctataatcatcacactgcactccaacctaggcaacagagcaagaccctgtctcttaaaaggaaaggagagtccagtgtgttctaaggaaaaccccaagagcatcccaccttagaakacaagtgaggaggcctggcatggtgtctcatgcctgtaatcccagcactttgggaggccaaggtgggtggatcacttgaggtcaggagttctagaccagcctgacaaacatggcgaaacctccgtctctataaaaatacaaaaattagccaggtgtggtagcgcgtgcctgtaatcccagctactagggaggctgaggcaggagaactgcttgaactcagggggcagagtttgcagtgagccgagatagtgccactgcactccagcctgagcaacagagtgagactctgtctcaaaaacaaacaagtaaacaaacaaaaaaaaaaaacaagacaagtgaagaatgtgtttcatggaaaaagaggtaattaattctgtcaagtgttgcaaattggtcaaataaagaatgaaaatcaacctttcacagcaaatagaaggaaaaaatatttttatttaaatgcttataaaggcagttgctagaaaaaatgtttactttttgcagaggccccgtttttacaacctttttcaggggtaatttgatatgataatatctacgggaaaaaaatgtttttttttttgagtcgctctgtcaccaggctggagtgcagtggcatgatctcggctcactgaaacctccgcctcccaggttcaagcaattcttctgcctcagcctcccaagtagctgggactacaggtgggcgccaccacacccagctaatttttgtatttttagtagagacggggtttcaccatgttggccaggatggtctcaatcttgacctcgtgatctgccttccttggcctcccaaagtgctgggattggtacaggtgtgaaccaccatacctggcccgaaaattttaaatttgtattttctttgacattgtaattccacttccaggattttttttttttggacaggattttactctgtcacccaggctggagtgcagtaacacaatcagctcactgcaaccctgaactcctgggctaaagtgatccttctgagtagttgggactataggcacatgccaccacccctgattaattaaaaaattttcctgtagagatagtcttgctatgttgcccagactggtctccaactcctggcctcaaaccatcctcccaccttgaccttccaaaacgttgggattacaggcgtgagccacctctcccagtttaggaatttatcttaaagtaatatttacatataaagaaagatgtataggctgggtgcagtggttcacgcctgtaatcccagcactttggaaggccgaggctggtggatcaactgaggtcaggagttcaagaccaacctggctaacatggcgaaaccccatctctactaaaaatacaaaaattagctgggcgtggtggccagcccctgtaatcccagctactcgggaggctgaggcaggaggatagcttaaacccaggagacgaaggttgcagtgagccaagattacaccattgcactccagcctgagcaacaaaagcgaaactccatctcaaaaaaacaaaaactaaaactaaacaaaacaaaaaaaccatgtgtaaaactgttaatcacaacactgatttcaatagcaaaaaacaaaatttctgtcaggatggatgcagttgttaaaggaacagcagatacatatgtatagacatgtaagatagctttcatacttttttttttgagatggaatttcgttcttgtcacccaggctggaatgcaatggtgagatctaggctccgcttctcaggttcaagtgattctcctgcctcagcctcctgagtaagctgggaatacaggcgcccgccaccacgcccaggtaatttttgtatgtttagtagagacagggtttcgccatattggcgaggcttgtctcaaactcctgacctcaggtgatccacccacctccaaaagtgttgggattacaggcatcacccaccacgcgtgaccagcttttatacatttttaaatgataaagacaggttaataaaatgtataatattatgttgctatatccaaaaaaaggccttctttgattacactatcaaaagttacctctccatytacatccccattactatctcattaacctgttttattcatagcacttactaccatctaaaatgactttatttctttatatttttgtttgctacctgtcttttacaccagaatttaatttttaagctttttttgtttgtttgtttgtttgtttgttttgagatggagtcttgctctgttgcccagactggagtgcagtggtgcgatctcagctcactgcaacctctgcctcctgggttcaatcaatcctcctgcctcagcctcccaagtagctgggattacaggcatgtgccaccatgcccagctaatttttgcatttttagtacagcagggtktcaccatgttggtcargctggtctcaaactcctgacctcaggagatccgtcagccttggcctcccaaagtgttgggattacaggcgtgagccacagcacccagccagaatttaaactttataagagatttcctgtcttgttcatacttatatacctgcagcttcgaaacatatatatatgtttaatatatataatagatatattttaaattatatatagagagatggagtttcactcttgttgcccagactggagtgcaatggcgtgatctcggctcaccacaacctctgccccccgggttcaagcaattctcctgcctcagcctccagagtagttggaattacaggcacgtgccaccatgcctggctaattttgtatttttagtagagacagagtttctccatgttggtcaggctggtctcgagctcttgacctcaggtagtctgcctgcctcggcctcacaaagtgctgggattacaagcatgagtcactgtgccctgccagaatttaagctttataagagatttcctgtctgtttatacttaaatacctgcagcttggaaacatatatatgtttatatgtatatattacatacattatatatatatttttatatattataattataaactcctgacctcaggtgatccacctgcctcagtctctcaaatgctgggattacaggcgtgagccaccacgccaggccagaaacatatttttaaaaatcttgttttagaggaaaaacagagtatttctttttttttttttattagatggattctcactctattgcccaggctggagtacagtggcacaatcttggctcaccgcaacctcagcctcccgggttcaagcaattctcctgcctcagcctcccgagtagttggaactataggcgtgagccaccatgccctgctaatttttgtatttttagtrcagatggggtttcactatgttggccaggctggtctcgaactcctgaccttgtgatctgcccacctcggcctcccaaagtgctgggattacaggtgtgagccactgcgcccggcctatttcttcttctctttgtttagttattatctatwactctcattcctatgaacataacttgtttctccccmcttaatttttatcatacatrattgtagacagtgggcactgtcttcaattatagtgaatttagcagtaaattcacattagaccaacttgtatagctttaaaaaatatatttatgtctaggttccacccttgaccaactaagtcagaacttgggtgggttcaaggttcattattctttgaagataagatgatgtttgaataaaattcctggtgattctggtatcaaaaatacaaatttgggacatactttttctgctgtaaaaatattttcctaaggccaggcgcagtggctcacgcctgtaatcctagcactttgggagacggaggcggcrgatcacttgaggccaggagttcaagaccagtctggccaacatggtgaaacccagtctctactaaaaatagaaaaaattagccaggcatggtggcacgtgcctgtagtcccagctactcaagaggctgaggcaggagaatcctttgaacccgggaggcagaggttgcagtgagcygatattgcagcactgcactccagcctgggtgacagatcaaaactctgtctcagaaaaaaaaaaaaaaaaaaaaagaatttcctagaattagaatcgcaggggttttttttgttttgtttgtttgtttgtttgtttgtttttgagacagagtttcactcctgtcgcccaggctggagtgcaatgccatgatctcggctcattgcaacctctgcctcctgagttcaagcaatcctcctgcctcagcctcccgaatagctgggattacaggcacctgccaccatgcccagctaatttttgtatttttagtagagactgggttttaccatgttggccaagctggtctcgaactcctgacgtcaggtgatccacccagctcattctcccaaagtgctggaattacaagcatgagccactgcactcggcctttatttatttatttatttttgagatgaagtcttgctctgttgcccaagctggagtgcaatggcatgatctcggctcactgcaacctccacctcccaggttcaagcaattctcctgcctcagccccctgagtagctgggattacaggcgtgcaccaccacgcctggctaatttttgtatttttagtagagacagggtttcactatgttggtcaggttagtctcgagctcctgacttcgtgatccgcccgcctcagccttccaaagtgttgggattacaggcgtgagccaccgcgcctggccagaatcccagttttttaacacatctaatgctttaggaatagtaaatggaaacatcatttccccttctttcgaagyacttctaccttgatgagatgtatgtattggagtacaatatttgacctagccaagaatttcacaaaagaagcccaaaatatgattttcacgtttactggactgttcacttttggkgggatcactttcttaagattacttaaagtactaatgcttgatgaaaatcatttgtgttttcacttcattaattggagaaagagctacatgtttttgttgttgttgttgttgttttgagatggtgtcttgctctgtctcccaggctggagtgcaatggcgtgatctcagctcactgcaacctccgcctcccgggttcaagcgattytcctgcctcagcctccygagtagctgggactacaggcgcctgccaccacgcccagctaatttttatacttttaatagagacagggtttcaccatattggccaggatggtctcaatctcttgaccttgtgatccacccgccttggcctcccaaagtgctgggattacaggcgtgagccactgcgcccagccagagctacaggttttactgtaacactttagaaggtcctttttctttgtacctctgtgatgtgttcacctagcaacagcttctttgatatgcaaacattctacaggcaaattgctcagagcagctactcatgttggacaattcaggtctcttctggaaactggccttgtatttggaattttctccagagtctgatgtggtaaaaatttatacttttcacttcttactaaatgcagcatagcatactacatcttttgagtgtgtaaaaaataaagtagtcatgtacaaacctaaaatcacagaataatcatgtaayggtgctatattttatttttactttagattcctaatacatttttattgtatctttataaggttagtttgggagaatagcactatcatcatctatattagttaactttgcattaaggtttttcattaaggtttttcccctgtttggttctttcattttacgatccatattttttgtgcctggtatgggatgataaagataacagaaatagctcctgtttttaggtacctttatttgtttgtttgtttggagacagggtcttactctgtcacccaggctggtggcacaatcatagcttactacagactaactcctggctcaagccatcctccacctcagcctcccaagtaactgagattacaggtgcacaccaccacctctggctaattattaaaattttcatagagacaggatctcacttggttggccagactgatctcaaactcctggtctcaagtgatcctcccaccccagcctcctgaagtactaggattgcaggcatgaaccactgccctggcctagatacatttaatgtagtagaggagatgagatttttacatagtataatattgaatgagacaacagtcaaaagaaaatcacatactataagagaagagattacccttaccttttaggaatcaagaaaactccctggaggagatggtacttgaacttatactggaggatttatatgttcatccttcttggtttatattttgtcccacacggtagcttgtttcttttttcttttttttctttttcttttttattttttgaggcagagttttgctctgttgcccaggctagagtgcagtggcgcgatctcggctcactgcaacctccrcctcctgggttcaagcgattctcctgcctcagcctccctagtagcttgtttcttagagacagtgtgagtgaaactcattaagtaaagtcaatacagcacaagtttcataaaatggtaaagaaatagaaataaaagtaaaggatgaaattcttaagaactttgtcaggccrggcgtggtggctcatgcctgtaatcccagcactttgggaggccgaggtgggtggatcacctgaggtcaggagtttgagaccagcctggccaacatggcaaaaccctgtctctctaaaaatacaaaaattagctgggcatgctggcgggtgcctataatcccagctactcgggaggctgaggcaggagaatcgcttgaacccaggaggcggaggttgcagtgagccgagatcacatcattccactccagcctgggtgccaagagcaaaaaactccatcttgaaaaataaagaaytttgtctccagtatcattcttgttctaggactgagaaacagttcattcttcattttcgtctactaaaatttaagttctttgattttcttctttaggtcttggaaaaagaattaatagagtaattttcttaggtatcaagtaatgaaaatgagaaaagagactagtctcattatagatttttttttttattcttattttattttatttgagacaaggtctcgctctgtcacccaggctggagtgtagtggctccattatggttccctgcagccttgaactcaggggcccaagcaatcctcccacctcagcatcccgagcagctgggactacaggtgcatgccaccatgcctggctaatttttgtgctttttcgtgtataaagatgagatttcgccatgttgcccaggctggtctcaaactcctgggmtcaagagatctgtccacctcagcctcctaaagcgctgagattacaggcatgagccaccacgtccagcctagagatatttatactttaatagctgcctgcaataccaatacacctagaatgaattagaagaatttgaaaacagatttcaggattagtaaaagaaagtcaagccctatgcctcctgttctacattcctcaaatcacataatcctgattttttcctcttcgtatgaaaattcctctcattttgggcctgtttgattttttgggagacaccacccagcagaaacacaccgcacttacatgcaacccctccattgcacagtttctaaatgcccccccscytttttttccattctctgatcctaaaaaaagaaatccagtggcacaatcacggatctctgcagccttgatctcttagcctcaagtgattctcctgcctcagcttcctragtagctgggaccacaggtgcttgccaccatgcccagctatttttttttctttgtttttttgtaaagatgtgtctcactatcttgcccaggctgatattgaattcctgggctcaagtgatcctcctaccttggcctcccaaagtgctgggattttatatatatatatatatatatatatatatatatatatatttccattttacttatgttaatgctttccctcttttggcatagaaaagctaataaagcttaaacttaaatggaacttgtataaacacaatatatctgatgatacctttgagagatgtcttacatttgtcttttctttcagcaaaatgtgatgccagtccctgaaatgtgtagcaatttaattatgggtagcattcttytttccctgtacttactatagtattaacttactactaatgctaagaagtttataatttttgataattcagatttggattagattaagatttatgtctatgcataattcattaaaaactttttaaaccaaattgtcaaaaaagattgtaggtaccttgtttaaagaaaatatataagctagtttcaagaattccaaaatattttttaaaagcagctctgtacatgtcgataarttatttgctcattgtaattttttgaatctgtttgtcaaagcaaatgtagacgggctcgaactcctgacctcaaatgatccacccgcctcagtctcccaaatgctggtattacaggcatgagccacygctcatggcctgttatcatttttaattgaaaattttactgagataattgtagattcacttgccattataagaaataattcagagatatcacttgtatacttagcccagtgtcccccaaaggtaaaattttgcaaaattatagtctaatgtaacagcrtgaatattgacattaatacaatccactgagtttattcagatttccccagttttacttgtattcaattgtgtgtttgtgtattaagttcgatataactagtcaatatactgaacagttctaacatcacaagtatccttcaggtagcccttttgtatccacatccacttccttctcatccccarctattgacaaccactaatcccttttccatttctaaaatgtgatttcaaaaatgttacatacttggctgggggcrgtggctcatgcctgtwatcccagcactttggatatackgtctctactaaaaatacaaaaattagctgggagtggttgtgcacacctgtaatcccaggtgcttgggaagctgaggcaggagaattgcttgaacccaggaggcagagcttgcagtgagccgagagtgtgccacttcactccagcctgggcaacagagtgagactctgtttcaaaaataaataaataaataaataaaatggtcttcatacagcctttgctgctaggaaatatagtttctaattaatgtaattttttgtcaaatacaaaatgcttctgaacgtttctggttatcaagctggtaatctttcacagtgtcctcaatttttttttctactctcttactagttctccagatcacatgcaggctattaagaaatgtgaactaacaagttaaagtagcaggacgggcgctgtggctcacacctataatcccagcactttgggaagctgaggcaggtggatcacttgaggtcaggagtttgagagcagcctggccaacaaggtgaaaccacatctctactaaaaaaaaaaaaaatttgccaggtgtggtggtgcatacctgtaatcctagctatttgggaggctgaggcatgagaatcgcttgaacccaggaggcagaggctgcggggagccaggatcatagcactgcactccagcctgggtgacagagctagaccctgtctgaaaaaaaaaaaaaatgttagtagcagcagagcacagtggctcatgcctgtaatcccaacactatgggagtctgaggcrggaggatctcttgagcttaggagttcaagaccagcctgacaacatagtaagactccatctctacaaataatcattaaaaaaattagccgggcgtagtggcacctacctgtagtcccagctactggggaggctgagatgggaggatcacctgrgcctgggaggtcaaggctgcagtgagctgtgatcgccattgtactccaaactgggtgacaagagtgagaccatgcctcaaaaataataataataaatgtataatttaaatgtgacctaacattatgaagtttttaaaaacaaaattataaatgattttaacactttctcattagctaagaaatcttcagaacaaacttttcataaaagaaacttcactgcaagagttgaagcctgagctagaaagttacaaagaaaataatgtacgacagtcgttccagataatgtccctgaaagataatatcaaggacctacagaaacttactgcttctctaaccagaattaaatatttgagaaacaccaatattcagaggcttcaaagaggcaactggaatttaactaaatgaattattgagctagaaactgtctaaggtagggatttttccagtttgttttcaaacatgtcttttgttgtaagcttgcaaatagcatatgaactccatactcctgattgatcatagaatttaaatctgcagaatttcacttaatacctgacccaacattattatattttgtattgagatataacttaaatacctcgggccaggtgtggtggctcatgcctataatcccagcactttgggaggccagggctggtgaatcacttgaggtcaggagttcaaaaccagcctggccaacatgacaaaaccctgtctctactaaaaatacaaaaaattagctgggcatggtggcatgcacctgtaatcccagctactcaggaggctgaggtagaagaatcacttgaatccaggaggtgcgagactctgtctaaaaaaaaaaaatccaatttgagatataacttacatacctcaagattcagttaaagtgtacaattcaatggttgtacaatcatcaccactgtctaatttcagaacaatttcatcacacctccccaccccccactgcaaaaaaaaacccatgcccggctgggcacggtggctcatgcctgagatcccagcactttgggaggccgagacaggcggatcacaaggtcaggagttcgagaccagcctggccaacatggcgaaaccccatctctactaactacaggcaggtgcctgtaatcccagctactcaggaggctgaggcaggagaatagcttaaatccaggaggckgaggttgtggtgagctgagatcatgccattgcactccagcctgagcagcaagagtgaaactctgtctcaaaaaaaaaaaaaaaaaaaaaaaaaagatttaatgattgacctgctggattttgaacttgcatggggcctatagcctctttcttttggccaaattctcccttttggaatgagagtatttacccaatgcctgcaattcccattatatttcggaagtcactaacttgttttgttgttgttgttgttgttgttgtttgagacagagtcttgctctgttgcccaggctggaatgcaatggcacaatctcggctcactgcaacctctgcctcccgggttcaagtgattctcctgcctcggcctcccaagtagctgagatcacaggcatgcaccaccacccccggctaatttttgtatttttagcagagatgggggtttcaccatgttggccaggctagtctccaactcctgacttcaggtgatccaccggccttggcctcccaaagtgctgggattacaggcatgagccaccgtgcccagcccgaagttactaacttgttttggattttacgggctcacaggcagaagggacttgccttgtytcagatgagactttgttctttgggcttttgagttaatgctggaatgagttagaactttgggggaactgttgggaaggcagattgtattttgaaatgtgagaaggacatgagatttgagagggcccagtgggagaatgggataaggcttgagtctgtgtccctgcccaaatctgatgtcaaagtataatccccagtgttagggcctggtgggagctgattggatcatgggggtgtatttcccctytggtgctgttctcatgatagtgagtgagttrccatgagatctggttgtttaaaagtgtgtagcacctctcacctcactctattccttctgctctggccatgtaagatgtgcctgcttccccytcaccttctgccatgattgtaagtttcctgaggcttccctagccatgcttcccatgcagcctgtggaactgtgagccaattaaacctcttttctttgtaaattacctagtctgaagcatttctttacagaagtgcaagaacagactaatacattgaacatctcttcatgtgcttattggccatgtgtatatcttctttgtagaaatacctattcatatttgttgtcccttttaaaattgggttgkctttttattgctgagttgtaagtgttctttatattttctggatactggacttttattaagtgtataatttgtaaatattttctcccaatttgtgggtcatctttccactttcctaaaagtgtcatttcaagcaaaaattttaattttgatggagttgtgtgtgtgtgtgtgtgtgkatgtgtatgtgtgtctttggtgtcatagctgagaaattattgtcaaatccaggatcatgaaagatttacatctatattttcttttaagagttatagttttggccgggcgtggtggctcatgcctgtaattccagcactttgggaggccaaggcaggtggagttcgagaccagcctggccaacatggtgaaactccgtccctactaaaaatacaaaaattagctgagcatggtggcacacgcctgtaatcccagctgctcgtgaggctgaggcagaagaatagcttgagcccgggagacagaggttgcagtgggccaaaatcatgccacggcactccagcctggccgacagactctgtctcaaaaaaaaaaaaagatttatagttttggctgggcgtggtggctcatgcctataatcccagcatttkgggaggccaaggcaggtggataactttaggccaggagtttgagaccagccgggctgacataacaaaacctgatctctactaaaagtacaaaacttaggctgggcacagtgactcatgcctgtaatcccagcactctgggaggccgagatgggcagataatttgaggccaggcattggagaccagcctggccaacatggtaaaaccctgtctctactaaaaatacaaaaatcagctgggcgtggtggcacgcacctgtaatttcagctactcgggaggctgaggcgggagaattgcttgaacccaggaggcagaggtggcagtgaattgagatcatgccactacacttcagcccgggtgatagaacgagactctgtctcaaaataacaataataataataataataataataataatagctggacatggtggtgcacacctgtagtcccagctacgtggaaggctgaagcaggagaattgcttgaacccagaaggtggaggttgcagtgagccaagattgtgccactgcactccagcctgggtgacagagcaagacaggtgtactccagactgggtgactgcaccccagcctgggtgacactgcactccagcctgggtgacagagcaactaactaactaactaactaaaactacagttagtttatatatagtttttagttaaaactatagttagtttgagccaggcgcggtgsctcacgcctgtaatcccagcactttgggaggccgaggcgggcggatcacgagaataaggagatcgagaccatcctggctaacaaggtgaaaccccgtctctactaaaaaatacaaaaaattaggcgggcgtggtggcgggcgcctgtggtcccagctagtcgggaggctgaggcaggagaatggcgtgaacccgggaggcggggcttgcagtgagccgagatcgcaccaatgcacctccagcctgggcggcagagcgagactccgtctcaaaaaaaaaaacaaaaacaaaaacaaaaaaaaagccatagtctttctaaaactatagttagtttataattaactatagttttagttataaaatataactataaagttatagttttagcacttacatttatgtctttgacttcttttggcaaatttttatgtatgatgtgaggtaggagtccagattcattgtttttcatataaatatccagttgtccttagcacctctgtggaactatcttggcattcttgccaagaatcaattgaccataaatgtatgggtttatctttgggcacccaattctatttcattggtctgtatgtctgtccttataccagcaccacactgtcttgattaatgtagctttgtagtaagttttgaaatgggtaagtgtgaaaaattccaacttaatytcatttttttcaagatcattctggctattttgggtcccttgcttttccatatgtattttaagatcagcttttccatgaacatggaatatttttccatttatttaagtcttctttaatttctttttttttttttccccgagatggcgtcatgctctgtcgtccaggctggagtgcagtggcacgatctcggctcactgcaacctctgcctcctgggttcaagcaattctcctgcctcagcctcctgaattgctaggattacagatgctcaccaccatgcccagctaatttttgtatttttagtagagacagggtttcaccatgttagccagactggtcttgaactcctgaccttgtgatccacccgccttggcctcccaaagtgctgggatwacaggcgtgagccaccgcgcctggccttctttttctttttcttagagacagggtctcactctgttacccaggctgcagtgcagtggcacaatcatagttcagtgtaatcttgaattcctgggctcaagcaatcctcctgcctcagcttcccaagtagataggactacagatgcatgcctccatgcttggctaatttttaattttttttttatatagatttggggtcttgctgtgttacccaggctggtctcaaactcctggcctcaatcaatcttactgccttggccttccaaagcactgagattacaggcatgcaccaccacacccagcctctttaaattgttttaacaatgttttgtagttttcagtgtatgtgtgttacatttcttttgttaaatttattactaatattttattccttttatgcattgtaaatgaaactgtttccatatttcattttttgattgtttatttttagagagtagaaatacaattgattcgtgtatatcagtctttgtcctgcaagcttgctgaactcacttattagctctagggtttttttggtatgtgtgtgtggtttccttgggattttctccatacaagactatgaatctgcaaatatgtgggtttttaaaaatttactattattattatttttgagatggagtcatactctgtcatccaggctggagtgcagtggcacgatcacagctcacaacaacttctgcctcccaggctcaagcaattcccctgcctcagcctcctgtagctgagattacaggagtgaaccaccatgcctgactaatttttgcatttttagtagagatggggttttgccatgttgcctaggcttgtctcaaactcctgggttcaggctacccacttgccttggcctcccaaagtgctggaattataggcgtgagccaccacacccaaatattgttgagtgtttttaatcacaaaagtgtgttggattttttgtccaatgctttttttttttttgcatcttactgaaataatcatgtgattttatcctctatagaatttgttattgttagacttattgtattagttggtatacagagagaggagatatttgataatgtgccctcagttgacaggagaaacaaagtcattaatttttcctcttataataagaataatatttgagaaactcacacaatatgaaaagctattctattcagatgtgcacactactgtagcctatttctattttgtattggttagtatgyatcaggtcatctcataggttggggctcttctgagtcttgcatttctcaaaacacttttttttcttttgctgtatttataccaagtcactttttgtttgtttgttggttggttggttggttggttggttggttggttkgttgkagtcggaatctcactctgtygccgaggctggagtgcagtagagtgatcttggctcactgcaacctctgcctcccaggttcaagcgattctcctgcctcagcctcccaagtagctgggacgacaggtgcacgccactctgcccagctaatttttgtatttttagtagagatggggtttcaccatgttggccaggctggtctcgaactcctgacctcaggcaagccacccacctcagactttcaaagtgctgggattacaggcgtaaaccactgcgcccagactactttttaaaagaaattatataggagactaaaattgaaaaaagaaacaaacctttactcagattgagatattagttaaacttaagggcctgaaacaaggaaaatggggtttgcttttttctggttgtgcagagagtgtatgaataaaaagawctcacaaagttcaagtgaaagactgattaaaagaaattcatcatccaaatatcttctcagtgttaagcaagcacatgaagttagctatagctcgacccttaacagctaatcaggtaaactcttcaactcagttttgaacgtaacatagtatactacagactttttgtttttgtcctcagagstaaagagaaacaatggctatatggcatactatgaggattaattttatatgtctacttgactgggccatagggtgcccaatatatggtcaaacattattttaggtgtttctgtgagagtgttttggataattttaacatttaaattggtatactgagtaaagcagatgatactccctattgtgagtaggcctcatccactgagttaaaggcctgaatagaacaaaaagattaaccctcccccaggtaagagcgaattcttcctgcctgatggccttcaaaatgggacatcagctctttttcctgcctttggactcaaaccattggctcttcctgggtcttgagcctgctgrcctttggactggagctacactatyagctctcttgattttcaggccttcaaacttagactcaaactacattattggctcccctgggtctcccagatcccagcagatcttgggaattgccagccttcataattgctgaggcagttcctttttttgagatgggatcttcctctgtcacccacactggagtgtagtggtacgatcatggcttactgcaacctcaaacacctgggcataagtgatgctcctgactcagcctcctgagtagcagggaccacaggcacatgccaccatgcccagctaattttttaaaaattttttgtagatacaaggtctcactttgttgcccaggctggtcttgaactgctgggctcaagctatccttccacctcagcctcccaaggtgctgggattataggcatgagccactgtgcccagccaaaagtcagaagataattgaatggcatcttaaagtgctgaaagaaaaaatactgacaacccagaatctatactcagtgaaattatccttcaaaattgaagatgaggccgggcgcggtggctcacgcctgtaatcctagcactttgggaggccgaggcgggcggatcacgaggtcaggagatcgagatcatcctggctaacatggtgaaaccccgtcagtactaaaaatacaaaaaaaattagccgggcatggtaacgggtgcctgtagtcccagctactcgggaggctgaggcgggagaatggcgtgaacccaggaggcggagcttgcagtgagccgagatcgcgccactgcactccagcctgggcgagagtgagactccgtctcaaaaaaaaaaaaaaaaaaaaaaaaaaattgaagatgaaataaacatggtttcagaagaaaaaaaaagaaatcatttattgtcagaagaactacactattaagaaacacaccaggcaatttttcaggatgaaggaaaatgatccttggtggctacagagaaatgtagggtagaataaggagtaaagaaagggtaaatagaaattaatactgacaattaatttttaaaaatcctatacaatttataatatatgaaaragtaaaacatatcagtagtacaagggcaagaaatggtaaatggagttaagctatcataagtgttttatttagggagtatcacaaaagtattaaagtagaatgtaataggccgggcggggtagctcacacctgtaatccgagtaccttgggaggctaaggagggcggatcacttgaggtcaagagttcgagatcagcctggccaacatggtgaaaccccacctctactaaaaatacaaaaattagccaggtgtggtggcacacgtctgtaatcccagctacttgggaggctgaagcatgagaatagcttgcacgtgggaggcggaggttgcagtgagccgagatcctgtcactgcactccagcctgggcgacaaagcgagactctcaaaaaaaaaaaaaaaaaargcaygtaataaatcaaatatgcattatgtaatcacaaaatccagcttaacaactaaataataatttaaaagatattaaaaacttaatatggaagaaaaatgaaataaaaaactttattaatccaaggccgggcgcggtggctcatgcctgtaatcccagcactttgggaggccgaggcgggtggaccacttgaggccaggagttccagaccagcctggccaacatgatgaaaccccgtctctactaaaaatacctgggcaaagtagagcatgcctggccgggcgcagtggctcatgcctgtaatcccagcactttgggaggctgagacrggtggatcakgaggtcaggagatcgagaccatcctggccaacatggtgaaaccctgtctctactaaaaatacaagaattaactgggcatggtggcacatgcctgtaattccagctactctggaagctgaggcaggagaattgcttgaaccagggaatcaggttgcagtgagctgagatcatgccactgcattgcaatctggcgacagagcgagattctgtctcaaaaaaaaaaaaaaaaattagagcatgcctataatctgagctactcaggaggctgagacacgagaatcacttgaacccagggcggcggaggtgcagtgagcagcgatcacaccactgcattccagcctgggcgacagagtgagactccctctcaaaaaacaaacaaacaaacaaacaaaaactttattaatccaaattaaaatggtagagtagtagtaaaggaacagagaatagatggtaaaaacaataaataacatgataaacccgacaatttcaataataactttaaagatagatggtattgtaactgcccaatgggttcaccttgcccgctgcctagacagagacgatttctcaagacaggggaattgcaatagagaaagataaattcacgcagagctggctgtatgggagaccagagttttattattactcaaatcagtatccacaagcattccgccttcagaatttttaaggacaacatgttgggtgggaggaagccagtragctgggagtgctgattggtcagagctgaaatcatagggaatggaagctgtcttcttgagctgagtcaattcctgggtggggactgcaagatcagatgagtcaggttatcaatctacgtggtgccagctgacccatcaaatgcagggtctgcaaaatatctcaagcactgatcttaggagcagtttagggagggtcagaatcttgtagcctccagctgcaagactcctaaaccataatttctaatcttgtggttaatgttagtcctaccaaggcaatctagtctccaggcaagaaggagggctgctttgggaaagggctgtcatctttgttttaaactataaactataaagtaagtttctcccaaagttagttcagcctacacccaggaatgcacaaggacagtttggaggttagaaacaagatggggtcagttaagttagatctctttcactgtctcaggcataattttgcacaggcggtttcagtataatcatttcagtacaagacaagatttwaaaaaagaaaactaatgctaagcatttttcaagaaacatactgtaggccgggtgcagtggctcacgcctgtaattccagcaccttgggaggctgaggcgggcggatcacgaggtcaggagatcgagaccatcctggctaacatggtgaaaccccgtctctactaaaaacacaaaaaaattagccgggtgtggtggygggcacctgtagtcccagctactcrggaggctgaggcaggagaatgggtcaacccaggaggcagagcttgcagtgagccaagatcctgccactgcactccagcctgggtgacagagcgagactctgtctcaaataaaaaaaaagaaggaaacatactgtagccagacgccacctatagtcccagatacttgggaggctgaggcaggaggatagcttgggaccagtttgagaccagcctgagcaacatagcaagaccctgtctccaaaatttaaaaatgtttaaaaagagatatattttacatataagaacacagaaagatgttattaaaaataaaaaaatgacatttgggtaatgtgaatattaccctaaagaaagctgcatctatgtggaactgttaccgggaatgggtcccaatctagaccccaagagagggttcttggacctyacgcaagaaagaattaggggcaaatccataaagtgaaagcaagtttattgggaaagtaaaggaataaagaatggctactccataggtagagtcacagtatgggctgcttaactgagtatactcagttatttcttgattatatgctaaacaaggggtggattattcatcagttttctggaaaaggggcaggcatttstcggaactgagggttccttctttttttagactgtatagggtaacttcctgatgttgccatggtatttataaactgtcatggccctagtgggagagtcttttarcatgctaatgcattataattagtgtataatgagcactgaggacaaccagaggtcacctttgtcaccatcttggttttggtaggtttgggctatctttatcgcattctgtttcatcagcagggtctttgtggtctgtatcttgtgctgacctcctatctcatcctgtgactaagaatgcctaagctcctgggaatgcagccagtagttctgagccttactttacccagcccctattcaagatggagttgctctggttctaatgcctctgacagaacctcctgattgtcacaatattaccagtagcagcaggcagctattcacacccaaatttcaccttaaaaagaatggcttcaaaattgacctcccccatgggaaatattgcaggacttaacacagrattgtttttctcttcatttctctacgatttctttctttctttttttttccttttttccgaggtggagtttctctctttttgcccaggctggagtgcactggtgcaatcttggctcaccacaacctctgtctccygggttcaagcaattctcctgcctcagcctcccgagtagctgggattacaggcatgcgccaccacgccaggctaattttgtatttttagtagagacggtgtttctccatgttgcaacctcaggtgacccgcccacctcggcctcccaaagtgctgggattacaggcgtgagccactgcacccagcctaccatttctttttgggacagggtcttgctgtgttgcccaggctggtttctaactcctgggctcaagcgatccactggcctcagcctcctgaagtgctgggattacaggagtsagccactgcaccaggcccatttctctaccatttctgatctctctctagaaacacttggataactgcacagctcctttcataagaaatatattttagggccrggtgtggtggcttatgcctgtaatctcagcactttgggaggccgcggcaggtggatcaaccgaggtcaggagttcaagaccagcctggccaagatggtgaaaccccatctccactaaaaatacaaaaaattagtcaggagtggtggtgcatgcctgtaatcccagctactcaggaggctgaggcaggagaatcacctgaacccaggaggcggaggttgcagtgacccaacattgcgccattgcatgccagtctgagcaacaagagtgaaactttgtctcaaaaaacaaataaacaaatgaacaaacaaacaaaaaatcattgttattcctcagagtaagagcaaagatcatcccctgcagaagcttaggaactatgcacagaactttacagaacaggggcgatgctttaactgaaggctgactactgaccagagaatggaattctgagagggctcaaggaataaaagraaactaggcagggaaagggaaggcgcccatctgaagcaaacttcagcggccatcaggatatcttgtggtggtcacaagttgtaggctctgtttttggaaggtttgggtatagcgcaggattccatttgtctacttggctacacctctgcctgaggtacactgttgccagaaaagagggtcccaatccagaccccaagagcaggttactggatcttgcacaggaaataattcaagggaagtcacacagcacagagaaaaagcaagttcatacaatgttactgagtwagttatcgccagaaagcaggaggaggaacacgccatccttgttagtgtctctatttataagaaacttatgagaagctataattaaacttggaacatgcagatgtgctcactaaaggtaggggctattggtgttatagatgaccattaatctttcaacctaagcctgctcattaatggcatctttaatraagtgggctacactcttaggacatctggacattctgcaggattggtgggagatgttctgtatggccaccaatattctgtaattataattggtggtcagcttgggatgtggctattttcagaccacaagcattaaccttacagagtgcctagctactcatttcaaggtggagtcactctggccatgttttaccaaaccagaggtctggtaaggagaggttcctctaacaccatgaggtcaacgtcactcaagttcctggccagccaaactctgaaagcaaggagtcccaaattgaggatcaagttcctccagaaatcattgctatgggtggcaaagcagtagattccctgaagccaatctcccacattgtctggaattttgggagcttcatttgcccagttggcagtgccaatggggaccccgctggaagccatagtagcacctttgggctctgcataggacttgctcaatacaccatattggagtcgttggctctttttgttattttaagttgaaatttgaagattggctgagttggtttcatgatattgttgcctactgatatcttacacagagtacgagtacatctggttgaaagagaaaaggcagagagaaaagcagactttttggagttgttgttctcaggcactaacagattcatcccttatatgcatatgaatggacaataagatttcttggatattttcatggcaaaggtgaggagaaatttttattgctttttgaagaaacatgatttttattaccttgggttattccaggagataattgataaatgttgagtagtttgttggtcttcttcttaaaggaggatcaagagaagcagtacagcatggcagactagaagcatttctgtttttttgttttgttttgtttgagatgaagtctcgctctgttgccgaggctggagtgcagtggagtgatctctgctcactgcaagctccgcctcctgggttcaagtgattctcctgcctcagcctccaaagtatctgggattacaggcatgtgccaccacgcccggctaatttttacatttctagtagagacggggtttcaccatgttagccaggctggtctcaaactcctgaccttaaatgatccacccacctcggcctcccaaagtgctgggattacaggcatgagccaccgcacctggctgaagggtcttcagtatcatctctgtgatagataaattgtttagtgggttatctacattggccattgacatctagaattagggtatgagttgggtttagaagaaggaaatgaggctggtctccaatagacagtgattcatatgataagcagaaagtgttacagaagtctggtagaggaggatgggagacagattattgtcaaggagatagtaaaagtttattttgaaatccttagactatgccgggctcagtgggtcacacctgtaatcccagcactttgggaggccgaggcgggcggatcacctgaggtcaggagttcgagaccagcctgaccaacatgaagaaactcggtctttattaaaaatacaaaattagccaggcgtggtggtgcatgcctgtaatcccagctacttgggaggctgaggcaggagaatcacttgaatctgggaggcggaggttgtggtgagccaagatcgcgccattgcactcctgcctgggcaataagggcgaaactccatctcaaaaaaaagaaagaaatccttagactataagtttgttatatratctgcatgtaaaacaaggtcctatatgactyaaataatgtgcagggttccctttaaaaagttcagcaactactttcctttttttttttttgagatggagtctcactctgtcacccaggctggagtgggttggtgcaatcttggctcactgaaacctctgcctcctgggctcaagccatcttctcacctcagcatcctcggtaatttagttgggactactggcgtgcgccaccatgcccggctaattttcctgtattttgtggagagacggggtttcaccatgttgcccaggcttgtctcaaactcctgggctcaagtgatcctcctgccttgatctcccaaagtgctaggattacaggcgtgagccaccacacctggccaatgactttcaaatttgtttaaagtaatcccaatctttatttgcctctctcaagtaattaatgataacactttctttaaaaaaaaaatgctgtcactaggctgggtgcggtggctcacatctgtaatcccagcactttgggaagccgaggcgggtggatcacctgaggtcaggagttcgagaccagcctgaccaacacggtgaaaccctgtctctactaaatacaaaaattagccaggtatggtggtgggcacctgtaattccagctacttaggaggctgaggaaggagaatcgcttgaaccccgggaggtggaggttgcattgagccgagatggcaccattgcactccagcctgggcaacaagagcaaaactgtctcaaaaaaaaaaaaaaaaaaaaaaaaaaacagaccgggcatggtggctcacacctgtaatcccagcactttgggaggcagaggcaggtggatcacctgaagtcaggagtttgagaccagcctggccaacatggcaaaaccccacctctactaaaaatacaaaaaaattagctgggcacrgtggcaggtgcctgtaatctcatctactagggaagctgaagcaggggaatcgcttgaacctgggagacggaggttgcagtgagctgaggttgtgccattgcactccagcctgggagacagagcaagactccatctcaaaaaaaaaaaaaaaaaaawgtcactaatctctaagatctctgaataactctctcagaattagagtccatacagctctgatcttttcttcttttatgctgcttgtttttccaaggcttttagtgatgcaaacttatcattactttaacaattccagctttccttytatgtcttggttttacacgacaagaagcccagaaactgaacttgcttactcagctcccgaggttgaaggtggcaagaaggtggtaagaatcctagacaggctaggcctggtggctcacgcctataatcctaacaatttgggaggccaagrcaggaggatcgcttgaggccaggagttcgagactagcctggggaacatagtgagaccctgtctctacaaaaaaaaaaaagaaaaaattagctgggtgtggtagtgcacacctgtggtcccagctactcaggaggccaagttgggaggattgcttgagcccaggaggtggaggctacagtgagcaatgatggcaccacactccaacctgggcgacacagtgagactctgtctcaaaacaaaacaaaacaaaacaaaacaaaacaaagaagatttggtagaattctcctgtgggagtttggagaaagaagtagaacattattattgtttttttcctgtcatatttctaatggaaacaggatgattacaagagtgcaggggaaaggttggggaaaagaaatgtgacttctttcacttttacattattgaaattgttatttaaattgtattctataaccataattaaatcttcataaacttttcacttaatgatcttagcattcattgatggtctttgcctgaatcttatttcaaaaggcaaggcatttcaaaaatgctgatttttaaaatttctatcatttcttatacacttattagctcacatttttctgtaatgagtttacccttatcaagtgggactctttkkttagctgctcctctaagctaattttcttgtattctcaaagcagtttctccatactatcatttcaatacctcttgctgttctagtttgctgttttgagtatgtccttgtcttacttatgtgattgactttttttttgagatggagtttctctctcgtcgcccaggctggagtgcaatggcaccatctctgctcactgcaacctccgcctcccaagttcaagcaattctcctacctcagcttcccgaataactgggattacaggcacctgccaccacacccagataatttttgtatttttagtagagacggggtttcaccatgctggtcaggctggtcttgaactcctgacctcagaggatccacccgccttggccccacaaagtgctgggattccaggcrtgagccacagtgcctggccatgactaactcattccattgagggtcttttctcctgaagttttgtgctatgacttgatatttcaaaagaagggaaatagatgtctcagtattaaatttcaaacgggaagtttaacctgtatattggcttatttagggtaagagtgaagctatcctggacaagaactttgacaggacaatactattcactctgaaggaccaaaaaatgagcagaaaatttgggataaatgtcaacaagatttgaaccctaaagaaaagcaagcatcgagttagacagacgtccatattcattcaactgggaaaataaaactgcagtcccaacatcagaatttccttggtcagttggttattgcgggacagcattcttctgcatgacagtattgtctccttaccagccacagaggaggctgtgagagagaggatttgggaaattggtgcaaatgagaaatcttggaaatctgtaagtatatagatataaaagttattctttccagtttgattyttttatgatgtagattttaatatcmgtcaatttaggaaactctgtggctctgaattatagttataattctagttttactattacagtgaaagaagagaagaggctgttcattattatattggaagtagtgtagcatgtttattaagagtgcagagccccagcatgaagcctagctctgccatttgccagctgtgtgtgctcttgggcagactacttatcctctctgtgcctcattttcatttgtgaagtaggggacggtgtgtagttcccacctcacagagtggttgcaaggaccaaatgggttaatacatgataaatgcttagtttagtgtaagttcaataaatatcaaaatagtggtatgttaaagatagtgtttacatgataacctaaaattaattgccagtttgttttaatttactggtcaagtctatcaaatgattgaatcagcatgtttaagtggatatatctcatttrtgtccagatcattttagtatattcatgactcctcactttaaaattcaaatgataataggtacagttagtcctccatatctgtggattcaaccaagtaaaaataaaaaattgcatcacaacaaggcatggtggctcacatctgtagtcccagcactttgggaggctgaggcgggtggaccgcttgaggccaggagtttgagaccagcctggccaacatgacaaaaacccatctctactaaaaatacaaaaatcagctgggtggtggtggcttgcacttgtagtcccagctactcgggaggctgagggatgagaattgcttgaacccaggaggtggaggttgcaatgggccgacatctcaccactacactctagcccgggcaacaaatcaagactgtctctttttttttttttttttgagacgaagtctcgctcagtcgcccaggctagagcgcagtggcgcaatctcggctcactgcaagctccgcctcccaggttcacgccattctcctgcctcagcctcccaagtagctgggactacaggcgcccaccaccacgcctggctaaytttttgtatttttagtagagacggggtttcaccgtgttagccaggatggtctcgatctcctgacctcgtgatccgcccgtctcggcctcccaaagtgctgggattacaagcgtgagccaccgtgcccggccaagactgtctcaaaaaaaaaaaaaaattgcatctgtactgaacatgtacagacattcttccttttcattattctctaaacaacagagtacaactatttacataacatttacgttatattaggtattataaaagtctcccgagagacagaggttgcagtgagccgagatcgcgccattgcactccagcccgggggaccagagcgagtcttcctctcaaaaaaaaaaaaaaaaaaaattgagatgatttaaagtgtacaggaggatgtgaataggttagatacaagcacaataccattttgtatcaaagacttgagtattcataaattttggcatctctaggaggttctgacaccagtctcccagggacgctagggacgcctgtatatggcttagattcagtgtgttagtgaaacctgctacacagtagcctgtttagagttccccatttttaaaaatactctgctyttttaaaattcattatacagccttatttctcagtactgactaaaatgtcttatttttatatatcgaagctttctatttattttttaaaccaatgtatacatgtcaaatcctaaaatcgcctgtattaatctacttagtaacttaatgccactccaatgtggatataaatagaacttgcacatagttttgaaactacgtagaaagcatggaggctgggtgcgtaggctcacgcctgtaatcccagcactttgggaggctaaggtgggcagatcacctgaattcaggagttcgagaccagcctgaccaatatggcaaaaccccgtctctaccaaaaatacaaaaattagcctggcatggtggcatgcacctgtagtgccagctacttgggaggctgagacaggataattgcttgaacctgggaggcggaggttaccgtgagccaacgtggcaccactgcactccagcctgggtgaaagagcgagactctgtcttaagaaagaaagaaagcgggcgggggggcggggggaagggcaagcaagcatagagcatgaggaagtttttaatgtctttttcttacagagaactaaagcctttcagcaggaaatccagatgctcactaagtgactagagcagctgcatcatctttaagaagaaggtgctcaagaatcatcccaagctgaagaaaaaagtattgggaacaaaaaagacccttgaaatgtctagaaagaaaaattgagatcaaggactttttcaagagagattagacttggacaggaagaaagtaagaatttcctgaagtataagcattcctttgataatgaaaatgattgcattttattcataactttaactttatctaatgtttgaagctgttaatactgttaatacttttctccacattgggaaaggggggaaatttgctacaaactctgaaagcttccgattttattttatttatttatttatattttttgagagagagtctcgctctgtcaccagactggagtgcagtgacgctatcttggctcactgcaacctctgcctcctgggttcaagcgattctcctgcctcagcctcccgagtagctgggactacaggcacgcgccaccatgcccagctaatttttgtatttttagtagagacgaggtttcaccattttagccaggatggtctcaatctcttgaccttatgatccacctgcctcagcctcccaaagtgctgggattacaggcatgagccactgccctggcctctgattttatttttaaaagcctcttctctctccgtatctccatgtctcttttgtgtacttatttgatgtttgttgtgagggcatctgtttacatatatatctcaatgtactttaaggagaggattagaagaaaaggagctcaaaggaataactctctttttttcttttttttcagatggagtctcactctgtcacccagggtggagtgcaatggtgtgatctcggctcactgcaacctccgcctcccaggttcaagcgattttcctgcctcagcctcccaagtagctgggattacaggtgctcaccacccgcccggctaacttttgtatttttagtagagacaaggtttcaccatgttggccagtctggtctcaaactcctgactgcaggtgatctgcctgccttggccttccaaagtgctgggattacatgtgtgagccactgtgcccggccaaaggaataactctctaatggggaaattttaggaattgtgacaggcagatataatgagcattgatgaggggccattgatgatgtctctcaataatcactgtataagtcattctcttctctactctctgcttccctgaatctgtaaggaaaaaggcagtcctaaaagttggatagaaataggtaggttgcaatacaatttattttcaggagattctctattttactacctcttcatagaattgcctatcatagccgggcacagtggctcacacctataatcctagcattttgggaggctgagacaggcggatcacgaggtcaggagattgagaccatcctggccaacatggtgaaactctgtctctactaaaaatacaataattagctggatgtggtggcacacacctataatcccagctactctggaggctgaggcaggagaattgcttgaactcaggaggcagaaattgcagtgagccaaggtagtgccgctacattgcagcctggtgacagagcaagactccatctcaagaaaagaaaaaaaaaaaaaaaaaagaattgcctatcataaccaaattacgttatagtatttctataattgctatggtccaaagtggaatcttgctcactcatttaccatttactcatttagtcttttttttttttttttttctgagactgagtctcactccatcacccaggctggagtgcagtggcgcaatctcggctcactgcaacctccacctcccaggttccaatgattctcctgcctcagcctcccgagtagctgggactataggtgtgtgccaccacacccagctaatttttgcagtttttagtagagatgcagggtttcaccatgttggccaggctggtcttgaactcctgacctcgttatctgcctgcctcagcctcccaaagtgctgggattataggcatgagccactgcgcccagccttcatttagtcttttggctcattcatttgtttatccaatatttattgagcattcagttttcttttcttttcttttttgagacggagttttgcccttgttgcctaggctggagtgcaatggcgcgatcttggctcactgcaatctctgcctcccgagctcaagcgattctcctgcctcagtctcctgagtagctgggattacaggcatgcgccaccacacctgtctaattttgtatttttagtagtgacagtgtttctccatgttgttcaggctggtctcgaactcccgacctcagatgaccagcccaccttggcctcccaaagtgctgggattacaggtgtgagccaccatgcccggcctaatagttttctttactagagttcttgggttttctggatttcactgtatattgtcaaattgtttcctaggaaataatgtatttttaaaatttcacttatttattttataaataatttgattctaaaggtggaacagtttggaccagctcatgggagaactgtctttttttttttttttttgagacagtcttgctctgcctcccaggctggaatgtggtgttaccatcacgattcactgtagcctcaacctcctaaggctcaagtgctcctcttgcctcagactcccgagtagctgggaccacaggtgcacaccactatgcccagctaatttttgtagaaatggggtctttccatgttgctcaggctggtcttgaactccttgtggctcaaatgatccgcccatctctgcctcccaaagtactggaattacagcctttatttcttttagattttcaatttactgcccctaagttgcaaaatgttctcttagaattatttttatctttgcattctgtatccattctgtatgcatatctatatattctgtatattcctcctttctaatattgtgtattttcactttctctctttcctttttaaccaggcttgcctgaggcatctattttatctttccaaagaaccagtggttctttttgagacagggtctggctctgtctattgtccaggctggagtgcagtggcatgattatggctcactgaagcctcaaccttcagggctccagtgatcctcctgcctcagcctcccagatagctggaactataggtgcacgcctccacgcctggctagctttttgaagtttttgtagagatgaggtttcgccatgttgcccaggctggtctcaaactgctgagctcaagtgattctcccgcctcggcctcccaaagtgctagtattacaggcatgattcaccgtgcctggccagttctttttttaaaatatacgttttatggcctggcacgctggctcaccctgtaatcccagcattttgggaggctgaggtgggcagatcacttgaggtcaggaattcgagaccagcctgaccaacgtggtaaaaccctgtctctactaaaaatgcaaaagttaactgggcatggtggtgtgcacctctaatctcagctacttgggaggctgaggcaggagaatcacttgaaccagggaggtggaggttgcattgagctgagattgtggcactgcactccagcctgggcaacagagcgagactgtctcaaaaataaataaataaataaataaatacacattttattagtttattttggtttatatgtaatgaatatatatagtatgtttattaaatctgcaccctactttctcttttcccttcttaagtaaatgtgctttttttgtcttttgtttttaaatcagaaaaagagtaagtactattgaatgttcctctgtagcttgtccaatagatttttataagaaatgtttcttttcactgtgttctatgtatttttgtaattttagtgttgatttccattttttggctgaaggtattcagaatttttgtttgtttgttttttgtttttgagacggagtttcactcttgttgccaaggctggagtgaagtggtgcaatctcggctcactgcaacctctgcctcccagattcaagcaattctcctgcctcagcctccctagtagctgggattacaggtgtgcaccaccatgcccagtgaatttttgtatttttagtagaggtggggtttcaccaccttggccaggctggtctcgaattcctgacctcaggtgatccccatgcctcgacctcccaaagtgctgggattacaggcgtgagccaccgcacccagcctagaatttttttaaccctttatacacacacacacacacacacacacacacacttttcaaaatcaaatataccaagagtcttttattgaaaaggagcagccctcttctgtacctctcttatttcccagagggaactctttaactcttttagctgtttctgatagtaacttccattttcctaaacaattttaaactgccttatctcgagttatctatattagacatgttgttgatttcctgttatatgatagatgaaatttcatctctcataccactttcctacctgctcctttcatcttcccaatctggttatattgatattttaagctaaatgcataatcagcatttactttaccgtgatactaaatgtttacaaaagcatgaagtactatattcttggtacattttctttcttgtattgcattttatttttcctacagttaataccttccttatattttcatacgtttaattttcagtgttcatttatcaaggtttttttcctgcctaaatctgtatcagatgatcctttagtctttaaaaatctcccattttttctctcccaaagtccttcattcccttgcttcagtctggattttactctgtgggcctgagcacagccatgatgccatgactttccttctctaatctcctggttaggtttcattgtttgccgaatcacatttcttcctcttttttggtttcctttcttattttactggaacacatcctccaatggcttcctaagaaatggtgccttggagagcgacattttttgaggtccttgtgtgaatgacaatgtctttttttgtttgaatcatcatactcaattgatagctgggtttagactttattttcacacacggacttcattgtcttctaatctctagggttgttattgaggaaaatatgccattctgattcttgttccttaatatgttatttcttgtaatggattaaaacatttaccataacttttttgtaataacattttataactaatttttttctcataataaaattaattcagctgggcatagtggctcatgtccgtaattccagcacttagggaggctgaggtgggtggatagctggaacccaggaatttgagatcagcctggacaacatggcaacaccccatctctacaaaaaatttaagaactagccaggcatggtgcacacttgtagtcccagttactggggaggcttaggtgggaggatgggttgagcacgggaggtcgaggctgcagtgtgctgtgattgcaccactgcactccagcctgagcggcagggtgagaccctgtctcaaaaaattaaaaaatcatgtgtattagtgaagatttgtaaagtagaaaataatagaaataaaattgaaatcaccagtaatcccaccattttgcgataactagtattaaatataggtatatttccctctgattattttccatgtatatttttatcatcattgagatgtacatagtttttcttaatcctgcttttttcattaactacatcattgttaatttttcttaataaatatttttgaaaacttaatttctagggaataatctatcatataataatttttcttttttgacatttgcattgtttcagttttttctattatgaataatgttgtaaagaatatctttgtgggccaggtgcggtggctcatgcctgtaatctcagcagtttgggaggccaaggtgggcggatcacctgaggtcaggagtttgcgatcagcctggccaacatggtgaaaccctgtctctactaaaaataaaaaaattagccaggcatggtgacaagcgcctgtaattccagctactcgggaagctgaggctggggaatcacttgaacctaggaggcggagattgcatttagccaagattatgccattgcactcca

SEQ ID NO: 17919 - DNA, 57444 bp, Homo sapiens
tatgttatgtttttgttttcatttgtctctaagtattttctgcttttctttgtaatttctttattgatccattggttgtttccatccctttacttttaacttctcagggtttttttttttttggtttttttttttttttgagacagagtcttcctcggtcgcccaggctggagtgcagtgatgcgatctcggctcactgcaagctccacctcctgagttcacaccattctcctgcctcagcctcccaagtagctgggactacaggtgcccaccaccatgcccggctaattttttgtatatttagtaaagacagggtttcaccatgttagccaggatggtctcgatctcctgaccttgtgatccgcccacctcagcctcgcaaagtgctgggattacaggcgcgagccaccttctcagggtttcatatgtaaagcaggtttcttgtagacatgtatagttgtgtttgtttgtttttttatttttagagatggactcttgctatgttacccaagctgaacttgaactcctagcctcaagcagtcctcccaccttggcctcctgagtagctgggactataggcacatgccaccatgcttgttgttttttgatgtactctgataatctttgtcttttcattggtgtatttgactattcacatttaaagtgattttttgatgtatttagattaatatcagccatgtttgtaattgtttcctattcattatgagtctttttctgccttctctacttttaattaagcgttttatggttttatctcctctgttagtatatcaattttatttatcttttttaaaatttctgcagttgccctggagtttacaatatacattttgaactaatctgagtcctttttcaactaactaatgtaaaaaaggtaacatttaacagattactcccgacccttccctattccctgtgacattgctgtcattattttcacttatccacatgtttatcacccagtacagtgatgatgattactttcaacagttatcttttagatgaataataataagaagaagatattttactttgtctttattccttctctagtattcttcctttctttatgtagatccacgtttctgaccttctatctgaaggaaatcttttgacatttcttgcagggcaggtctgctggtgatgagctccctcagtttttgtttgtctgaggaagtctttatttctccttcacttttgaaggataatttggctggacacataattctaggttggtggtttttttctttgaacactttagaactgtttaacttccctctgtccttgctggcatggtttctgatttctgacaagatgtcctctggaattcttttcgaattcttttccctgttcttctgtaggtccacttgcccccacccagctgctttcaagattttctcttttttttttttttgttttttgttttttgagacagagtcttgctcagccgcccaggctggagtgcagtggcgccatctcggctctctgtaaccactgtctcccaggttcaagtgatgctcctgtctcagcctcccaggtagctgggattacaggctcccgccatcatgcccggctaatttttgtattttaatagagatgaggtttcaccatgttggccaggctggtcttgaacccctgacctcaggtgatcgcctgccttggcctcccatagtgctgagattacaggcatgagccatggcacctggccaagattttctctttttctttggtattctgcaggttgaatagaatatgtcttcatgtagctttgggggtatttattccacttgatgttctctgaattctttggatctgtgctgtcagttgttaatttggagactttttagctattactacttcaactgtttctctagtctctccttccagcattccacttaccaggtgttatatctttcgaaactgtcccacaggttttggatgttttgttctattggggatattgtttctgtttttgtttttaattcttgtttctctttgccttgcagtatgggaagtttctgctgacatatcttgcagctccctgactctttccttggccgtgtcgtctcctgatgagtccatcactgatagtcttcgtttctcttagattgtttttattgccagcatttcttcccatctctctgctcacacggcccccttgttcttgcatgctgtctactttttccattagagcctttggcctaccaatcattttcaatttcctgtatgataattgccatccatgttatctccatgttcctgcaaccattcagttgtctctctcagcctctggtgagattgttgttagaccttcttctgttctgcattcctaacactctcttgcatgtttctcatctccttttctcccagttccatgttctgagaacttttttgggatcagtcctccagttaagtgattctgtagtggtgcctagcctgccacttaagtcctgattctgactatatttattatttataagttttaatttactttttttttccaaagatacttagtagctctttatattctcttgttccttgttttttttttctttctttaagcatttcacacatagttactctgtgtttgaatgaaaccttgagcatccagattcgttttctgctgatatcacctgtgatgtattatttccttttgcggatggagtatattaggaggttatgttttgctcagcttactctgtgagaaccacagccctccatagtggatgcttccctgtgagggttggcgtctgctgatgcgagagctgcctgagacctgggctcctcttgagggcctccagactgctgcccccacacgtcactgtggcgatggtgtacggctgttccttcccctcacctccacctcgcttctctcatgacctcctgatacttcttttcatcctttgcctttgtcgatagcagttggttaccaaagtgttcagtgtcatttctctcagatctagagctaagtagcccctcttacctagcaaggcccagaccaggggggaagaacggccttcaagagaagagcaaagccgagcaggtgcggctgcattttgctgctccttccacgtggcctaggagtaggaagttaacgactacagggcctgaatctataccggaacccaaggcatgtgactttgaatcctgggtctttttcatccaacacggaggatgtactgtgaaacagttggtgtactaagaaacggcctagaagtgaagacagggatgtctctaagtctccactgagaactttgcagtggagcatttgcagtggccactgggttctggccctcaggagttcagtgtatcaagtggagcctggtgacgtggtgtaaggggaggaccgggtgccaagtagccttggtcccttgttagcttcgagggccagggtgtatctttacactccctctctgggttactttgagacttaagtaaaaccactggaaacgcatttaatacagttaaaatatgattcaattaaatatagtttaaagtataagtgcagatttagattgggcaggtaaagctatgtggataatagggtcataaataggttgcaatatggggatcacattgtgatcttcgacctgcatgttcttttagagctgagattcagctcttccagcctgaaaactggcacagccaaagcaaagatggtccttcgcctctttaccaatctctgggagaaataccaaaaaacctgttaagcagaaatacagagagtctgtcatcttaaccttttcgttactggggatacaactggaactcatttttgctcggatgcttagtgttgggaacctctcacgtgtgggcctcatgactcagtctgcggctcttgctcctcatgtcttgcacccatgttccatgtccgagtgggtgtgggtggtagaggacaggcgagtcacccagctcctggataaactcagtgtgtgcgcagtggaaagcagtttgttgtgtttgcatatttgtgtcagagctttcatttaaagcaacagttttccttttctatggattacttcttttgtctcaaagtggataaaaatgcaaaacttctgctagttgaagctttgtgggtttgtataacgagtgaaattggtgttctgattcaatagcgtagtccacgttctgagagagttactttacagttatatcattggtggacttataaagtcatggtccaaaaatggtctaggtgacagacacctattttttcctgaaagaaatccataagctattgaggtcagtaggcatcttctgcaaaagcattaaagaaaatacaactttttttgttactgatccctgttacttttgtccctacaactgggcttccgtttttgagtgtgtggggttctgaatagtgtgtaaatcaaatgcgtagaatcattgccgtatgtttccaatattacagttatatagatgcattcccttattcctctaagctagacactgttcagcaaacacttattgaacacccaatatgtgccaggccctgtgctagactctaggaagacaaaaatcggttagtcttggcccctcttttcaaagagttcacagtctaaagagaagacaaaaacataatcaaaatatcaaaatgttgtgacttacagatgctaggcagaaaagtaacaccgaagagagaaaattttaaatgagcccacgggtggttttgcagaggaggtgatgctgatgaaatagggttttgaagcataagcaagagctctctgaacacacatgggtggtggagcccaggctctcagccaggcttttcaaacctgaaaccaaacaactcatggtcgtgtcttgaggagtccaggaggcacttaacgtagcttcagagccctgagagtgcttctagtcatggtttaccagctgggccggcacaatgggactgctgctcaaagctagcagtttggcatctgtcacgggcttctgccttttacaagaaggtcctcaagaccaagaagtcttctacttgttactttttgtcaattacttctcagcaaagcagctcttagcttatcgctgctttgtagaaatgggtatctattgaaatacgtttttttattttcctggctcttgtcccatggggctcccttaccaaaacaatgacttcaggccctttactgtatcctgggtggcccgtctggacctgtttattcctgctgttgagtcctgagtgtctgctctaccctcctctccccctttgccttcctgggcctgttccaggtcagtggactcgctgagctgtccagcagcccagaggggagtgcttcctctctgctccgaagcactgtggaagaagggcaaggtggaaaggtttggtcggttggtcaggtgttttgtgtccagggactctatgtctatataagtagtctctatatagtagtctctaagactattgtcctagaaaatcaaagcagtgcaccatcacactcactgaatacttactatgggccaggcagtgtgctcaactcttaccatacccctggaggtaggtatttccagattacagatgagaaaactaaagcacaaaaagattgagtgatttgcctgaggtcacacagctagcaaaagggagagctggcatccgagctcgccagactccagagcccaaaggccaagacgtgggactagagttcagatctagctgtcacctgaccgtgcctcctcatagtggagccagcagtggtagctcctggactagatgtgcagtcccagctttcatcttgatagctccagaattcctcctttccttgccaccttcactgccattgcttcatcctttctcatcccctgactaacctactcgtcctccttccgccttctggttcatccacagcattgccacaaattgatctttccacaaagctgaccaaatcatctcactctgctgtttaaatccctctgtgactccccagccccttcagaacaaagtggtacaaagttgtctttggcctggctgctgcccacactcaacctggagcctgtcagggtgtagcactgtcatccctgtacgtgcgccatccctttgctcctaacctcttcctgtcctccctctgccccagccaggccagcaggattctgccgaaccatcgcccattcttaagaaccctccagggaaccctcccrcttgagtttaaagaattcactactcatttctgcatcccagaggatgtgatgaccaggttgcccataactgggcacttctcctctccagcagacagaagtcctgctgagggagaaccgtatgtctgcccagcattagcaaggactgggggagaagggccaggacccagatgtcccacctcatcctagagcgcatataatttggggaaaggcagacatcaaaccaacaggctacaagtaggtctcgaattataactgtggtaagtgctaagagggaaaatgacggattttagtgtgttcagtgggaaggctcgccttggtcttgggtgttggttcctgggaggtgacagcaaaggcaacgccggcttctctgaggaagcgatctttaggccgaggcctgcaggatgagtgcgagtgtggtarcgagctgaggcttgcacattctagagcatggacacagcacaagcagaacttagggccaagaaggtgaataggcgtgtgccggccaaggggaggcctgtgtgtccagggctttggtgagcaggaagggtggaggtggtgggcccagctcccttggaactttgcaggccagagccttgggaagccattgctgcatcctgagcaggggagtgacatgctcgaatttacattcaacaaagatcactctggctgtagtggggagaaggactgggaagagttcgtggtgcaaatgtgcaggctgttgcactgcgccactgtgagaacatggtgctcaggatctcctaaggaggtcagcagccagggcctgttgcctggatagtggctgaggcagagggaggacccaagggggccccagcctgtgcaggagcagccagatggctagtggctcaataaatgcatggatgttggctagccagctggccagaccctgctcaccttcccttggtgccttcaacaatggtctgccccacagggcccagggcggggcttgccaatgaggcagctcctttgagaacgccctggtctttagagcacagtatacaaatttctctaggtcattagatttgtgctgtaccttgcctgggtataagaggtcagtgtaagggttttatccattttcatcagtgattccaaagttgacttattagtgatgatcattaaaatgcttgctgagattaagccgtagaaacagatcttacgacgcacatggcacactcacatgtgacccagtaggaatgtgagaagttactgagttgtctaaagtttgttcagatatactcctcaaggcatcggttgcttttcatatctacatctggttgaaatttgacctgtcgtgtacagtctcataaatcaagtccatgttttgtgagatgtgctccccctgggctgagctcagctcatggcgagcacatcccatgaggctcataatgaattgtctgtctgtagtttaactacttacctaggtaaacagaatattaattttgatatgtgattagaaaatttttttttgtaggctttaccgccagcacctgttcagaatcacacaaataagcatcaggtattcaatgcatctcttcaagaccatatttatccgagctgttttgggaatactccagagtggaatagttctaaatttataagtctttggggatcagaagtgatgaatgataagaactggaatcctggcactttcttgccagatacaatttctggtaaggaatttgttaaaactttcttgaagttttaaaataacctgagtagactgacatctttgccgtagtctcccgtggaagccctggcgcagctgtagccagctgctgctccaccacctctgtctccagtgggaggcccctcggggctgtcatcctactccatcctctcgcatctgccaccagtcggtcccactgtgtgacagagcggagcaagactctggctccatggctgcccgtcagcccggtgagccacatgggcgtggcctcagcgctgctgagggtctcgtgaccacggtcgggtgcccggccttcaattctcgagcagtggtgacagccagacctcagcccccccggtgcacaggggcaggaagaaagtgccacagttgacttaaatctgtgactcacactccttcctctggttactgcattggcgccacgtggcatctctcccctttactagctccttactccccagctgcctcagccactgaggcccagccgttacttcagtcacagggtcaggggcacctgaaaaggggctggtacctactcctcatctctgtcttcctgcggccagagctcctggcagccccacacccagcccctgcatgtgccagaacagcaggctagacttgacatcctgatctgtgcttaggaaggatttctagctgtgtgaccttgggcaagttgcttggcctctctgagcctcagtttcttcatcttcttaggatgggagtaatagtaccaacctcagaaagtaattttaagactttacgtaactttggaaagcacctagcacaggaattggcacatagtaggtgctcaatacaattttttcttagattaaaagctagttgacttagtgtcatcccagtgggatcctgacttcagtagcacccccagtatcaagtgttcagtcatcagcatgtcttttagggtttagctaagtatgattgctgtcagaagccttaattttcctgttcttctttgaagggagtgaaatattagggccaacactctcagaaacaagaccggaagcccttccacctccatctagcaatgaaacacctgcagtctcggatagtaaagagaaaaagaatgctgcaaaaaagaaatgtttatacaatttccaagatgctttcatggaagcaaataaagttgtcatggccacgtcatcagccacgtcctctgtgtcctgcacagctaccacagtgcagtccagcaacagccagttcagagtgtcatccaagagacctccttcagtaggtaaggyttgaaggctcactggccctyggggwctgcaggaaggctgggcttactgacttctcgtctttgtaactcatctttgtaactgccttttacttggcctagccagaggcgtaagtgtaattaactgcccaaaaatgctcacacacagagagctgatcccctaggactttgattagaattttagctgttgtgctagattcctctggggcttcgctgcactgtcttgcttttgtctctgtttctgttcttctgtgatttgagttagggtctcactcttgttcgcccaggctggagtgcagcagtgcagtctcagctcattacagcctctgcctcttgggttcaagcgattctccyacctcagcctcccaagtagctgggactataggtgcccaccaccacgcacggctaatttctgtattttttggtagagacggggtttcaccattttggccaggctaggaggtcattgctttctgagcatgtggcaagatttctcagaagctgctttaggaaaatgctgagcagatgtgagctgacagggctgcctgtcacccagcctagggtacagcccctggctgtcacttagggggcccaaaagcaataatgtgatcagagaccaatggcaactcagtagctggctcgaggaggcctcactagccaaagctgggacagattgagcattaaaaggaatgaggaggctgagtgtggtagctcccagcactttgggaggctgagaggggagggttgcttaagcctgggagtttgagactagcctgggcaacatagtgagaccccgtctctaaaaaaaaaaaaaaagttaaaaaaacaggaagtttgactatagcatacaaataaagtcaagaatccataaggattgggatgctcaaacagagcagtagggtgggaagctccttcttctaaaagcacacctcctctaaatgtgtaagaaggataagagtggcaagtcagcatgctgcgcccccagggtaacagctggtgcaagtatgcagcattcatggaggttaacaagggatatcagtttggggaatggagtatttctactgttcaaaagcagcacccatagggtactgacagattacagcaggatgatgggcgcttgtgttaatcaattctcacactgctatgaagaaatacccaagactggatgatttataaaggaaagagttttaattgastcacagttccacatggctagggaggcttcaggaaatttacaatcatggtggaaagcacctcttcacgggggagagaacgagtrcacggcgaagggggaagccccttataaaaccatcagctctcgtgagaactcactcactatcactagaacagcatgggggaaaccatccccacgcttcagttgtttccactgggtcccttccaccacatggggggattatgggaacaaaattcaagatgagatttgtgtggggacacaaccaaaccctatcactgggtaccgacagattacaaaggaatggtgggtgccagactctggaggaacctagcagacagtgccatgcacaccaccatgaaacagagagacactgggtgcatcccattgccacaaactcagaaggatccaacgtaatatttgcaggatttgtgcccagaacattttatccaaatctaccaagacaagacaaatccaaattggcagacaggtrgcctattaaaaatgttaagtcttgtgaaaagagaaaagggttggaagaggctgggttagtgggaaagctataatggacatgtgaaggaaattggaaaatggaatatgggttataccttagatgagagtatcctgtcagtgttaaatgccagtgaggtgatcatggtattcagcaaaatgtcaaaaaaagagagagggagggagggagggaaagaaagaaaagaaaagagaggagagagaagggaggaaatttttaagtaaaaagctcggtacagtggctcacacctgtagtcccagcactttaggtggccctggtgagaggattgcttgagcccaggggttcaggaccagcctggacaacatagtgagacactgtctcttagaaaaasgtgattttttttttttctttgagacggagtcttgctccgtcacccaggctgctggagtgcagtggtgcgatctgtgatcctcctgcatcagcctcccgcgtagctgggactacaggtatgtgccaccacgcccagctaattttttgtatttctagtagagatgcggtttcactgtgttagtcaggctggtctcgatctcctgacctcatgatccaccagcctcggcctcccaaagtgctgggattacaggcatgagccaccacgcccggccaagaaattttttttaaaaaaccaaactgtcgatgttctgaggagttcataccgaagtgttcagaggtgagtgyaacttgcagacgttcggctaaaaagtgtgtgtgcctgtaagaaataaagtttataaatatgacagaatattaggtcgtgaagatgaagcaaggtgaaggatgaatgggtactctttgtgtgttctttcagattttctacaggtttgaacatttttgaaacaaacttggcagtgactctcgcctctctaaatgcaggtgacgtgtttcatggcatcagcaaggaggaccacagacactcggccccagccgccccgaggaatagccccacgggcttggcccccctcccagcgctctcgcctgctgcgctgtcacctgctgcgctctcacctgcctccacacctcaccttgcaaatcttgcagccccatcattccccaaaacagcaaccacaactcctgggtttgtggacacacgcaagagtttctgtcctgcacccctacccccggccacagatggctccattagcgcccctccaagtgtctgcaggtgagccaagtcctgactggggacgtgggagcactttggaaaatgggtgttatgcctcactaacacagctacagaaactcccctgggaccatgcagtggaaaagtctagtgaaatgccgagggaatgcagggatgtccccagcagaggccatgggtagaggggggctcccatctcagcctgtagttttgcagagggaagagcaggggccgtgggccgccatggataggtgggccaactacgcctaaacactgacagcatcgggggtgtgcattgttttttactcattgtataagttgtatttgttatacctagggtggaatcagaggaaaatgaatgaaatgtgtatatagtaaaaacacaatacaacaaacactcaacaggtgtgtttttttgttttttgttttttttctctgagacagagtctcactctgtcgcccaggctgaagtgcagtagtgcgatctcagctcactgcaacctccacctcctgggttcaagcgattcttctgcctcagcctcccaagtagtgagactacaggcatacgccaccatgyctggctaatttttgtatttttagtagagatggggtttcaccatgttggccaggctgatctcgaactcctgacctcaagatccaccttcctyggcctcccagagtgctgggagtacagacgtgagccactgcacctggccagactttctttttaagacaaattctgttacctttgaactcgcctgtttgaagctataccccttttcgaagccccttagtatggaagctgtggtggcaggggcagtctcagaaggagtcattggagagactacgtgttcctgttcagtggcgctctgtgagcactttgagggaccgcctgcatgcatgcgcacacgccatgtctcccacgtgagcccyttgctgcttgtgtatgactccctagtaaccctgggactatgcaccctctgcgctgcctcttgtctgtgaaatgggcaggacagtgggtggtcatgtgcaacaatgtgagtcattgcctcccgggccggccacttgctgatgagcttgtatgcggttttgcagtgaccctgactgcgaagggcaccgctgcgagaatggtgtctacgacccacagcaggatgatggggacgagagtgcagatgaggacagctgctctgagcacagctccagcacctcgacctccaccaaccagaaggagggcaagtactgcgactgctgctactgcgaattctttgggcacggcggggtgagtgcatgaggtcagcgcatcatgatgtgggaagtgtgcaacacacgggctcctttgcagaaattctgtactaggttgaattcggggtatattccacttctagggtatatccattgtaaagaaacaaagaaaaatatatgcccaaagatttagccataatgattttttttcttcattttttactttgtggtttttaaggtaactggtaaatcagcagtgaggtattcctactgaatacccattggtaggaggttgttaaccatggtgtatccatatggtggaacattgtagccagcgacagcagcgttgtgtgtgtgcagttgggtttctcttgtttgaatacagagggcgttggtacacacacatacttgtccatctttccagagctgtgatttaatttatacaaccaattatcacccactgtttaagagggatgggtgacaggaatagcaggggcttatagttgttctttttctgctttagctctgtttgcatttcctaaaatgttcacatgtttttatagcaagaaatttggcagtaggattcagggctttttttggcaccaaaaaggaaacccacaaatggatggaaagatactacagacacatttattgacatgaaaagatattcacaccatgttaaataacaggtagaggccaagcatagtggcttatgcctgtaatagcagcactttgggaggctaagggagsatctcttgagcccaggaattgaagaccagcttgggcgacacaggagaccctgtctctacaaaagataaagaaaattagctgagtgtgacagcacacccctgcttgagctcaggaggtcaaggctgcagtgagctatgatcgcaccactgcactccaacctgggtgacagagcaagaccttgtctcaaaaataaataaataaataaataaataaaatacattaatcaggatttgtaattgtttccttttcagtttaaaaaatccacttatgtgcatagctatacatgctttatcaggtttttcatgaatatgtaaaatttgagagtaggtatcaaaatgccacttttgggtgacttgctgataggtttttctctttttctgctggttgttgtatttccttatttttcacaacaaatatatactacttgagtaataaaacagtttatttttggaggtgtggtctgaaatttattatattcaaaatttttaaaacttaagcataactttgttgtttttctcagcctccagctgcaccaacaagtagaaattatgcagaaatgagggaaaagcttcgcttacggctgaccaagaggaaagaggagcaacctaaaaaaatggaccagatctcagaaarggaaagcgtcgttgaccatcggagggtrgaggatttgttgcagtttataaatagctccgaaaccaaaccagtgagcagcacgcgtgcagcgaagcgagcaaggcataagcaaaggaaggcaagtgacagttctcagcacctggaggcgccaggtctgagggcatttgaaggtgccgtgccacgccagtctctaggcagggctgagccacaggaggtcggkgctctgacgtgtgttcacttgcccacaactttgttctgagagccagcctgtctctggtggcctgaactggagactggtaaaaaacttaactttgtgttttcgggaaattacttccccttttgtagaatgggtttgttcttgtgctggccatcatgagggcagcagcagacactccagctttatctgctggagaaccttcttttcgaagaaaggagccgtcaactgtagagatgatagaagaaaggcccaggtgggcttttggggcctgtgggttcagaagtgtctttgatatgagactggggcggggcacttggcacagggaagtcttctggactcaggtctgagcatgtcccccatgctgctcttgtcccactgctgttccagatgaagaccagcacatggcattgattagaggggaggaaaataagtcttcatgggaagacatgagcagttccctccttaccagagggcatggtgtgtcacaaaaagcaaatgtcaaatacaaaaaacgttagccagtcatggtggtgtacgcctgtagtcccagctactcaggaggctcaggtgggaggatcacttgaacctcagaggtggaggttgcagtgagccgagattatgccactgccctccagcctgggtgacagagtgagactgtctcaaaaaaaaagacaacttttttctcttggaggattgtctaaatgcccctatgctggagcagttccaaagagccttctggtttcagctccctaaaagtgtcaggctccaagaaccagacctcagtgagcagatgtgggctgcatgcagagggaacttgtaggttcctggggttctgacagtaggacagtggtcttgggaagaggccaggtttctgtctgcagcatggtcaggcaaaaaggtgaggaagaggacgatcccacagtggaccagagggtgggcccgatgtcctgtgttgttacttgtatcttagctgttgtgattgttctaccctcaagagctctgctcatacctcgcagtcctacagtagatttagactgactattgggcctgattgggaggctttgggggagaagccttgtcccgtgccccagaagactagagactgctggagtgcagagaacacagtgtgtcctccattcaggagcgtccagcatcggggtacccacgatggtccaaggccctgagacstcccattgggattcactggaggcctctgggacgccttcctgagttttsagggtactctccaccccaggctcttgccctctgaccttgcaggtggtctgaatccagacttgaggcccagctgaaccttagaggctgatgtcataggccctgcccagcacccagtcccacctcgagggaccacctcctggtgctttctacgctgcacccattttacagagcagctcacagatgtgtgttgaggctcactggctggctggttgttgaagggacagcaatagttgacctatggactctgtcccgtagcaggtccaaaccgggggcctgtgctggggcagccgttctgctggagaccagggcacctgccyttacatgcttgttatttgtccatatattgacaaggcacgtgtgctggatttagatcagctctgagaggatgccaactggccagtgtgtgccagcgagtgtcctgatggagttggtctctcctctgctcccgtgcaggcccacagctcactctagacactggactscaggacccatccacgaggtggctgctgggtgctgctcctgacatacacatggagaaggatgttaaataatttttacttgaattgtcaaatgaaatttttaataacataccattgttaaatttttatcataatttttaagtttttcaaaagacaagtcaatttgcctgtttaaaatattgtgaaaaataatttacacttggggagtacttttctatttctctaggagaaatgcttttggcagagtttctcataagccccagcatttctaaaggttggtggtgggtggagccgtgctcctaacactgatgactctcatctgctttctgaacacaaagaacagtttccatttgtgcccctggagtttgtgtgcatcactactcaaatgctgtctttacttgggatgaaaattaattttccatcaagttggacagtgagtcatttgctctgtcacatctgtcacactagtgaaaatatatggcacttctgtttatctgctagggtgggaagaaggaatttctagttctttactacacattgctttttgtggtgccatcacagctcattgcagcctcaacctcctggcttcaagcgattctcaaacctcagcttcccaaatagctgggaccacagtcgtgcgccctcacatccagctaattttgatactttttgtagagacggggttttgccatgttgcccaggctgctctygaactcctaggatcacaggtgtgagccactgcaccagcctggtacacatttcttacattccctgttcaagtgaatgcattagccttcgcctggaaaggtgggtttgctcagagttctggcggcacgtgtacagcctcagtactgcccgggcagtctgtggtattggttacatcatccactcggccaggcggcatgatgccctgccgcacctgtgagggggtagctgactccctggatgtgtgctttgcagctgckttgtccttggttactgtgtttagtaccaggtcaaaggctatcgggaattttttgttaactaccacccccccccccacacacacacacacaaataagtaagcatatactttagtaaatagatgaagtttaacaatcctgcagagtaagagaattggaggtgggtgtgtgttaagttttgatttattacagcctcttcagagtttatgttccatatgtgattygtttttgaaattatcttagtttttctgtatgacttaatttttagcactcactgtagtcttaaattgccttctttttgcattggcagctggaggagaaagctcgcctagaagcagaggccagggcccgggagcacctgcacctccaggaggagcagaggcggcgggaggaggaggaggatgaggaagaagaggaggatygtttcaaggaggaatttcagcggcttcaggagcttcagaagctaagagctgtaaaaaagaagaagaaggagaggccaagtaaagactgccccaagttggacatgctcactagaaatttccaggcagcaacagagtctgttcctaactctggaarcatccacaatggctcactagagcaaactgaagaaccagaaacctcttctcactccccatccaggcatatgaaccactcagagcccaggccagggctaggggctgatggggatgctgcagaccccgtcgacaccagagactccaaatttctcctccccaaggaggtgaatgggaagcagcatgagccactctcttttttcttcgacatcatgcagcaccataaagaaggaaatggcaagcagaagctgaggcagaccagcaaggccagcagcgagccagcgaggaggcccacagagccccccaaggccacagaggggcagtccaagccccgggcccagactgagtcaaaggctaaggtggtcgacctcatgtccatcacagagcagaaaagagaggagagaaaagtcaacagtaataacaataacaaaaagcagctgaaccacrtcaaggacgaaaagtcaaacccaacccctatggagcccacctctcccggtgagcatcagcagaacagcaagctggtgctggcagagtcccctcagccaaagggcaagaacaagaaaaataagaagaagaaaggagacagagtcaacaattcaattggtaaatacagaatagcgggaaggtatttctgagcgatgcctggttttccatgtgtgatgtgctagtataggaaaacactgggtttggcatgctctcgccatgtggcctccctcctgtagaaaagagcgtagaggggccaggcatggtggctcacacctgtaatcccagcactttgtgaggccagggtgggcagatcaccagaggttaagagttcgagaccagcttggccaacatgctgaaaccctgtctctactaaaaataacaaaaaaaaattagctgggcttggtggtgcacctgtaatcctagctactcggggaggctgaggcaggagaatcgcttgaacccaggaggcagagattgcagtgagccaagatcatgccgttgcactccagcgtgggtgacagagagactccatctcaaaaaatayatatagagagagagaggatttctaccccctccagttccccaactttagttccccaacatcagtatttcccatgtttgcttcgttattctctctctccctctctctcttrtttttctggacagaaggagagtcacttcatacatgatacccctttaacctaaaatacttccatgtatatttcctcaagataaagacacttataaaaccacagtacagtgatcaaaatgaagaagttgacactgatccaatgctattctctaattgtagaccttactcatgtttctccaattgtccttttaacatcctttatagcaaaaaaaaaaaaaaaaagctcttgttgtttctcctgacatgggatccaatccaggatcccatgtcgtatytctttaatttcctttccttkggatcggtttctctgtttttcatgacctttacttttttgaagagtgcagcgcatttattttttagaggatcccttggtcagggtgcatgccccatgtcttcccagtcaggttcagataccatgttttggcggcaacaccactgatgtggccagtccctgttggtatatcccaccaggaagtgggtgacggtgtctgtcccatcactggggatgggaactctgatcctsggttgagctggtctgcccattttcactacggtcaagttaatatttctcctttgctaattagtaagtgtcttatggggaaatgagtatcctgtttttattgaacattcaccgactagttgtagcatccattaatgattcttgccggaaatgtttattactgtgttgtcatatggtgatttttttttttttttgagatggagtttcgctcttgttgtccaggctggagtgcagtggcacgatctcagctcaccacaacctccgcttcccgggttcaagcgattctcctgcctcagcctctcaagtagctgggattacaggcatgcaccaccacacccggctaattttgtgtagtagagatgggatttcaccttgttggtcaggctggtctcaaactcccgacctcagttgatccgcctgcctcagcctcccaaagtgctgggattacaggcgtgagctgccacccctggcccaaatggtgaattttctaatattattctttctatatttgttacttgccattcaactgtaggaagagctttccaacctcatgtgtttttttcattcacttagttatatcaggatagatccacgaagttttacttgatgctatagatgagaatcttttacgaacactctttatgttgctgttttgattgtctgagattcggtcagtgggagccccctcggaatggctttttccttagaccatttgatgcrgccctaccagcctttaagcattttatactttgtgtcatggttcgatgctccgggctcatctcgtgtcttctctctcccagccctgaaccagccatttctccaaggagccctcctctttcttcaacagtggtgttcagaaacccagacctggacactgccatatggcattgcttttaggccctctcagtcagcagagcaggaggagtgggggtgtgagcatgtgcacacgagcgcctgccacctacacacactaattgctatgtacaagccgtgagttcccacagatatcccagccccactcctgtgctacagtgagcgttctcccttccccgtccacctttgtaactccttagacagtaagaacctggaccccatcatccatggtgcctttactgacttgctgagtcctacaacacaggtaaagggttcagaagtccctgcccttacccgatggaaaactccgggcatgctttcggtatttgttcagttctttttgtctttagcctcagggtgtggtgattacactgaatttacaaatgacttaaattagttcttttcacctttagtacaattacgttattgattgaaaacacacctgattgcgtttttccatttgtgttccatttgttttctcccctacccagttcctctttttttttaatctgttcccacccactccctgtaggtaactaatcagtttcttatttgcttttcttttttacataaaaggtagtgtattatagacataatagtgacttctgggttcttttctacttcatatattctgggaatcactgcacatcagttcgtagagattgtcctcattctttctgcagcgacacggtactccatttaaagtgtacgatgatttctgcagtcactcttctttgtgcgagcgtttaggttgtttctaatgctttggttttttgtttttgtttctgttttaaggtggagtctcactctgtcatctaggctggagtgcaatggcgcaatctcggctcactgcatcctccaccccccaggttgaagcaattctcccacctcagcctcccaagtagctgaaattacaggcacgtgccaccatacccagctaatttttgtatttttaatagagatgaggtttcaccatgttggccagattggccttgaactcctgaccttaagtgacctgcccaccttggcctcccaaagtgctgggattacaggtgtgagccaccgtgcccggactcaatgctttgttttaatcattacacccagtgctacagtaagtacttgtgtgcatatgtgtttccatattgtttggaggtgtttccttggagcactttcccagaagggagagggctgggtcaaaaggtaagtgtgttcccggtgtggtggctcacgcctgtaatcccaacactttkggaagctgaggcaggaggattacctgaggccgggaatttaagaccagcctgggcaatatagcaagaccccatctctactaaaaaaaaaaaaaaaagccacttatctgggcatggtggtgcacgcctgtagtcccagctacttgggaggctgaggcaggagaatcgctggagcccaggagtttgaggctgcggtgtgtcatgattgcaccactgcactccagcctgggtgacagagtgagaccctgtctcttaaaatttaaagcagccgggcatggtggctcacgcctgttatcccaacatgttgggaggccgagggaggcggatcacgaggtcaggagatggagaccatgctggccaacatgaaaccccgtctctactaaaaatacaaaaatcagttgggcgtggtggcacacgcctataatcccagctactcgggaggttgaggcaggataattgcttgaactggggaggtggaggttgcagtgagccgagatcacaccactgccctccagcctggcaacagagtgagactccatctcaaaaaaaaaaaaaaaaaattaaggctgggcatggtggctcacatccataatcccagcattttgagaggccaagacaggcagatcacttgaggtcagaagttcgaggccagcctgaccaacatgtggaaccctgtctctactaaaaatacaaaaattagtcgggtgtggtggcactcacctatagtctcagctactggagacaccgatgcaggaggatcacctgagcctgggaggcggaggttgcagtgagtcaagatcacgccactgcattccagtctgggcaacagagcaagaccctatctgaaaaaaaaawaaaataaaaatttttaaaaaggtaagtgctttcatagtttttttgctagctacgtccaagttctccaaaccctccagtcagcccacccaccagcagcatctgagtgcctgtttggccacagccttgcttatagagtagttgtcaggctttttaactgttgccaatccgttagctacagtaagccctcagtgtagttttcatttgcatttttctcctctaattacaatgaggtcaatatattattaagggctatttctttttgtgtgtatgaattttctattcatacctatttctcatttcttactaggtttttggtcttttcccttttgtatttaagaattttgtttttgtttttgagacggaatcttgctctgtcgcccaggctggagtgcagtggcgcgatctcggctcactgcaagctccgcctccgggggtcacgccattctcctgcttcaacctcctgagtagctgggattacaggtgcccactaccacgcccggctaatttttatatctttagtagagacggggtttcaccgtgttagccgggatggtctcaatctcctgacctcacaatccgcctgtcttggcctcccaaagtgctgggattacaggcatgagccaccgcacccagccaagaatttttttatatggtagggacattagccttttactcatgcagtatgctgcagacattctctcccagttcataagttgtcttttgactttgtrtatgcttttcagtcaggtggaaatgttcttccttttatgcggtcagcttcttgattttttattgcctctggattttgaataattgttagaaagctttacgctaacattgtgattaaagaggaacacacccatgctgccttccagtgtttgtgtagtttctttttttttcatttatatccctaatatgtttggaaatttttcttctctgtggtgtgaaatatggatccaatttctctttttccaaatggttagcgagtggtcccagcacattattattatttattcttttttttgggaagtggggtatagggtcttgctctgtcacccaggctagagtgtggtggtgcggtcatagctcactgcagcctggaactcctgggctcaagtgattctcccgcctcagcctcctgagtagctgggactacaggcacgtgccaccatgctggctaatttttttttttttagtagaaacagggtcttgctacattgccttagctggctataactcctgggctaaagcagtcctcctgcctcagcctcccacagtgctgggatyacagacgtgagctaccatgcccggccttagcaccagttattagaaagttcatcctggaccaggtgtgagggtgatggctcatgcctgtgatcccagcactttgggaggccaaagcaggaggatcattcgagcccaggagtttgagactagcctgggcaacatagtgagaccccatctctacagatattttttttaaaatagcagggcatggtggtgcacaccagtagtctcagccacttggaaggctgaggcaggaggatcacttgagcccaggtgtttgagattacaatgagctataattgtgccattgcactctagactggtctataatgagaccttgtttctacaaaaacaaaaataaataaataaaatcatcttgtcccagtgattcaagatgccacctttgtcctacaataaatttctttctttctttyttttttttttttttttttgagacagagtttcactcttgttgcccaggctggagtacaatggcatgatctcagctcactgcaacccctgcctcctgggttcaagcgattctcctgcctctgcctcccaagtagctgggattacagccatgcaccaccacacccggctaattttrtatttttagtagagacagggtttctccttgttggtcaggctggtctcaaactcccaatctcaggtgatctgcccaccttggcctcccaaagtcctgggattacaggcgtgagccaccgttcccgtcctgtcctacagtaaatttcaatatgcacttgggtctgtttctggaatttctcttcctttcctctctgtttacttgtgtcattattgcatttagttagttatttttagaggctctacatgttgtaatatctcgtagggctgttctctcctcatagcttttccagctcagtatttcccaggctatttcatgtttgtagttctatatgaactttagcatcaatgtgcctggctccatttaaaaaaagcttgttggggccgggctcacacctgtaatcccagcactttgggaggcctgggcaggcggatcacctgaggtcaggagttcgagatcagcctggccaacatggtgaaacaccatctctactaaagataaaaaaaattagccaggtgtggtggcgagcgcctgtggtcccagctgctcgggaggctgagatgggagaattgcttgaacccaggagccagaggttgcagtgagccaaggttgctccactgcgctccagccgaggcaacagagtgagactctgtctccccccacaaaaaaaaaagttgttggtatctttgtcaggattccattacacttatacattaatttagggagaattgatgtctttatgatattgatcattccttccaagaacaagggatgtttttccatttgttcaagtttactttcaggtcattcaggaatattttaaattttctcttaaatatttttcacatttcttactgagtgtatttctcagcatttaatcaccattgtttttaatttaaatgggatcttctccaccattatattttataattctgaactatccaatacagtagccattagttatatgtcattatcgagcacttgaaatgtggccagtccaaattgagaagtgttataagtgtaaaatatatactggattttgaaaacctagtgtaaataaaagaatgcaaaatatctcagtataatttttaatattggttacatgtttaaatcataatattttggatatattaaatatattactgcaattaatttcacccgtttctttaaaaaaaattttttttaatgtggctgttagaagaatcttttgtgtgtggctcagactcagatttcagattatatttcttatttttttttttttttttgaggcagagtctcactccatcacccaggctggagtgcagtggcgcaatctcggctcactgcaacctctgcctcactgcggactttatttcccaggttcaattccacctcctgggttcaagcagttctcatgccccaccctcccgagtagctggaattacaggtgccgcaccagcacactcaactaatttttgtatttttagtagagaccaggttttactatgttggccaggctagtctcgaactcctgacttcaagtgatcctcctgccttagcctcccaaagtgctgggattacaggcgtgagccactgtgcccagcctcagattgtatttctattggatagtgctgccctaactggttatttatttgtgtatgaaagctattgatttttgtttgtttgtttgtttatttcgagatggagtttcgctcttgttgcccagtctggggtacaatggtgcaatcttggctcactgcaaccttcgcctcccaggttcaagcgattgtgctgcctcagcctcccaagtagttggaattacaggcaagcaaaaccatgcccagctaattttttgtatttagtagagatagagtttcaccatgttggtcaagttggtctacaactcctgacctcaggtgatccacccatctcggcctcccaaaatgctggaattacaggcgtgagccaccacgcccggctgtatgttaactttatttttttattttttattttttttaatttttatctattttttgagatggagtttcattcttgtcgcccaggctggagtgcagtggcgcgatcttggatcactgcagcctacgccttctgggttcaagcgattttcctgcctcggcctcccaagtagctgggattacaggcgcacaccaccatgcccagctagtttttgtatttttggtagaggtggggtttcaccatgttggctaggctggtctcgaactccagacctcaagtgatctgccctccttggcctcccaaagtgctggaattaacaggtgtgagccccctcgccctgcctgtatgttaactttatatattttactttactgaattttattgtttgagtcttactgttgattctctggggttttccaggcattctattatatatgtgtacaaatagagaaagttttacttctactttttcaattcttacgcctctaattgttgkcttttacttaactgcatcttttctgatcttaacagaaatgtctctggtgtttccacattaagtaagatgttggctttagggttaaggtttatatattataagataattatttaaaattagccacattaaaaaaatttaatgttaaaaaaaaatccagcgattcctcatctcttgagtgtttttcattaggaatgggtgttatgggtgttaaacttcaaaggttttctagcatctgtggagataaccatgatgtttctccttagatgtattaatacgatgttttacattatttgatttttaagtattgaactgaacttsaattcctggaataaagctcacttgattatggtatatccttttgttttggaatctgtttacattatttaatatatttacatctatattatttttaggagagatgggtctgtgacttccgtttttgttctgtctgtattagctttgagtatcaatattatacttgcctcataaaaagaattaggaagtttttggctgggcacggtggctcatgcctataatcccagcattttggaaagccgaggaggggtgcggatcacgaggtcaggcgttcgagacaagcctggccaacatggtgaaaccccgtctctactaaaaatacaaaaatttgccaggcgtagtaacacgcacctgtaatctcagctactcragaggctgaggcaggagaatagcttgaacccgggaggtggaggttgcagtgagccgagaacacgccactgcactccagcctgggacagagagactccacctcaaaaacaaaacaaaacaaaacaaaacacaggaaattttcttgttttttacattttcagtgatctggaacaattcacattgggaccatccaggctttaaaggtttgatagaaatccctttgcaagccccctggacctggtgtgttttctgtggtccttgctagcagtcttctctcctctctggaaattattctatctctagtgaggttaattttggtaaaccatctttctgtagtaaattattcttttcaactagattttcaaatttatttgcatagatgtctgcaaggtagtctagtcatagttttaaatttctttgcaatgattattttcgcctgtcatttcttagtttgtgtatttttcctttctccctattttgcttaagttaatagtttatgtattttgttagttttttaaaatcatctgagtttattatttaggtttactgttcttcttttgtttttttttttttttctttttttttttttttgagacagagtctcgctctgtcccccaggctggagtgcagtggcgtgttctcggctcactgcagcctccacctcccgggttcaagctattctcctgcctcagcctcccgagtagctgagattataggcgcgtgttactacgcctggctaatttttgtatatttagtagagatggggtttcaccatgttagccaggatggtctccatctcctgacctcatgatccacccgccttggcctcccaaagtgctgggattacaggtgggagccactgtgcctagcttactgtttttctttacctcctttctttcttttttattttttattttaagacagagtctcactcatgttgcccaggctggagtgcagtggcacactcacagctcactgcaacctcaacttccctgggctcgggtgatcctccccactcaccttctcaagtaggtggtaccacaggtgggcaccaccacactcggctaattttttygtagtttttgtaggaacagcattttgccagattgtccaggctggtctcaaactcctggtctcaagccatctgcccacctaggcctcccaaagtgctaggattacaggcatgaaccaccgtgcccagcctaccttgttaatttctgctttcgtctttattttctttctgtgctttcttttttttttttttttttgagacagagtctcgctctttcgcccaggctggagtgcagtggtgtgatcttggctcactgcaaactccgcctcccgggttcatgccattctcctgactcagcctcccaagtagctgggactacaggcgcycrccacywcgcccggctaattttttgtattttttagtagagacggggtttcaccrtgttagccaggatggtctcgatctcctgaccttgtgatccacccaccttggcctcccaaagtgctgggattacaggcgtgagccaccacgcccggccactgtgctttcttttgttttactttcttggggttttttctaactttttaatttagaaattcagttcattttgttttttcttccatttttattgataaaagtgttcagcacgtggaactttcctctsatctttttcttaacaatatcccatggaatctgatagataatttttccttttttgtttgtttgtttgtttgttttgtttttgagatggagtctctctctgtcgcccagattggagtgcagtggcatgatctcggctcactgccacctctgcctcctgggttcaagcaattctcctgtctcagcctcccgagtagctgggattacaggcatgcaccaccacgcctggctaatttttgtatttttagtagcgacggagtttcaccatcttggccaggctggtcttgaactcctgacctcaggtgatccacccgcctctgcctcccaaagtgctgggattactggcgtgagccaccacgccgagcctccattattttttttaaagaaattctgggctgggcgctatggctcatgcctgtaatcccagcactttgggaggccgaggcgggcagatcacttgaggtcaggagttcggaaaccctgtatctactaaaaatacaaaaattagctggacgtggtggcacgtgcctgtagtcccagctactgtggaggctgaggcagaagaatcgcttgaatttgggaggcaaaggttgtggtgagctgagatggtgctgctgcactccagcctgggagacagagcgagactccatctccaaaaaaaagaaattatgtaatttccatgcgtcttttttctttcactcgatagtgtaataggcagcttttaaatttccaagaggagaaactttgttgttgttaataatttacaggtttttttcattgtgatcagagaatattgcttttgttttgcaaaacctattgatactttctgaggcccagtgtatgtcagcttttgtaactcctccatgtgtacttgatagaagtgtattttcttgggtcttggtatagagttcactgtgtgtgtgtgtatatatatgtacgtatgtatttacatatggagatacatatatgtatacacctccatgatacattaattctgttgtttagtcttctgtatatccttaytttgtgtcctcatggcctgtcttctgtggcttattattaatatgtttctgtgttttcttgcatctcctgtttccgtgttgtttggtgcacattcctgttatatatttttagttacttgtggctttttgtgttgagaagcggccacsttctggtcgtgctttgtgcctgcggcctaagtcctgctctgtctgcgttgtgactgctgcccctgctctccttcggcccatttgcctgacgagacagccttgtccttggccctttgtttccagcctttttctgagtgccttggttttaggackttctcttgtgtgaagcaaacctgaggcttgctttgtgagccaaattgaaaatcttcttttcagtcagttaagcccattcacacttagtgatataactatgtggttggtctcaaccctgtcattattttataatttctgtattttctatttactgttttgytttttgggtttttttaaaatgtgttgtggggttttttgcttttttatttaaaaaaaaaattgtggggctgggcgtggtggctcatgcctgtaatcccagcactttgggaggctgaggcaggcagatcacctgaggtcaagagttcaagaccagcctggccaagatggtgaaaccccatctctactaaaaaatacaaaaattagcccaggtgtggtggtgcatacctgtagtcctagctacttgggaggctgaggcaggagaattgcttgaacctgggaggtggaggttgcagcgagctgagattgtgccactgcactccagcctgggcgacagagctagactctgcttcaaaaaaaaaaaaaaaaaattgtccaggtgctgtggctcacgcctgtaatctcagcactttgggaggccgaggggggcagatcatgaggtcaagagatcaagaccatcctggccaacatggtgaaaaccctgtctctactaaaaatacaaaagttagccaggcgtggtggcgcgcacctgtagtcccagctactcgggaggctgaggcaggagaattgcttgaacccaggaggtggaggttgcagtgagctgagatcgtgccactgcactccagcctggcaatagagcgagactccttatcagaaaasaaaaaaaaattggggtattaggaaaatgggtgcttttttcctagtgcattcctatagacttgcataccccactcatgctccttgggcctgggttccctgtgtaccccctcgtggcctgctgtgttggcattagggggtcctctgacacccactcattgcctccacagcaggcagtgagtgaattccattctttgtgttttctctttcctgtctccctgtctctcctcttcccattttttgttggtggtgtttctgctctgtcagaacacacggtattcttaggtacacaatttactacaacagggctcccgcttgcctctgctgagtgttcccaggtgtcttcaggttggtgaagctcatcctcaggcagtggccttgagtagggccacagaattctctgagttctggagaagtaaactttgacctgttgtgttgtcaatgaacagatagtttggttggatataaaatccttggatcaactgatttctcctgtttaatatagtgtggttgttgtaaaaaaattttttcctgataccaaattggttaaagttgtgtttcctgtttttcttacaccaagattttatagactgattattctagttctagtcaggaaaagagartattagaaatctattatgacagcacttccagcagacatgccagctctttttcctcctcaagttggagctcttttcttctagaacttcttgtgggcggctgctgacatcatgctttcttagatcttcactttttgtacatctgtaaatgctccggccctctctcacccttgcttgtgcatcagtttcctgcatcagcagacggtgttctgtgcttcctttctgctgcttgagtttttaaaaatcgagactcagaatgctttcccatgccctgaagcacctctctgtacaaacatgtggagcctgctgtggctgggggctgtcctcactctccagtcacatccgctattctgtgccaggattgagctattggctgcgtttcctttaacctaatctttcccttcctcctgagtgtagattaccaaaggttgactttcccaggcctttccctgaacacacccagccttcattcctagaccacccagtcccagtggcaccagtgattgtggcctccaccccgctgtgtgccctcagggatacagttgggatccgagatagccaaggctgtcatagagcaggtccctagagagagactcctaagtgacatgtctgtgaacaaacacacttgaaagcacttgcctggtgctgtgtgagttgtcaaaaatattagctgctattatgcgagtaaaacgtgcctcatgctaccatggaaattccccagtggtagaaagaaatggagtgtttattaaaggttctgaaaaattgtcccgtgttgagggctgcagggaaatggagactcacctttaacaaagaaatgtcagtggctcctgtcctctttgttcacatcgatgaggctgaatgctgtgtgcactgcacccccccaaccccgccccagcccagatgtgtgctgctggaccctctttgatacttaaggctcacataagcctccgggaatgtattcacgattgaattagataagtgaccagaacagaacagagaagtagaaattctcaaacttgcctgagagtctaggaaattgagtaattctcaatcaatgatttccctgctatcctgcctgttttcaaagatggttgtgtaattgcagcatgaaatgtagccttggtttttgtttggaacaacttgaaagtgtttggccaggcacagtggctcacgcttgtaatcccagcactttgggaggccgaggtgggtggatcatttgaacccaggaattcaagaccagcctgggcaacatggtgaaaccctgtctctaccaaaaatataaaaattacacaggcatggtggtgtgcacgtttgatcccagctactcaggaggctgaggcaggaggattacttgagcctggaagatggaggttccagtgagccgagatcatgcctgggtgacagaatgagacttcatataaaaaaaagaaaaaagtttttgatgaaatctctggatgtcatatgggtgagatgaatgcctgggagaaccaccttcctgtagggttgatgtctgggtcctcttcctgtcaagggcacattcgagggacagccctttccttaacatgggcctgycccctgggcagcttctgctggcagctgtgctctgcctgactccaacggagacttagggcagtccctgggcttgcgtgcgarttagatttctgggaatcttcttgctaaagggctctctgatgggctgcctgtcatataatgaccagtcacatggggagtctaggttctggcaaacatgtcttctaacgggacctgaagccacagttgctttgcttagtggacatgtgagttctgcagtttccaggtcagacctgggtgttcataagcacaccaaagagatctgtcctctaaaatctcattttagaaaaaatgtttacaatttttgaagttgtttaaattgagcgaagacaaatgatttcttccgttctgataagatagcctgctgctgtaatttgacttgctgcttctcttttgttttacagatgatgtctttctacctaaagatattgacctagacagtgtggatatggatgagacagagagggaagtggaatatttcaaaaggtaaatgtggaggctgtgtctgaaaccgtggtgactgtgtgcttgccatacatgtttggttttctgtctttccatggcacttctagttgtcttggacgaagttacatcaagcaagccagacaacatggcttctgaagagccttgtagtaggacaggccagccacacacacccctcccatactcccaacactcacacaatcacttctgctccccctcacatgctagaaaaatagttgatggcagtggcttcccccccacccttccccgccaactggctgttgcgcttctgaggcggtggctctccaggtgtcctgggccagcagcgtctcctggggatacaggcccctacttagacctgtcggatcagattctgggaaggggccggcatctacgttcttgacagccttccgggtgaccctcacatatgctgatggttgaacacactggagtggtatgcttttgagaagaaaagtaacattttacatacttgctgttttcctgatgggcaagttttatcagtgcttgttctataatgttttaactactatgtgaattattaatggcaacaaaattttatttattttatttttaagagggaatctcactctatcacccaggctggagtgcagtggcacgatctcagctcactgcaacctctgcctcccgggttcaagcaattctcctgcctcagcctccagactagctgggattacaggcgcccacaaccacaccaagctgatttttgtatttcagtagagacagggtttcaccgtggttaccagactggtctcaaactcctgacctcaggtgatacacctgccttagcctcccaaagtgctgtgattacaggcgtgagccaccgcgcccagcctatttatttcattttttttattttttgagacagagtctctgtcacccaggctagagtgcaatgttgtgatctgggctcactgcaatccccacctcctacgttcaagcgattctcctgcctcagcctcctgactaactaggattacaggggcctgccaccacgcctggctaatttttgtatttttggtggaaacagggttttgctatgttggccaggcaggtctcaaactcttgactttaagtgatgcactcacctcagcctcccaaagtgctgagattacaggtgtgattaagcgtgcatttgtattataataaaaacaacaaaactggactagaggctgcgcctggtggctcacacctgtaatcccaacactttgggaggccaagacaggcagatcacttgatcaggtcaggagttcgagacgagcctggccaacatggtgaaaccccgtctctactaaaaatacaaaaattacctggacgtggtgacaagagcctgtaatcccagctactcaggaggctgaggcaggagaattgcttgaacctgggaggcacaggttgcagtgagccgacatagcaccattgcactccagcctgggaaacagagagagactttgtctcaggaaaaaaaaaaaaaaaaagccaggcatgcacttgtagtccaagctactcaggaggctgaggccagaggatcacttgaacctaggagtttgaggttgcagtgaactatgatcacggcacttgcactctagcctgggcaacagagcaagaccctgtctgaaaaaaaaaaaaaaaaattccccgagtagctgggattacaggcgcctgccaccacacccagctaatttttttatttttagtagagacgaggtttcaccatgttggccaggctaatcttgaactcctgacctcaggtgatccacccccccttggcctcccaaagtcctgggattacaggtgtgaaccaccacgcccagactgtcaaaatttttaaatacacagamctaaaaagataattaaaacattgcatatgaaaacctgcgggatatcgaaaaacgttaactttttagagctgtttatgtaaggctataattgcctaaattagtttttaaaaatcctgaaacataatgagttaaagatttcacttgagaaattaggaaaagaacaatagaayaaaccaaagaatatataaagaaggagataagagagataatgaaatagaaaacaaagatttggtagagaagatcaacaaagctaaaatatgattgattgaaaacaccaaataaatctttaggagacagattaagaataatagagaaaaaaagacacaaaaaatagcataattagatggaagaagaattaagatgttgataaytatcaaagtcaggtgatggctatgttcattatgctatactatctgtttttgtgtgtgtttgaaaatgtcagtaattaaaaaaaaaaaaagttttgtccgggtgctgtggttcatgcctgtagtcccagcacttcgggaagccmagacaggcggatcacttgaggtcagttcaagaccagcctgggcaacatggtgaaatcctgtctctacaaaaaatacaaaaaaagtaagccagatatggtggcatgcgcctgtagtcccagctactcaggaggctgaggtgggaggatgggttgagcctgagaggtggaggttgcagtgagccaagattgtgcatctaccctccaacctgggtgacgagagccctgtctcaaaaataaatttttttttttaagtgtgtaaatatataagtgaaaaggaggaaataactacagatactggagagattaaaataagagaacactgggaacaacttcattacaattgactttaaaactatgaaatgcaaaatcaacctgaggtaaaaatagcctgaatggtccagtaactactaaagaaatgaaaacaatagctgtaagtctcagtgagaaaactacattttaacagttttaccgagaattctaccaaactttcagactttgaaagaatggattatccagtcttgagcaaactctaccagtgaatttaaatgagtgagacatcacacacacaagtgaatactccctactttgttttatgagacaagtaaaattctgataccaaaatctgcccaaaacaataccagaaaaaatgaaaaatcacaggtttatctcactcatattagattcaaaaatcctaaagaaaatattctccaggaggctgaggcaggagaattgcttgaacccaggaggcagaggttgcggtgagttgagatcacgccattgaactccaatctgggcaactagagcaagactccgtctcaaaaatattctcatacctacatcagtgtaattttcaaaaaaaagaaacaatataccaaatcgagcagtgtattttaaaaagcagtataccatgagcaaattggtttatcccaggaacgcaaatagtgtttcatattagaaaatccactttattggccaagcgtggtggctcacgcctgtaatcccagaactttgggaggcccaggcgggcggatcacctgaggttgggagtttgagatcagcctgaccaacatggagaaaccccatctctactaaaaatacaaaattagccaggcatcgtagcgcatgcctgtaatcccagctactcgggaggctaaggcaggagaatcacttgaacctgggaggcggaggttgtggtgagccaagattgcaccattgtactccagcctgggcaacagagagacactctcaaaaaaaaaaaaaaaaaatcctccttccttcctccctccctccctccctccctcccttccttccttctgacagggtctcactcttgtcacctaggcttgagtgccatgacacaatcactgttcactgcagccttgacctccccagggtcaagcagtcctcccacctcagccctccaagtagccgggactacaggcacatgcaccatgcctggctaattttttttttcttcttttkgtagagacggggtttcgccacattgcccaggctggtctcgaactcctggcctcaagtgatctgcccacctcagcctcccaaagcgccagaattacaggtgtgagccccygcacccagctagaaaatccactaatgttagttgctacattaatatattaaagaagagccatatgatcatggcttagtagatcatggatcagtagatttccaaaaaaagtattttatattcaaccttaaattgtaattcctaggctaaaggagtataaaagaggaactaaaaatcaattttacaggtgatctaattgtctacataggaaatataaaagaacttacagcaaggggctaactgtgtaggatcagtacagaagttatttgcttttgttttttgtttttaaacagagcacggtggctcacacctgtaatttcaacattttgtgaggctgaggtggaaggatcacttgagcccaggagtttgagaccagcctgagcaacatagcaagatactgtctctacaaaaaataaaataattagccaggtgtggtgacatgcacctgtggtcccagctactcaggaggctgaagtggcaggatcccttaaacccaggagaccaaggctacagtgagccaagatgcaccactgtgctccagcttgggcaacagtgagactctgtctaaaaaaaaaaaaaaaacagttatttttctctatacccacaccacaaataattggaaatgtagctcaaaagagcatttataatagcaccaaaatctctcactatccacagataaatctggcaaaagttgcataagacttgtatacaaaagactgaaactttattggaaaacattaaagaagatctaaatcacagagattcattatccaaagacaggaagggttagtatcataaaagctgtcaaggaccgggcatagtggctcatgcctgtaatcccagtgctaggagaccgaggcaagaggattgcttgaagccaggagtttgagaccaacctggacaacatagaccacaactctacaagaaaattaaaaattagccaggcgtgggccgggcgcggtggttcatgcctgtaatcccagcactttgggaggccgaggcaggtggatcacgaggccaggagctcgaaaccatcctggctaacacggtgaaaccccgtctctactaaaaatacaaaaaattagccaggcgtggtggcgggcacctgtagtcccagctactcgggaggctgaggcaggagaatggcgtgaacctgggaggcagagcttgcagtgagccgagattgcaccactgcactccagcctgggcaacagagcaagactccgtctcaaaaaaaaaaaaaaaaaaaaaaaaaaaaagccaggcatggtggtrcatgcctgtagtcccagctactcaggaaattgacacaggagtatcccttgagctcaggagtttgaagcttcagtgagctatgcttacgccacctcactccagcytaarcaatagagagatcctttctccaaaaaaattaaaacaaaaggcaaaccattaggattmcacagcaagcttttgamcactaaactacaaagaggtcttcagcctgaccaaggagccccatggcaagaccagaggaggtgctgctgcttcatgggtttgcagctagcgagccctccctctctcctgctggaggaaggtgtgaagcgacgggagtccctaaccactgctccggggagcataactgttaaattactttggaaaagagtttggcagactctagcaaaattgaagttgtgcctcccgtgcaaccccacaaacagctgcacacttgtgtgcacgacyagaggttctcctgcatgtcccgggggcggggcaaacgtgaggcaagcagcagcatctgtctgttcactgccatgtgttcataccgcagtgaagacgaacagactgtcacctcatggagaactctcacagacataacattgagtgaaataagaagctgtaagaccatgtacatacagtgcagttccctcgatatgaggccacacagcacaaccatactaacatttaggatgtcatagagaagtcacgaaattaccaagaactatggtgaactaattactccaaaccctagggctgtgactacctcttgggagaggacagcacggcgccacggttagcaktgtcaggttttgtgacctgggggtgctgtgactcaggattctccctgctggttatgtggctgtcctgtgtgtcagacaccgtgtgcatgtctcacgtagtctgcagtcgacaaaacaggcctgatgcagaggccactgtgtctcgggtgcaggtggtgtggggagggacaaagccaggtcacactgggcctgggaccttagagagcagcgtgagctctgtgcccatgctgcaagaacctgtggaagctgtgcagtggtttggattggatttcttccttgaatggcttggagcaggaatgtggttgatgttcttgagcattctattccagctgctgtgtccagaaggggctgggggacagggtcacacatgcactaatggaaacaggattagtgattgtcagagttaggaggggacagcagaggcagaaggtaacatcacaaactcagggcttgaccagctagggacagggaaagagaatttggattctgggagatgacacagtcagcccttccagtttaggggagtgaggggatcagtctcatagaggctgcaaggcaagaacgctgttgggcattcacgaatgtttgtggttgaataaacaagccacagtttaagcaaccataattaaacctaatggatgggtgacagtaataaccattttcaggtttcattcaagtttagagacaaataagtaagtaagtaagagacagggttttgccacattgcccaggctggtctggaactctggagctcagaggattctcaaaccttccagagtgctgggattgcaggaatgagccaccacacctggtccagtgtttcaattttgcttacaaaagtatactttaggccgggcgcagtggctcgcacctgtaatcccagcactttgggaggccaaggcaggaggatcacgaggtcaggagatcgagaccatcctggctaacacggtgaaaccccacctctactaaaaatacaaaaaaattagccgggtgtggtggcaggtgcctgtagtcccagctagtcaggaggctgaggcaggagaatggcgtgaatccaggaggcggaagttgcagtgagccaacatcacgccactgcactccagcctgggcaacagagcgagactctgtctcaaaccaaaaaacagtatcctttaggccaggcacggtggctcatgcctgtaatcccactttgggaggccaaggcgggtggatcatgaggtcaggagttcaagaccattctggccaaagatgttgaaaccccctctctactgaaaatacaaaaattagcaagatgtggtggtgggtgcctgtaatcccagctgctcgggaggctgaggcagagatttgcttgaacccaggaggcggaggttgcagtgagttgagatcgtgccactgcactccagcctgggcaacagagcaagactccgtctcaaaaaaaaaaaaagtttgaagtaaaaaagactaatttagaatttaaaatttgattttaggaagtatgtcagatatcaaaggtttaaaacacttgatatcaaaataagatcatcacaaaagaagttattcatttaaccaaactaataattcaaaggtttcaaaaagcaaaaacctttatgttttgataggagactctggttttggagggttggggtttctgggttttttgtttgtttgttttgttttgtttttttgagacagggtctcactccattgtccaggcagtggtgcaatcacggctcactgcagccttgaccaccaggcccaggtgatctttccacctcagcctcctgggtagctgggaccacaggcgtgctccaccacccgctgcctgagactcagttttctcaacagtcagaagacataatgaaaatggcatgaggccaacagaatgtcttttttttttttttcagcttactcaaaagataattgacaaagtattttattatctcttattaatactacatgaaatcttattgaaaagagaaaaccagttgcatcagtgtattactattaattgtagtaaaatcttttaaacagatccatctaatttcaatcagctttgaccacacaggatttccataaatcttttataacctcttagaattttcccattcacttccttttcccaactttctatattcatttattttcttttccatctgtttttcaacttaagaccacttttaaataacctctaaactagtcaaaatcactttttcctttgacaaaaccacatcctcatgtttttcttataaccttccttaccaaaacacatcttactttttcttatgtattttatatgtagaactgttttcctgcttatctctactttgagttaccatgttagtcagaattttagcttttagtaaccttaaattatagtgaaaacttaagaaataagcaattattaatattttgtttatctgaaataagccaggcacagcgttcacaccttgtaatcccagctctttgggaggctgaggtggaggatcacttgagcccaggagtttgaggtgtgagctgcgattgtgccgctgcactccagcttgggagatagagtgagaccctgtctcaaaaaccaaacagaggataaagaatttaagctttccagtcaatgaagctttacattattggcagaaatcatgtcaacaaacagaaaagcgggctgagaaagtgcatatcgttatcaagggttacggaagagaggaattcagtcaactgagaaggtttttttattatgaattttttaactttttgagatggagttttgctcttgtcacccagactggagtgcaattggtgcaatctcggctcactgcaacctccgccttccagattcaagtgattctcctgcctcagcttcctgagtagcctctattacaggcacccaccaccatgcccagctaatttttttgtgtttttagtagagacagagtttcaccatgttggccaggctggcctctaactcctgagctcaggtaatccacctacctccgcctcccaaagtgctgggattacaggcgtgagccaccacacctggccctgtctctattttttaattaaattaaaaactatatatatatgtatgtatatacacacacatatatatggtgcttgcctgggcaacacagcaagacgtcatctctacaaaaagtaaaatcagctgggcatggtggcacactactgtagtagttccagctacctgggaagctcaggttggggagggtcgcttgagcccaggaggtcgaggttgcagtgagctgtgatcgtaccactgcactccagcctgggcaacagagtaagaccctgtctccaaaaaaaaaaaaaaaaaaaaaaaaaagtaatcacaccagagaggcagtgaaatgtgagagcgggtacatcctaccccttcccccacctcaagctgagtaatccacctgctgtattgtatagactctagatagagtgtggccaaagtagctgtaaattaacctcttaatgttgtcatagggataactcatatcctgtagttcaacagtttatagccaatcactatcaatataatttctgtaaagcaatgagaattcttgacaactttttttttttttttaaggcaatagtcttgctctgtcacccaggccggagtgcagtggtatgatcttggctcactggacccttgacctcccaggctcacttgatcctcccacctcagcctcctgactagctgggactacaggcgtgggccaccaatctcagctaatttttatttttatttttattttattattattattttttgagatggagtctcgctctggcgcccaggctggagtgcagtggcgcgatttcggctcactgcaagctccgcctcccaagttcacgccattctcctgcctcaggctcctgagtagctgcgactacaggcgcccgccaccacgcctggcaattttttttgtatttttagtagagacggggtttcaccgtgttagccaggatggtctcgatctcccgacctcgtgatccgcccatctcagcctcccaaagtactgggattacaggcgtgagccaccacgcccagcctcagctaatttttaaaatgtttagtagagacagttctcattatgttgtccagggtggtctcaaactcctggattcaagtgatctatctgcctcggccttccaaacgttgggattagaggcgtgagccaccaagcctggccctgataaacaacttttgtaatcacctcctctcctaatttgttctttttttcttaaaaacttgagttgttctttctaacccccttccctttctaaagaggcaagagatttgggtttcagggaaaaaaaagggaaactgccttctctggccttgcttcacagcatgggatccgggtcccggtactggcagtttggctccgttcctcctgtggcttctttttttttggcctaaattacacagcatgcttttaaaattgctgcttcctactgtttgtaattcagaccttttttcctccttaaatttgtgaccaaggccaggtacagtggctcatgcctgtaatcccaatactttgggaagccgaggcgggtggatcacttgagggtcaggggtttgagaccatcctggccgacatggtgaaaccccacctttactaaaaataccaaaaaaaaaaaaaaaaaaaaaaaaaagccgggtgtggtggtgcacatctgtagtcccagctactctggagtctgaggcaggagaatctcttgaacccaggaagaggaggttgtagtgagcccagatcgtgccattacactccagcctgggcaacaagagcaaaactccgtcccaaaaaaaaaaaaaaaaaaaattgtgaccagccgggcgcagtggctcctgcctgtaatcccactactttgggaggccaaagcgggcggatcacgaggtcaagagatagagaccattctggccaacatrgtgaaaccccgtttctactaaaagtacaaaaattagctgggcgtggtggtgctcgcctgtagtcctagctactctggaggctgaggcaggagaatcgcttgaaccccggaggcggaggttgcaatgagccgagatcgcgtcactgcactccagcctggcaacagcaagactccgtctcaaaaaaaaaaaaattgtgaccaattgctgttagttttaaactggtgcatgaaggtgagttctctccctggccctcaagagatttggaagtttgttttagagagtgctctcagtcacttaaggatgtaaatcttacttacttatttatttattattttttgagacacagtctctcactctgtcatccagggaattagcagcattcccgctgagactggatttgaaacaaagttacagttccttagagccactacagatttctttcctcaatggatacctttagcttaggataaccactaataggaattaatttgaatttacttgaaattatttatgactcttgaccatttgggatacccatttgtcatcttttctactaaaggaaactaaaatattgctctctcaaatactgggtattgttgagctgaagacagagtgcaggggctctctctacctctcctttgtttgcctaaaggtaggacataaatccttttttactgaagacagctactccgcagcccacagatggtgccagtggggcagaggaatctgtgagcagactttaaaccccaaaagactttctaaaaatgaagtctcagttcaggccgaagtgaagtggcttgatcacagttcattgctgggactacagatgcgccaccatgcctagctaattaaaaaaaaaaaaattattttatttattttttttttgagatggagttttgctctagttgcccaggcacgatcttggctcaccgcaacctccgcctgccgggttcaagcgatgctcctgcctcagcatcctgggtagctgggattacaggcatgcgtcaccacgcctggctaattttgtatttttagtagaggcagggtttctccatgttggtcaggctggtctcgaactcccgacctcgggtgatctgcccaccttacctcggcctcccaaagtgctgggattacaggcgtgagctgccacacccggcccaattttttttttttttttttttttttttggtagagaaggcatctctttatgttgcccaggctggcctctgagtatctttccacctcagtcttccaaagtactaggattacaagcatgaactacctccccagcccaaccccacaggtttaccttccctcatttttggcactagtcccatgggcagtttcgtttttctattttcctgtctctttaaatcttccacctggcatttgtgcatagactgtcagctgagaagctgagaccttagaaaatatggcctgacagatgtggcttgcaccctattcgcagctagcaagactttctttaagctgttcttgagaggggcctggggctgaaattttgttccctcttcagagaccttggttaaagccataaagggattcttaattttggtctcatgcatgtctgtgtgtgttggctttgagtcgtttgtgcaggtatgcccttgaatgattataaatttctggtttatatttagaatatgataggggttttttgttgttttgtttagccttctcctaagctaaatgaaaccatatactcagaaagtaaacagtttattaaaacattcaaagacaaacagctttaaatagtggttaccctagacctctaataagcaaatatgttccmcctccaaaacttttttttttttttttttttttttttggtgggagcacaaagtctggttctgtccgtccaggccgtagtgcagtggcgcattctcagyttgttacagtgggtagctagtcaggtgtgagcagggcaggggagggcctcctccatccaccagggatgtcaggtgaccatcaggtgatggttaggcagttgtcacactgcctctctaaaataataattggtcatagccagcaccagggaaactgaagctggtgatcagcagcttcccgataagatctcaggaattgggcaagtgggctcaagcatgtgcactaaggcacagaatggtggagtttaactggtgtgtgaccttccaggtactttacaccgggaagggaagatcgcctcaggtgagcatgcgcatgctccagtaaacacactacgcatgctccctcccaagtgctagcaggccagtgtgtgtgcaggcagcccaccccaagggaggaattgsgagaagggacgcgaggccctgaagtatgccaacacctagaaccctacatcagaggccggatggggcacttgcctctcgagttgcccacttggcctcttccaagtgcactttccttccttttgtttctgctctagagctttgtaatgaacttccactcctgttctaaaacttgcctcagtctcttcttctgccttatggcctttggtcagattctttcgtctgaggaggcaataattgaggctgctgcagacacatacggattcgccaccggcaactcaggtacctgccaccggcaacaggctcgctcagcctctgcccaccaggctgaagccatgctcccaccacagcctcccgagtagctaggaccacaggtgtgcgccaccacacctggctaatttttgtgtttttttgtagagatgaggttttaccatgttgcccaggctggccttgaacttgtaagctcaagtgatccacgcacctcagcctcccaaagtgctgggattataggcatgagccaccacagcaaggctttattatttttgagacgggtctcacctttgtcacccaggctggagtgcgggggcaccatcacagctcactgcagccttgacctcccaggctcaaggatcctcccacctcagccccgagcagctgggactataggcacatatgtgtactgccactcctggctaactttttactttttgtaaagatggagtctcactgtgttgcacgggctggtctcaaacgcctgggttcaagtgattctccaacctcagcctcccaaagtagtaggaaaacaggcatgagccaccatggccagcttcagatctcctctttggtgtcagtttcaggaaggaaaaaccaagaaacaagaatgttgactatttgcctggctaagacctgacacaggaatccttttaaacagctttagagttgaaagttgacttaattagaagctgatatttaggatatatgtgtatacaattttttcgaggcctctgctttctataaaagcttcttggaggccgggcgcggtggctcacgactgtaatcccagcattttgcgaggccgaggagggcagatcacaaggtcaggatattgagagcatcctggctaacatggtgaaaccccatctctactaaaaatagaagaaattagctgggcgtggtgataggtgcctgtagtcccagctacttgggaggctgaggcaggagaatggcatgaacctgggaggcgaaggttgcagtgaaccgagatcacgccactgcactccagcctgggcgacagagcaagactccgtgtcaagaaaaaaaaaaaagcttcttggccagggaagaagctacaaaaaatacaaaaattagctgggtgttgtggtatgcacctgtagtcctaactatttgggaagctgaggcaggagaatcgcttgaacctgggaggcagaggttrcagtgagccaagatcgtgccactgcactccagcctgggtgacagagactccatttgaaaaaaattaaaaattagctaggtgtggccaggcacagtggctcacgcctgtaatcccagcactttgggaggccraggcaggcggatcactttaggtcaggagtacagatcagcctggtcaacatggtgaaaccctctttctactaaaaatacaaaaatcagctggacgtggtggtgggcacctgtaatcccagctacttgggaggctgaggcaggagaatcacttcaacgtgggaggcggaggcttcagtgagctgagattgtgccattgcactctagcctggatgacaagagcgaaactccttctcaaaaaaaaaaaaaaaaaaaaaaaaaaamccggtgtggtggtacatgcctgtagtcctagctacttgggaggctgaggcagagaattgcttgaaccttggaggtggaggttgcagtgagccgaaactgccactgaactccagcctgggcaagagagtgagaccctgtctcaaaaaaaaaaggatttcaccatgttgcccaggctggtctcgaactcctaagttgaagtgatttgccctcctcagcctcccaaagtgctgggattacaggtatgagccaccacaccctgcctgggcctgataatttaagggsgctcacagctctcagattaaacgtttcttttctttctcaggactccttccgcccacccattcctcctcccgagtcctttccccttctcaagtgcagcctgtagcagggcctggaggggacccttgacactgtgcccctcaccgagaatctaaacccctgaccccgcagtgagtttctggcaagaacaggagtgtgatgggctttgccaagcaccagcttggttgtgggctgtttccttcagtgactgtttggctttttgtctttgcaggttctgcttggattctgctagacagacccgacaaagactgtctatcaactggtccaattttagcttgaaaaaagccacctttgctgcccactgaatgaggactccctggagagggacacgcgagaggcaggccaggctgcaccaccccaagagccacgcccctcgctggcgccccagagccgtggtgcttgccaagggctgtgcggagctggtgctgcctgaaaccccagaccgagaagttgatgctcggcccacgccgttagctcgtgtgcgtgtagtctgtgcgtgagactccttcgattgtagctctgtgctgtcggattggaacagtagttcccgccaagtcctcccaccaccgcggcctcggaggcctgggccgtggccagataggagtttgcatcatccacgtggctccgttgcctctgcattgcgccctgtcctgtcatgtgtcctcaccggggtatcggccgtcactcagctctcctgtgcccctgcgtctcaccctaggcgggctgggcggggcaggcctcctttgttctccacaatctactgtctccgagtgtacacgttgcgctgtttgtgtttgatccccctgacttgtagccagcttgtgtaagatcccttgcagaaygagaaagttaaaaacaagcccacccagtactcacaccatcaartctgttatagagtgtacgactgtattaacacggaggcctgcctggctacttttttaamatattgttaagtaatattaaaatcatgtctttctttttgaaagatggaatacattagtacagcaggagacctcggctgcttctttctgctgggggagtggggggatagcgggagagggcgtgtaggtgatgtgtccgccatggggagccagggcaccaccccggagcaggtcccaggtctctccaggcaacggctcacccatcctggtgcccccaccatcctctgtgtgccaggcagagcaggcagcaggagacagaaagctcccaaggagctgcatcctggttacttcttactacctagaacactcagtagctcccacttctcccagcctcatgttcagcctgtctctgtgtgccctatcagagtatgacttcactctgagtgaaggtgaakagggcagggcctggttggggagagggtagggagagccagcttctggaggtattcggacgatgaggccacaggatttcctggtggacaggatgcaggtaggagaaagaggtgaagacctgcgctgtgtgcctggaggtgggactggagaccagttctggatggtgagtctgggatgtccaccggccacccaggtgagaggtctggaactggggactgctgttcatggacagagcctgtgtgagggccctgcaggggtgagtagatgggatgggggcccgagctgtggaaccaggaaggcagaggagggtgaggaggcttcgaggcaggtcaggggagacaaggcccagggcacccccacccaggcaccggtttgcaggagaatgaggtggggacagcaggtcctagaactctggagattgcacgaaagctggaaaagggtcaccaaccaggggaggtgcagcacgacgaactttcctcacttgtttttttttccaggtgtgaggaagagaacgttcctttgttcgtgggatgatagggcagagagtgaagcaggtcaggccatgaccacggcaacagtagtgtccttgaaaccccagtgcaggcccccgggactccagccgctgcctcttctggctgcggtggtggctggggaaaggcccaggcccgggcctcgccctatggggaagctgcctgcccaggcccccagtacctgccctgctctccccatggacagcctttaacactgtgctgaaccatgcctgttgctgaggggaactgcacagccctgagtggtgatggggaactctgggtgccccgacacactaagcatcatgctgggacctagagaccctcagacgcccaccgcacatgcccagttctgggcactcccatcacctccatggcaaccctgcctgcggcttcacagctctgcccgctctggcccctgacctgcacctgctagctttggccctcaggctcccagccattgtcctggccatgcccttgccaggaaggatcttcctctatttccctggaaaccactcatccttccagcatcccagggtgcttataggacatccagctccagggtccctgacttgatgggagcccctggggttcctgatgacatcacttccctgtgggggagggtggggccgccataggggagcctcacatttttgactcacacagtagcacagggtgagtatcccttatcccttatctggcatcctcagtaccagaagtgtgtccagtttcagacttttttggatttggagtatttacatcatgcttaccaattgagcatttctaatccaaaaatctgaaatccaaaatgctccaatgagcatttccttggagcatcatcttaacactcaaaaggatttgaattttggaacctttcgggttaggcatactcaacctgtaatagtcatgaaatgaaacaataacaatagttagaaaggaaactttaacagtgaacagttgtattgagaagcttactgttttctgcaccctcagctctgagccctgctcagagattttgcctgggtagagaaacaggcagtaaaacagatagctcctaatctcttcccaaagaaactgactttgtttgcaacaaagaatgaagaggttcaagcctgaaggcactcagaaacagtggaggccatgaaaccctgggaagagagacaagatgcaggctcagctacaggccagatagtttgcaggaggtaactgaagaaaagagctgggagaaggcatccaggggtcagaaggaatatcacacagtgttcccagaaactctctcttcaaaggagtcagaatttgattggatttgtttgtagagcatggtgccccagggcattgttgaaaacaatagaattggcaattagtggtttaatgaatgtggtcagggaaagaggaagagaactctaccaaaatgactgtcatcccagggtgactgtgggcatacgcaaagctacacaccctgaggagcaacatcatagctggaatactagtgggtagtagaaagaaaacaatgatataataaggctgcatcaaatgaatatagaaattattttaaaggaaccaaatggaaattatggaatctgaaaagttacgtgtgtatatatatacacacacatatatatacacacacacatatatatacacacacacagagagagacagatggagtcttgctctgtcacccaggctggagtgcagtggcaccattttggctcactgcaacctccaactcctgggttcaagtgattctcctgtctcagcctccgcagtagctgggactatagttacacaccaccatgcctggctaatttttgtattttttgttgagacggtgtttcactgtgttggtcaggctggtctcaaactcctgacctcaggtgagctgcccaccttggcctcccaaagtgctgagattacaggcatgagccactgcacccagcctaaattttaaaattagcagaaggaaaaataagtggatttgaagataggctgatggagattatgccagccaaagaacatagagaaaaaaataatgaaaataaagagtctcagaaaaatgtgggacaccattaagcataccagcctatgtataatgggaatatcaaaaggagagcaaagagcaaaaaaaatattcaaagaaataatagtcgaaaacctcccaaattgaaaaatagtaacatgtatcccagaagttgaaaatgtttatattaagaaacaagaaagatctcactcaaatcaataaactaacttgtcaccttaagacactggaaaaagagcaaactaggcctaaagtaagcagaaggaataaaatcataaaaattagatcagaaattaatgaaatagaggatgcaaaaataatggagaaaatcaacaaaaccaaaagttttaaaaaggtaaacaaaatagacatctgtagcaagattgaccagggaaggattcaaattactagaatcagaactggccacacagaaaaaggattttaaaggaatactagaacaattatatgccagcaaatttggtaatttagatgatatcttagtccattcatgcagctatgaccaaatatcacagactgagtaatttataaataatagaagtttatttctcacagttctggaagctgtgaagttcaagagcaaagtgcaccaacagattcagtgtctggtaagggctcactctctgcttccaaagtggcaccttgttgctgtatcttcatatggtagaagggcaaaaaggggaattaaggtgatcccttcaacctcttttataaaagctgtaatccctttcatgatgatggagcactcatgatttgaacacttcccagaaggccccacctcttaatactatcaccttgggcactaagttctaacatatgaacatataaaccatagcagatgagatggacaaatttctagacaggaagaagctacaagaactgactccagaagaaatagacaatctgaatagacctataatgagtgaagatgttgaaatagtaatttaaaacagggaaaagtacccacaaaagctcaagcctagaagtcttcactgctgcattttaccatacagttagagaagaattaaaaccaatttttcaaactttcagaaatagaagaaggaacacttcccaactaattctgtgaggccagtattaccttgataccaaaactagacaaagacatcacaagaaaactacagactattatctcatgaatattgatgcaaaattcctcaacaaaatactagaaaaccaaatccagcaatataagaaaagaaatatacaccgtgatcaagtggaatcccaggaatgtaagggtggttcaatatccaacacatacttaatgtaatcatattaatcgaaattttaattgcatgatcatctcaatagatgcaaaaaaagcatttgacaaaatccaacacttttgcataataaagacatttcaccaagtgtgaatagaagagaacttcctcaacctgaagaatgacatctacaaaaaattcactgttaatatcatccttaatgttgtgaaagaccgcatgctttccccctaagatcaggaacaaggcaaagatatctgttttgcagtttctattcaacattgtgctagaggttctagccaaagcagttaggcccaggcaggcggatcacgaggtcaggagttcaagaccagcctggccaacatagtgaaaccccatgtctactaaaaatacaaaaattagttgggtgttgtggtgcgcacctgtagtcccagctacttcggaggctgaggcaggataatcacttgagccccggaggcggaggttgcagtgagctgagattgccactgcactccagcttgggcaacagagcaagactctgtctcaaaaaaaaaaaaaaatttcagctgggcatggtggctcaagcctgtaatccctgcactttgggaggctgaggcaggtggatcatgaggtcaggagattgagaccatcctggctaacatggtgaaaccccgtctctactaaagataccaaaaaaaaaaaaaaaaaaaaaaaaaagccctgcatggtggcaggcgcctgtagtcccagctactcgggaggctgaggcaggagaatggcgtgaacccggggggcggagcttgcagtgagccgagatcatgccactgcactccagactgggcaacagagtgagactctgtctcaaaaaaaaaaaaaaaattttttttcagggaacttctatctcagtaaactttctagggctcccgtggtgtggggcctgtcaagatattccttccaaggtgaaggataagtcgcctcatttggtccctcctacaaccaagaagatccacaatgcttagtgggtctatttggattttggaggcaacacattcctcacttagatgtgttactccagcccatttatctagtgacctaaaaggctgccagttttgagtggggtccagaacaggagaaggctctgcaacaggtccaggctgctgtgcaagctgctctgccacttgggccatatgacccagcgatccaatggtgcttgaggcgtcagtagcagatagggatgctgtttggagcctttggcaggcccccataggtgaatcacagtggaggcctgtaggattttcaccccataggtgaatcacagcggaggcctgtaggatctggagaagatggccctgccatcttctgcagctaactactctccttttgagagacagctcttggcctgttactgggctttggtggaaactgaatgtttgactatgggtcatcaagtcaccatatgacctgaactgcccatcataaactgggtgctttctgacccatcaccataaagtaggtcgtgcacagcagcattccatcatcaaagagaagtggcacatatgtgattgagctcaagcaggtcctgaaggcacaagcaagttacatgaagaagtagctcaaatgcccatggtctccactcctgccaccctgcctcctctcccccagcctgcaccaatggcctcatgaggagttccctatgatcagtggacagaggaagagaagactagggcctggctcacagatgcttctgcacgatatgaaggcaccacccaaaagtggacagctgcagcaatacagcctctttttaggacatgcctgaaggacagcagtgaagggaaatcttcccagtgggcagaagttggagcggtgcacctggttgtgcactttgcatgggaggagaaatggccaggtgtgtgattatgtactgattcatgggctgtagacaatggtttgcctggatgggacttggaagacaatggtcaggggcttgaaagaagcattattggaaaattggtgacaaatttgaggaagaggtatgtggatggacctctccaagtggtcaaaaactgaagatatttgtatcccctgtgagtgctcaccagcggatgacctcaacagaggagaattttaataatcaagtgggtaggatgacctgttctgtggacaccactcagcctctttccccagccacctgccatcgcccaatgggcccatgaacagagtggccatggtggcagggatggagattacacatggagattcagcaacatggacctccactagccaaggctgacttgtctacagccactgctgagtgcccaatttggcagcagcagagactaacactgagcctcaatatggcaccattcttcagggtgatcagccagctacctggtggcaggttgattatattggacctcttccatcatggaaagggcagaggtttgtcctcaccggaatagacacttactcctgatgtgggtttgcctatcttgcacgcagtgcttctgccaagactaccatccatggactcaaggaatgcctcatccaccatcagggtgttccaca

SEQ ID NO: 17920 - DNA, 111320 bp, Homo sapiens
  misc_feature (1)...(111320): n = A,T,C or G, or insertion/deletion polymorphism (see Tables 1-2)
catgctcaaagcccttttgttgaaaataatacataaatcatagcagacatttaatgagcagatacattgtgccaggtgtggcttctaaacactttatatggattaattcacttaattcttgtaattaaccaataaggaaggccctacttttatccccgttttacagataaggaaactgaggcactgaaacaaagctgtgtgatcaaaaatcttacccaccactttcttaggatttggctaatctctgagtgctgtggtcttgtgtttgggggttcaggtgttaggtcaagggtatacaatattaattcaaagtgatgtgtgggcacagataaatagctgcttcatgtcagatgccatgtgaagagctaaatatttgctaacccatctaggcaggcaccatgagaacacattgtttaactccacagtagccatgtaaagaaggtattaattttctcattttacagatgaggaaactgaggtccagagagggtaagaactgattcaaggttccacttctagcaagtgagggggcttgattggaaacgaaaaccagctttcgcctagctctgaccatccaattctgggccacttactctctccaaaagttgagacattccctaagcccctcaaaccaagaatttctcagggagccattgtcccacagagtacactaagctgggactccactcattcctaggtagaagggagtcccagggcacatggtctggcccatgcagctcctaaatgggacctagtcccatcctgtcctgcacatccattagtagagtctactttctcctctagggaccagggaagataaagaataaggtagatatggttcaaattatagtatcaagccttgataattgaattaataaaagaaggaaggaaggatagaaagaagaagggagggaaagaagtgaggaagaaataagatcaggcaggtgtggccctaaccagcactgagcaagctgctttctgagctctagttttattatctataagacggagacagtaatagcctctaccccagacatctgaaggatttgatgatgttatgcatatcaagcaggtgctctatgcaaatggacggacggagaggaggcttggtctccttgttggaatgtttctgggaccaattcttaggcctagaagagactacagggagccttttctccattcatatgttggagggccttctgagtgtggcagcctcttagagaacaagaatctacccagagtcctaggtatggggttggctggggtctgctgggacatgttaactgttctactttatgacccagaatgtctaccctaatatgtaaagttctgggttgtgaataacagaccccataggctgaccccaaggcccagaaacagaccactggctctgtggtaaacatagagtaagatacacatattatgatcataggtggcctgttgggatgcctacagaacacatggtgcttctggcactctttgtatcagttaagtttagttctaattttctgcctttgtaattcccttcctccctctcttccttcttccctctctccctccctccctcccttccttccttccttcattccttcattccttccttccttccccttcttcccctccctcccttccttcctccctcccttccttccttttccttccttccttctccttccttccctccttccttccccttccttccttctttctttccttccccttcctttcttccccttactaccttccgtccttccttccccttccttccttccttccccttcctaccttctgtccttccttccccttccttccttctccttccttccttctccttccttccttccctcccctccctttccttccttccctcccctccccttccttccttcctcccctcccctcccttcccttcccttcccttcccttcccttccttccttccttccttccttccttccttccttccttccttccttctccttccttccttcctttgttccttaattccctccctccctccctctttccttctgcagcaaatactgtttgagaaagaactctgcctgctaatagagataacagtgcattctgctacaggattttacaaataagctaggagaaatgcatagagaaggaagagataagggcaaatggaaaatggatagaaggaaaggtgaaaaggaagaaaaggaagagaaagagggagaaagaaatgaggaaggggtgaagatgaaaaagaggcagaggaggggacaggaaagaggactgggaaacagaaaatataaggggagaaggaaaggcagaaaagggaaagaagaagaaaggaaagaagaagaggcagaagaaggaaaacaggcctcttgagtattttctatggcccttcagccagtcttgtttatttggagctggtagagatatatctatgtccaactctcaccaaggggagctcataaataaatacctctgggtaggagcagatatctgtaaacacagctgaggaattgaaagtcaggttcttcaagggtatcgacttgtcaaaatcacaccacagctgcggattaaaaaaaaaaaaaaaagaacaacaaaaacaaaaacaggaacaacaaagtcagtgtgagtgctggaaatggagcagtgtgctatcagtggctgggcttcagcacgagcctgggtagactgaaccctagaggggacttgaagtcagaatggaagtgccaaagtgccagctttgatttcttttatttaaaaaacaagtgcttgctcagaaagaccttttgtaagccagtcatgaaactaagtttagactgctctgttggccccatcatttaaggtcactggagtgtgcttgtggagctcagaagagaaagccagatggcaggagaagaggtcttgggtaaactcatagcctgtctccagatcaacagctgggaggacttgaagaatctgaaggggtacattttccagaaagactcttagcactggggtgatgggcatttcctaggacagaagttgctgcaggagattttgtggtattaggaaaagaataactaccattggccaaatgcctcctctgtgccagacactttgtacaaaaaagcctcacaaccaccttgtgatgtagctgctatttttaatccccattttacaattgaaaaatacgaaactctgagaagtaaagtaacttgtccagtgtcactgagctggtgactggtggatctgagatttgaacacaggtctatctgactccaaagcctctgatcttcctaccacactactcactgaggcacagttggcctcagaggtaaccctgacctacagtcattgggcttacttacaaattctgcaccccagaaatatctaatttgttatcaagacttaatttaaggtcctggctgcttctctgcagcctgtgatcaattgatcccatgtacttccatttcagttatcataatctataaaatattcattagatgatgaactaaattagatgataattttccttttcctcttttcctttatccacagagccttcactagaaggacaaccacagaacttaagtaaggtaattactgggccaaattggacagtgatttcaggcagtctagggctccaagtcacaggccaacaattgtgggagtctatagcttgggtccctgcacacttggggaccctccttcaggcccaaagggcacagtgatggattcaaccacatgacaatgcctcaactagcctctctcaacaagccaagtttaagacctggaaccaaacaaatcacctcaaaaatctagctgcctgagtcatggacaacacagactacttgtaaaagcacagaaaatacctatagctaccatggtacaattcttgagaaaaaatgaaaccatgacaatgtgggtcagcaaattaaacagtgataaatatcatggcagttggaaattcatctgagttctatgtgtcacgtgaaatacaaacttttagaaagtataggtgagatactcagctttcctgaaatgcagtttcctcatccattaaatggggacaataatacctacctgtagcacatagtaggtgctcaataaatggcagctatttcatttccatttcccccaccccactcccactcccagagatacaatttagcatattagaggggcgtgggtcatggagtcagacagaccttattatcaagttatttcatgtctctgagcctcagtttcctcagccataaagtggggataattaaacttacctcacggggtttatgtgaggattaaatatgaaaaatatgtaaaggtcctccttcagtgcatggcacatagcaggtaggtactggtacttgatacatggtaactcttatttatgatgtaattggctactgacaatatggaaattgaagggcttttggaactcctttggagaaaataacctatcccactgggaaatagacagttttccaacagtaaaatgcacagttttggcagtagccacatctttgttatctgtccctaagcttggggctggaccaggcacataaaggtaactggtaccaaggaagggtaatgcaggaagctgcaggctccataaacttcatgctcaactgcacactagacaccagagggttggtggatgtgggatgcttacgatatttaagatggcacccaggaaattaatcaaaatggatgcaaagatgatgacgttccgggccaaataggtctcattaatccaacagcaagttttccggaggatgaggggcaaacatttataatcctctgctgtggtgatgaggaccagagccgagtgcagcataatcagaatggagaactggatggtcattggcatcactctgcagggaaacacagaatgttgggtcattggcatcaattgtctgagcaacactgaaattctattcctggtcttcctttcccatcccttgcatcggatacttctttgaaagttctgtttgtccaagaaaaaggttattagcaggagagatttttaaaaattacatgcatccctagagcactctctctattgagaaactttgcaaaaaaacagaatatttggcttgatttattgctcctgcccattttttccctcctattaatttttgtcactaggcaattgctgtcatggcaacacaccactctagtttgatatcaacactctggctgtgggatgaacccacatacccttttcccttcaaggtgggttttgtgaagatttccccctccacctatcctgataccaagaactggatttggcattggttttaagttgctcaggttggttcctggttttgtggttttcatggactataccataagttatttgagacatgggtaaggagaactcatccttgtccaaggcatcagcatcactctcgagtttacatctcgagtttcaaactctcatcaaaactctgtcccatggtagcctgtgtcagttggacacctgtgctcggtgtcaggatgcttagtcagtctgtgatctaaaactccatctctggaggcatctttaactcctgtctcccctatcaacctatttatcaccatgcaatctgcttctccttgggaattaattctttgttctcaactctgtgtagccattcatgtcctacactggcagctctaatttttccatctctatttcaggcagcaaactgatgcaggtgttaaagggtaccttgatagaagtggagggaaattttatatctgctcctttttctataaattgaggtttattcatctggcattaatatcttccattggccagtgctaaataaatgtgtgttcagcaaataaagttgaactcaccttcttttcctaacaccatctcttactatcctcctccttaaacttcttatgtattattaataacactagtataaataatgtatcgagatctgattatgtgttagccactatgctgagcattttatatataatatctaatttccattccttagaatgaaccaaagaggtctttttatctctttttttccagatgaagattcaaggctcagagggaagaaacttcccaggcatcatacagttggtcagtgttagagccagaatttaaagtccactctgttataccgttctgatattctaatcactttggtgagtaatagatctcccatgtttgcaatcatcttttttgcttttatggtttcatcataatatttatttattcaacaagtcttcttcccaggtatacagtggcaggcatcagggtactggggccaaagacacatcttcctcatctaggtgattataattgagagaggaatataaacatgcaaatgatgaactattatataatattccgggatctataaagagttctaaacaaacatcaactgaaaaataggaaagggaatcaagggaggcttcataaaagaggtgacattgggttaggctgtgaaggttaaagagaaggcttgcaggtaggaaagagtggggagcatgagcaaaacatcagaagaatgggagtgaccagtgtcttcagagtttcccagtaacccaggcagtgtggctgtgctcaggagctttgtcctgtaggcaatgtgcagaaggaagtaatcagatctgcgtgtttgaaagacaactgtggtgggaggtggaggatgaagtgaagaggaaacgtgttcagaagagttaaatagttaaggcatgagttaatgagggaggaacacaggggaacagtatgataattggggggtgcagggaaagatgtggaggtatattaatctgtgttttgtatgtatgtgtagagggtatttgagagagggaagtcattaacgatgacattaatgttttttattgtaactggtaaatgcaggaaaagaagctagtctgtacaggagataagttgataaagttgattttggacacaatgcatgtttggtacttgtagatcattcagttacagatatctagatgtccaggcagtgagggacaattgaggaactctgaggctggagggaataggtggtgattgagatcaaggaatggaagcatttgcccaaggatagtgtgtacagcaagaatcaagaggacccaagatgagctgtgggggatgctaatgggctggaagaagagaagacagcaaagggagtttatgaagtgtggttagataagcaggagagcaggagtgcatggcatcatggcagcaggggggataagaaattcacaaggaaagagtaaccaagaatgtcaatttcctctgcatgatgaggctactttaaggctggaaagtgactcctcccacagcctcagctattgttggtagaggttttttttgtttgtttttgactagcaaagttttgattttatggatcaccttgacaagaaatctctgtaggagttctatataagaacagaaggttggtgcatcagtgagttcccagagggctctaggcagatgggaaacttccctccaaacaggctggaaaaacactccctgacaacacaccattatttstgggcaccagggggagataaatgaaagagaatgcaggcggatcgctttgtcaggaagtcccatgagagagggggccaattgcaaggctcatgtggctcattcacatgaggaaaccaacgagtataaaaatgtctcttttcaaagtgtgagacagaagcaaaccagggaaaggcagctttgaaagacgctgagttggagcctcaaattcttacatggccaccactgcctgtggacctccacatggcatacagggccttgagtgtctgctcttggctctctctcctgccttttttttttcctccctcacccttctgcaccccatggtctggrcaatgctgaactatgtgcagtctgtcgccagtgctatgcactttctgccttatgggcacttaacatggtgtgtcctgttattcctgcaaggctcagctttcctttggattcttccatgacacctggcatagggctgagtatacagaaggtgctcaataagtattcattgacttatgctttttctgggaagagaagactctgctcctcccctcagcagccttcacagggaagaagacttccacctacatgcccagactatctccctgcctgctcactatatctctccaaggaaggaggaagggctaatccagaaactatcgggggtgctcagtggacctcattttccttggagggcagggccattgttaaaggtcagtatatatgcacagttcagacacttatattctcctcctcttcgatccactgagatgacagggaagccagagccttgatctaccctatgggaggagggctggccatctcttctctttggccagggcatctctgcctttaaggaagaaagcccaggttggcttaaccctggctctggccacagatggcaccgtctcaggtctgcctcattcacctttgacactggtggagtgcgttggtttaatcttttgcagcatcatagtggtaggatctcacaccagagtttaactgtgggatatgagggccagcagagaagagattcaggatggaggccatgtggtctcttgacttragccacattctgtattccagcttttatcacagttttgcataggctaaatgggcaattgtttggaaatttgtaaaattgatgtttttttttttctcatttagcgattgaacttatgtgtaatctttggcatggcggggagttcatcagggtatctatagggctgtgtgggaggatttgcacacagaactcacctgagtccctgacccagttttaaatggctttcttctgggtttgctgtaaaagggaaagggaggtgaaagacaggccatgtggtccagtggcaagagcaaagtcttatatgtttgaacctgtagttctgaagcataactagtagtgtggtcatgggcaaggtaattgattcctctgagaattactttttaatctgtaaaacagggattttttaagcctaccttttaaaggaggctctgagattaaacaaagtcataaagtagtataataaaaatttaaagaaatgttagttctctttctctattcatcatgaaattcaggaaaccaaaagcactttaaagttctatggcaagggtattaattacaagattagctttttaagcaaaagtactgacactgtrtattacatttctctggaaatctctgcagcagttcctcagcattcatttatttctttacatgtaaacattataacatcagattgtacattttatctaattatagagccactcaggcatccaggggttctgaatttgcttttgcattgttggtgcacataagaggcaaggaaacctttcatttctgaaatcgagtctcaaaaagaatgactagttttgcaaagctctatccaaatcatttctagacattaagtcctaattattctctgcagtctgtctttaaaatggtttgtattgatattgtgatttgacatttgctgggaaggcaggaatcagtggggatgagtgaacagcctatagcagcttgtggtgcaataggaaacaaaaactcagattatactgaaagatggcacctggacaacactttagaatctacagactctatgggtacaatagtgtctttgatccttgcagcaaccctgaagaaagatattctaagccctttcaacagatgaaaatactgtgactccaaaagggaatttgccagaaataggcttggttaatttaatttttactgcagtcttggcaagtgggcattatcattcccattttacagatgaggaaacagaggtttcagagaggttaaatacatacatataggtagtataatgcacagaaaataataagacccagtgcctgcctctttccctccgtccctccctccctccctccctccctccctccctcccttccttccctccctccctctgtaggtcactacctctctttcttttccctttccctccctccctcccccttttcttttccccctttctgcctccccctctctctttctgtgtctttgtctctttctcatcatcacatgcagaccagatacattgttctatagtcccaagaagtattttctagtctttccttcgtttacccttcttggagaggaacatctgtgggcatgtggaaattaaaggaaagagctgggtaagcactgtctctctctctctctctctttttttttttttccagagtccattaatttttgctttgggggctaagaattagctgtggtcatatgagtagaaactccctcatctgccaaaaaaaatccatgacagaagaaatgcgagtgaaaagcacccaccatctgtttagtttcaaagcatcaaacagaaacaaaatgagttggagagggaaccagcacatattaaagaaagcttttgctgtgtctggggtaaatgggctacccaattcccacagcatatggattgtctggtcagagttcagtttccttccttgtcaggatttttctcctcgctaggtaaggttggggtgtgggctgtatttcagttatgggcttcaccttgaattctagagttggagactccttatgactagctgctgggtgagggtccaggtctcttccccctgaaccccaggaaccagggcatcaaggcttgctcccctcccccaccccgtcacaccacctagaaagaaatccagcccaggcccgctgggaagtgtgaggctcgcttctcgtggaggacagtggccccttctcctgtccagtgccaagtccagatccgcgggctcatcctggtcttctccatctctctcatcccccacatccagccagtcactgtgaaccgtcaactctctgccctaaatatcttaaaaattcttcctctcctgtccacccttctgccactctcttctccttattattttgtgccagattttttatttgcagttgcctcctaattggtcatcccaaatccagatttcactcccacctctccatcatccccgttcagtatgatccttctaaacatgaatctgatcacatcatctctttcattaaaatgctttaatgaagactcctctgccaaccagtcacaacgcctcaatgaacttcacaactcctatccttcagaatgctctatttccagcccttcctccccttaatccttctcagtctttttccatgacctggtgagctcctttaggagccaggtgagctgtcactgtcatctcctctgggaagcctgccccagaggcaaaaggactacttttgcctcaccccaactcccacacatcgaatcccagcttacacctttcctatcacaatagtcatcaccccatatgatagctgttcagctaattgtcttttagccctactagatggtcagctttatgatggcagagaccctgactgtatatccccatcactatccagcacaaactgtcacactgatgtttgttgagtgtttgccaggaatgttaacaccttgagctctaggagtccagaggaagcaacagacacggccgggcccttcttggctaccaccttcccattgacaagagtgactagaggagcccagcaggtttggctgaatcctgccaggccccaccaacactcacagctcgccaccccgaggtgccttcggtcaggaccctagtcctcattgtctcttargtagtcaagaaactcattctttcctggtattctctggtacccttcttctgatttattacttggataacacataactatcgccgtggctggcatattcatatctacatatgtgtctaccttcgtatgctataagtagctacatatatagtatatacacctggacagatacttatatattccttatgtcttagtctccttcctccagattatacattccaggagggcagggattttgttcttgtcatcttttttttttgtcttgagatttattcctagtgtttggaataagtctggaacataataaccaccaatggctgttggtgggaggactcctatcccacatttggcaaaagtcattagtaactttttaaaaatggtaaaacgaagcataaataaagaaaaccacacaaaagtatctcttggttatttgttctgccgtgtgttggtttttcatgaccattaattcctgaaatagaactttgcagtgcacaccaaaagcccatccatttgtggggtgggggatggggggagggatagcattaggagatatacctaatgctaaatgacgagttaatgggtgcagcacaccagcatggcacatgtatacacatgttactaacctgcacattgtgcacatgtaccctaaaacttaaagtataataataaaataaaaataaaaataaaaacaaaagcccatccatgagccctgtcccaatgataatcctctctgtcaacccccattaatcactttccatttccatttctttatagttttatcctttctttatagacactacagtttagtctcatccatttttattaaatctgatttgtcttttaaatcttaaaatctgtaacttgtctctttatccttttatcttccttacaacgtatttatcgaaaaacacatgcctctgacccgtagcatttctcactgtctggattttactggtgtgtacttagtcaacattctctgtcctctataattcctgaaaattggaagctggaatcaaaggcctgaccaaatttaggtttgatcccattggcaagaccataggtggtgtgcgcccccaccaggaggtatggctgtctctcttgtttgtgttgatagcatcctctgatgctcaatttgtagattcattaaatcattatgggttggaatatgatgataytttaattcttttatttctttaaaatgttatagctaggatacttttatgatatttccctcacttactatttagtgatcttatggtgaaaagccactggtttctctcacttttttacaagttttccagataatcaaccatttccctatcatccactaaacactacaaacttaaaaaaatcattacaaactcataaagctaaatatatttgctgggttttgataagtattttaataattatccccattgcagctcaaattattccatctttggacagtgggaacttctataatgtggctcctgcattcttttgatatgatcctaatagtgtttgatggcatccttgctttcttgtaggacaagatgttctaggctcatctagcacatttcctgttccagccctaaaattagccatatctccaaaattgttttttaaaaaacagatatgttacttcaagaccataatctagccctgaggtatgctcatggatgctgagttggtcattctttctaaatctccccataggtgtttctccagtccaggatatcatcttccatttagttgttatgtctcctyaggtgcctccttgctgtgacattttctcagacttcccttgttttacatgactttgacaggtttgaggaatactggtgaggtgttttgtagactgtccctcaattgagatttgtctgaaattttcttcatgattacattacgggtttggggaggaagaccacagaggttatatgccatacttactagatcccattaacataacttatcactgttggtattaatctttatcccctggctgaggtagtgcttgtgaggtttctccatatttgccccctgtacatagtttactctttggaagaaagtcacttttgctgttgcccatacttaaggagtggggaattaaattcctcctcactgaggatgaattatcttcataaaatatgtagactttctctgcatgggagacatatcattaatttatattagtatgaacttgtggatatttattttatattgtggattataaataaatattacattgtttattttgttgctcaatttattccagctttggccctcgggggctcttttgttggttcctgtgtccctttgaaatactcccattatcatgtatatgtgtgtgtgtgtgtgtgtgtgtgtgtgtatgcatgtgtatgtatgtatgttttagcacattcttattttctggccctacaagatcgccaaggctaatcttgtatatttcctgtctcactgttagactcagacagttctccaaggagccctggttccttttattggatatcggcattagaaaccaagatgtgagtggtagatgtgctcattaccactgaggtgtcattgcttccaggccctctccactgacagaggaaggaaatgtatgtatayattctaacctgtgcatataaacatatctataaatattcctacatgtaaccatctctatctatattaagctatacatgagttcatatggatgtctccaactctaatccattaccaccaggatatttctaactttctcccttcatttgcatgtaaacttccattccaacaatgagaaaactgactcccaccatctgccatccacttacacaattgtttagttccagtatacctatataggtgttgcaaattcttaacccatgcctcaatgggaaattcctatatcaactacagcacagtgcttaagtgcagtttctcttgcctttaatcctacagacttctctcattttcaaagctacttagtacaccattttactccccacatccccttcagggaggttgcttcatacacttttaatacagttagattcttttgtcacagtctgattccatcatgggatcccctaaactcctaaataaaatgttttaaagcctgtatatattaaagttcattctctgtgctgtaaagttttataagttttgataaatgcatrgtgtcaggtatataccattacagtatactgaatgcactaccctaaaaaatatgctggacttcatctcttttattctcctttccctcattccccaagctcctctcacctaacgatctatttaccatttctatagttttgtcttttccagaacattatataaatggaataatatatataaagcctttcagacggtttctttcacttaggaatatgcatttaaggttcattgatgtctttgtgtggctgatatcttattccttcttaaaatggaatcttacttcattgtctggatatgccacagagtttttgttgttgttgttgttttctccagcaaatggtattgacagttatttatttatttatatattagtcattgtactaggtatgtagtggtaggtcattgttttaatttaaatttcccttatggccaatgatgttgagcatttttcacatgcctatttggtatctgtatatcttgtttggtgagttgtttgtttaaatcttttgtccatttaaaaaattgggttgttttctagttgttgagttttgggagttctttgaatattttgggtggaaatcttttcccagacacatgttttacaaatattttcttctggtctgtggtttgtgttttcattctcaaacagtgtcttccacagatcagacattttaaatttcagtaaagtctgacttacaatttttttctttcatggatcataattttggtggtgtgtcttaaaactcatcaccaaattcaaaaccaaaattttatttgtgttttcttccagaaattttatagttttgcatttgggtatataaaccattttgtgttaatttttgtgaaggtttaaggtctgtgtataggttcaagtttttgcatatggatacccaatttcttaatttatttttttattttactttaagttctgggacacatttgcagaacgtgcaggtttgttacataggtatacatctgccatggtggtttggagcacctatcaatccatcgtctaggttttaagccctgcatgcattaggtatttgtcctaaagctctcccttcccttgccccccacccccaacaggccccggtgtgtgatgtgtccctccctgtgcccatgtgttctcattgttcaactcccacttatgagtgacaacatgcggtgtttggttttctgttcccgtattagtttgctgagaattgggcatccaattttatcagtaccattagttaaaaagaatatcctttctccatggaattttcttaacatctttgctacaaatcaattgattatatttgtgtggstgtattttggggcttttctttctgttctattgagcgatgtgtttattctttctttagcatcatactgtagctttatagtaagttttgaaatcaggtagtattaatcctctagctttgttgttattcttttatggtattgtgttggctatgctatattctttgtcttttcatacaacctttagcattggtttgttgatattataaaacagcttgctgaagttttgattgacaatgcattgacctatagatcaagttgggaaaaattaacattttaacaatagcaagtcttccaatccatgaacacagaatatctcttcatttatttacatctttgatttatttcatcagtgttttgaagatttcttgtacaaattttgttaaatttatatttaagtatttcatttttggtgctrttgtaaataatattgtttctttaatttcaaatttcaacgttagatggctgatataaaggaaaacaattgacttttgtatattgacattgtattctgtgacttatttgtttattagtcttagaaatgttttggtgggtcctttgggattttctgtatagaaagttatgtcattggtagataaacatagttttatttcttcctttctgatatgtatgccttttatttctttttgttgttttgtttcaatagctaggacttccaacatgatattaaatacaggtggtgagagtgtatttttgttttgtttctgatattggggggaagctgcagtctttttccactaaagatgatgttatctatagcttttttttttgggagatattctttatcaagttgtagaagttcccttctgctgctagttttctgagagtttttaacataaatggacgttgaagtttatccaatgcatttatttggcaattgataagatcatatgattktccttctttaacttactaatatagttaaccactattgtttgattttagaatgttgaataaactttatatacctgggagaagttctgttggagcatggcgtatgcttctttttatacattgttagatttcatttgctaatattttgttgagaggttttatgtttatgtttatgagatattggtcggtagtaactagattttaattttgttaattttctttattgttttcctgttttcagttttattgatttttgccctaattggtagaatttattttctcctttttgttacaagattaaattgctttttgttctgtagtttcccaaggtagaagcttagattgttattaattttagatctcttttcttttataatatatgcatttaatgtaaattttcttctaagcactgctttcatggcatcccacaaatttggtaagttgtgttttcattttcatttagttcaattttgttttgttttgttttgtttttttagaccgagtctcactctcccaggctgaattgcagcggcgcaatcttggctcwctgcaagctccgcctcccaggttcacgccattctcctgcctcagcctcccaagtagttgggactacagacgccggccaccacgcctggctaattttttgtattttttagtagagacggggtttcaccgtgttagccaggatggtctcgatctcctgacctcgtgatctgcccgcctcggcctcccaaagtgctgggattacaggcgtgagccaccgcgcctggcccaaaatatttttaaatgtctcttgaaatctttcactcacgtgtgattgaagagtgtgttatttaatctccaagtgttttgggattttctagctatctttctattattgaattttagtttaactctactatgatctgagaacatactttgtgttatttttcttcttttaaatttatgaaggtgtattatggcccagaatggggtctaccttggttactgttcatgtgagcttgagaagaatctgtattcttccattgggtggaatagtctattaatattgattaggtaaattcaggttatctatatctctaatgatttcctgcctacatgatgtattaattactgacagagggatgttgaagtctccaactataatagtgggtttayttatttttcttttcaattctatctgtttttgccttatgtagtttgacattctcttgttaggcacataaatgttcatattgctcgttcttcttagagaattgattttttaatcactatgtaatttccatttttatctctgataattttccttgttctgagtctatttggtgtgaaattgatatagctacttaagtttttttttcattaatgttagcatggtatatttcttcatttctttaacttatttgagtctatacctatagtgggcttcttgtatacaacatctattggggcctttttttttttatctactctgacaagctgtgctttgtaattggtatcttgagaccattaacatcaaagagtaatatttttgtgcttggtttaacatccatcatctttgtaactatctttttcatccattgcatttattctttgtttgttcaccttgtttaacattctctctgattttgattgagcattttatatgatttaattttattttttcctagcatatcaattatatttctctctttaaaaacgtttttttagtgtttgctcaagagcttaaaatatgcattttaaattaatgtaactcagccttcataccacttcatgtataatgcagttaccttaaaataaagcattaccaattccttccttatgtcccttgtgacattgctattgttcatctcacttttatccatatttataaccaccaaatacattgttaatattgttgctttaaacaaaaaataatgttttagatcaattaagattaagataaaaacattttacttaacttcatttattttttctctgatgctctttctttatggagatccaagtttctaatctacattattttcctgctgtttgaagaaatttttcacatttcttgcagggaatgttggctaaaaatgtagtttttgtttttctgagaaagtattttttctctgcttataaaggatatagaattctaggttgatggtttttcttttaatactttaaatgcttgactccacgctcttcttgcttacatggtttctgacaaaaagtctgatgtaattcttatccttgttcctctacaggtaaggcagtgtccttccttctggtaagatgatgtccttcactgtggtatcctctaagattttccctttgtcttgcattttctgcagtctgaatacaatatctttttttgatgtttatcctggttggttatttttatttaaccaaagtatttaacctttaaaattctgtgtttctgtgattctgtggtttgttgtctattattaattttggaacattcttagccattattactttaaatatttattttgcttagctctcctttcttctccttttggtaatctaattatgtgtatatttcttcttttgaaatcatcccagagttcttggatgctttgacccgtgtcccctgcccaacccccattcacttttgtctttgcatttcagttagggaagtttctattgacctgtcttcaagcctactgattatttccttggcctttctgagcctactattgagcccattgaaggcattcattatttctgttaggtgtttttaaatttttatcctttccttttatttcctttgattttcttagagtttccatctctctgtttatattgcccattttttcttgcacattgcctacttctattagaacctttaatatattaataagttattaaaaattccctgtatgataattttaacactgttatatctgagtttgattctgatgattgctttgcctcttcttttttttggtgtgccttgtaattttctgttgaaaactgttcatattgtatcaggtaatagaaaatgaagtaaatagatattttctgtgaggatttatatcactctggctgggarttaagctatggttaaggtttgctatagttgtatgttccagtagcttcaaattcctctagtgtattagtttcccctcttgatatgggcttccctaagtactcttcctcagaaagaatctgtgtcttgcagttctttcagctgttagtatccgtggttagtatacagggtccttgttggtgtgacattaargtgtggggaagaaggctctgtcaatcttttaaattttctttttgacttaaaaaatgatgttctttctttcactttctatatttcttaagtaatttttgctgcgtttatgtgctgtttgttctcttttgctgtcttcatttctgaaatatatatattttaaaatttttatttatttcttgagctgtctttccaaatttctaagtttttctaattttggttaggttgttatttcatgtcttgaacaacattaagtgcttcagcttcttttaaaagaataggttaaagttttgatatattttgtgagcatgtctttctggagcactttcaatgactataagaagattattctacttgttattctcttattttttataatagtatagtattgccatcaatatattttgttgctcatttttgtgtaaaacacttccctgaacttttagaaagagcatggttcagagttctagaaagagcatgggttgtttatttatttttttaactctatagagctttctctttggttgctttcatgcagtgtttcaaaacatsatagctmgaattccttcccactttaacctgtatagcccttattgtaagtgattttgatttcactcacacagttcctttcaggcctttatcatgagagggagattagatgatcagtttcacgagttcatagtgtcttgatggttccagctcttcatgcctttcaaaaggttattggattgggcaaactccttcccactttcatttgctttcttaatttggctcacagcacttctcagtgcatatctgttggctgtattgagatccttttgttccccggtgtgacatgcccagtacttctttstgctttctcccatacaggtactgatatcacacagattttggggctattgggggattgttgctacccacttctatattggaatgtatgggtctatcacccttgtttattataaatatagtccatgaggtttttggttttgctatctagttggtcagattcgtaagaattctgagagattaagaaatataccatctgtcccatcatcttcccggaatcccctctctctttctaatgtcctctgctaattagggggaaggtcaagcatggcctgcccttgcatattagttaacttgaacatctttcttccacagcatcatgctacaatcttcctaaaaatctcctggggccccttctcaccctcagaatcaattccaaagtctttaacatagttatgaacattgaacttctgctggttctcttctttttcagccatagtgtctactatattcttgcacaagccctttgctattggctcttacatttaatcactattctataaacacaaggcctttctcacttgtatggccttgccagagcagttttccaaatggaatactctcctactttttcctctctcatcttagtgaaatcaaaaccttttctgcaaatttttccttgagtcatgtggtcagaatgaatcactaattttgatgcaaagcagtctagtaactaaaagcacagacttggtctctgggttcaaatttcagctcrgatattacacagacatgtgacctgggataaatcctcatctacgaatgggaattggaatgctgcctcactcatcagttatttttgaggctttttgagacaatccatggaaaagatgtagtactttcctggcatgtataagtgctcagtaactgggagccattgttaatgtctttgtcacctactaaattatgtcttagaggttacagaacctcttcttccaaaactgtgtcatcctcaggggctataatgttccttagcctatattaagtatttaaaaaatatttgttgatattatttttaatcatgtgaaaggggaaaactcatagtaagtatagggagaaggcaatttagctgagaaaagaggcaggagctagcttatagtttagaggagagraaaaagcatagctattggactaatccagaactaggttcaaatcctggctagagcatctataacctggacaatatgtgtttaatagagggttaagaacccagactctagagctagtcttcctgggttgaatctaggcagtaacatcttgaactatgggatcttagggaatttatttaactattatgagcctcagttccctcctctttaaaatgaggataatcatggcacctacctcataaggttgtcatggggattccagaagtttttgtaygtaaagtagaacagtggctggccacaaacaggtgtttgcattattattaaagtgttgattttgcggacccaaggagctacgatgctgtatctgtgaatgaattatactaacaaaagcacaagtaaatggtgttgaggttcttatacctattttctgcattcatgagtgtcatgtcaaataagagtggggcctattttaattttggttgttgtttttattaagattgggaaaaagattattgtctggacagagttttgagattattagcagagtaagacaaccggaatagacattgatactgtcaaacattttggtatgcgtcctggactcagttattttaaattctgattctttgaaaagtcagctggctgactccacatgaggaatctcacaaagatatttcaccagatcaattagttcttttacatttaccttgaagaaggaagcaaactttgtattgccgtgataaatagaagaacgataaatgcacagaccaagtttgacttgaacacttcatccctcatttgagaatactgtaattaaraaaagagagaatgagttactttgcagcagagtgcagtgtttgaggttgagggaaacatcaagaagaaacaaggcaattagatttttttwaaattaagaataattcataycttaataaaaccttcacagagcattatccccatccctcctgccaactttccagtgagagcccaggagtaaatacaatgggagggatactttgcatgagcttatccagttcttcccctccctctgaactaacattattttaacagaacagaagagcgcacatccatatatgcagcaaatcaaatttgcattgactttcttcatgagtaaacttaagtcatttaaggatcttgcactgtttcgtgttaagtttgggaacacagggaaatgttttaccaggaagtctttctgcctccttttttttattaaaaataaattctcaggctcttaaaatagaaaatagcctaagagatctccagctagtgtagccttttcatttcacagaagagaaaccaagactaatagaccaatatgcttgatgcccttcgtgtctgctcaaggcagccctggggaatggtggtaactttattttgattatccagagtactcagtaatttcattgtctagctttaaaagcttctagaaggtcagcactcaatgtgtatttgccttacttctgcctactctcttgaactatcttggagttactaagctggggaatatctacttcctccagaaggtgggaaagtttttaaaactgaaaaagaccttagaattagcctaaaccaagccccacatttgaccttaatgagagagaggactagtagcaggcaggttattttatttttgggggatagaaaactaagtgtcactttggaactttgtaatctctgatttgcatttcatggttacttcaaacaagaagctggcaaatagaggtctcacaacatcttaggctctatgtccacaataccaagacaaggtttcagtcaggtcaagaaataataaaatcagtccaatctgttgttggtatggtgtttgcaataaacagttacatgatttttattcttttctgacttcttggkgtggtctgggttttagactgaaccccacttcttagtgtcatagctaaggtttggagaatatcctgtagttgttgagctctctggatgaagcacaatgctgttcagagactgcacagttattgcttttgcagggcaatgctttttctactctccagtattgaggcctctgtccacttgctggcaacctgcttgttatctggagggaaaccaggaacatggctctgaagaatcactttaagccatcctcaaccctgataaaaccacagaaagcccatattattaatattattaatagttaccaatagtgctacccaagaacaggtcacaatcatagaggcctacacagagcagcttgaaaattaattagccacaaagcagttaattcaaagaaagataaatgtttgaattccttctaacaaccaattacagaggatctaattattcatccttggcttactgttttttttttattttgtttttttttttttgttttttgtttttttttgagacagagtctcgctctgtcgcccaggctggagtgcagtggtgtgatctcggttcactgcaagctctgcctcccaggttcactccattctcctgcctcagcctcccgagtagctgggactacaggcgcctgccaccacgcctggctatttttttgtatttttagtagagatggggtttcaccatgttagccaggatggtctcgatatcctgacctggtgatccacctgcctcggcctcccaaagggctgggattacaggcgtgagccactgcacccggccggctactggttaatttcaaaccagcatggttgcgtagatttgataatgaaaatttaaaaacagcagtaataatcattttagtgtagttaatcagtacactaaaattcctcctcctcctcctcctcctcttcttcttcttcttcttccttcttccttcttccttctccttcttcctcctcctcctcctcctctcctcttcctcttctttcttcttccttttttttttttttgatggagtcttgctcttgtcacccaggctggagtgcagtggtgcaatctcggctcactgcaacctctgtctcctgggttcaagtgattctcctccctcagcctcctgaatagctgggattacaggtgcccaccaccatgcctggctaatttttgtatttttagtagagatggggtttcaccatgttgaccaggctggtctcaaactcctgaccttgtgatccgcccacctcggcctcctaaagtgctgggattacaggcatgagtcaccgtgcctggctcttttcttcttttatgtcatccacccatcatcatcatgaacatcaccacctgtcatcatcactatcatcatcacagcatcctggagctgtaattgaccattgccttcccaattcagaaatccttttcataacattcttgatgtctcctcaaatgtctgttgattatcatccgatgaccttctctgctttatctgggaaagtgggtttcttttctctggtcctaagcagggcatctcaggattctaaacaccctcaagttgaacactcagatcctgagcctgagagctcattgctttgcaaaggcttcctttccattattggcccatgatcctatgaaaagatcccttcctatagatcccaagcctgagtctctgtgactacttttatgaaggttttttactgatgacttaaaaaatgtgacataatcatcatttgtccagactaaagttgcgtaagatattatattttcaattttcttcagatggcaaattgggtggagacaaagtacrgagacgtactttgcttttagatttgtcactattttattgtgagcaaagccaatttctttgaacctcacttttcttatctgtcaaatgggaacattaatatagttcataagtttggcgttaatgtagttmataagtttgaagcattctattattttcctgtttgaacttcagtgcytagcataatcacataaaagaagaatcttataattgtgaagttgacatcatcaaatataaaatgctgtgtttcagaatgtggtgcattgttactctggaaatgcaaggagagcaggacttcgaaaagaaaattcctaattggctcagaatgatagagtactgagattgattagtgattcatttaacttcctcttgacttgtaaaggtctgaacactctggctcatagctttattaagttagttgtgtgcttattgcctgccaaagttaaggactccttgtctcatctctgttctgtcctcacctggccccacttatccttttatatctcagttgtgarcatgaactaatcaagagctagattaastggatttgaatcccagctctaacacctatgcaaccttggacaaaatctttaagctttctatgtctcagtttccttatctagaaaatggatacaataataggaattatctcataagggttactgggagaatgaaatgaggtaatatatataagatgcttagaacagtgccttccacgataaycctatataaatgttacctactgtcaatcaattaattatacttattttatttctatactttcwtctatgtgaagcttgccttttcaatgktgttgccttgcaggatgctgtcttctattcctctgtacagtattgtaccttgcactcagcggtgaccccaaaagtgttgactgatttttccaccatgttataaaagattcttctaaagaaattatgacctcctgtgtgttttttaacttggaagaagaccccactctcattattccccttgcttcttgaaagattacccaccaccgggtagaattcttaacttttctaggatccttaggaaaagtgttcttggaaatgacctgtgaacccttgtaatttactgagcccttggtctacaagagaacttggcaatcacacacacacacacgcacgtgcacacacacacacatatgtatatagatatatatttttttcagataggaaacttgaggatcagagatgtgaaagagcttgtcatagtcagttggtggcaaaattcagacacttggaacaaattacaaatacttcttcggagatcttagattaggatttggaatattattatttctcaatctttagggtcttagttgattcaaaaaaaggtcaaaatctaggataaggaatttgaataataaggactaatatctagtgcaagrctggtgctgtgatacacgctttacatgaatgttctcatttaactattgcaactcttgaagaaggtcttgtttataatatcctcactttgtagataaagaaactgagggtttgaataactgagtaactcaaccacaccttcacagrttgcaaatagagaatccagtgagttttgcwctagaatgcagggactcactggctactgcttccttgctattttcagagtaaggctatcttgttcataggtgcatgatcagatttcttgggtatatttcagtgatgcaatttawgatatacagaaagggaatgtgttaaaaatttaagcctatgtaaatcttggttagaatgaaagtaaagcatatgggcaaasaatggacattagaaacagcctaaaaattagtttaataaaatgccacygctatattttcctgattgatgaatggatcctcatcacaatgcaatgcaaaataatgagcccctttttaggccaggatgggtgaactgataatagggaagaaaacaaaagacagtagattttatttaaatgcaacagaaggagagtgaccacaatcttcaaatgataaacaaatcatttcaaaaatgaaaattcctgtttgatttgatgaagttcagacccattccttccaaggaagtggagcaggataaacttgtgtttcattttgttcatgtctggggattctggccctgaattatcttgaaagacatattcagaaatgaaatcatagtcatgagggtcaatgggtttttagatccaccacaaagaagctgagaaaccccagtctgatcacatgcaaaacaaatctatttcagatttcttatccacagagagatgatcagggaagttcgtttacagaggtgatggacagagcttccagccttccatgtttccatgcctgggatagtcctaagaactcttcctaggtgagggggaggaaaaccacagtgctttcctagactctccattttgactgtaagstaaaaggcactgaaagattcttacatttctacaagatgtagaagatgcttataactaaaacaattatctagttaattgcctaaactgtaactgtactctgtcttttttttttttgagacacgagtttcactcttcttgcccaggctgcaatgcaatggtgtgatctcggctcagcgcaacctccaccttgcaggttcaagtgattctcctgcctcagcctcttatgcagctgggattacaggcatgcgccaccacacccagctaattttttgtatttttagtagagacggggtttctccatgttggtcaggctggtcttgaactcccaacctcaggtgatctgctcgcctcagccttccaaagtgctgggcttacaggcatgagccactacgcctggccactctgtctttttatcaaagattgtaggtgagattacagaatcttctaggtggaatgaattgtatttgtcatcttgctccaatctttactaatgccagtttaactcactaatatctctcaggtataagctgttaactcctgcttgaatatttccagtgttgggggaaatcaagtcctcaattgggagcccatttcatttttggataaatttagtttgattaaagaaaattttctagcacatcttttattagtatatattaatatagttgtaaaagaaaattctcaactgggataacctgttcattttgcattagtggatgaagaaatttaaccactgttctgttgttaaattcatgcattctgtagcatggcagtagcatagagcatccttaaaatagaccatttgggctgggagcggtggctcatgcctgtaatcccagtgctttgggaggccgaggtgggtggatcatctggggtcaggagttcgagaccatcctggccaacatggtgaaatcctgtctctgctaaaaatacaaaaattagctgggtgtggtggtgtgcacctgtagtcccagctactcaggaggctgaggcaggagaatcacttgaacccaggaggtggaggttgcagtgagccgagatggcaccactgcacttcagcctggaagacaaagcgagactctgacttaaaaaataaataaataaataaataaataaataaataaataaataaataaaatacaccatttggatacaaggcataattgcaatgagactaattttcagtaatttttgaatttcaaaataggccatcttctctatcttggttcctacaccaataaaattattattaagagcaattaattctatgagtgacaggtgagtgtgcagaatgtctcactgacatacttcttcccaagcaaactgacctctgaacaaatgtggatttaatcatgttaagttgactcacaaggaaacatgctaacatgcgtttaagattgatgggcttsagaagtgcaaggctgggaggacacctgcccaggggtgacagaagaccctaggttggtaatacatttcctaatgttatgtccttccttgatagcggggttagactgggcacatgagaatttcaagaaaaacttttaaaaaccttccataccaccattcttccagctcaccctccccaacatctttcatccttgggaggaagaactcttcctttcttcactggtccagccccccacccacacccccagccatggagaagccaagagagtggtaactattgctatattctttacctagaagtccctggttgtagatgataatgatgtctacccatgaagcgttacaattgcttcagtgaccaggtcaatggcctcataattctgtaattctatattacactrttataggtgaaattggcacttctgactctgaaaatgctggctttatgggactggaactggctaattgatctgattaaaaaatacacacgaaatggtacttgatatcatttgactacctagagggtggtagaaacagctgtaattttgcaagataatatcaagacaataaaggagtcttataagkctactgtctcattaagggatggatttcttcccgaagcctctttgaaacctgtccttcacatctgaaggaggaggccaagatattcatactatgttgggacttactagagcagtaaaaactcaagagcagcctgatrctataacagaataaatctttaaaaatcattttaacaataagatcatgaaaatgactaggagatatgtgatttagaaaaatgaaagagaaaagctgagaccatttggttcatgcttcatgttcccatttctgttcatctaaataagacatggagtggttcaacaaattctgaatgtccccaagacaaaaatgtgcattttgctcgttacctaattccagagtccaacatcataacccatcagaaaattcattcatttgcttagccttcttttctttgcccagatttctcctttattattttatactaatcattacaactccaataaaagttgatgggatgaagtaagaaacattttagagtttatgattcatttttcttgaagtttttaaagcctccatttaactttgattttctttataaatgacagaaaaaaactgagagacattctggacatagckaagaaccaattgtactgagccaaataattatctaaagattctcttgtgtggcaaatccttggttttatgtggctgctaaccgaaaaaagaaataacattaaatgaatgtttttgaaaatactcagcacagaacttggttcatagtaagcactatttacaatagttatcataatataaaactggcaaaagcttagttgtgtgtagcaaacraagctcattcaacttcagttttgtttaatatgaatttgatctttttttttttgagatggagtcttgctctgtcacccaggctggagtgcagtggtgcgatctcagttcactgcaacctctgcctcccaggttcaagcgattcttgtgcctcagcctcccgagtagctgggattacaggtgtgtgccaccacacctggmtaatatttgtatttttagtaggggcagggttttgccatgttggccaggctggtcttgaactcctgacctcaagtgatccacccgcctcattctyccaaaatgctaggattacaggcataagtgaccactcccggccgggtttgattgttctgggaggctatttctggctttgtcttctcttgagccatcttgtcacaaaactacctccttgattgctcaagctaatcagccttttttgggatacacagttcaacggtggttcgaggactcatcattccttctcccactggcctaagaaaaaatgtttcatgtgttcatgtattcacttatttgattcttacgtgttcatgcatagttagggtgatagagttgcctttgttttcaggctacctttatcaagattgtgtctgttgccagaaacaagaggtggattgtttgtatatgtgtgtgcctatgtatgtgtacatgtgtgacatgtgtggatatttgtgtgtgtgtaggggggcaggggggaatgaatagaggataaaagaaatgttcatggttttaacttttttttggtctctatggtatatttgccatatgcattactgtataactcctcccttgcaacccactggctgcatccttcttgaatttcaaactatatgaaaatcaggtgcttaggagaaagacaggatttttcaaggtgtggcagaagtggtagaatagcttgggagacacagtgaactctacttgaatccccactctgctgccttctattactgtgggccttggaaaagctgctcaaactctttgagactcccttacctgtcaaatagtacaattagtacctccataaaggaagttgtgacacttaagtaaaatgaggtaaaacatttaaaatagtcatgatagggcctgatatggtagtaagtgatcagcaaataccagtttccttgtcacattgctgcctcagttgcaattcattgcagcctccaaggcacttaagtattatctgcatttcatctgcaccaccttgcaaagtggccattatcatgcccaattttaggatgggaagttcccagatcacaagccagagtgtaagttcccagggcacagaagctgtggctttatgtcttcctatatcatctcagtataagatgcccaatggagtggacacaaacagaatccaaaccaagcatactgaatgctctgagctgttcctratggacttcccaagaatcaatagcatgaatgctctgagctctgctggaggcacttcccaagaatcactagagtgaacactctgagccatgcctgatggactcccaaggaatcacaagaagtgtggacagaaagacaatcttttgcaggagcataaagaaacccatgcgtgaaatatctaatccttggctggcttgtcctcacaggaagaaaagcatggcctttgggaatgataaaacatctatcatccttgaagagagaaacaatccttatctttttttggaaaatagtgataataaggatcttagaataatcaaatcatttagagaaaatacaagcaaatgacacctacaaatttaaacacatctcagaggccaaggtggtcactgcttgtgctccagtgatcctgggagattgttggaagcacctcttccaatgagctacaaggctgtacttgcttagattaatgacggttggaaccctggtaccctgggatacaagacrcattaagattggcccatatgagatttatcttaaagagggtcttgccttgtgcaggtttgggttagaagaggattaattagaaggacaagggaaaagaaagactattgcatttatacaaacttctgttatatgaatattgtgccatttaattttcacaacaacccctaggggcagacaatcatactcatttcgatgagatcaagccccttgctttgtatcacccaaccggtaactggttggaactgggttcaagtcagaatccagtctatgttctttcctctgtctttcaacgaagactaaatactggtgagcgaaatgaggattttatacgtgtgtgtgtgtatccatttgagtgacagaaagatatcaacttgtcattacccattattgatcagtaaactaatcaactgtcctttatgctcacttctatttccaaagtgggacttgaactgaggtctagctgatcccaaagactgtggtcctgaagccattattagtctcttggagacatctcctctagacttgttaaaagccatattacccttgagttaggacccggggactttttgatgtaagctgatctctgaagatgtggggcaagtgaccagcccgagtctcatgctcaatcaaggacagagaaagatggccaacaaccaagaataacaaaatccaaaaaagagtatttaccaaaatgcaggtcttcttgcaaaatcagaatcttgggggcagagtgatgggatggtacctgcatttcaaacaagatccccagatgattcttaagtttgaaaactattagcctgagacaaagagagttttagtacataaatttgtcacaaggacaaaggatgccttttctcaaagcaattaagaatcaagaggaaaaatatcagcattaaaagaaggaaggaactttaatcttccttgatatggcttgattatcacagtttacccacaaaaatgcccatatccaaagcataaatatgcaatcaattttgaagtatatattaaacatgtcttaatctttattcaagatgaggaagtcaccttattataaggtgataatattgtttttggaacacttagcttaatgaaataattccaaataagtgttcctgtgttattaagctctcttaagatgctaaagttttgggttggctactctggcttggaaacatccataagtaaatgtaattaattgtcttccctatcctaagcctcattcagagccatttcccagaagagaagtgaggaccagaggctgagaaacatcaccttcttgtaagtgctctgaaaatggaagggcccaagataagtgatcccacaaaaggttaagttcctcagtgtgtaaagaaggctcacaaataaaaaagacaaaggtgagcactgcgataaaagattggcaatgaagacaaatgtgtaaatcataccatcaaggtataagaaatgtgcaagtcacaaaaggagaattataaaggccaaaatatgtactgacaaaccttctactgcaataataattttaaaaataaaaacagaaatgccaggcaggtgctgctttttacttcttaccaaattgacaagtttttaaaagtgtaagcacaatttttgagggcaacttcaaaatgactattaagtatttttaaatgtgaattctctttcacccacccctaggattttatcctaaaaataaataagcaaaagtgcataatttaactatgagaatagtcattacaacataatttgtaatttataatagtgaaaaactttttttaaaagcctgaaatagttaaatgtgcaatgagatagtatgtaaatactaaaattactgtgtaagtgaatatttaataatgrggaaaaaagctcaagcaaagaatgtttaacactrtgttacgaagccctgtgcatacaatggtctatttttataaaaatttttgatatggtttggctctctgtccccacccaaatctcatcttgtagctcccataattcccacatgttgtgggagggacccagtggggcgatgactgaatcatgggggtgggtctttcctatgcgattctcgtgatagtgaatgggtctcgtgagatctaatggtttttaaaatgggagtttccctgcacaagctctctctttgcctgctgccagccacataagatgtgacttgctcctccttcaccttctgccatgattgtgaggcctccccagccatgtgtaactgtaagtccaataaacctctttcttttgtaaattgccccatcttaggtatgtctttttcagcagcatgaaaatggactaatacrgttgtgtacataagtctatagattcacactcatgtaagaccagaatgacagatgccagaatggtaacagtggttaccctgggttgaaagatccaaagagatttcatttttttctttttgccttatacttagtatcaacttttactggtgaaaatgcattcttcttttaataagaaaatatccaataagaaatattcaataaggaaataccaatgtgattggtagcatctgacagacacattaagttttctacatmtctttaccatagttctgatttgtgcttgcccatgagatctgtaagcccacttaggaaatatctagcctgactaaagaagggcaaatgattcatctgggaaatgtgggaagagctgaagaaggcctttggcaactgcaataggtctcctctcccctatccagagttctgcttagaaagtcctgatgaytggctgggtagtgaaggaagatgttgagtcactaattctaacctggctgaggcccaagccttgggtcacatgacttgttacatatcatccacactgggtgattttttagagtgaagggaggtgatactaatttcacattgtaaaaatagacatctactactctcctgggcaaaccaggacatatggccaccatgatcataggaaattcacagatttatagcattaactgctgaagtggtcagcagctgtccaacgtcctcatttcacagataaagaatccaaggactagagaaggaaagatatgttcgctaagctacatgagtcatgagcatactgttctgaagcttaactcaaaagactcctgtgagggagcagggagtgagccacctttgaaattccatggcagggagtacacagaacttttgttctctgctgaaactccactaaaaagagtcagatcaaaattgacccatgcctttcggctcttagagttcacaaaaaatatcctgaaaacagctacagggggtgaggcagtcttatctaaccttcttaaactgagtctttattcatttccttattcattcaacaagtatttatgcaataccatgaattatataaaagtcctgtttcacataatgttgtggataggcacrccaattattataggcaaacgtgaccagggaatgtstgaatgatatttctgtacatttcgatggagctttgttcatttcggtgtttgaacatttcagtgttttcataaaggtggaaaggcaaacgggttcctatattcatttgtcttcttattgttcaaacggaataaagcctttcctttcctacaaagattgcaaaggaacaattatttttccatttccatttttcctttcagaaaacatacttttatggtccagacttgttcccaagaagaaaggtagggcagtggsaagagaaaaggctttagaatcataaatattgtatgtatttaaaaaattctaagacatatattcttaataaaaatrttcaattttccttaaaatgtacaccttracatctctgaaatcagcatgcaccttattatcaggggaatcctaaaatcttgagttctttccagggaggtttgcaattgcttctgtggtcaccaggtggcaatatcaacccaggatcattttaaattaaattctctgataatttttttttttttttgtccacattcaaagtgtgaattcatgcagcaaacctatgcagattccatttcggagtttaaattcttggggagcttcttccctttattaaatcaataccagggtataggcatatgggtttcctcactacccttgtctaagggggttgtcccactagcccctcagccccccatatccttacccggagggtgtaagcccagtttattagtgtgtgtgtgtatgtgtgtgtgtttcctcttagaaacccatattgaggtttttttttttttttttycctttytgagagctgcatagaaaatacagcatctcacagttgatgacaccttagagtcaatgaaatatagtagctggattttgagatctaagatctccacttaacctcttggaggttcagttttctcttttgtaagtggaatagtaaactgatgtatctaacagcaagcacagaggaactgcatattaatgctattttctgattctggaatcctatgtatttgaaagccttgttttaattttgttatggctctagaaccctttcctacttagcctctcctgtaaactccctctctgtgcctcccactgcatccaaagtttgacaaaaggaaaatgaagacagcacgggattgtcttcttcgtacgaaaccctgggaaatcaagtcctggggactcctggcagaggcagcatagtcaacagacaagagcagtggctatggcatcatggtaggctcagattccagtccctctctgacagtttgactttggaaaagcttcatartagtttctccatgtcacstttcaccaagtataaaatgaagctcataataacatctactttttattactgtttttgtcagttgatttatgcagacagcttagaaatagtgcctggtacttggtaaatacccaatgaatgttacttgtgatatattctctgctcagcagtaacacagtccctagagatggtctcagagcaagagtcaatgaagagtatctcggtaagagtcagtgaagaatatctcggtgacaggagaggagtgatcgtttgctgatgtgtcctgttgccatcaccactggggaacccatgcaatgcatagcacaggctaggtggtctgtggctagactgtcaatgggcaagtcccatgtttgttcagggtgctgtactctggctcttctagaakaatcttccctggtcacagaaatcaacctcaggcatgctgttcctcccttagatgtgaatgctattaaataaaacacactagaaactatctgtagtatgcacgggttaggttattagtgaagcaagtacatctttagcaaaaataaataaaagcgttttgtatagctctggacacaggtatttacacaagctaattgagaagtttctttgtaaagcaatctgctcttcatcctagcttcttcaatgcagtaaccgggaaagaaaatgtatttaatttggaccttaagcccttaattatatgatgaataagagaagtgtgtcttttactttttttgtgtgggttgagtgaggcaaaatgtttcttttccttttgttttgttagtacatagacacaatccatctcaaattgggaactgtaggtgaaggtattaattttggagtctgcaatccttaggtagctatcaaagaagctcattgggaatgctgtatgtgcacagaattgtgaattctctaaactaaggaaagcaaatctcccaggcagctgaacaaacttacaaaaaaattgctcactggagctttacagagtattgaatcaaactcctgaaatttgcttgtagattccctgctgttcctgcccgaggctcctgcagatgccaggcacctcttatgctcagtcaaggaaggtctgtcagcttctatcagcacaaaggagcaacccagttaagcaaggtcggcaccccatctgcccactcccttctccagttcaaagctgaggtgggggaggggaatggaaaaagtcatcattaatgtggtgatagctgccatccttgaacactttacctaatcaaggtgttgccctgaagactttcatattaactgtgaggtaggtgcattcattatcctcatcayacagaggggaactcacgctcagagaggttactttacttatctaagttcacatagcaagaaagtggcagaggtggaattcaaatttgactctgaatccacaacccatcttctttctactatgcctaggtcagaagactctgaggcagcagacaactggggaaaggggagaatagatatctaaaatctaagaaagacagtgtttatcactgaccgcttacatcaagttattgggtgccctcatttattatgttaaaatggttgcagctgatgtgaattcatctaaaagcaaagktaagtggctgttaatgccacttggcttaataatctgaaagtggaagaaactcttgatgcttactgagttaaaggagtctttgttctttgagtcttcttttccttaaagagcaagctgatgttctcttaatctaactctcatctcctttcatgaccttcagtctactcatgattttcaaggagaaaaatgaaagacagtaccaaaccaaaccaaagcaaacaaacaaagaaaccaaaaccacagcccctgggctctctctctagtcccatgaacatctaccacaatttactcagaaaaagagccgctgtggagacccagctctaccttgtgctccaggctggagtctttaaacatcagtgagaatggcttgatatgctctcttctcaatttatcgccactccgcaagtcgatggtatgttctattctcttgttaatttcctcaggcccagactggacatgcaaagcttgtgcaagatggtttggaagcagatttattgaatttcttgttagggcagccagagtctagggggaaagcacatgcaaacacaataaacctgctagtcccctttagataaaacagaaatgcaatgtttttaratcatgttgcattgcaaacagtaatagcattccatgcagttgtattcagtgaaacctacagaagttgatctgatagcatttggtgcagagaaatacaacctggcaaaatatcacatccagagggacacttcctttttctctatgtaggcacactgaattcctttggttgaggtatttggagagttgttggcttagaaatgttaatcaagaccctttctctaaccaggcacaacctgggtatgagagaaagagaaccaaaaaaataacagaaagtaaatatatgttaaaagtccccaaaaatgatcatctccaactgagtagattccacattttcgtgtgacctttcatttaatggtggtggagagacttggggtcttatggcttgcattttktttttttagcattactcatagaaagacagccaaatatgccaggatctgctccttaaacttgataaagattgctaaattttttacttcgctaatatgtccctccctcagcataggccattatatatctatatattcatatagatatatgtgtgtaattycttttaggtaaaaaatgcaagcaacttgcagcctcccaccatttcacagggttacacagcacgagacggggaaaggcataaccaccayggttggtcactggatatggatacatggatgcagaaactgcattggcttacgaagacacaccaggtttggcaaggagacctttcctcctggtgattcagtagccaggataagattaactggctgtatctagccaaatgcagtgttcactcacagcaccaatttaaggcagcttcttagaccaaaaaacaaaaaaaaaagtgtgagttggacctgaagggatatatagggacaaggaagcccaacccatccttccaatagatcttcttgaaggaaagtagaggatgccacgcatctgtagagtgagtaaggaagtgaaaattctctgcctttatacacactcactgcatttgcttttctctgccagcctctcagcttggctatgtttagaacacaggctagatgaagataagattatggagtcatcaaatggcagcctgtgagaggtgacataggaccttgcagatcctcttgccaaaccttcagatatcgatgagcctcagagagacttgctcatttgcygccaagccagatctgctgactccaggaccacagctggagtcaggagctttgacctctgtgaagccatccagcccaccccataaggattctccctatggtgttattgaacccttcattttaaccttcatgaaggtaatcaatgtaacataaattcaaagcttctaaagcattctatagcagggctcatcacggctagactttactgaaaccctcttctccagccctagaataaagaatagagctgcctgtgccaacatgagaaagcaaagtacatgctcttagggcactgaagcatgtaatttcagctctgagtaccaaagagactactatagagaaaaaaatagatgttagggggtggcatgttaggagaagggctggagcagagacaaggaggccagaaccaatgttctggagaattgaaaagcaggatacatgcggggccagagagtttagtccctggaattaaatgctattagtgcagcatcccagagagcaaaggaagctgaactgtcagccacttggtggatttctcattggttttttggtcagaartttttttcatatggcatggaaagtgataaaactccattttccrtcttggagaagagatggaaatgacagtccagctgtcctcgtctgaccatacattctgaccttgggatgccagggtgccctcgtaagtgcttggagctggggtctaacagctggagaggaaatctgctacaacatctgagcacattcatagttaggcatctctcactgtctgatatttttatttgtatatggttttccttctattaactaaattgagcttatccactctaccagtcccttgtgccttcagtgactctaagacttttggatttcacagaggagagaagtttcaaaaaatagtttggggattgatttctttaaatttcagtagcagcagcagcagtagcaaccacagytctttaatatgaccattatgtaatagaagaaagggcgtttttttttttccttaacaggaatgatgtagtctcagaataaaagacagtcctttacattgaatacatttaatttaataaataactatctactttgtccttatttttctcatattaatgtgaactggtgaaaatgttagcaggaattgatactggtatgtagaggacatttggaaattaggaatagacattgcttcctggttgcctgtgctgtattcagccgtccattcagagaaggattctgctgccattggccacttctgtaggatacagaccaatgaaatctcctcctttcgaaactcccctgctcctctccacattctattggctgtctatgtggttgcttcaaatgagagagaaatttagaggcattcttctttctttcatcaccaccaccaagttataggtaatagttgggaaggagctcctttcatcaaaatgtcaataatgtggtggagaattcttttcttgcccatgtagttatttttattctttgcaagtgttttcctagcattttatgcaggtagtcaattttcagtgatgttttttctgattatttcctctgtcaattacatatgacaattacaaatgctgtttggccagcaacctctctagcacctaccttactccttaggagtatatgtgcttaagggaagaccatcattaactcaagaaggcaagcaaattgaaactagagagggacatcaggaaatcatctgctttcatttaaccctcagtacactgcaaaggctacatgtctttgggggtgactatgatttgggattatctgtgatacccctctatctcattagtcattagtaatgaccactaagatgtcaccttcagtgggataatgttaccaacataaaaaatccatacactgatatattcactatattcacagtgattcatttgtaatcagtagtggagacaggtataacttgtcttatttgtctatttagagtcattagagtcatactggaatgagctatttttaatagaatagggctttctctttttaagacttacagcaccagtgcgagctagactgagatcatgtttaaaaatagcataagcttccaaatgtgattccagtattaaatggacctccaaaatgttgagacggttctttcacataaacactctaaacaattggctaaagaataggaaaaacaaatggacaaaatggaataaaatggaaaatgccataatacttgactataatataatatatatatawtagaatacatatatttgaacgtatgcttcaatgtatgattgaagtatacattgtatttatatataatatatgtatatgtgtatacttagctggtgtttttgatatttgggatgtcagattgaagcagcaatgtaataatgttataaatgatgttataaataaataatgctattcatttactttagctggtgttttaggtatttgggaagtcagttggagcagcagaaatggcagagtttgcagctgagatggcctctcatgactgagttttttcccaaaatgatgttgaattccctagatttatcctaatggagattcgtgctctcctcaggtatttccataaatgtttcctccctcacaggtgcttgagatagatcaaagtgcaaatgagaaccagagttccttctgaactgagtctctgatgataggatcttgcttgacagtttgggggttctggtgaaaattataatgagagggtcaggtagccctttgtaaattgcatttgaatgggctgggggaagtcacaaatcctcttaagctcatcatttggtttatgatcagaagactcttctttaggacttgtcttttatctgtgttcccagtaaaatcctacttttcttgcagatcctatcacttcatggattgtcataaaayttggtattcattaatcagtttgtcacagcaaataattcttcccagcaagactgcaggctgaaggtgtactgtctagaaacatccagttttgttgagtcaaaaccatttcaggtcttagggatcatacgctcaaatctcaaaagaccctttaaagcatccttacagacactgcaaatcagcttacatagttacagcactggagtgatctatttcgttgttagatcctcctaattcactctttctcaaaaatgtgtttcaagaagcacaagaatgatgagatgtttcattacaaagtggttctgtggaccaatcagtttagaaaatgtagatccattatttgtttactgccatttctccttaccttaattttgtctcttttgttcatgtctttgtccccagggcctatgacaatgcctgatactttgtagtcacttaagtactttgtaaccacaataaatgtgtttactgaatgaaaaatttcttatatcttcctatctcaatacactttattgagataaaggcactgataagttccacagaaataagacttttaaactctgcatcttccaaacttttttgaccacaaatcccccttttcttgaattgcctctatatgtttcatggaatgctatttgggaaacagtgctttaaagttcttccctgcttttattcagaatttccacacactagacctgtttccgatttctgaacaagatctacatccatctcccttcatgtggctgctttccagtgtccttagctttcttcaccaggcacatgaaatgtatttccccagttgttccataggtgatatagtttctacatattgcataattcttcttagtttgtccttgccttgtgggyactacttcacagagtatcagacccagtgcacgtggcatctgaccttgtggtggaacatggacacctaacataatctgacctattaagtaattactcattttatgcattgaaacatgtagcatctaggcatgtatcctactgctactataaaaaacaaataagacatcacctcctccagtaagcctactctgaggctgcaattgtccttatcaccattactatgattcattgtaattgcctaattaggtgattgtttctctagactatgatctccttgaggccaggcactgtgttttatctataactgagtctccggcacctggtatatctgctaggttcataataagtgtatatgaaaggaaggaatggatgagtggatagaygaaaggtcaagtgcctttataagaagattgtcgaacacatggacacagggtggggaacatcacacaccggggcctgttgtggggtcrggggagkggggagggatagcatttggagatatacctaatgtaaatgacgagttaatgggtgcagcacaccaacatggcacatgtatacatatgtaactaacctgcacgttgtgcacatgtaccctaaaacttaaagtataataaaacataaaactaaaaataaaaaaataagaagattgtccctagggcagtgtttctggtctttcactgcaaaagtccctttagtttttttctgttctctcccaaatggacttcaaattttggaaagattctgtttaccaaactgtattaaataagaagtagtttattttcctgctatttgatcaaatgcctagtttttctcagcatgagataaaaggcactaccaatgcagttaatattccagccaagagcaagggcctttaaaggcagcctagtgacgcttgtcaatgtgaggttttattcagacttttgggacccagagaatgtcactcccattactacttcccagtgctggctgctagagcaccagagaccacaggctggcaaggggtaaccttgagccttttctgggaccagcacctgggctaacttcagtttgtgtgttctccatgagccagttgtggaaggaggttaaggtcactagtgaaagcactttattctttattagctcctggacaaggcagatgtggtagtctttrgatttagctatagtagttgtgactgaggtctcacagtgtgggccaactcattgctgatatggaaaagacctagcgagaacgccaggctcagcaatctcaaggcacagctgtrcagcttctgtctttcatgctgagatgtcctaacctttcccaaagactctgcttattttcagtttcaggctggaatcttcattcagaagtaggtagggccagtagtttccccaacctattctgggagcacgcttccattacccctgtggcagcatgtttctgtgcctaacttggaagcctctgtacctctattttaaacytgatgcctgcagcctttgggttgtggaaaaggcagaggttccacctttcagttcttatgaacttcctatgtcctacaagacacaggaaaaacagtgagcctaagtaagagtacctcaacagtgcacattacagcgattctttctctactgtttgttaaaatgccaacccaacccctggaagagaaggcttctactttaaaaagagtcattttgtgttctttttttgacagattataataatatacaattatgtggtacattgtgatatgatatacgaatatgttgtacaatgattagattaatctagttaatatacccatcatcttaaatacttatcatttattcttcttaagaaagctcataccttgggaaagcttcaaggtgatctagtctacaatggtttgcattgaggacctcagggaggagaatgcttgttatgtttgaaaatggcacaatttttttccctcaaatctgggaatggggagatatgagatgaaatattttcctagtaagaaaatgctaagtggtatttgagtaaacattgacttggggagcccttgataaaatatccacatgagatctccaagaccctgtcttataacaagttttccttcttatgggagtggaggtgctagtgaataggaacatttcccataagcaaggtatcttagttaagattgttgcaacttttcttgtctatactaagagaaaatgaaacagtacagccaaatgatctgtttgatgcttttttagttagaaatcatgcttacttttccttttattttttgaatatttatgtcactgtaatctgttttccaagaaaagcaaatgaatgtttaacgagatcttattgtgggagaaggtctgtgggattctgctatggaaagcggtttaaataattttcataatagtctcatagcttctgccccaggaaacgatataacaggggtcagaatgtccattctgttgcaataatagcctagacatttctataagcctactgtaggatttcagcacccctctgttgtctggtttcccagttatgagtaaacaatgtcagtctggggmtcaggtcatttgggaaatcgttgcttcccatctttaggcagaattggaagtttccgactattgtctggatgctaactttgatagggatgaagggatctgtgacatcctttgattgacttttgttcctyggtgtcctgaaatttcagtctatgatgaagaaaataaaacaatgacaaggcaggtgcccygactctggctgataccacactaggcacttactcatttgctactcattggaaccccacaacctcactcttggcctttcaactaatattggtaaactggagcatgaaaacagtttaatcatttgggggtttaggtcccaggatatccaagcacaatcctgggctgtcttcctggtgtgctttgcctggcattaaatgcctcacctcttgcttcagttcaacctactcctgggtcatggctttagacacagatgtactctcctggttctcttgagrtgtgatgtgggcaagtggtccgctgtggcttctctccaggttcaaccacaattccccgtgattgggcagagttctcaggataagaagactgagacctcacagagggaattaccaacattctagattttgtcccttagagctggcctaaggaatccagccaggttaacttgggtcaagtggggtctgacaatgattccctcctgcctgagaagcttrcctgactctattccaccaatctattagctaatcctagatgcttgcctctgatattattctttgagctccttaaaaagaagattctcatctcagtttgggaaatgtgattatgtctgagacattacacacttgggtcatttttataaaatcaaaaaatgttgttaaacttctgcagaattggcggaaacagaacttggcacactcatttagatccgaccactttgacgccacatgatttgaggcaaattgtcaattgaattgaatttttagctttttaagtatcacatccgtagtaatgtgtggaacagatatgcaaactccagcacggacttcatctcgagattagggatggtgtaagtgctgggataaggtacgatctaggaatggaggcaagatttctgccaggattcacatgggactcacaagtaggggagagagaaactgaaacattggtggtttgttcatagggccacagggtaggtgtgaattgaaatatctcytagcactgaattagctgggttgaaatgtcattggctgtagttggtgagatgaccactatcccattgactgaatgaccttgggttggcaacctggagaattttagctcaggaaatgaataaacaaacatatatccagacctaagttactccattttcttgtgaacatcaaagatgtggattttttagaggtgtcaataccatggggagaagaaggtgtgtgtgtgtgtgtgtgtgtgtgtgtgtgcatgtttatatgtgtgtgtgtgcatgtttatgtgtgtgtttgtgggtgtgcaagtttatgtgtgtgtgcatgtttatgtgtgtgtgtttgtgggtgtgcatgtttgtgtgtgtgcatgtttatgcgtgtgtgtgtttgtgggtgtgcatgtttgtgtgttttggggtgtgcatgtttatgtgtgtgtttgcgggtgtgcatgtttgtgtgtgtggttgtsgttgtgttttcttaatagaaattttgagaaaattgaaatagaattatttaaatgtttagctttgaaggttcagaagtaacttttaatttaggcagatgaaaaacttacacatcttgggttgctgataaattgctcatgtttggtgttttaaatttctcagtatgagttttttcagaccactcttatacaatttactaatcacatgtagttattgatgctttccttaatttaattccaatggagcaacaaattactgaccttcaagaatccagcatctcttacttttcaccagttgtgtcagggcaaaactgggaaaagaagaaacggtctatgttagagctacattgctacctctttggggttgtgcctgctacttccttttaccctaactttcccaacacacacatttctataagaatggtgtaattggtttagcttttctggttttttattatcccgygtgtttatttccaggcttatcmcttatsagtggtcctgtgtttaagttttccccagacatgaagtccagagtgggtgatacttcatacaatgtatccaaagtccttactatctcacagtgtgacatgattctttaggggactaaaggtaacataaaagtcacacagtgggaagagacactgccaaatctagtggtgcataacctgaaattcacaacagtagtttgggaatccttgagatagaagaggaccttgcaaaaacttccatccatactgtatgcttactgaagataagccactgtaagtctcttttgacacaaggggaagtaaaaagaagtacatatataagtaccgtggctgttcaggccaacaaaaatatccgttatcttttctctggctagaattcagtcaccttagaatgggaagacccttgtgtttgtgtagagcaggaaaactggtgggtcagggcacatataaaattacttgaaaaatgggaataaaaattcactcacatcaaatgcaattttgcttggaaagaaaaaccttcctcgatatgaactgcgctgtgtcaaacaataaaagttatacttggtggcaaagagatgagagcaatcctggtgtagctcaatgaagagattttacactgaaggatctgagcccagtccttggcaaagtgaacaccaagaatgatagaaaataaatcccacttctttgttttcaaattgaggaaataagtcaggggaaaagaatccagatttttgcttttactcttcctacctatcttctcatatttaaaatatcatacatttccaccttgacatatttaaagtgctatacatttattgggtcttgtttgtcagccctcagttttatgactccccaaacaatgactcaatatctcataaaagaagagtccaattcgtttgtgtagaaaagttttagcaggttatcagcaatgggagtaaccgtggctgcatgatgtatgcttgacaacctaaatgtgtatttttcatgtctgtggttctacataagcctcagtcctatctctacctttatctcttcttccttagtctaccccaggaacttcagagaaaggaaggatgatgagtcaaagcaaatggatccaattgcctacttaatccattcaatgttctctggaagscttcaaatccacttgtcttttgaaacagagtgaaaaagcagaccccactaatgattctccctggctgaactcagcagctatcctcagattcagagctcaggacagcctggggagttttattgtcagaaaaagccatgttactggaagaatgcagcttgacttcaggaaaatttccaaagatttccatgttcttgaccctaagtctgcagatgtcttatctaataagcatcaaaacttaatctgatgttaaaatggttaaaaaaattacctgtggggaaaaatatgcctgtgattctctgcatatttatattgaatatggacaattagatgtcctgtaacttatcacagaagcagttacctctgaaaacacacctttctaaagatcaagattcaatatttcaggtgtttttagggggaggaatttcaggtcagaattccctgtagggaaagagaaatctgtgctttggtcttgagcaaagaaactcaggctgagatggtggacttgctttttctcccgttctaaggtcttgttccctcattcttggcttaattcctgcttgcctgtagatctcagcttaaggtatttcctgattaactcagatcaattttccctcatctactactctactactctgtcctgccataattgtaacaatgttcacagtgagcctgctgacctcttagtagcaccatcaaactaagctccggagtgcttgccccaccttcgtctctatccccagatcctagaactttactggcaaattgtagtttctcagtaagctgttgataaatgcatggctgaatgaatgaatgaacaaataagcatcttgataggattgcctttcttaagctgaatgataaaagtaagatgagtttgaatttaaaraatgcatttttttgcacgccttcatattcacraaaaagaggcttgccccttagtttgaatccaccctttaggggcagaaagaagaaggaaagaaatcaaatcccaggsaacaatatcactcaataagagaacataatgaccatggtgaaaacaggaccttgaaagcaggcaaagtgtgatgatgtctgtaatgatgtttgggtgtttatctacayaaaatcataagttatgcttagagaaaagggtaaatctcattccctagttaggtaagattttacctcaaatactttttaatttttttttctttaactcctgttgctgaatttggtattcatgttttaagacggttcaccaggataagtgtagctgttaccctacagtaagataactgtaaacagtggatgtccccatggcttcctggtaaattatttatggatggtagaattctgaagtgtatgtggctcaccagtatggccacagtcttggagcctgtgtctgaggtagggaaactgaatagggcaatgtcagagctgaaaggaattgttsgatcatccagtccagttttgctattgttcaaatgaggacaccgagccttggaggggagaagtggttgcccaaggtctcttagtagcaactggacaaatctgactccaactcagttctgcttagtttctattcaggcccttccactatcatatgtgcaaatttcaattcctgcagagatttactcaaagatcacaagactcacagtctacagaattaaccagttcactctgaggagcctgaggctcagcattggatccacaaggaggtttcaatcaggacggcaatcagatgagaattcttccttttcttctaataaatacagagaacaagatctaagaaaagtcccagctggaattggtgaagatatagtaacctaaatatattctttgaccatgttcaccagcccagccagcccccactgacttcacatttccttttcttctggtatcaacatttgccaactcaagtgggactaaatcaaattgttgtttgtttgtttttactactaggcacatgtgagaggctgcctagtgttgccttgttccaggcaaacaatcatcatgcgaggacactcaggcaatgagatccttcttggttgggtaggatttccaaaatttagctggagcagaatctggtcatttcctgatgttttcatttaaaatttctaaatagccgtggtgagcaagtgacccacatatatgagagggtgaatacatgtacacacacatacacacctcacacatacatacacatatacatacacaccacacacatactcacacacaccacacacatatacatacgtaccccacacatacatacacatatacatacacaccacacacacacatatatacacgctacacacgacacaccacaccacacatacatacacatatatatacacagcacacacacatatatacacactacacacagacacaccacaccacacatacatacacatatacatacacaccacacacatatacacactacacacatacaccacatcacacatacctacacgtatacacacatcacacacatacacaccatgcacacatatcatacatatatacacataccacacatatatacaccacacacacaccacattcctaccacacatagacatatacttgtacacaacacacacagccacacatggaaagcaaatatgcttcattgcctggaatacagataaacatccacgaggtcaccaacactgacaggagtagagagctttacacatgtttatacacaccccacacctatacacatcacacacacatatacacaccactcacatacacacacctcacatcatatgcacatacacacatcacacacatacaacacatgcaacatatacatacataccacacatacatccatatatacacacatctcacacacaccataccacacatatatacatatatcacaccacatacacagcaaacatacataatacacatataaacaccacacacatacaccacatacataccgtacacacatatacatgcacactacacatatacacaccatgtacaaatacacataacacacaccacaccacaccacacacatattcacacacactacacacacaacacacataaatactcactcaccttctgagactgacagatgacctgaaaacaaggtagaagatgacacccagcatatatcttcaggccacaaagayggaagcagtgtgaactgatggaaagcatggggctttttgagtcagatatatggggctctaattccatctctgttatttaccagctatgtgtccttcagggaattaatcaattctctctgaatcccaattttcccatttgtgaagtaggcacatcacacttaccctgtaaggttggtgtgagaattaggtggaaaaacatgggcacaccactcccgacatgctacctgtcccraagctctctactcctgtcagtgttggtgaccttgtggatgtttatctatattccaggcaatgaagtgtgtttgctctccatttgttacatggagatagaaattccatctgtgtttataatcctcatggtaaacacattaatttcaagataacaaaaatgcctcaaatcagtctattgcatagaaatgactaaaacatacagtggaggtaccagttgtgtacttttctccatatgactctttcaaaaggcctagcggagtaacagaaacatgcctggattctcaggctgtaataaatgtgaaagggatggatgggatgaagatgattccacaacatacggaaacaaattccaggctctgaaaaggggccttgcttctcaaagagtagcctcagttctcttggcatatcacttgtcataaaaatccagttaaaatgattaatatcctacacacaatacatttttatagctacataaaaacctttggtatcttcttgaaaatctgaagtctaagacggatcttttttctgctaagtctactcttgtcccgacagtccattcttcacaggcagccaaagtgatcccttaaaaatctaattgagatcacatcactgccccgcttttaccctttctatcacttctggaataaaatacatcaacaaagcttgcaggacggaggtcccagccccttcagctccatctgttactccttttccctgctcactatgctctagccacttgggactttttgctgttctaacacactaaactcctttctacctcagggtgtctgcactgcttttcctctgtttagaatgctcttttcctgcttatttgcatgagagtccttttagcactcatattaaatctttagagagactttctctgacaatgccttctgtatgctatatactccctggtcatatctctctatttccttcattacacttatatgttttgattaattgtctgcattcctcactcctttgaaatgtaagctcctgggctgggtgcagtggctcaagcctgtaatcccagaactttgggagtctgaggcgagtgcatcatttgaggtcaggagttcgtgaccagcctggccaacatggtgaaatcccatctctactaaaaatacaaaaattagccaagggtgctggcacgcgccggtaatctcagctacytaagaggctgagttrgaagaatcgctggaacccgggaggcggaggttgcagtgagccgagatcgtgccattgcactccagcctgggcgacagagtgaaattccatctcaataaaaaaaaaaaaggagaaaagaaaagaaacataagctcctggaggacaggattcattcattactggatcctcagtatgtagtacacttgagtatctgttaaataacagaatgaacaatagctcaagcccagatatagattttactcagagcatgcagcagaaaaggaaaatataacctttatgataaggatcctgttsttatcttcctttcatttgcaatgttgtctttcaactgagagattcaatgtccatgttgataactcatttaataatctagccttgaacttcctggatattctcccccatatgtgaaatttttcacttttgatctacttcaatcatctccttctactttttaaatcttaagttccaatagtccacctgtgatcataaacttcttgccttctagtttccttactttcatttcacctggaaactcaaggcatggggagtctcactgggatctgagtcagggttcaggaaaccaaggcatcaaattaagaggcagaacatctgcacttgtcaagggccagggatataaaagggcatgggtgttcaggatgtccaagagcaaaacttggataccagaatggggtcaaaccaacaattttaacccaaatggatacagatacaggggcagacaagacacagcatcaaaaccaagggagtatggtcaggcagacagaaactggaagactcacataaggggccacagataattattagtgattttcattgctcctccaagccatttacaaactactgaaatgggtagagggaagggaacaggggtggaactggagttcttggaaacccagagccacctcttaccaattatgatgacctggcttctgactctaccatctcaccagatctgcctcttgccaatgatgtccttcaatccagttccaataggcagctatcagtcttcatcttcctgggcctcttgtctccatttgactttgctgatggccccttccttcttaaaatgccatactctaggcttctgtgacaccacattccctagttctcttctgacaactttgactgtttcttctctgtctctgccaaggaatacgaatctttcaccttccaacttgtgctcctcaaggtctgcttgtgtcttcttgttccttaattttacagattctcaacagtgatctctttcactgccatgtcttctactaacaccaaaattctcgtgactatgaataccaaattcacatcccttgcacagttcttttatgcctgagtttcagaaatgtgtgatcactctccctggatttttcccagacacttcaagctccacatgtcccaaagagaattcctagtcttcctcacacaatctcctattccagtactgcttattttagttggaagttctatcatcsacgcagttccaagcaaaaaatctagaattcaaacttgactgattcctctccctcactacccatatctatcatttaattcacttattcaacaaactttaatcaagccctgtgatttgccaggtattgttctaattgtgggctaaattgtggtaagtgaaacggatataatttctatcttcattaagaatataaaccactggctgactttgtctctaaagtgattttttttccccatccctcctcttttttttttttttttttttttactagcagtagttggcttgtaatagatgctcaattaatccttattgaatgaatgaatacatgaggatgtaactatctgaacatctgctatctacatagcacagaatatgacacagcaatttgatgccattaaacatatttctaagcacatattatgaatgaatagaagccaaaacatctggccaatttagctggaatacccccagtgaagcattagcatgctttatctgtgttatgcaaacactcagatggtcggggcttccgtggaattgactgggtgttttggcaaagcataggctcagccagaccagtcttgatctcttccagggacaaattatgtctctgaattgcacatatggctcactgacttctagagttaggcataagtacaaacattgaatacttgtgacggttttaattggctcagtaatttccaaaatattattggtggcacgcggttattcatgaatatcagcacacattcacttgctcttcagtctgaaggcatcaaaatgaattcagatttttcgtgctaaagatggcacagatgggttacatccaggcaaaacttgggcattaaaaaaatacacggtatggttaaacaacactaacaatctctagctaataatgacatctcttataataggtatttggtgacatcaggaaatatctttaggaaatcagcaaataaatatttcaagcattcctatacartttaaccacatcaatcaactatagaataaaaccaagaacctccacctccctcttcttggctctcagttattagtagcaagttcatgtacaatacagattagaacattaaggaattatcttaattcctacaatcagcataactggagagagatttttcaaaaataaagacaaaacaaaaactaaaactgagagagagaactttatgctgaggtattcaggatgaggcatgcatttctttctctttaaataatcagcatacagacccaagctaacaataggcaaaagcagcagagagggcactgtcagctggtcatgcacccactccaggaagtatataacaccattattttataaaacagcaaactgtaccatgcacaccaactcagagatggaaagaacctaggcattgcaatcagttatgacttktgtgkgcataataatttttgggggaaattaaacactcacaaaagagctgtcgaagacctaagggtcaactcttgcaaggcatgcagcctaggttcaacctgcagcttttcccagtggaatctggcccatgcattttctcatagtttttcccccacagatccagaaagaaaccaaagacagcctagtctcagagtgccccatcaaactttcaaatgcagaaaaaagaggggagactttcagcattttaacctttccatttaaaatttttttaggcagacagatttttcttatctataagttaatgagaaatgttgaggtctatggaatttaaaaattaacccttatatgtcttcataaaactccagacactattggctgggtacttcatggtactctcagcttctgcttggtcgaggatcttatcagaaactgtcagataactgtcagataagtgttatatattggctatttttatttctttctctaaaaatgtatagtacagtcacatcattgaacttatgtgaattcaactaaatgtgctgtgtctaagaggttaaagggaaaatccatattagagcaggtaattttgccatggctccaagcaagcattctgggagaacagaatctctgtgtccaccttggttctcgacctggctcagcctcagttctctaagtgcctcttggagtctgagcatctcattgggtttactgtgatttcaatatttgaataaataatttaaaaagaattttggttattggtgatctactccttatgtactgacttagtagccctgtccttcatagaagatgcaaatccatgctatataaaaatagaatcatgtgggtggctttgaaattgcatgctcctcctgaactccctaactctaggcatcacttggtgctcctttcctatttccaaatcwgcagtgcccccctgattttgaatctcagagggtgacacagaactgatgatggccagctaccgaaaaaggggcattcccatgtacttgatcctcccctttagtttaataacaragggtttattttttccaacatgagtggtttttttttttttttggtaaaattacaattcagcttcacataatatttatttttagctaggttacaaaaaaaaaaaaagagagagagagagggtgttaggaaccctctggcatttctggcatttcctgaaattgcatacgaggttaattctgtcctgaggagacagagagatagtttgatcatttgcaattatggtgttcattggagaaaaggttaaagatgaatcagttttctctgaggtgtctggattggagatgcacacgagcatgcattcatggccaagcagaaggaggaagagaggacttacattctgtttccccacgatattatcaaagggcagttcagggctccaggatccttcagtgaatgtggccccactgtttctccggtctgaggagctcactgactccttgacgatatcttcaggcaaggacagcagactgtcctcaggctgcttaattaagtaagtttcgatattatgcttcctcaggaattcattcctctctttaccatggccctcttccaygttatagtcaccgttgagacagtccagcgtggctttggaaatgtgaatcctcctgtgtgtagaaggcataggtcattacacrctcctgatgttgcctgcaaaggctatatttttttgacctgtacaaaaccaacaccaggttacacaagggtattattaggacatgtcctcagggacaatacttgtcttcctaaaaagtagaaagaataaaagaaaatagaagcataaattcatgagcacagtatcacggacatcgtcccaagagacactgctgcctctgataaaatacagcccttctgagccacacctaagcacatcttttggcttttcttatgattgtcagcctgatcccagcaaactttacaaaacagtgatttttttttcagtcgtgttgattatattggaaaaacaagtgctgcaaatgtttctgaaccccagtggcaatcattatccaaatcaccatgcaaaaacagttctttcttcgtcttggaacctgtcctatcatttcaatcttcatgtatttgtaacttgtttctccaacttgtctatattcttctcaagggtgattctgataagtccatagggctgcactgagggtcctttgggaaaaccactgtagggtacaatttcccctataacatgtatattataaggagcaaagaacaaagctgtggacatgtgcaggctggcagctggctgggctcactcacaagtgaagtgactcatggctgcacaattgtcagccactgtggctcatgactcaggcttcttttttagcaaaataacatatgacatcagggccttgaggatcaaacttgattcatggaaatttcacatggtaaattcttctggggaagagtttttctgtcctcgtaactgtctaactcaatcatactacttattgcgttatagtgtggtctgggtagactagcaaggtaaggtggttacaaacatggacttcattgctagatctcctagattcaaaccgtagctctgccacttgccagctgagagatcttgggcaaattacttagcctttctatcagtccattttcttacccataatatgggaaacataataacacctatctctgactattattgtgattattctacgagttgatttgtgtaaggtagtcaaaacagtgcatggtacaacatatacactataaaagcaaatatgtaagttattaagagtattctaaaaaatgccattgtcatcatattactgttgtgtattccatgccttctcaaggcttgcagaagactattgtcaggccttctgaataaggcctccaagctttcattctctggctctgtcacttcaaagctcattttctgacactcctctaatatagctctcctaygctctctccagctattcaagtaattggcaattctccagattcaacgtactatttggtgcttactaacaatytcctactgtccaattctgctcaaaagtcatcttcctaagtttactttagtgttcatttgaatgaaagaatgcttaatattttgattggcttttggaatgctaagaacaatatatccaagtaaacagaaaagtttttaaaaaaaatttagagtggcttttaaaaatgcactgtagtggctcatgctgaggaagccgagactggtgaattgctggagctcaggagtttgagaccagcctgggcaacatgacaaaacaccatctctacaaaaaaatacaaaagttagctgggcgtggtggtgcatgcctgtagtcccagctacttgagaggctgaggtgggaagatcgcttgagcccagacagttgaagctatagtgagccgagatcatgccactgcacttcattctggaggacaaagtgagaccctgtcttagaaaaaataaataaattcattaattaaataaaatgcagtttacttttagtattagctctgctactccctctcatccttctaacccattctgctaaatccctccttacagaaagaatagttcattgcaaagaacatgtgaaaaaccagaaactacaaacaaatcatttctgatacttcatgttctccacatcttccacataaatatcttgattgatttcaagtgcaagatgttaaaaataaatgtgtgaaagatgttttcactctcttgagaaatgtgctgaataaatacaaaatattcccaagatgcattttgttaatacayatgaactcaataatattgacctgggagaataacagatcgtttgaccttccatgaaatggaagtccccatccgctttctcagatgaatctgagttaagactggaagcttaccttttctcctagacaaaatgaacctggtaggagggttttctaaagtaccatggttgattttcttttaagataattaagttacatatcaaccccttttagcatttctctggattctatttttattattctgctgtcagtatgcaaggggacaaatacttccatgtattaaatcaatattatgttttcactagtgaaagagatccttgccttcactgattcttctgctgaagtgctaatcaatatgcacttaaatgttttggtagaaactgggttttagatgtttcttttcatccttgttactaacttgagctttggggtaagacatttgcagatgagattctgaagattgcatttctttctaaggaaatgtgtcagttttcaggcatttctttctaaggaaatgagtcaagtaaacttggcattttctgataaattttaatgctaggatataataaaagtagtcatgatactaaattaagacctaacaattgtgtaactcttgttttgcataaatgttatctagtagccaaaggtgttactgtgtgccccatggattatctcatataatttccgttctttcaacaaccttaggtattagacatttctttgtctccttttgcagatgctgaaactggcccagaagtaacaagtacatatttggccccaaatcatattagtggttagtggcagtgctggattgagacaagaacttttactttcagcgtctctctaccaccctggaactgtattatatggtaactactaccagcacaaccacaataaatatttactgagtacaggacaaaggactttatatgcattatttcatttaacacaagttcaaaaatggtgatcttcatggtgtggtactaaggccagcagttcctaccaggaactggtagaaagcatcatcttgagttccatgccagacatactgaaccagaaactcggcagtggggcccagcaagctatggtttaataaactctcgggtaattccaaggctgaggtttgagaaccgttcttctagaaacccaaggctcagtggtgttaaagaagaagacaataaaaaagtggaaaaatataaaacaatatcaaaccatggtgagtctggggtcccgttttgacattcctgcattttgcacattgacaacatgccatggctaagcagagatggatactgaatagaagactagactacgtgctttataagcactatcatatttgaaactacatttttaaggcggataatgttttcagtccaaaattacagtgaagaaactgggaagggcatgaagtacttgccacaatcttccagacttcataactggtaagtagtaaacccacggttcagactcatgactcatgatatgaaaaataagggtgtgaaagatgatttaaactcagtcacttttctgtttctttttacaaattattttattcgtttctttcctttttcaacttttattttagaatcaggtggtatatgtgcagctttgttacaaagcatattgtatgatgctgaggttcggggtaagaaggaaccctcacacaggtagtgaacatactacccaacaggtagtttctcgtcccttgtcccactctctcccttctccctctagcaggccccagtgtctattctcgtctttatgtccatatgtactcaatgtttagctcccacttagaagtgagaacatgtggtgttgggttttctgtttctgcattatttaaattaagataatttctttcagctgcatccatgttgctgcaaaggacatgatgtcattcctttttatggctttgtagtattgcatggtgatgtgctgatttaaacttggtcactcttctgtttcttaatgttattgagaacaatagctaaactggcttccagatatcaaagcagtatcttacaaacccccaaagcatcctctaaggtttgcaaaaggaatctattgagtatatgggcaattccccatttggtgatgcttttaagatacaggcctggaaacacagatgaattggctaacttgtttgtctaaattcagcaggtagttacttgtgggaaaatcctaaagaatggaaagatttaagaaacccagcagtgacacatcagaccttcctcaattctaaacctgtctggcaaacagccatgacacaccacatagagtgaaggatccccataagaatagtaactgacctggggtgtccctgcacagtgtacaaaaaaaagcgcttcatacccattgcctgagataatcttcagaggagacctgtgaggtggattatgccattatagcagatgagagaacaaactctcatggaggaggaaaataagttcacaaggtagcaaatcataagtagtattatctctcttcctgcagtgaagaaagttggactcagaagttaagcactggcctgagatcacacaggtagagtgatgcaagccaagttcacactaaaatcacacgccaggtgctgtgcatgctttacataacttgctgaagataatagagtttagcaaggggcagagtgggaatcctagttactctgattccacctcttgttgtctgtttcccccatgataacatattacttgatattaaacatagtttgcaaggagtgatggcacataccagagaaatctgtgactccaagggcagttctagggggtaggaaaaggaatatgtggaagtgctctctctctctctctctctctctctttctctatctccatccatccatccatccatccatccatccatccatccatcatctttaagaaagagaggctgcagaaaatcacactggctcacatatatctgagatcttattaggtccaatctgtgtaaacagaatcttgatacaacttttcaagacttacattagttgcagtggcctttgcagaccactagcacctttggggatcctatgtcaaccaaccttgacagccaaatttgaaatgttgagtttctaaggaagagcctgatttcctcactgagtcctagatcatgcatggaaagtcagtaggtcttaatcctggctgcccattacaattcactgaagaacttaaaatagattctgcacagattctgctttaaataaactggcatggggtctggacactagtattttttaaatgttcctttggagattcgaatgtgcagccaagtctaaggaccaatgctgtgcagggcagagacccgaacacctcagtgttattccacatccttrttgcctctgatgcattttactagattttggaagctaatagttgtatgatgtttcagtgtctggtctccttccaaataattgcttcctagatctaaccctgaatttctgtacacaggaaacccactgtcacaaaataagccaatgacaaccgttaagcatgaaaagggctttgctttatcttacccrgggattcctccagattcgagtttgtttgcaatatccacatcccaagaccagacatcaaactgccacttccktagtcccaaaacaccgcacagcaccgagccggagtggattccaatcctcatgtcaacatcgtgttttgtccttgaccgcacatacctgttgacataggtaaatggagagacacatgtataagaccagagtgggcatcgttggctctgcactttcttttctttttttttttttttgagacggagtttyrctctgtckcccaggctggagtgcaatggagctgcaacctctgcctcccgggttcacgctattctyctgcctcagccttgatggtctcgatctcctgacctcgtgatcctcccgcctcggccttgcaaagtgctgggattacaggygtgagccaccacgcccgtccacctcttcactttcaatgtcaccccttccatgaagccttcttaggttctttaataactagaaagagtctctgaacatccttagccttttatctgtacttttaagggctctttgaaaccttcctccaaaacctgctstgtaacctctgtctyagggaatggcaccagcatctttttctacccaacattaacctgagatagattattgatttcatacttcattacacattccatttccaaccaaaatgtcaactgtttccttctttctagcccttctgtgacttagttcagaccaccatcatgcctgagtctgggatccctgcctcagccttacctccttccagcccatactgtcatggtttccagctgctccttctaaacacaaatgtgacctcattaccccatcactcttttctgacctactacttagagctgtggtctctgaaatagagtgtttacatcccagggctgaactgggtcatccgttgagatgcaggaggaaaatgttagaacttccattcacagcttttgttacttatgttgaaaagctttaccaacatttgatatatagattgatattggaaacttaggggatacatgtctggtcatcctctgactgtaagtatggaggaggcatcttgagaagacagaagaatttctaccattggatgatttcctgtagtcatgagcrttctttctttcagagtattttgaacaattttagtttatgattaaatgatgtcatttatgcagaaaatcaaatggtagaagataatactttgtagtagaattactagaaaaaccttcattgccccccaaatgcaatgattatgtgacttcaaaatgcttaaaagagttgtcagacttaaargtgagctattcatttgtctttgacagaagacaagtgttccaaatttgctgatatttttgtgataataagtcgccattaatattccttctagcatatatttgaaaaaaacacacaaacttgcttaatttrtttcttccaactcaagatgatgacttaagaatgagcaagaaagtaactgatttttaaagaaattgatgctctgaagaaagcattttgagaatggaagtttggaaatgtttccatctttttaagaattttgttgtaaaaccaaagttatgttatatcatctatcaaaattcttagagctgcacatttactaatgtttaaatatcttctaaatgaagatttctgatgaggtcagaacccatttataagggcttaaatccatttatgagattggaaaacatttataagatatatgtttagctctgatagccactgaagcctggtatagagataaattgaacttaaaacctgacctttacattactatatcacaaactattaaaaattttttttaaaaagaattatgtttaaacccattgctctctaataaatggtgaaagcagaaaagtctaaattaaattgtaattaatttaaratwttttaaawttgtaatcaaattaaaatatttaaattaaattggatactgtaaattaaaatactttaaagtatttttattttctcattatcctttaaaatccctatattatgtatattttatggtatatatttttaaacatatgaatataattaaatataattaatagaatagttaataaatataattttattagatatgcatatcttcatataattttattaataaaaataggggatcaaaatatttagatactactggtctataagatacaatggaaaattcctagtctggcacacaaaattcctcatgatctgtccagtgycttagttattcttctcattcctcatgcacacattagactccagccatccaaacaacaagtcattgtctgaaccttgtgttccttctttcctctctgggaccatggtgcttcctcaatctggaatgtccattacctctttcaatggaagagcttctactccatcttttagagtgaagcttggtttaactctggccagtaagctgccctgatttccaagtctgactatgtacccttccctgtgttctcattgcatcctgggtgaacagtaattagggtgctgtgttataataatctgtctcctgtaaactaattgagaatggggactttgaacaactactctgtatgttcccctcttaagattgtactgtatctggcacgtggttaacacttagcaggtgtttactgagtaggtggatgggtggatgcctgggtgtccaatactttctattaatgttcatatatatccaagctttttggtaaagagtataaggtcctcgaaggcattattcctgcctgaggcagccttacattcctcacagcctggagcatcctgctttccatacagtaggacttaagacatgcagtgtccttttttaaaagaaaaaaataaataaagaatgaatgaatgattccatgtactcaattgaatctttgcagtctctgttcttaaattgtaaggtaatgcaaagctatttacataagaaagtaaagttgaattgggttgagaatatggaaatattgtaataaattagacattaggcaggcaacctgtgaacattagaagaaatgcttgtaactaatggatgaggtttttcttgatcttggtgaagttcctggtttctgggtcattgtttttactttaactcccaagttaaaaagcatatggtactttatatctactgayaatgaaaactgtaggagccatttaaaaaaaattgacaaggcaagagaagaaatggaatccagcctttgagaggagcacatcagtttctgaggcacttttccagtgagcttctgtgcaggaggtcattgagaggagtcatttgtgctatccacagccatgcccactactatactattcaagtgtatagtaggattgtcctccctgcataattttttaatttttaatttttgtgaatacatagtaggtgtatatatttatggggtacatgaggtgttttgaggcatgcaatgtgaaataatcacatcatggagaatggggtatccattccctcaagcatttatcctttgagttgcaaacaatccaattacactcttttagctattttaaaatgtacaatcaagttattattgactatagtctgttgggctatcaaataataagttttatttcttttttctatttttttctacccattaaccatccccacctccctcctaaccccccactacccttcccagcctctggtaaccatcattctactctctatgtccatgagttcaattgttttgatttttagattctgcaaataagtgcaaacatgtgatgtttgtctggatattgatgttacttttgaccaatgaaatatgagcagaggtaatatgtgtcacttctgggcagaagctttaagaccatgatcaaccacagtctttaaaattttttctctcctgtgtcaccatcatgagtcaaggagctcctgatgaagccttctaaccagggtccttgaatcaggataaaatgttatgatatcctgctatcacacccccctcctgtaataaagtgtgaatgaaaaataaacataaagtgtgaatgaaaaataaatgtttactgttttaagcactgagattttagggatgtttgttactatcctgactggcacaatcatgagtcccaattgatgttttccttattacactgttgtcactgtagtatgagggttaatatcacagactttagtgctagacagccaagttctcatcttgttccatcactgactggcaacatgaacttagagaagttattttatttccctacagatgctttaatctctgcatcgataaaatgttaataacgttgtcaagattaagtgaataaacacatgcagggagtttataacagtgcctggcctataataaggactagttgcttgtctactatttatgaaggaattgtagcctgagaaagtaaaatgattttccctatggcccagagctggtaagtaggattccaggactaaactggtactgttgtgtttttaaaacccatactctttgaacatgtgatcctgggcacatagtttaatctgaccctgagtttccatagttgtaaaataaggcactacctgattgcttcacacacagaactattgtgagccccgaaggatataataatggatgttaaagtgctttgccagctaatggtgagagactactaaacagcacacggcgctaatgtcattaggcaattaacattatacagagaatgcactggagcatcttaatgaaaagacatttagatgatttttattttcctctacaaaacaagaagcatagcaagaagacttcacatttttttactgcatagcttttctttctctttcattttgtgtctgggatttgacttaaagataagaatgaaactatataaaagtaattaataatttacagacattgatactcattagtaaggctaccctgtggttgcaaagaaccacaaacacacacaatgtatttcaagatcagttcttgaggggaggacctcggagcattcttgaagctaaaatggagacaattctactcctagcgacaagtcttgttcagttcttccagagcagagccccagggatgttttgctgtgcctaatcagtcacaaattaagagaaaaggactatagatgacatctgcatcttctctttcttctctagacactcggattctggagggcagggatgccaccttccattcccacttagctcaaagctcagcacacagacatagtcagtgctgaaagttatttatcaagttaatggagaaagctcaatggctttctgggttcacaggcctttggctgtcccaagatggatctaagagtcccagagaaaccactgagttgccttaggacctcctagttggggaggggataaccccctaaacctcctcctttcaaacagagcaaatctactttctgttcttcatggtgagattccattcaaaatttcttttaaataaaaaacacacgtaattatcattattatttttgctcacctctgtctagctggggacaaatcatgcaacaattaacaaaccaaagattgacaacattatttcttttaactgaactattaaggaagcatgttataattataaggtaaaaaatgagggaccttagattttttctttcaacttaaatgcttcaaagggttctttttagacaattaatccataggagttgctagaggaatgacaggacgcataattcagtagcaatcattgatctatacattagacaggaatcccaatgctgtaggggctagagcaaattacacatatttccccagcaacaccacacaggcatagaacatgcattaaagcaggcccggatctgacatcacacttctccatttactgcttgtggatgtcaggctagttgctttagtctcagtgtctcagtcttcccaggtgcaatggggaagagaattggtcctctgtagaggtgttagggtggttcataaaataatgtatgtaaaacacttagcctggtggatactgaacactcaaaaatagtacctagtactaacttttggaagtaataccatttttcaattgcacagattgaatcagaccaataaaatgatgaattgatcactttacctacccttttctgctaaaactctgcctacatcaactctattcacacagacatagcttcaaccaacccatcagcggcacagttcttaggcataaactggtctaaacagagtgaacaatggttacaatttaggcagaattgattgggccccagtcacctggaaaaaacggtgcccttgaacattccagaacaaaggaaaggcaagggagttagttatggaggtcaactacgttcattgcccagggcgttttgtgcagctatggaatcatcttcataacaaacctgggtatcactaccagagccagtttacaagtragagaactgagtcacgagaggtatattgctttacgtcacacagttattgatggactagttagaatttcaccccgggtrtataagcctgaacccattggtccatttctacttccctgcatggcttctttaaagggaaatacaaaaggaagtatgtggactactggggtctgagctgactcagcccaatatatggacacagtctctacagattaatctccaaagcctcccttcttatagatctgagtttgctgagggtacttcaggagtcattgtggggtagggactgccattgtggtggccatgragcccaacttttccttcaaccctgatccattctattgcctctgctggactttagtgtcagcctgccgtatgaaacgtagggtccatctgcttcttaaaatgtttgaaagccaccgtgtgttgggagcaagcccctcaatgtctggccataaactggccccaaaactggccataaataaaatctctgcagcaatgtaacatgtccataatggccataacgcacaagctggaagattgtgggtttacgggaatgagggcaaggaacacctggcccacccagggcggaaaccgcttaaaggcattcttaagccacaaacaaaagcatgagcgatctgtgccttaagggcrtgttcctgctgcaattaattcggcccatcccttcgtttccctcaagggatacttttagttaatttaatatctatagaaacaatgctaatgattgctgttaataaatatgtgggtaaatctctgttcggggctctcagctctgaaggctgtgagactcctgatttcccacttcacacctctatatttctgtgtgtgtgtctttaattcctctagcaccactgggttaaggtctccccgaccgagctggtcttggcaccatgcttaccctgacatgaaagttgtgatttcacaaagtgcttcccaattcatgttctcattttgatagccacagtgactctgaaaggtagatgcctatcaatattataaattttgattttatagatgagcaaactgaggctctgagaggattaagatgcggttattacctctcctgtgctaggccttttaccttaataacctcatttcatcctcatttccaccacaggctacatatacagctcatccatttattctttcaacaagtgtctgttgaagaactctaaagatataagcagtgacccaaacagacaratcaagttctgcattcatggagcttacatcaatgtggtttattcccattttacaaccaaggaagctggagcccagagaggttaagtcacacgggtgttaggtaatgccagactccaagctgaatggtgtttggatactttgctgctgcttgcactcccttccagtggaaaggtaatggggaagacctaactgcactcacattcaaaagcagggtggatctagggagagaaaagtgagagcaatggtgttcttgaagatgaaagcgttgctgacccttcctgccctggtgccccggaatcttagaagaacaatagagaccaagtcaggacagcagctgtgcgccaagtcagcatttccttgttgatcccgctcaggggagttctgaagttctgaattctggattttttaggacaatttatttcctgaaatggccctaactcaggggtgagggaggcacagggagtttgtgtgtgtgtgtgtgtgtgtgtgtgtgttgggggtgaaaccattggtgcttcttttattcccgttaatttcctctccttccttcaagatgccccttattgtatagtgcatttccttttccaacgtgccctctgtcctacctgcctggaagcactcagcattccctagcagcccacatctggccctgtagcctggcctgctgcagnnnnnnnnnnnnnnnnnnnnnnnnnnnnnnnnnnnnnnnnnnnnnnnnnnnnnnnnnnnnnnnnnnnnnnnnnnnnnnnncgtttcttttaatacaactggaatgttttttggagttattacaattttcaagatacatagggtaatactcagggataaatattcttatgattctctgattttgtgtgggtcttaatcaactcaggctgccataacaaaatttatagactggatggcataaacaagaggaatgtatttctcacaattctggaggctgggaagtctgagattacggtgctagcaggatcaggttctggtgagggccctcttcctggcttgcagatggctgccttcctactgtgcccctacaaggtggagagagagagccagcaagctctctggggtctcttctaataagggcactaagcctcatttaaacctaattagatcccaaaagcctcatctccagatactgttatatttgtggttagggcttcaacacaggaatttgagggggataaaattcagcccatagcagtgtgatttattaaatgagggagtaaaacctatttttttaaaaaaactatattatgaaatatattttaagagattattcccattttaattaatttaaaaattatttgttttgtttcttgtcagtaaaaataaacaatgttggataaaattttagatgtcaacttagaactgtttgagggatgtagctttcaacattattttagagagtatggagcaaagagtttgtaaatcactgttttaaaaaccagaatcaaacccttccattggacaacctctaatccagtgctatagaaattgtgtatcctggccgggcacggtggctcatgccgtaatctcagcactttggaaggccaaggcgggcagatcgcctgaggtcaggagtttgacgccagcctggctaacatgatgaaaccccatctctactaaaaatacaaaaattagctgggcatggtggcacacgcctgtagtcccagcttctcaggagtagctgaggcaggagaatcccttgaacccgggaggtgaaggttgcagtgagccgagatcatgccactgcattccagcctgggcgacagagtgacagtccgtctccaaaaaagagaaagtgtgtatcccattaggtgttccatgagagaagtctctgtttaaacagagctctgtgggactggtcagtatcgcatgtccaaactgggagagtcatttaacccgaaacttcatctacccttttgctgttttttaacatggcccagacacttaacagttacaggctcatgtggagagtgtggggagtcctggccaaagatttttgtgtgcattatttaactcacactcgcacacacacacacacacaccacacacatgatgtatgttgtgatgggctatggccaggccagctgtaggcacatagatacagtgagagcaagaacatggctctgtgtcaacaggaatttcatgtaaaggggttgatctctgagtgccaatgtggcctctctcctagcctgcagaagagtgggtgcagagcttgagggttgggtgggtaaatgtttaacaactgtctctttgggaagaaaaggtcctgatttgtgatgtctgtcaacttctgtggtgtcactatttttgtcatggatgagttcaagcttccaacttgaggtcaactggcttgtaaaattcctgcaagtttaacagttggcttttgcaaacagacaggggctgacctaggcatatcactttttaaggcttgtgactgggtagttttctcctcctaggggcagctgagaccactgcaattcacttccctctgtatggaacagagagggacaccacagcccagcccacttcctgtgcccttactcctctgtgctttgtgtcttgcttgtttctgttgtggcaatgagctgaagtcacttcaactatcctccagtattcaaacctggattagtccttatggtgtggccttccacattattatccccatttcctcaggaagaaactgagattcagcatgtttaaaattcttggaagcagggcctggtgcagtggcatttgcctataatcccggctacttggaaggctgaggtgggaagatcccctgagcccaggatttccaggctgcagtgagctatgattgcaccactgtgctttagcctgggtgacagaacgagactccgtttcttaaaaaaaaaaaaaaaaaaaaaaaagattcttagaagtagaatgtaaaccaagttctcctgaattctaaatcctaagcatttcctattatatcacgtggcctcttcccagaagtgtcactgggttagagtgagaactgtgttacatgaagacagtaagcaacagacaaacagtgtgccagggacactgtgaggagccttccatttagaaccaaaaacaccgtgatccaaggatgctaatggaatatggctccaccgcatgtggggctcctggtatttcaaagggaaagacagctgtggtcacactagactcccctgcccacaaacctctaaaggctctgccacttatccaatgaagtgaaagtgtttttactattactaagttggtgcaaaagtaattgcggtttttrccattaatacattttgatagtcaccctgactcatctccatatattctaactctgagcttttgcagatgttattgcctaagggagggaggaacactgtgatttttaattttatgtgtcaatttggttaggcctttgtatccagatatttggtcaaacaccaggctagatgttgctgggaaggtgtttttttaggtgagatgaacatttaaatcagtagactgagtaaatcagattaccctccacaatgtgtgtgggctttacacagttgaaggccttaagagaaaaattactgctgttccccaaggaagatgaaattctgaatccagcctgcttttggactcaagctacaatatcaactcttccctggatctccagcctgctggtccaccctgcagattttagacttaactagcctccacaattttgtgaaccaatttcttaaaacaaatttttataagtaatacacaccctgttggttctgtttctccagagaaccctaacacaaacaccttcctgtcatctctacctgtcaatacttttcctttttgaaataacattttcttttctagttctattagttatacatgattattcccaaatattaaaaaatatagtaaagaataaagaagaaaattaaaactactcaatttcatcacagagctttatgtcmtttctttttataaaaatagatgtattaagaagtggaggttcccattccagcaggggtagctaaaaataaataaaaaattaaaaaagctgaagttggtttaaatatgtgtgcatgtgtgtatgtgtgtattctactatgtatactttaaatgcatgagcatttttcatgccattgaatattaatgtaaaccatgatgtttaatggttatccatttttctttttcttttcttttttttttttttttttgagacagagttttgctcttattgccccggctagggtagtgcaatggcatgatcttggctcaccacaacctctgcctcccgggttccagcaattctcctgcctcagcctccctagtagctgggattacaggcacgcaccaccatgcctggctaattttgtatttttagtagagatggggtttctccatgttggtcagactggtctcgaactcccratctcaggtgatctgcctgccttggcctcccaaagtgctgggattacaggtgtgagccactgcacctggtcgttacccatttttctattttttacatatgccagaatttatataatcatttccgtacctttgaacatttatggcatcagatggtgctgtggtttgaatatgtcccacatatttcatgtattagaaagtctccaagtggcagtattgaaagggggcttttaagaggtgattggatcataagggatctgcccttatgaatgaatgattccattcacagattaatggattcatgggttaatggattagtgggttatcatggcagtggaactggtggattaataaggagaggaagaggcttgagccagcacattagctcactcaacccctcatcataagatgccctgtgcctccttgcgctttcacagcgagtctccagcagcagtaagtctctcactagatatggtccctcagccttggacttctcagcctctagaactataagaaataaattccctttcttttttttttttttttttwaattgatcattcttgggtgtttctcacagagggggatttggcagggtcacaggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatctgtttaaccctgagtggacacagcacatgtttcagagagcacagggttgggggtaaggtcacagatcaacaggatcccaaggcagaagaatttttcttagtacagaacaaaatgaaaagtctcccatgtctacctctttctacacagacacggcaaccatccgatttctcaatcttttccccaccttcccccctttctattccacaaaaccgccattgtcatcatggcccgttctcaatgagctgttgggtacacctcgcagacggggtggtggccgggcagataaattccctttctttaggcatagtctgwttcaaatattctgtcagtaagcaacagaaaacgggctaataaagatgaacatgattcagagcctttgctatgtcacttacaagctgtgtgtcattggtcagaagatgtttttattctatcagagcttgagtttcatttggaaattgttcttcacagagttttggtatttgtgaagtaattcaggtagattatttagtatagtgcctggcacatggcaaacattctatcaatattagtttatcaacaattatttctagatatattcaattttcattattacaaataattttgctaaaaataaaaatttctgtccatgtactgaacatcactctaattgaagcaggcttatgagtgctgaatttaatgacattttggaacagagtgagacaagggatttttgggggaaataaagaaagggaaagagagagagagaaagagagaaaagaaaagagggagaagaagtgacgaagggaaggaaggaatagacagaaaaaaatagaaaaaaataaaatgtaacaaagagagaaataaaaaggaaaggaggctgggaggcaggtttaggcattcttgccttcagtaaaaacaatataatttctgtttttcgtttcttgtcctgccatattgcttggcagggtgaccctgccacaaggattaagacctttactctgattaactgttggggacaaaccagttactacttggcattctgctgtcattcctatgacttttttagcaattgcactgaaaagaccaagctctgcaattttcattaagattaatcaagaacaacttttgcagatcattaataaacattgcatatgacagagcccagtgtcagccctggcatcttctcaacgatcaggactccccaaaacagacatagaatatgtgaagagaagccacctggagccacttttcaatctatgtaatagaatctattatataaacctattttaattaatttaattttatgaacagacatgcatgagatgacattaagtgtttcattggaaataaaattacattcaatctcttttttgccattcatctagctaatatcatgtttctaaaattaagtatttttggtggattgaatttactatgaggctgttttgattagggcttattatcttgttattcttagatgtttattgactgacattttcctctttcaatatcagttctgctaaagtattagaaatgtaccaatgtatgtaggatctcctaaactatatgttgatcctttgrgtattgatggcaaatttcaggcatcagtagcaattgcacaaatctggagttgggaggtgggctaccatgatgactaagatagacggctttgaagtcagatgattccagaattggtccccttgtgctgccactgactagtcatgtgatctaggtggaggtaattatacaacctctgttagcttgtatggcagaggcacctgacagccataactgaagcataccctgagggtgaccctatggtctaagaagagcgttagtttggagttccaagctaaggaatctgagagtggccaacatggagatccactgcttatccatgaagaacagccaaacctctggctcattcccctggcacacaggctgtaaggggactgacgccctttgctttggatgaaatgggggttgctaggtagagagcactaagtaaaaatgctgtataaacagcatactttttacaaatggtagttgtcttcttgtgcagggtgccaccactagaccaccccatatgtaatttccccctgtaaaccctatgtcttatttgctgtctctaggtctcatcttcagcctgagacacmgtaccatccctactggatgcaataggggtccagcactacacagctccaattttctcattggtaaagtaggagcccacttccagaccttccattagttaggacaaacctgtctagctatattgtttgttgtttgcatccattctcattgttgctctaaactagtctgatttgtccatgctgcagacatacttagttcttcagtatttggcctatcaccccgcctatcttctagaatttttatgaggacttaatgagccaatacatgcaagacatttatctcagtatctgggatatagttagtgtttaagaaactcaagcgtccgggcacggtggctcacacctgtaatcccagcactttgggaggctgagacaggtggatcacaaggtcaggagatagaaacacagtgaaacccagtctctactaaaaatacaaaaaaaaaaaaaaattagctgggcctggtggcatgcgcctgtagtcccagctactggggaggctgaggcaggagaattgcttgaatccgggaggtgggggttgcaatgagccaagatcgcgccactgcactccagcccgggtgagcagagtgagactctgtctcaaaaacaaaacaaaaaacaaaacaaaacaaacaaaaagaaactcaaactgctatcattattttatgggcatagaatagaagccatggtaaaacaataggtttctgtaactcaactgcatcaaattttccaggacccaaactcagcctcccttgcaatattctattaaaaatatttccatagtgataacatgcatgctacctatttgaattttcctatttgaaattgggatcttattatcctcattttgcagacgaggccatggaggctataagttaagtcacccacccatcattacagacctaattacaggaagaggcaggaaacagggtaggtctgttgctgcctgtcaagggccccccaacccatcccactcactcagcatattttctatgtcaccttacagtacaataggcactctttcagggaagctttgtcacaatcacatccagcaatgaattataattttaataaaatggaatcctgactggaattcttggagtagtcaattgaaaattagtttaatgtcatgataaatgtttggtttaattaaaatttgtatgtcacatattgtctgttgggtgactcttggaactcagctttgatgtgttatcatcccatcctttctatttcacagctgctgctctatttcagatccttacttctctcccctggattagtatgagaatatccccaaaccagtttccttccctttggcctctgctcctccattccagtgtcaaggggagagagagttatccctctccacagtcatcttcctgacatccagatctgaccatgtcacttccctactttaagagtcagtgacttttcattgcctgagggataaagccccagcgtatcgtaccctaaccctattgttttaatttagaattgtggtaatcaccaaggtcagcttcaatgcttaacacacacacatgcacatacatacaaacacatataaacacacacatatataccacacaggtacatacatttacactcatacatacatatgtacacacatacactaatgcacacatacatgtggcttttgccattcttaacagctagcatgactcattgttcaagcctttgtttccaggaaaaaaaaaaaaacctttggttcttggtttaaaakgctactgtgcaaacagctcagtaaaaggcaaatgacagggaaaaaggtttccctcatactcgtacttttgattgacttgactcttgcccactttgcatttaaaaaatattttttattttattttttgtacattgacaggtaaaattgtatatatttgttgcataccacacgaagatttgaaacatatatacattgtggaatctagctaattaacacatgtattacctcacagttatcatttttatggtgagaacacatgacatccagtctcttaccatttttcaagaataaaatatattgtcaactatagtcaccaagatgtataataggtcttttgaatttatttctcctatctaattgaaattttgtatcttttgattaacatctcctcaaccacactccaaccacccctagaccctgataatcaccacctctacttctatgggttagcttctatagcttccacataggagtgagatcacgaggtatttatctacctgtgcttagcttatattttttaacataatgtccacgttcatctatattattgaaaatgccaggatttccttctttatggtgtaatagtattccattacatatatatatatatatatatacacacaccacatttttctttatccatttcatccattgatggacattcaggttgattgcatatcttggctatggtaaataatgctgcaataaacatgggaatgcagatatttcttcaacatacagatttcatttcctttgcataactactcagtagtggaattattagacatatggtagttctattttttaagtttctgaagaactgccactgttttaaataatgactgtattaatttacatttccaccggcagtgttcaaagtttcctttccaccacctcctggtcaatacttgttatctcttgactttttgatagcagctattctaataggtgtgaagtgatatctcattgtggtttttatttgcatttccctgatgattagtgatgtttaactttttaaaaaatatacctgttggcttgtataccttcttttgagaaatgtatattcaggtcctttgcccattttaaaatcaggtgattgattttcttgctattgagttgttggaatttcttatatattttggattttaacctttcatcagaagtatagtttacaagtattttctcccattctgtagtttaggttcactatcttaatcgtttctttcgttatgcagaaagtttttagtttttcagatagtttgctgttaatatatagaaatgctacttatttttgtatgtggattttatatcctgcaactttactaaatttgtttaattctaaccattttttttttggtggagtctttagggttttctctatataaaatcatgtcatctgcaaacagaaacaatttaacttgttcctttccaatttagatgccttttaattctttctcttgtttgaccgctctagctgggacctccagtacctatattgaatagaagtggcaagagtggacatccctgtcttttttcagatcttagaggaaaagattgcaactttttattgtttaaaaaatttgttttaatgacagggcctgctctgttgcccaggctggtgtgcagtggcacaatcataactcactgcagcctgaaactcctggtctcaaggactcctcccacctcagccctctgagtagttacgggattaccagtgccactatgtccagcttgggggaggtcaatttgaagaaccaaagcagtcacctgtggctgccgaagagaatacagtggtgctaacacagcaacctcaaattcctgggctcaagtgatcttccctcctcagcctcccaagtagctaggactataggcatgtgcaaccacacccacataatttttaaatattttgtggaaatgagatctttctattattgctcaggctagtctcatactcctgacctcaagctatcctcccaccttggcctcacaatgtgttgggattacaggtgtgagctgctgcacttggcctaactttttcttattgagtatgatattagccctgggtttgtcatatacatggcctttattattttgaggtacattctttctctaattaattgagaattttcatcatgaaaggatgttggattttttcaaatgctttttctgcatctattgaaatgatcatgtggttttgtcctttattctgtcattgtgatgtatcacagttattgatccatgtatgttgaaccatccatgcatcctgggatgaatcctacttgagcatggtgaatgatccctttaatgtgctgttgaatttgtttttctagaattttattgcatatttttctttatcaggaataaaatcaggaatatttttgtaattaatcaggaatattctgtaattttcttttttctagtgtctttgtctggctttggtctctggatgatgctagcctcataaaatgagggtggaaacagttttccctcttcaattttttggaagagtttgaaaagaattgatattcttctttaaattttgatagaattcacagtgaaaccatcaggtcctgggcctttttttagatgagagactttgtattactgactcaatctccttacttgctattggtctattaagattttctatttcttcataattcagttctggtagattgcatgcatcaaatgaatttrttcattttattttatttgtttttttcttaattagtccagcaataggtctttcaactttatcttttcaaaaaaaatcaactcttggttttgtttattttttctagtctatttctgtcctgatttttattattttctttcttctactaactttggacttagtttgttcttgtttttctagtcccttgaggtgcaatgttaggttgtttatttgagatcctcttttttgatgcaggtgtttattattgtaaacttcccttatataactgcctttgctgtatcccataagtttgttgttttccaattttgtctcaagaaattttaaaattttcctttaagttccttcattgatccattggttgtccaggagcatgttgtttaatttcaatgtakttgtgaattttgtgaagttcctcctgttattaatttctagtgttatacccttgtggtcagaaaatatactttatatgatttgaatcttcttaaatttgttaagatttgtttatgtcctaacatatgagctatcctcgagaatctttcatgtgaaattgagaataatgtatattctgcagctattgaatgaaatgttctatatatgtctattaggtccacttatttgagaggatagcttaagtctgatgtttccttattgatttcctatgtggataatctgtgtactgctgaaactgggatgttgaagtcctctactatagttataatatagtattatctttcccttcatatctattaatatttgccttgtatttttaggtactttgatgttgggtgcagataaatttacaatgttatatccacttgctgaatcatccctttatcattacataatgactttctttgttcattttcatagttattaatgtaaagtgtattttatcttgcataagtataggtattcctgctttcttttgttttttatttgcaggtaataccttttctatccttcactttcaatctatgtgtgtcctacaggtaaagtgagcctttgtaagcagcatatagttgagtcttgtttttcatccattaaggcactctacattttttgattctagaatttaatgcatttacattacatgtagagacttgttaattgttttctagttgttttgtagatcttgtgttacttcttcctttccttttgtcttcctctgaggttaagtgattttcactagtgttatatttggattccttcttctacattttttttttttttgagatggagtctcgttctgtcacccaggctggagtgcagtggcacaatctcagctcactgcaagctccatatcccaagttcacrccattctcctgcctcagcctctcaagtagctgggactacaggcacctgccacsaagcctggctaattttttgtatttttggtagagacagggtttcaccgtgttaaccaggatggtgtcgatcccctgacctcacgatccacccacctcagcctcccaaagtgctgggattacaggtgtgagccaccgcgcccagcctcttgcttctattttttgtgtatttactataggtttttgctttgtggttaccatgaggcttacaaaaacatctcatattcataacaggttattttaagctgatggcaacttaactttggtcacacacacacaccctactgtatatttttaatccacttctctccagcattttctatttttatatcaatatttacattttaatattgtatatttcttaacaaattaatgtgggtattatcatttgtagtagttttgtttttttatcctacattacaaagatataagtaatttacatctttttccaagtttgaaaagttttctgctactattttttaaaataagctttctacccttttatctttctgttctccttctaaaacccacaggacttgaatatttgctcttttggagttgtcccataaatcctgtattactataatattagaatattctgaattttactttgtacttatttttaccagtgagttgtactttcaaatgtttttatgatactcattagcatccttttctttcagctagaacttcctttagcgtttcttataagacaagtctggtggtgatgaattccctcagcttttgtttgtctggaaaagtcttaatctcccttcatttctaaaggacagttttgctaggtatagtatttttgtctggcaggtttctcatttcccttcagcactttgaatatgtctcccactttctcctagcctgtaaggtttctgctgaggattctgatgttaaccatattgggactcctatatatggtatttgcttcttattgttgttgttgctttcaggatcttctttttgtctttgattttaatagtttgattattatgtttctttggctattcttatttgggttgaatctgattggagatctttgactttcatgtacctggatatttacacctttttccaagtttggaatgtttcctgctactatttgtttaaataagctttctacccctttatcttatttttctccttctaaagcccccatgacttgaatatttgctcttttgatgttgtcctataaatcttgtaagctttctttatacttctttattcttttttcttctttgactgtatattttcaaataacctgtgttggtgttcacaatttctttcttctgcctgagaaattctgctgttgatgttctctattgcagttttcattttggttattatattttttggctccagatttctttttaaaaattattttcaatcactccattaagtttcttgttctggtcacttattattttcctcattttattaatttttttttgcattttcttcatgtttgctgggattccttaaaatagttattttgaaatatttggcaggtagttcacacatcttcatttctttaggttcagtcactggtaccttattttatctcttagtgatgtcatgtttccctgatgatttttgaccttcatcattgtgcctcaatccctgctcagttgaataagtaagtccttattatagtcttcacagactggattttcctgggaaagcactacggcaggtgtggtactggggcatgccagaagcctggggcagctgcagccagagtgacattgctagaaacatggtatctactacatgggtattacttctgggtgggccagaagcctaggaccactgaggctttcccattgctaagggatgtccagagcccaggtccactaatgtcaacctaatagtggtgtgtgcctgagatcagactggccaagcaagcctgtagccttgagctgtgtggtcctatctgccatcggggcrtgtgtagaggcttagtctgtgggtaccagcctggtatatgggatcatgagggtctgcctagtgctgggttttactgtggcaggcccagtgttggggtccaagtcaaagtcctatgcccacttccttctcttttccccaaatggatggtatatttttctgcactgtgctgcttgggatgggggaaggatgatatgggtaatataatataaatttgtcctgcctactycatttaatgtgccttttattattattgtgctacagctgagtattatgacatctcacctgatttccttagctcttttgaagctattttcacatatgaatacttgctcaaattgatgtttctgttagagaataatcacaagagagtcctatttcattaactggctttactactcctcaccctctttgaaacctgccaatgcactaactagcagtggacgaccctggcctttcgtgatattggcaccctatcctacccatatctatggttgtagaggatttctatcacatgtttggaatgatcagtgagtaagagactagggtcattttgagtgttggtttgccatttgcacaaaaattatagatctcacctaaacaaggaaattattggagttgttaggtacagtgactaaaaatccaaatgccatcttaccaacagagcactggccccttgttgtctttctgcactctggggattgatggtatcctaactttgagaaaatgccagaaatagggacaaggagagctgctgaaagggaaagacaaaacctcaaacaggggtccatttctgacagcaaataaagagggtcaacacgaaatytggggacaccagtaaacaaatgktwtattaacmtataacattatgatatatgcaatataatattatgaacatttccagtctttatggcttctatcaagttttcaaattggaacaagcaactttgcagctgaataaaaaattccatcttgtgtaagcagtaattggttaagattattaactttttgataaagctatgtaactggcattttcttctaaacacattaaggtgcaaatattgttcaccagccattcctcagagtgaaatatttggcagtaagactggaaactatagaagtctgagccaattgcaaccaaggtttatctaattccagggctcctattaattcctttttagcatgctttcttgctaactagaataattaatactggacctcatgttacttagattagaatcaaggagttgtttggatatcaacagattttgattcatacagtttgaaaaagactttgaatcatttctcactgttcaatttcaaaactccagaaaggagatcttaaattcaataaaatgatcaggaagaataaggtcctctccagaaagagaaataataatgctctaagtatcttaaagtatttgattatagatgctcatttattttccaatgttatctctgtaacatatcttttacttaaggctaagatacaaatccttatggaaagtctgtagaaagttttgctgcttaaactctgatgtttatgtggctataaatcacagattttcagaactggtggagacttcaaagttgtctgatctgattttttcattttgtaggcaataaatttaattgttcccctaaaggacacccatgtacaaagacctccaggtgacatgtttatcactgtatttctagggcttagcccagttcctgacacatagtggagctcaataaacatttgttgatgggtttactgattgacagaataaggctcacacacctaattagttgtagagatctctgatcttctgggtgtcagtctgtgttagtctgttcttgcattgctataaagaactacctgagactgggtaatttataaagaaaaaaggtttaattaacaagtagttccacgggctgtacaggaagcatggctgcgaggccacaggaaacttacaatcatggcagaaggtaaaggggaagcaggcacatcttacataacagagaaggaggaagagagcaaagaaggaggtgctacacacttataaacaaccagctctcatgagaactcactcactatcatgacaacagcaatggggaaatccacccccatgatccaattacctcccattaggcccctcctccaacactgaggattacaatttgacatgagatttgggtgggaacacaaatccgaaccatatcgcagtcccattgtccccctttacaccagttaaagtattattacaattcatcctagttttcagggaaaaactctcaagtgtccaaattagcagttaaaaaacatctgcagccttttccattaaccaaaacccaaacaaaagggaactctgtgttggaacccatagattcctctctccatagttcctaaagtggagtacttccgcatctctacagaagacagggagatagtagagaggacatcttgggtctctttatctacctacctacttggtattagggacagtaaagggtttggtttccatcatacacttcacagaaaagtaccataaattctcatcccacttgtacatctcccgattccatttttttggctttatgggagactttcagataaatcccttaaatgaggcataaggcctctgaaattgttactcaaaattttttctttccataggatcaatgacataagaagactgtgacaactggatatttttcttgagatatgataaagctctacatgtgcctttccagaggtaggctgctgtcactatggacacatgccttctgctgatggaaaggtactaaaaagattttggaaattcctagtctctttgccctgtgctggaatggtaatccagctgtcttcgaagaggcttggatgcatgcagaattactctggatccactttgatcaycaagctggccagcccagcctaatgtagtctggggcggtagcctaatgtagggcaggaaagcttggccagataatgcttaaaattctattaagagatggcgtaaagggagaaagaaggtttttagagtgcttttgtctcctgctcctcagattccttctcttctgaaagaataaaaatatgatgctacccagacaaggaaagaatcccaaattttgacgttaagacacccagaaccatgacctctgtgtccctcctgacagtccacctccctgtgcctggtctggtgagttcctgctgctcctttttgcaagacaatgtgctacagcaactgcacaccctactcaactgtttgcagaagacagcaaaggccctgcagtttacagacagcactccacttgaagactgttgagtgaccatctttgctacacagctttcatttagaggctgtacgcctattgcccactgccttctttcaaccaaacgtggtttttcctcatggtagcttctgggagaatatgacgtttgctagtttgtttcctttgtgaaaactgggttgtctgtggaaatatcttttactgcaggtgggaaaacttcatgtgaaaagttcatatctgtgaagctacattttgagaaactctctattatactgatttttccatggtatgctctgattccacctttaaaatctctctaaagacagtggttttcaaggctggctgtacctttgtctcatggaagaagcttacaaacagcccatggtcttccctagatcaattaagtctgagtttttgagggtgttagtcacccaagcactgacatgtgtgtgtgtgtgtgtgtgtgtgtgtgtgtgtgtgtatttctgcctatgcatcctcttgttactgcttttgctgtggctttgtgaggacgtgacacttagaggctctgcaaccagtttggacctcaaggggagtgctgacaatactaagattctgtctgaaagccacacacagcctagttccagagtcctcaaccccaataattccttcccccttgatccatcatctgtttgtcagatatgctgaataaaaccaaaagcacttgccacacatccatgargccaaccctggtggcagccttctagtaatttcctattggccataggataaagtgcaacctcttaacatgactgagaaggtcatatgggctctggctgctgccagcctacagtccatctgtcactactctttccaccccaggcttcacagtagccattgcagcacatcctggtttctgtacatgtccatcctctcttgaaaactctcccctccacttccaagatcctgtcaatgtccacccacctttcagtcaacagcttagacatttctattccggaaagccttccccaacatcctacgttgaattaacttcctcctctattttccccaagcacttggatttgatttatcacaaagcttattgttctgcattgaaattttttattcattcattcattctttcattcatctctctctctgcactgtaacatccctgaaggtaaggactatgctcatcttgttccttgctgcatctccacaagggcatttgtaatacaaacttgtagcacaaataattaaaagtgaggtaaacttagaaaacaatgatgctaacaggttcattggtttatatgggagaactaaggggcacacagtttttgtgaaataagtcaaaaggttctgcctttcaccatacatatgatttaccacaaagggtaggtgaagtggcctgtgatcgtgcacattgaagacccaggtaacatgatggggatcacaaattacctgatggttttgatcatgctgagacccatttcaacacagcagtgggcatggtcctggcggggctcaggaagtccagacacgcagtagtagcagtcccccaggattttaatacgaaggcagtgatgctcctggaaggaacaggataagagggaaaggtctatgtcagcagaaggatcagttcttcagaaaggcttgagaaagaggcragcagggttaggtggtctgcaacttggggtaaggagaacctrcctttgaaatatacttctacctgtctttctaaaatatttgaggtgtaacctaaatgggggtttgaaggacccagaggtggaatggaatcataaagaaattaggttttgagctcaaaagctacatggttatatccaagctttgctatatactagctctatggtctgcacacctgtcacttggtcaggcctgacagagtgctcatagtatctcctacaaattcagccccaagcaatgtctctcttctcaaaaacagctgtgaattaacagctttcatcagtctttagcttaatagtaagcacttaaaaatgtacatcacttaggaattcctattacttcaactctataaagttcctttccagcaaggacatttgcactttatgaggaggaactaagtcttcttatatatccttttattcgtttattaatttatatgtttgttcattgaaaaaattaaaaatcaattgggcacctataataaggcaaacattgtccctaacccaaagatgactaataatagctcctattatgcactataaataaaacagagttaatcctcacaacaaccctctaaggtgggttgttttwtatctccatttcaccggtgagaagtagttgttagtttggtggattcccaatcttaaagacacaactcttacaaaatttcaaagaacaacaagcattaagaaaataatgcatgcttttatattggataggaagcagctagatgttataggttctagtagaaagagaacttaaggtagtatagcatggggagccaagggcactggtttacgagtcacactgcacaggatcaaatctcagatactgcctctgtcttttctgtgagtctttgggtaaactacctaacctctggccttcaggtgcctcatctatcaaatggggataatcatagggcctgtccccttgtgccactatgagggttaagtgagatggtgcaagtgaaagctcagtacagggcctggcagatggggcactcaattaatattgcctctttctatgaggaagagttggactccaggcctagctccttcacatatctgtttttcatcatggacaagtgacatatcctcttggtttccttgggcagcttgttggggctgaatgacctctgagatgccttctagatctgaagtcctagaggcttatggttctatggctgtgtgggaaaaggagggccccagagctggagaaggggagttattgataaaaagtacccactgagagaccaacagtactgttgatgcccttgtagtagcaagctgtaaagcactgtgttggtttcccaatctcaccaggagttggacattatgtttgggtaatggataagtaaatatactatcccaagaaaaacaaatattagacagggaaaagagaatcagaactgtctctggtactttcccgtcagatttctggagccttgtcaaccttcccaaatgggcccagatgcaatcttcagaactctgacagcatgtacagccatcccaggattatttttaggggatctgggctcctgtctattggctgcttcaatgcagctaattttgcaacacagctgacaattaggtctgattcattaaataaaagaagcttaaggccttcagttgtttcttctaagaccttgagggtgtcaggatcagaatggaacttagaaagtttcttgttctttggtgctagcagtgcccagatttgtggagtcagtgggactgttatggaaaaagaaatcagagggtttagagatgttgtagggtacattttttttttttgtcaagaaagtatgaacaatccatcaacaaacaccaaaaacagcaacccaaatactatctactatccccatcacttataaaagcaaatatatttttaacaccagaactactggaaagacatatcttcagaataaaggcaaggttttctttttacctaaataaatttaacattatgaaaactcactacattgcttttatcatttttaaaatctcatgccaagtttaaaatttccaatttttgtgtatgaaggagaatttgagaaccagtgttccaaaatcttactctgattttgcagatccgaacactgagactggaaggcagggattggtgacttcatctgcaaatggtcttttggggcatcgggttggtatgagagacttatgcgaaagaaagcctggtaccatcaaaatcagatgcatggattggcctgttgcctgtttgctacagggagggatgagggaaaggggcataacaaaaattactttggtctaagaatctgacatctgcattccagagaaatttaccagctgtttgaccttggataagacactgaagccactgtatgtgggtttcaattcctcatatgtgacaagtgccaaaataatctatcttgtccttaatacacaacagagtaagcttggccattacttaacaatgacaatgacaactgacacctggaagtagccttctcaatgttcaacatgctgctccttatcttttttcgttgagcttcacaataaaactctgaacatggcagagcaggtaaagtcacgtctgttttacagatacagaaatctcagtggagagaggggaagcttcctgtgctacagaggagctagctaacagtaacaacctgggctggatgtcaccctcaccaactctgaatctgtgatctttccctgaaaacagaggtgaaagcactttggmaaaaatctaagtggggacaggagctaatagtcattgagcatgtactatgtgccaggcaatgtactaaatgcattacacctatctcagtcttcaggaccactttctaagtcacgtgtcatcttacggatgggaacagcaggcttgagggaaaggccacacggcaagtaagaggcagaagaagaattcaaacccatgtttgtctgattgtggggctccatgctctctcttggcaaaactgcaggaattatggcaaagtccagaatggtaggtctcctgacaaaagtgtgttttagaaggagattgtgtaaaatagtttattactcrtctgaggcagacattggataatgatgtgatgatgttcacgtccagggtttgttattcttccaacaaaatgtggagctggtagcctccttgraactctttggatcccaaatacatggttgtatatacgcatatatattatataaaattattttatacaaaaaaataaaatgtatgtaatatatataatacattaaaggcctggattcttatctgtcaaggtctgtcaatttgcagacacatttttctgatcaaatactatgagctgtcagatgacttgacagtaatatctgaataacttatttgtaccagaaactaccttgaaaagatcacataaaggaagacagmctrctttggaaaaamatattcaaaaagaaaaataaagtagggtgaggatcttcttgaaaattttattgagttggccttattgcaatcctttcctcttgtcttgatgactttgacattatcaaaatcttggaaaattcccaagagtttatgaaactgcacatacagacaatagacaaaaattaggagatgaatgcaccaaattatcaaagatggttatattgttcacagggtagaatcacagggatgtatactttgcattgtgtacatctttgatgtttgaattttatgtaatgaacatgtataactttaataagcagaaaaactcaatacaaatgaaaaagactctcaaagcaaaaacattagtgctatcagtgtacttttctaaaaagttagaaatcccaaaaaactttatagtattttatctaattgtaatcacgtaagtagtacgtgaatatattgtcctagtaaaaatgaaactgtagataaggttgaagttccctaggatggcctcttctcgtcagacacacagcaccctggaagcctggtcttcctgccctctccgtggaggctgctatgyattcacatgtgattttcccttgccagattctgagcatcctgaggggaaggactggttttgtcttttcagtcttgcgcagtacctgaaaaagtaccctttctctttctctgggtcagcagggtttactgtgacaccagaaatgcaccttaatcacatctgccaatggcctttggatggccgtttttgttcatcttggcatctttgataaaaaatatcagaaccataataggaaatggaatagctatgtgtaactgataccaaccaccactgatgcaacaataaaaggaaatggtatacatgttttcccccagtccctagccctccagctaaaaccaaccctcctattaggaggatccctcagtttccacttcctcctccgcccccgtcagtctcctagctagtagctgttcagtagctgaaatttatactaaggttgcttgacaagtccctgcctgtctttctagcctcatctccaccacttcctaccctgcactttatcctctagcaatctcttctggtttcttcacaaatacagagtaacatctttatgcttgttttctcctctgcataaaatatcctgctctgatttctttgccttgctaattagtgtataaattatgtataataaaatcaccttcttgacaaattcaaacccatgtctgtctgactgtggggcttcatgccctctctctacaaaactgtaataataaaacaaccaccataataaaaatataaatcagctatgtaatcccccaaatcaccccaccccatgctccattgctatccatatgcttactccattcccagccctccttgcagctacttatctgttttctgcctctgtaattgtaccttttataggatgtcttgtaaatggagtcataaaatacctagcattttgtatctggtttctttcacttggcatactgcacttgagattcattggtgttgcacgtaagagtggataatcctatttttattgctgaacagtattctattgtattatttatatcatttttaagactcagcttaagagtcactttcttcaagaagtcttctctcatctaaaggtcatgtgttacctctgtgtttccatggcccccagacttaccttcctcataacacayggcacattttacattccttacctattaatgaatacctaactagacttaattccaggaagggaggaggtgtgttttcatcattctcatattcctaacacatagcagcatgtacaatacctagtaggtgcttaaatgcaagtattaatgtatttcccatagagtgaggcagccttaacagaggacattttgatgctctaaaaatgaactcccaccgatgtggtcttatttaattctcattacagctctgtgaagttggcactaacatacacactttacacagcaggaaattaagatgtctatttgaacccaaagcccactctgaagtacagcgtgataatgatattacttcgtaactcaagtggctttaggactatgaatctgtgttttgatagcaaatgtccatctcctttaatctgttttctagcttagctctgatcaagacagctggaaaatgaaggtactgtcttgttggctaaaaacaaagctcttaagttaggttgatcaagatggtggtgggatggcccagcagattactggtttttgagaacatgctaattcatcccagatggccagggttggctgggaaactgcaggccatcattactgcatgcatgagcactgaagctgcagctggatggcacctggccacgtgcaaggggaagcaatgataggggcgtggaaagcagataaaaaggactggggtttgattgtcactcaaccagccgtctctcaattgagaaaattaatctgacaaacctcctgcatgagacctgtaaatagctaacatcagtccccagaatgtgagagggtcagggtccatgcctagggacaggatgcagaatggtaatgacattggggaagaaggctgaatccttctctttccttattccatatgcagtccctcactcctgcaaaagacgaggaggaaattaaattcaactcacatgggccagtcgatcaaatctggcaaagagctcgttgagcatcctgaccagctcctgagcagacaaggtcgtggagaggttggtaaatcctttaacatctgcaaaaagaatactaaacacagggaagagggtgggggtggggggaggaagtatattaatattttagtccatcttgggatacacatcaacaccatcccagcagataaactgtctttgtggtctgagattttagctcttgctgccatgagagtcaggaggaatgtctcagtatttaataaatatctcagcagagagtccactcaggagctcaggaaggacaaggggacaacaggaagcccttttttcctgtgcagggctgtgtagagtgggcaatgcaaacaatccaaaagaatttgtcaccatgaagatatcaatttcttgtgaaaagcaagatgaaactttatgaattatctccatattttcacaatgaacagcaatgcacatgcaatgaacacagagtaaaatggtcacaaggggcaggggcagaaccgaaaacctcatcatcttgaacccaatgacaggtaccgtacccaaaatggcaggtaaataggcatttctcaaaaattatgacaataggtggcaaatctgggagacctcaggcagaataattaatttcccaatactctcacattactaaagatttcagttaggtgaggtcttgttctatgtatatggcctggtataagggacagggcagcttcccaaagccttctaaaagccaggttactctcttggttaagccatccagttactctgtggggcaagcatagttctctccattcagcccatgaggaaactgaggctcagagatgcaaggagacttgcccagcatctcactagtggcacatggcatagctgggattgtccatttggttgaattgcactgagggatattgctccaattatcttaccatgtcatctcagggacctctgaaaggaaagataggacacaaaacaggataccatatttgatcatttctcatttttcatcctctctgaaagtgagatgtgtcttacaattgatcactttagctgtgtcgagctttttacatcttttcttagtgttgcctaaaataatgacaagtcttacaatcagcctatgagtgtaatttagttttaatgaaataggtaattgggctagaagacatcgtggaatgtgttgacttacatcagtcaccacatttattcaataattcttaaaattcatctcctttacaaacccttttaagaatttgacatagactatggattatctctcccaaaaatgtacgagcattcaaaattttgcacctcacttaaagggatttttaccttccgcaaagtccattcatgaaatcattaggaatccttagatctattgctttagttaattattgaatggctcattctttcagcaaatatttatatatttactatgtgttcagctaggcactggactagaaagttagattaaatgatatataagacctagtgcctttcctcaagatgctgagtctgaggaatggagctggaaagacaaaaagaaaaatggaaacagtgcagggtgatgatcactgtgattgaaggacatattggggggtgaccagccacagagggatcaggagtctcccagtagagaaaagtctcagctggttcttgaagaatgtgatgagcgaagtgattgggaggatggatgctctgagcagagagaacagtacattctagggtctggtggaagaataagtgtatgtatcaaggttctgcagtaattcaagggcagccagtcagaaggtatcactgagcaaggaggctagaaagaagagagagatgaggtcagaaatacaggtggggcaatgatggagaaggggctggtaagccaggatgaagaatgtagactttgtcctgaaagtgatggaaagctagtgaatgggatttaagcatggacatgatgccaatagattttcagtttactaagctacctttggcagagtgactatactgccattgtcttctacagttccgtggtggcagaacatatggtcatatgcacagaatttgagtctagatagatctgggttcaaatcttagctcaccacttaggaattctatgaccttgggcaacttcctgaacttctgtaagccctagctctgtaaactggagataactggcatacttgcctcattagtgggtagtgtttagcacatcacctggcaattgccagcatagtaaatgttccttaaacgtgttagcttttgttatcatcattttacaaaattatactataattgcatgttatatttgagagagaaagagaagagagaggtaacagaggtagaaaataatatggccattcatttgattatgtattacttgtagctaaaagcattcctaactgttgatgaagcctgaactgccaggcagcagcaacacttacagagtattcactgtggacttggtaatgctctgagagccctacatgtattcactcatttattccatgtaacttatgagggagaacctatcatgttcttctccattttatggaactgaggcctacgtatcttgcctataatcatgaagagctagaatttgaaccaggaagcctggctctggcatccatcctctttattgctcagctatgctmtttttgaagaaagaaaagtcattgctatgacaggtgggaagtggacaggctcttagatcacttggtttaacacattccctttatgaatccataagcccaaagctactagtatccatctgtctatggcaagaatggtttaccaatttatttattcattcaacagcttattaattaaatgactactatacaccaggcagtggagataaagtagtgagcagatgatagcatcatcccagcctttataaagctcacagcctattgaaagaacaaatggattccctgagagctaaggtcataaaagtttcagatgtcttcagtgttccaatatcatcaaacttctccaggtctttcgatcccaccatacattatgcacctgtatctttgtacatgctatgcctgctccctggtatagmtttttcccccttttgctacctgttaaaatctgacttgtccttcagagccccactcaggtgttaaaatcatgttaagagtctatacccctctggagacttccccaagcatagccagttatccccaactcaagcttctcgccctgttggtgcccctctctgtcataacacttaactctcaatagcacaatcatatgtggctaagtgtgctccatctattagctgaagaacaagaatgaagtcacctctgcatcccacctgcccagcacacagttggccctattacatgtttccttagtccaatcaacagaaacattcagaattaagtcctccttcctcagagcatggtcatggcccccagtggcatctcatgaaattgttagaaatgtagactctcaagccacctctccagacccactgtaccacaatctgctttaactgagccgtagatgatttgtgtgcacatttaagactcagaagcactggtttaagtcatagttgtacaataaggatttattgaataaaagaccagaagcagaaaccagggccctggttctcattccattgcttgttctgccacctccaggtgctgagctcagatcatcaagtcttttgattcttggcataatttgtagctttccaggatgaatataccaagggggccatagtaattttcaactctaatttagccaacttttagccaaataaattgtttatttggctaaaaataagtcatgttacctaatagtcactcttcaaatagaatccccaaggaagcttttgcggagttcaatagaatcattaggaacgtggtccctgtgtagactcctctcactaactaagtttcagatgtgttcggtgttccaatatcataactgtgtgttcttgggaaagttacttaacctctctgagcttccattttccttgataatacagcaaaggtcattaaagctactctgtaggactaccataagaagacaacttgtaaatcattgcataattctcaataaatgaagggtatataacctctttgggaagtttttacgaatctggaagtgcttaactgccatgcggatggatctagaaagtcatcaagttctctagctccattcaattgcattttgcttgttcgtgaaactctagtctacaggacagatgtagtgatcacacatgttgacagggctggctggaaattaacagccagtcaagaaagtgaacagactgagcaagactctaaaaacgaggatttttttgatccttgacaattggtcactaaaatatctaccatggcatagggagagataaagacaaacatgtctcccagacagacccacaaaatgtatgtcagcaaatgtgcaaatgtacatgaaatggaattggcagggccaataggaaatgggaaaaagaaccatgacagagaaggatgactgtccaccagatccatgcctctatttgcatagtcaatccacctgtcactaggaaaagccattgagccagaggcactgttcccagcccactttgtttctaggtgggcacctggaattgattctccctaatggaatctgaacagaaatgacatacgtcattttctggttaaggtggaaaaaaaagtgggtgtgagtactctgcttccccttccaataaccaaatgctgggaactttgaggcccaagggatggtagttacaaaacaaaggagcctttgttcctgaatcacccactgaccagtaatatcagcagtgaacacttgcatgaataaacttgattgagttaaaaatcactgaaattgaaagggtatttgaaagagcagatagcattaccctaatgaatacaagaagtgtcttaagtatctgggggaaaaacaggaaagatcaatacaatcgggtaggtgggatggagagcgtgaatgacttccagtaaaaagctggtggccaggtggatcctcaggtgaacctggagaagtctcagaggttgatagctgaagtcaayttgagcgttcaaagagtccagcttttagattgggaaacggaggcccacagggatgaggtgatgcagtcgaagtcttgccaagggtgtggctaccccagcccacgtgggcacacgaatgcccccaagcatggcgcctttaagcataccctttcctgatgaaggtaaacagtggtatgaaatgtaagtcaagacttagatgtgtacagcacttttttaggaaagagtcttcaaaattaaaaaaaaaaaaaaaaaaagccaagggagaaaaaataatgcaccaggcagtttaccatgaagagggtgacgggcttggaaatgatttcaaaaatgctcccaacaccgcagcggggttgctttgggggctggggaagcgggtggagcagccagttggctttgttctccgacttgggctagggaccgtcctcctctgctttcaaggctccggtcttattttagcaccctgcagcctcgcagtgggcaggagacgccccgccgccccgagctgagttcatcttcccgaaacccccggagccgcgggcatctcrccacgctgctctgagaatagcccgggagcaacagggccggcggctggtttctgcatcaattctcctccccctagtarcggctctgaaaacgcggagacacggagagcagaaaacgaaattttaatgtactgtggcgtgaacttctggaaaagggtctccagcacaagaactcagttcaatgacttaaaataaatgggcggggttggaggggtgggggcagaagaaactagctgcttaagagtaacgggagcactgaaraaggattcctgcagaaagcgagccgccgaacatgctgtttattgcacttaaggcacctgagcatgttggtgtggacgcgctggcttgttgaattttccttatttttctttttaaaggtatttttccctccttctttctccatggtgacaggtactttcatcatatgccacatattttatttataaatttatatgatttgtatatatttatagatgagtatgtaattaaatatttattttttccccaaatattcacgcaatttctgctttctctggatctgcattcgtggtcaagccattttgccaccagggaaggaatatggaacaccacctatgattctctgcatggaccgtggctctgccttcacttctgctgacccctttgctcagaattcatgtatttgtgtttttcacttggctgacttcgtctcaaataaagccaagaagaatcatcatctcttccaggaaggtttctctacctatctccctgtcccgccctccacctccttgccccaggttttcctccttttatgatctcttggcatttgtggcctgcttaataatcaaaccccatattctattatgattaataggttcctattgtcttagaactagtattgaagagttcttattatgtgtgggaccaattcctagatctggggcgcatctcttcctggaattgctgtttgacaaagggctgttttgcaaactcaagcatctaaatcagtgtagctcaattcttggacaagaccctgggaatgacctatcctgctgtgcccgctgaagggttgtgttagaatcatgatctctactgaattttaaaacgcgtgttcctgcatgccaggagtagaacacctacagatgctgctaagtgcaaaattgtcctctatcctgctgacattaggaggaaaggaactatgagaataggtttgtcacttttgaagttgcttaatgtaaggactctgactctatgtttgggaaagttttaccttatgatatttggtgggtgggagatacagttccactgtataagctgaaaatgccagagacttgctttccaggcacttaaagaaaatgactgggctcagccaatcagacccatctgctccaggctttaatttgagatgcaaagaagcagcaggagcaggaagtcagggcagagcaaagacagcaatgtcagtttctggggctgcaggaggaattgcagtggtggccgtgtcagggtttgggggctggtttggggacagggaattgcagtggtggctgtgtcagggtttgggggctggtttggggacagggttgattgcacaagcaatggactggtcagagacagtggcagtggcctcctaactggcctaagtgctctggcttgattttgcctatgcctttcactctgtggccttgcttcattctggcccatttccctcatgtacttctccattcttccctaactattctgtaatccatgacataacctttcaaaacgtttattattattattttttgagatagagtcttgctctgttgccaggctggagttcagtggtgcgatctcagttcactgcaacctccacctcccgggttcaagcaattctcctgccttagtctcctgagtagctgggactacaggcatgcaccaccatactcagctaatttttgtatttttggtagagatggggtttcaccttgttggccaggatggtctcgatctcttgacctcgtgatccgcccaccttggcctcccaaagtgctgggattacaggcgcgagcgaccgtgcccggccagtacatttcttttaaatcagtcatggttggattcttttgactgaaactaggaaacatgtctgaaatgaactacaatgtaccgaatgctctactacttgcttaactctgcctgttttatattttgtattaatattcacttatatgatccacataaaactctgcaaagtggctaagatgcttattttacagggaagaattttgagattcaggtaaataaatttcccaagatcacaaacaaggaataggcagaattgggattttaaagcttgtgtgcctcaccatgcagttcaccctttgattttcagtacatgccatgttgtccagtgttgtgctgggcacatagagggcactgatgcatggatgggggagtaagtgggaagatacatggatggatggatagatggatgggtggatggatagatggatggttggccaaaaataagtttgcaaaggaaaataaactgtcatcctctttgtactgttttaaacacacttatgagtaatataaggaggggatgtatgtgatcacacctgaaacccccagattacattctgggattatttttcttatcatagtctaaaaggtgtttgcctttcccactcaaaatgtaaagacagacacgcctactgtaggagagctaggcagtaagtcaaccagcaaatataattttatctgtgacattcttctctagccttaatttggaaatgtagaactctctgatgaataatcactaggtaatgaattaatcaaccagatgaggaaaggtgctgacattcaagcagacggaagtcacggaagtgcaatgagagcacccaaacacacatggatcatgcaagagccggggcaagggtgttgtgtttctcacctgacgttctcatagcgatggatgtagatccgatggaactggtgctgcaggtgctcatcttccacattggtcatgtcgttgatcatttccaggacaacaaaccgggggagcacagaaagcacgagccgctcctggaacaaatgaagagggacggtcctgttaggctgaccagcgagtctcagatgggagggtggagggtggagaagtcatggggcttttggatgaactccctttgggattgctaatttcataccattctatgaatacaacaaatatttattgagtacttattatttgccaggcactctgctggtgttggatatatagtggtgaaccaaatggatgtggttctgactctggtggagcttacattctaataaggaagatacattaagtattacatacccaaagatacctacacacatttacaaaatgtgatgaatgccatgcaaaaacaggtcatgatgagagagtacaatggttgatgacagcgatgcatatcagggattaagaatggccttaccaaggaactgatatttaaaattgagacctgaaaatttggaaggagtctgtcctgtgtagtgcaatgagaaatccaggaattaaaaataataactacaaatatcctgaggcagaaatgagcaatggtgtggctggagggtggtgatagcaatgaggttggaggtgtagctagatcttgcaggtgagcatacaatgtttgtgtttaattccaactacaactgaaagccactaaatggtactaagcagcagagtgacataattggatttatgttttaaaagatcactttggctgggatttggagaatgtgttctggggaggagccaaggctggaggcagagggaccaggtgggggaagctcctggagtgtccaggtgagataagattcatagaactggcaaccgagatggcaggaaagaaaaagggtgtgcccaccatgatagctagttttgactttagttgcctgggagagtgagctacacttacagaaacagcgaacatacaaaagaaaccaggcttacaaggcactagctctttatcaaagatgagaggaagtgagacgcacgcagcctgaaagtgggttcctaacaccaaacaataatatttctattgtgatcaccactgtagacaaaaggaaagtaatgggttaactagcaacatgaattaaattctaaaaagtctttgtgttgtggaaactaggcaagaggctggcttctgacacatggtttacttggttacgtggtttactgtgatagatgaagtttaatacttttagttgaataatagaaaatagggtaattatcattgatatgataataataggtcatgtggaattatctagttgaggcatatcactatagagagataaaatttttcttggtctatggtttactatagtgtcaaacagtttaagacaggcacgttctaatcatcacagttcctcatatctttgtagttatttatgggtattaagcattgtcaccattcattctttcatgtgtttctctcgaaaccctgacaatcagcttgcagaaataatcattttcatataatggacagaatgagtccaggagagattaagttacttgcacaacctgaacagttaatcaagcggcagttgcagggtacggtcctttcccttgttattcctagctgggattcttggtgagatgggaaaagtcttggattgagtctgatgaagaagtttagattccaactctatcattggatatccattaggtaaactatctcatctttctgtgccttagttccctaatttggcaaatattaatagcaataatatcatctacttcaaagagttgctgtgagaattcaatgcaataaaatatgtgaggggcctggcannnnnnnnnnnnnnnnnnnnaatgcaataaaatatgtgaggggcctggcatcaaatccttctccctcctctcacctctacttcactctgcctctcatgcaaaaggctttattaatgaaatgcccattgaatgacatatgatgaagccctttcttctcttgagtgctatcccatcacgggactaagaggcatgctttctgcaaatgccccaacatcatgtccattttgtgttcatttgtgctatttgtcaacttcccaggtacttgtggccctgctctctcaattgctgctgggtgggagtaggtgctaattacagctgtgaggggcactagtgctctgtcaatggctggggatgtttaattaagatgccactgcatctgcacttgtaagtgatagagctgtaatacacaatccacacacactccaggaccccacggtcagtttgtaaaagtgtttgattgcaaatcatccttacactagtgttgtattacagtgatgttttaataaccagagtgagaaaaatggaagaacttatgttaggaagagaatggcacaggagataaaaaggtggtgatgcagcacataaaatgatccaagtgtagggaagaaatgggaactgaagagagacacaagaaagctattcattcacaggacctagttaggaagatgttcctccctgaaattcaagtccatggacatatttataaggctatcccatggattctgtgatctgaccattcatcagtatgttttgaaggttcataaaagtgcagctgccctgaccccacccacacctactgaattggactctgagaaaaatggtcaagagggtggagtttttaaaaactccttaggtttttgggatactcaggtaggattgagaaattctggcctatcctgtggcaagcactactaagcactttattatactcaacctttactatagctccataaaacagattatgttccaaataaaacaaacacatggttatagtaaactgattacctagcaacatgagcacctagatcataaatagcaaagaattgaaaccaaattctcctgattcccaaaatagctctaacaactgcacttcctacaaaatgtattctaatcacttcttatctgatccacatggctcttagaaaattgtaaattaaggcagcacgtgggatattcctatgattggagctaacagtatgcaacaaagcctccgaggaggaaagaaccattgttcattaaggaagatgagggacgagtttctaaggagggttcctgaaaaatgtgtgagggttcaaacatttatttatttattcatctaacaaatatttattgagaacatactacatgtcagctcagttctagatatgggagatatatagatacatagagagtaagacagccaagattcaagagggagactttataggtagagactgacaggctcctggaatggcatggaaagatacgcattcttacttcagagctaccatctagttggctctgaagcaactactgtgggccagggactgagttaagagcttcatatataatttcatataacattcaacataactccatggcagaaataactcattgtagattaacaactgagaaaatgaagtctcggagaagtagtttctcaaggttatacagcaaagaagggccagtatctagtctatcagaccccagagccagttggaagcttccccttcaccttatcagaaagctgttcctaaaaaaatccctccaagccccattttcagaaattgaaaatgtaattaccactgcaattagtggtgcacaattatgtctacagttaaacaaaacatacacatgatactcaatgattacttaattgaatccttaatgcaaacaaataaaaataaaacagaatagtacagttaaaataaatcaatggaaata

SEQ ID NO: 17921 - DNA, 14123 bp, Homo sapiens
aacggggcttttacacgctccccttttacacacttactgataaagggacgaggagaaatagtcaacgtagcttcctgtgggacagcagagaaaagaggcttgaggggtactgcacgagcaaaattaggcagccactcagtatagcgtgcgagattagtgctagctccacctccttttccctaattccttcttccaactgaatcccttctaccggacccctttttcgttctgggtgattccgttctccagtagccccgccccttcgattcctacttgagttggcctcgcccattaggctctaagcccgcatctcaaccctccactcatttctgtcccttggctccagcaactccacctggtgttcctcgagccaggccccggcccacgtgctcagagccttggccacgcctcccctcttagccccgccccaccagccttccgggccaggctccgcccccaccaggattcaccacgctgggcccggcaccttcctcaggtttttccagggccccgcccatgctcacctggagcgcagaccgtttcgcagaccagcgggcagagatagcagaactgacagtgctggaggcggggacggggagagagagtgagcgtggggcgtggccgggggcggagttaggatggggccgggaccagacccggaccagaggctaggtctaggttaaggttggagtcaggatcgcttgtggagtcaaggttgcatcaggggtaaggggttgggtcagaggccaggatttagggctgggggtcctcagagggtcccggtgcatcctgaggcccagtggagccttgagtgtgaggtgaggtctcacctggcactggtcgcagtgctcacccatgttctcctcatcacagtgacagctctcacattcagtgcatcgctggggaccgggggagcctggttagatggaaactctaacgccacttgggaggtacccgcccctggcccacccctgcaccctggacgcttccccagactctaccctctttatctctaacactgagctctgtatctgccccccaaaccagcctcccctcccctcccctgcccctggtttccttcctttccctttttttccttttttttcttgaggcggagtctctctctgtcgcccaggctggagtgcagtggcgcaacctcagctcactgcaacctccgtctcccgggttcaagcgattctcctgcctcggcctcctgagtagctgggattacaggtgcgtgccaccatgcccggctaatttttttgtattttttagtagaaatggggtttcaccgtgttagccaggatggtctcgatctcctgacctcgtgttccgcccaccctggcctcttaaagtgctgagattacaggcgtgagccaccacacccggccctgcccctggttttctatctcagggcgaccccatgtctccctgtcagggtgggctcaggtgctctctccacccgctctctgcctattctccccctagcctatcagcccctgtgccatccctccttcccccgactctctttgccacagacccctgtctctgtccccacaccccaagatgcagcttgggtcttgtcctctccttcctggaccactgccccagcctcccagccttcatcagtctgtcctcacctcacatgcctgcagaaggatctcttttctttcagaactgaccctggcctgcccttgctctgagccctcccacagcaccaccccagggcccctgggacagattctggggacaccttggtgggtggatctgggctggggacatacattgcagaaggagcagtagccacacagggaccctggctggtagttcccatactcctgagcatcctgtggacctgcggggacaggagggcagcagtgacccaggctgactcggttccttcccacccacaccagcccaggccacttacctgtgtcctcaccgctttcctcctcgctggaggcacctccagcctcctctctcctgtccagtgggttggggatgatggtgaagcggggctcatcttcctccagcccctcctcctcctcctcttcctcctcgctgtggtctgggctcagtggggccccaacctcagccctctcttccctcctctcctcgtcttcttcctcctcctcctcctccttgtcttcctcttcttcctcctcctggttcaggctgaggccatgaccttcctcctcatcctcctcatcttcctggtcccggctgccatgatgggtgcctttctctccctgctctgaactttcatcgtcttcctcatgggagccggggtcctcttccttctccttttcctcctcagaatcatccttcctcaaatggcttctatccttgaccactgtgtgtcctggggggtgatggctcatctctttgatggaccctctttgaccatggccagtttcttcatcttggtggctttgcctgtggctgggggcctggtggccaagctcagcagagacctcctcatcttcctccctggggactctgtggtggtgatggtgagggacttctgttttatactcatcttggaagtcctcttcatcactcttgtggcctcgaggttggtggcttgcaacatagtggccgaactggactgtgatctcctcttcttcctcttcctcatctacaaggccatggtggacatgttggggaccctggtgccaacgttcagtggacacatcctcatcttcttcctcgtctctgtggccttggtgcctgtggtcagggacatgatggtggtgttcacctgagacagcctcaacctcttcctttctgtggtcttggtgcctgtgggcctggtgtccatactcagtggagacatcatcatcatcattgtcatcttcttcatggcttcggtgcctgtggctggggtcgcgatgatggtgtccatctgagacatcttcatcctcttcaatcccgtggccttggtgcctgtgagcctggtgtctatattcaatggagacatcatcatcatcatcatcatcatcatcatcatcatcatcgtcatcttcttcatggccttggtgcctgtggctggggccatgatgatggtgtccatctgagacatcctcatcctcttcactcccatggcctcggtgcctgtgggcctggtgtccatactcagtggaggcctcctcttcctcctcctcctcctcctcctcctcctcttctccttcatcatcttccccatcatggcctcggtgtccatgcctgaggatatgatggtgatgctcactggacacaacttcatcctcatcctcgtcttgatggctgtggctcctgtggctggggaggtggtgcctgtgctcagctgagtcttccgtgtcttcactcccgtggcctctgtgcccacgggcctgcccaccatgctctgcaaagacctcctcacctgagacaccctcatctccgactttgtggtcttgggacctgtggcctgggagtaggtgcccatattccttggcgacatcttcatcctccttttcacggtctgggtggctccagaaatgatgcccattctctgtggaaacatccttgttctcatctggatggtctctagggctgtggaggtggtggcgaagctctgctgatgcctcctcggagagcccggcgactccagtgttgttgttccggtttctgaagcccagcccatcccctctgagctgctgggtcatggccggggggaggagcaggctggccaccccagcccagaggacagaagcgtgcagccatggcctatggtggcccatggggacggacaggcagcactggctccagctgcctctgcggcaatgtggacaaacgttggggtctttgtccctttggggttggtctctttttttctctgtgtctctcctttgtcctttcggtctctgtccaccttcctctggtccttgctgcctggctctggacacccctctgaggctgtctccggagccccctgacccccctctggggccctccctccccattccccagccaatagggtccttcccctcccctctctccagctaaatttactctcagccctgagttattctgggtcagtccccgcctgcctgcctcctgctcctcctcctcccagctggggaggggaccagtgaggggtctctccctggccaggagacggtggccaagggacttgactttgaactaccaacaagctcacgtttggcagctgcaaagacaaaggctagacttttagcaggtttttgggggagcctggggcacctgggggaggcagaagagacttatcagaggggagagactcctgggacggaaggactgggggttcgattgcggggtgtttccagctggaatgatacgtgctggtgagagagtgatgtcagtattgaggccctagaatggggggaaaggaacatggcccccaacacacgtgcccatgacctcctgtccctggaactcagatctgggggcagggactgggctaggccagggctataaatacagctgggaggggtagggggactcaggttacggaggccacagctgtccccatcacagagggctggcaggagacaagtggccttgcccgtctctgtgtgtcagtatttcctactcctcacccttcatgactgcccccactagggtctcctttcctgttcacgggtcctcctctctcttcaattctgtcatctgctctctcagggtccctgtccctcctccatgggattgcctctccctctcactctgggcttctgtcccactcttatcttagtgtcagtcctcccccaagtctgtgtccctctctctcccctaaatctctggcccctcctttctgagttcctgcccttcccccaattctttggtttttgcatccccctctgccccttgcctcagtcaaggtgtctcctccccatctctggcatccacctctctgggtctctgtccccactctctctcagagtctctgtccccctctgtctcagagtctctgtccacctctccctgggtctctgtccccctctctctgggtctctgtccccctctccctgggtctctgtccccctctctctgggatctctgtccccctctctctgggtctctgtcccctctctctgtgggtctctgtccccctctctctctgggtctctgttcccctctctctgggtctctgtccccctctctctgggtctctgtccccgtctctctgggtctctgtccccctctctctgggtctctgtcctcctctctctctgggtctctgttcccctctctctgggtctctgtccccctctctctgggtctctgtccccgtctctctgggtctctgtccccctctctctgggtctctgtccccctctctctgggtctctgtcccctctccctgggtctctgtccccctctccgtgggtctctgtcccctctccctgggtctctgtccccccctccctgggtctctgtccccccctctctgggtctctgtccccccctctctgggtctctgtcctcctctccctgggtctctgtccccctctctctgtgggtctctgtcccactctctctgggtctctgtcccactctctctgggtctctgtcccctctccctgggtctctgtccccctctctctgtgggtctctgtccccctctctctctgtctatccctgggtccctgctgccccaccttctgattctctgtcccctaagtctttgtctccccctctttgggttaaattgtcccctccctgtctggcatcctcctttctgagtctgttccctctccgccactggcccccaactccttctgttcccatctcgcgcttgcccttggagtctcccctgtgtgtctctctccccccggcccgggcctctgcaccccccaggtcgctgtccctctgtccccttatcgcggcctgggacccgccctctccccgcctcccgctttggcgtctccaagactccccgccccccagacctcgccccgccccaggctaggctggaaagtggaggatccggtttgctctgggcgggtctggaagcagagccggcggagggagcgccggggccctgggctgcaggaggttgcggcrgccgcggcagcatggtggtgccggagaaggagcaggtgagcgccggaccagggtctgcgggagcgcggagctggggacctcgcctccaggctcccagagaggagggcgctggacacccagattcctgggtcagacggaggagggggatgggagggtccaggttccagggtccagggcatgggggtcgagactcctgagtctggagcgggagggcgctgggggcccggactcctgtgtccgtggggagcgcacggggtgggtggctctgtgtcccataggacagaactgggtgccctctcaccccacttccacccctacatttgttcctgtccccagagctggatccccaagatcttcaagaagaagacctgcacgacgttcatagttgactccacagatccggggtgaggagttcgcccctggactgaccccagrgggtccgcggcccgctgaccccgcccgcggatggycacgccccagccctgctccttccccattcctggactcggggaccttcccaagggcgttccttgccgacgctctccctctaggagcgtttgggtctstgtagacacccctcattccccattcgccattctcccgctcagggtcagtgtagacgctccagggctcggttctgcttctttcctccccgatgtctcttctatgtgcttctgtctcttcgtgtcactttctgtgtctctgtctttcccttttgggtatttctgtttcattcattcattcattcattcattcattcatccatccatgcaagaaaccctcactcagcgctcccaaggtccctttagcctaattcaacggccctgccagggttccaatttcccctgggacacgtgctgtgtggcttcgggcaaatcatttcacctctctgggtcccgtttctcatctgagcatcaaaagaggcttgatctcctggggttattatgagaattaaacaagttaatgcttgtgatattcctggcacagcgcccagcacaggacgctgggaaatatctgcagctcccactgggaggtggcaattattaccgcgggcgggccctgtcttggtggccggggacaccaattgagctagatagggtgtgtgcgtccgcgaggagctcccgcccttcagtgacggcctctcaagcggatccaggctttctagttttttttttttttttttttttgagacggtgtctcgctctgtcccccaggctggagtgcagtggcgcgatctcggctcactgcaagctccgcctcccgggttcacgccgttttcctgcctcagcctcccgagtagctgggactacaggcgcccgccaccacgcccggctaattttttgtattttagtagagacggggtttcaccgtgttggccaggatgatctcgatctcctgaccttgtgatccgcccgcctcagcccctcaaagtactgggattacaggcgtgagccatcgcgctgggccaattttttgtattttttttttagtagagacggggttgcaccgtgttagccagatggtctcgatctcctgacctcatgatccgccggcctcggcctcccaaagcgctaggattacaggtgtgagccaccgcacctggcccaggctttctagttttttgttttttgtttttttgagacagagtctggctctgtcgcccaggctggagtgcagtgttgcgatatcagctcactgcaacatccacctcctgggttcaagcagttctcatgcctcagcctccctagtagctgggattacaggtgcctaccaccatgcccagctaattttttgtattttagtagagacgggatttcaccctgttgcccaggttgrtcttgaactcttgatctcaggcaatgcacctgccttggctttccaaagtactgggattacaggtgtgagccaccgcgcccagccctctagttgtttttcaagacagtttttggggtgygggaagtatccacattcctacttcagtgtgtattttgttatgactatatattagtgcagtatggcttgtaaatgatggataaataaacagatatgcgcttgttggacgtgagtgctcaaaacctttttactgataggtcagtgtggtcaagacaatttaggaaactctggtctggcctgaggaggaagaaacgcagaagataattatagtaaggcaaggggttgcagctcccaaagacgagccactgggctctgtgagagctgggaggaggtgtttgcttaagactgggaggggacacaaaatgtcactaatggtttctggagggaggaagagtggctagtgaggtgacatttgaaagtgagctggagagaggcccatggaaagcgatttggggccgggcatggtggctcacgcctgtcatcccaacaatctgggaggccgaggcgggtggatcacctaagtcaggagttcgagaccagcttggctaacatggtgcaaccctatctctactaaaaatacaaaaattaactgggcgtattggcgcatgcctgtaatcccagctactcaggaggcaggagaatcacttaaacctgggagacggaggctactatgagcagagatcacatcactgcactccagcctgggtgacagagcaagactccatctcaaaaaaaaaaaaaaaaagaaagaaagaaagaaaaaagtgatttgaacagcatgtgcaaagtccttgctaaggaccatatggtttggcttgaatatgaatcaaagttcagggtgcagggagcactgtcatgagagaagaggctgcagaggagggcagggccagagcttgcagggtgtcagaggccaccctaaggggctgggatcttgtccttgggagctggggcatcaccgcagcagtggggttggctctgggtgtggaaaaactttctggggctgggagaggatgaacaggagctcgggaggaggctgtagagagcgtctgagcgggaggggtagtggcctgagccaggtcagggctttcgggacacagagaggagggcatggggcaaagactcagggggcaggaaggcagagcttggggcttgatgagggtgatgagggagagagggggtgccgccatcggtggatggctccgggacgtatggtctgctgactgggacacagtggggctgtccctgagatggagagctcaggagggcaagcaggtttgggaaatgtcgctgagtgcaatgtgggaatctgtgcatatgagcggcctagggggaccgaggggcatgtggggactgagattgggaaaggtctggactaatgtccagaatctgagaggtccgagttgtagctggtaattgaaactggaagtaggtaagacgtcacagggaaaacaacgtgtaaagtcaggggagttgcaaactggcaattctatagccaattgtgtgcgtgtgtttgtgtgtgtgtgtgtttagaagagcatttaaaaatatctgtcttctgtctctctctcttttttttttttttttttttttgagacagggtcttgctctgttgtccaggctggagtggcacgatcatggttcactgcagccttgacctgctgggctcaagcgatcctcccacatgagcctccggagtagctgggaccacaggcatgcaccaccatgcctggctaattttaaaattttttgtagaaaccgggtctccctttgataccagaccaggctggtatccaactcctggactcaagtgagcctcccacctcactctgcctgccaaagtgctggaattacaggcgagagccaccatacccggctacctcttttttttttttttgagacggagtctcgctctatcacccaggctggagtgcagtagtgcgatctcggctcacttcaacctctgcctcctgggttcaagcgattctcctgcctcagccccccgagtagctgggattacaggcacccaccatcacgcctggctaatttttgtacttttagtagagacaaggtttcaccatgttggccaggctgatctcgaactcctgacctcaagtgatctgcccacctgggcctcccaacgtgctgggattacaggtgtgagccactgctcctggccctggctacttctttctgttgagttacttgactggcctctgcacacattgggtttgagaatcatgtagggaaggcttgcactgggaacacctacactcaagggaggtgaaaagcaagagaaagccacaaacaagtcaggcatgaagcagccggggcggggaggaaggccagaggggcaggggtatcctgccaaggagagggtttccagaatgagagcctttcagctgtagccagggccacttgtgatacagtcagatgaaacctgcataagggccgttgtatatggagccaggcaggaaattgatgatttttatcaggaacaatttcaggctaggcacagtgactcacagctgtaatcccagcagtttgagaggccgaggtgggctgatcacttgaggtcaggagtttgagaccagcctggccaatgtggtaaaaccccatctctactaaaaatacaaaaactagccaggtactgtggcacatgcctgtaatcccagctactcaggatgctgaggcacgagagtcgcttgagcccaggtggcagaggttgcagtgagctgagatcgtaccactgcattctagcctgggagacagagcgagactccatctcaaaacaaaacaaaacaaacaaacaaaaaaaaaaacaatttatttcagtttctgtggctccaccgaggaaagagtgtaggaggcaagctgtgcagaaggaatggctcctagcactgaatgtcagaattttccacgattttggaaacgttctatgtctacatccaatatggcagtcctggccacagggggctactgggcacttggaatatggccattgtacctgagaaactgaatttttttttgaggtggagtctcgctctgtcgcccaggctggagtgcagtggtgcaatcttggctcactgcaacctccgcctcccgggttcatgccattctcctgcctcagcctcccgagtagctgggactacaggcacccgccaccatgccaagctgatttttgtatttttagtagaaacagggtttcaccatgttggccaggctggtctcaaagtcctgacctcaggtgatccgcccaccttggcctccctaagttctgggattacaggcatgaaccactgcacttgacctgaattttttatttgatttaattttaacttattagaacagaaagagctccatggctacaaagaaccccatgcagctatcacattggacagtacaagctccagactattccgtgaagagcttttattttattattattatttttttttttttttgaggcagagtctcattctgttgcccaggctggagtgcagtggcacaatctctgctcatcacaacctccgtctcccaggttcaagcgattctcctgcctcagcctcctgagtagctgggactacaggcgcgtaccaccatgcccggctaatttttgtatttttagtagagataaggtttcactatgttggccaggctggtctcgaactcctgacctcatgatccgcccgccttggcctcccaaagtgctgggattacagtcatgagccaccatgcccggccttatttcttatttttagtgacatggtcttgctctgttgcctagcctgaactgcagtggtgtgatcatggcttattgcagccttgaactcctgagctcaagtgatcctcctgctacagcctcctgagtagctggaaccacaggcgtgcaccaccacacctggctaattaaaacaattttttttgtagggatggggtctcgctctattgcccaggctgttctcaaactcctgggctcaagcagtccttctgccttgacctcccaaagtgcttggattgtgcccagccgtccttgaagttttgctcagaagagcaaactttctgggaagtagctgcaggtgttggaagtagctgcaggggaactaggggattcaaggatggagctgaaatgggtgaacggacaaagtcggtaaactgaggcatgccagggccctggaggtagactcaggaatgaagaagacactttattgtagttctcactgtgccaggacctggcctaagtgtgtttggttcatcccatgtgtggatcagttagccgttcttttagtgtctttacggcttttgccaaatccttgtagcacctctgctatcccttctgtaaaattgctcttaaatctgctcactaggtttgtgtaaatacaggtctcccctgatatctgaactcctggaatctggaacaaagaatttagatacatttttctccttctttcttcctttctctttcttttcttttcttttctctctctctttctttctttctctctttctctttctttctctctctttccctccctccctccctcccttccttccttccttcctttccttcctccctctctgtctctctccctccctccttcctttctttccttagtttttttttttttttttttttttttttttttttttgagatggagtttcgctcttgtcgcccaggctggagtacaatagtgtgatggctcactgcaacttctgcctcctgggttcaaccaattctcctgcctcagccttctgagtagctgggattacaggcacccgccaccacgaccagctaatttttgtattttttttagtacagacagtgtttcaccatgttggccagtctggtctcaaactcttgacctcagatgatccacccgcctcagcctcccaaagtgctgggattacaggcatgagccactgcgcccggcctcttgcttgcttgcttgcttgcttgcttgcttgcttgcttttctttccttcttttcttttttttgaacagggtctcactctgttgcccaggttggagtgcagtggcgtggtcacagctctctgcatcactgcagccttgatctcccaggctgaagtgatcctcctgcctcagcctcctaagcacatgctgccacacctggctaattttattttattttattttatttatttatttatttttagagacagggtctgactatattgcacagctggtctcgaactcctgggttcaggtgatcctctggccccagcctcccaaagtgctaggattacaggcatgagccatcatacccgaccctacattttcaaatgaatttctcattctccaaacccctgttacttactcaggtgccaatcacctttagaaagcaagagagacttgtgcatttctttaggtgggggaaagttttatatgtggaaactttccaaatggaaacctgttccatttggcacagagaggaagaaacaagccacacagaagccaaagacaatgaaaagcaaacaaaggtgtttccctactcgctagatggctgttgccagctccattttttgagcccgaggcctgcttttcttgttcaaaagagtagcaaagggttaggcattcaaaaatattctagcacccggctgagcctctctccttgacagtcgtcaggagaactgaaaaaggaatgactttctcactgcgttattcaaggttattttaagctccgtgtgaagttcgtgtcgcgttgcctctggctgggactggtatgcgagcctcatttcaggaaacacggcgttctttccctggctcctcatagctccgtggagtaggccgcgctattattgtcttttcattagaggaggaaatttaggctcagagaggtgaagccgctcgcccaaagtcacacagccgcgtcagccccgagcatgcgggctctccctgagttacccgctggatgttctttctcgtgttgaacgtcatgtgtttggatgggggcacagggcacagcaaggatacccccagtggccctctgccttcccacttgaggctcctcaggtgacagtgacctgcttcttcctgctcaggctttctggactcactggcttccttcccgtggggaaaggggaccgtcctcggctccagtctctccccgaggccgtcagagccagggccaggggcagcgtggactctgcc

SEQ ID NO: 17922 - DNA, 91576 bp, Homo sapiens
aatgacattgactagcccagtgttttccttgtttacatcttggacataagtcaggtggctcttttttatttgagactgggcaattcttttttagatgaccaatttgatcacaattataacatttccctccaaatgttctaacttgtcctcctaaagcaactcctgttattgtggaataaagtttagaaaatatccaaagcttatcagcctgtaaattctgggtagttcagttgtctaccatgctgttaattaaatgaaaacatcctgttatttcagggtccttccttgacaaagtactatacagctgaagaacatctcgaatacaattttggtgggaaaggagccaattgatttcaacagaatcagatctgagcttcataaagtctttgaagtgacttcacagagacgcagacatgtgcacttgaagatgctgccccttccctggtacctagcaaagctcctgcctctttgtgtgcgtcactgtgaaacccccacccttctgcctcgtgctaaacgcacacagtatctagtcaggggaaaagactgcatttaggagatagaaaatagtttggattacttaaaggaataaggtgttgcctggaatttctggtttgtaaggtggtcactgttcttttttaaaatatttgtaatatggaatgggctcagtaagaagagcttggaaaatgcagaaagttatgaaaaataagtcacttataattatgctacctactgataaccactcctaatattttgattcattttctgcctatcttctttcacatatgtgtttttttacatacgtacttttcccccttagtttgtttccttttattttatagagcagaaccctagtcttttaaacagtttagagtgaaatatatgctatatcagtttttactttctctagggagaaaaattaatttactagaaaggcatgaaatgatcatgggaagagtggttaagactactgaagagaaatatttggaaaataagatttcgatatcttctttttttttgagatggagtctggctctgtctcccaggctggagtgcagtggcgtaatctcggctcactgcaagctccgcctcccgggttgacaccattttcctgcctcagcctcctgagtagttgggactaccagtagatgggactacaggcacctgccaacacgcccggctaatttttttgtatttttagtagagacggggtttcaccatgttagccaggatggtctggatctcctgacctcgtgatccacccgcctcggcctcccaaagtgctgcgattacaggcatgagccaccgcgcctggccgctttcgatattttctaaactttaattcaaaagcactttgtgctgtgttctatataaaaaacataataaaaattgaaatgaaagaataattgttattataaaagtactagcttacttttgtatggattcagaatatactaaattaactttttaaaacacaacttttaaaaaatgtatcaaaataataaacgtgttctgatatttttaaaataagtgaccttgtgttctttaaccagtccacatctttagagaacaaaaatgtgttatgatattatgggccatgctaatgacctctagaaaacatcagaatatttctggatatttaataatagctttatatatgactaatgctcatttctatgtaattctgtttaatagttgctttaaaggtgaattttgccacatttactttgacagcagtataaggagtgagatagacatgaacctgaatttcaatttaaaatcatggaagagagggaaaaaaaaccagcttaagaaaaatcaactgataaactgcaagaaaaaaatgcaacttacatcacaaaagctaattgctttattatttagagagtacttaaaaattaaagaccaaacttctctccacccaacaaaaatgggcaaaggacatacagctaggtcaccaagaaagaagggcaaataggtggtgagtacatgtaaagatacttgataggacttttgcttagttgaatctttagcaaatctcttttatttcttgggattttgaagaagtaatttttaaaggaggactagaaactaagtgattgggaattggcctttttagaattaaaatttcccattacaagaaaaaaaaatcctgtgttcttttttttttccagaatggagtaggtcagtgagcaatgtgattaataaatatttcaatgtctgtgacttttgatttattttggagacagggtcttgctctgttacccaggctggagtgcagtggtgctatctaggcttactgcaacctcacctgtcactttttaattgcaagaaagctgaaaggtttttttctattatatcagttataatgagaaatactgtatatactaactatgagtaaaatactatattgcctaacttgtattattaagcaattctgctaacctgtgaccttacattttcatctgaaaagcaggggctggacaccaattgccctatgaagctattgctagtcctaacattctttgttttgtttgcttttttggcacacttaagtgtgtactatgaagtttatgatgctttaatgaaattttctgtctctaccattgtaatgagaaaggaataaaatactttattttgcaaatctacttatggaatatagttctgtacctgattgttttcataatccctgtgttgatgtgtaatgccacagacatgctcttgatagtaacaggaaagaaaatcagacacagctaaacataaaggtcagttggctggcaggtgcttagcaggtgtaaatagaggcccattcatgctgctccacttgctcctgaaaagcataatgtaaatacagtatactaattaggaggcaaagaaccatctaacatggttcttttttttttttttttttttttttgagataaagtcttgctctgtcaccaggctggagtgcagtggcgcgatcttgactcactgcaacctccgcctcccaggttcaagcaattcccctgcctcagcctcctgagtagctgggactacaggtgtgcgccaccacgcccagctaattttttgtattttagtacagacggggtttcaccatgttggccaggatggtctagatctcctgacctcgtgatctgcccacctcggcctcccaaagtgctgggattacaggcatgagccaccgcgcccagccctaacatcaaattttaaaagagttggccacagtttaatgacatccctgcacaccagcctccacccatactgcccttcataagccccttaaaggagatcccatagttctaaaccgggtccacaaacacacatatcctcattctctccttttcttctctttggcagtttgacaaaatctttagggggaattggaggaaacattaatctcctaaatcaacttcattcaaagctttggcttcaagttctacccgttaaggcctcaggaagttcattgtcgacattgaactcagtcactaaaatgacctcaaggctaagggatagaccacagctccacttcacaagtaagcttgcaacacctgatttaggaaagtttgctgtgcagacagttgtagctcatccattttacagaccgatctcgatttgtttcctagggtctaaaattatttaaatcaaaatctctcagaaatttctggacatttaataaattcatgctggaggagaactggcagagatatgttaaatgcacttgaccacaagaaccatttatttcatccaatatttaccagctattcattgtacacttactacagattttggcactggagatattataagaaagctctaaccctgacttatggaacttatcccaaaaaataggaaacaaggctcagaaccattcaaatgaagcttcagttaactcaaataaaaattagttttataaatttaatgtgaaagtcttcgagtatattaagaatggcttgattaaccccagggatggaaattttactgattgaaagaaagtttcaataaaataccgatcttcgaatctaatctgacacctgaaactaggaaatcaaacactagccatattttttcttctattctttataataatttttctcatgagaaaaaggtatctttcttccaagcctgaaaataaatggagaatttttaatatctattgatgtggagaaaaataaatagactatctgctttcacaaataagtgctggcattgagccacagaacatgtctgtcatattgctctttcacaccatacattaacaggaataataatttctcctcattgagtttcctatttactatccccttaattatacctcctttaattactgtcatagagtgtctgaattttataatccaagatactaagatgtttatttgatataccaccagactcaatgtcttgtattctatgccaaaaatttgaaaatgtttgggaagaggaaattccgtggtttggtgaacccagaaagtcttcagtacatctcagttatagaactgtattaaatacatttaaactctataattccataagacccattttaggtttatacactaagcatccaattcctcactatcctctcatacaaaccctgtgtaatacaagttctactcccataattctatgaacaaaacaacaattgatacatagatttgatttttaaaatacattttctttaccttattctaagtgtaacatagggtcaacatagaaaaagaaaactgaaaagcacaaggaaagtgaaatatctataatcttaaccattgttaattttgttgtgttccaaattagtgtatgtatatatatatatatatatatatatagcatttttgttttaataaaaggactgccaaaatgcacatgccaatttggactctgctttttccacttacaatgatatcatagtttctcacatttggtattcttttgcaatacttgctgcatagaattccatcacacaaaggtaactgccagaaattccttattacttttgctagacacttagggtttacattttttacaaaaattataaatctttgatcacagctctgatgatttctctgggaactgagagcctaacacaagtcatttccactttaagacttttaacattctgaaaagttatgttacaaacagagtgctggtccccctgcaacatgctcactcacattggctgacattttaattctttgccaatctgaggggaagagatgtcaactttttttgtttgctcttttaatgccagtcatgttcccttttttttcccccttttaccagtcatactggcttactcagaaccctacaaatcaatcctgctcattcttaattttccaacattgttcctgagattgtttcaccagaaaagttctcccccttatccacttcgcctaacaatttctacccatcccaatcctcctgcatttattgcttccaggaatttggcacttaggacacccttgtccttacattgttcatgcatgtatatttcgtcttcaataaaacatttagttgctcaagggcaagggtcccatagagtctcaatatgctaacggcctggtgttgcttaataatttagattctgacgggtcctctccagggaggggagcaaagggcaaattatcttaggggctgggagtgcagaagccaaacctttgagactgtgaaaagaagacggcgccgagacgattcagtagcaggcattcaagcaagaaaaactcaaatattgttcccaataatgcctgactaatgccaaataccaagtaagggcccaggcagtcctgacagcctgcagtgccccaggataaaactaaccctgaggggtgctagcccacgataaccccctgccagggctctggacacgccctgtctcctcgaaggccaacgggctgcccctgcgcgccgaggccccgccccgcggcccgccgattggccccagccgccccggcgctaagactcaatttcacactacgcgcccaggccacgcccacctgtcatgcggccctggaaactgtgagtttggggattgttgtgtccactaaccggactcagaagggacttccctgctcggctggctttcggtttctctgctcacctccggataaatcacggggtctcccgcgccgctcatggcgcctcccgtccgtctcgagcgtccctttccttccyggcgctttcctgggttgcttctggcggccctggtgttgctgctgtcctccttctccggtaggaccccggggtggattcgcgcgtccgcggcgaggctagarctctgctcagtcagtcgggcaggaggcgcggggcgaagctcactgcacgtcgtgcctgcttgggatagagagcgaggccagggttctccgaggggtgccgtgctcagatcccgggggtatgtggcgggggatgcgggaaccacgcagaagcttgtttggtggcatcgtgtgcgcggccgacatttacgcaggatctggctgcgttcccaaaagaagcgtgaatcgtgttttcgggattgagcccagtcagcaaggggagggcttactgggcgccccaggtgagggcttgctctggagtgcacaggtgcgtgggattgttgctagagcccgtgctgtgcccgtggtgagagtttgccctgtgttcccttggtgccttggtgagtagggtgttcattagggcttggacagtacccgcggtaagggttgcagtgcgtctgctktgccccatgggctgggctggcctgggctgggctgggcgagcaggggcctggccaggtgttgctgggagcgtgctgtgcgcaagtggcctgtgtgcggagttcactgtgggcaagacagctcactgtttgctttgagtggagcgagcgcggactctgcggctagggagggcatgttgagtgagagcaggctctcagtgcctggggttagagaggtggtaagggcgcaccatgcttttagtgcyttctgtgaacagtgtccgtgttgcctgagatcgtattggtcttgaattttaagtggctgcttttttggggggtgggtgggccatcgagtcatcttcctgttcccaaccaatatagacagtatctgattccattgcctagtggctttttgacattgttttccttcttttcattagtttgagtcatatttgagagatgtgaagcaacctaaaaaacactggtagccaaacctagtgagaaattagtatcctaacaaaggaaggcagataatgttaatcttgttttcccctacagctcataaactgaagcttaaggcctatcccactgttytgtatttcattgaatggaatcaatatttttaaaaatgcatgctaggccaggcccagttgctcacacctgtgatcccagcactttgggaggcccaagttgggtgattgcttaagcccaggagttcaagatcagcctggacaacatgtcaaaaccccatgtctacaaaaaataaaaaaattagatgggcatggtggtgtatgcccgtggtcccaactactccagaggctgaggtgggaggatcgcttgagcccaggaggagaagactgcagtgagctgtgatcatgccactgcactccagcctggatgacagtgtgagaccctgtctcaaaaaaaaaaaaaaaaaaaaaaagccaaaaaatacatgcttaaatacaggcttattgtgcaaaatgaacaaaataaaaggacaactgtttttaatattttgttatatttccttctgactttattgtgtttcatgtgtatctatatccaaattatatttaggatcttattccatgtacagattgtacgttgcatttcttctcttaggaacattcattcaacgaatatgggtcttgtatgtctggtgctgttacactggtaggtaataacagacaattcctattttctttatcctttttttactatttgtttacacacgtacatgcaggaagataagcagggactttttttgctcattgttaagtgcttaatgccgggaacacagtaggcaatcaacagatgtttgctaaaatgtattgggagtggcagacattaaccaaaacataatagtaacaaatatattaaccagggaagtgttctggaggaaaggagtataattttctgacagcatttaacaaatgactggggggagggaaggctttgcttctcatcaaacagacaaaactctgccactttggggcatctgtgctttctgttccctcagtcctggaacgttctccccatgacctgctgcataaatgggctgtttcttctgcaagctcagctggaatgttaccgcttcagagaccttcttggaaccccccaactcaggttgaacacatacaacccagttcaagtacctcttgtaatcacccttttaaagtgatcttttctgttctctgtctctccccatcagaatgcaggaatcttctgtcttcccccatttgtggtyccaaaagccccatttgtttgcttctgtatgaaccctaactcagtatccatatagacatctgttaaatatcagaaaattaaatatactatttggctggggcttagagcctaggaaaaagtccctcctgcctccaagaggaaggttctttaaagagctatgctcaggatggtctttctgttgtacctaaaaagctagggcagcagcagctgagggccagaaaggatctgtctcccctgtttatgttgactctgcagggcttccagtacttcagtcttgcatctcactgatcattaaaacgttcattttgaaggagggtgatgggattagggagcagtggtgttaagaagaaaacgaaaggacttttttttctttttaaagattaatgtttagaataggcttagtactagaagtacatacagcctgggcatcataaggagagcccacctctacagaatattaaaaacaaaaaattagccaggtgtgatgttgcatgcctgtggtcccagcyacttgggaggctgaagggcgtgaagggggaggatcactggagcccccatggtcaaggctgcagtgagccctaatcataccactgcactccagcttgggtgacagagtgagacccggtctcaaacacacacacacacacacacacacacacacagacacacacacacacacagaaaaaaaaaaaaaacctggaagttgaagaagataatgaaagcaatttgaaatagaggaacatagaattataaaatgaatagggtgcaacatggaagataacaaaactaaaaatgaagagaaggaaaaataaggttaagtttgaggttgatagggttaaatcaagacaggtatgaaacctagagaaagtaaaaatgagaactcacgatgctaggcagagagaatacatgaattaaaataaacattcaatttttggagcaactcactctcacaaagataaggttttgtaagcaggtggtgctgtgcatgggagacctgccctctcaaaggtagttgccaaatggttccagatagcagaaggaaacatgtgtcaaatttcaggccagtctcattcattcctccagaagaggagctgcttttttggacaaaacccccgatctcctgttgtgtgtggtctcttctgcctatttcaggtgttttccttattttcaatgaaagaagccaagaccartaagttcttattgcttcttagtttcctcactcggcatactacaatgcaaaaagagcagtccatatctggtcacctgccaggataccagaagactgggagataggcagcacaagaaatggctaaatcttctttctccattgttctgtagaatgattattttcaatatgaaattgattacaatatattcttcacattgttttgtgtttgacagcagtggactttgagtaccaaatttttttcraatagctactatgagggacatattgtgctgggtgttgtggccacatggatgaatggagtcggccttgttaactattaaactcaaaaacacgtgataattacctgagagatccatgcaggggagagtccaggggaaggtgactgatcactgcttcccagggggaggcagaaaatgcttcttggaggagatgatgggtggattaaagaagacaagagctgagcaggagttgtagctaccggccagggaggaagggtattcagagcagaggaagcaaggtgagcaaaggcaccaagatgtgacactgctggactgccaagctattcagtgtggcagagtagggtaaaggagacaacaaagaagggagaggaataaatcacagggtgagcagttctaaaaagcaacagtcttgtcaggaataaacaatcaccatcgtaaactcagactttgatattattccctgtccttttagggcagcttgagcccttttgtttgacttagcacaacgtgactccaaactagggttgttttaatttcccaagacacagtagtaggcaatttcttgaggacctaattgcagatagagtttgtcggtctcagcatgtgggagctccagatgaatggcagtaatgggaagcagtttggtagtggttcagcagtgtggcctgggaacctagttgactggcctgcctcctgggtctgccaacctaactggaatgtattcttgggttctgattgtgatgggatttaaaagtctctaagctatgttaggaagccttagacattatcctgaggtcattggagagccatcgaaaggtatctgtcttggaaaaaccttgattacyctgtcatataaatactgctctggtaatgtgaaaaatgaattgaatgaaaggtggcaagataggtatggagacctatttrgttatgtcgtggtaatccagataagaaatgatagtggcttgaatgaaaagtaaaggatacaactacatagaataaacgggcatttcagttgtggaaacataacttgtttggggggcgtgtgtgtgtatgtgtatgtgtgtgtagagtcaaaagtggctcttgggyctccctttgttgtttgagctagagtgacacattccaagtagagctgtgtggggaggcaattgaatatgtagttttggcaccccagctagagatctgggatggagagatacccagctaggaggcagctggttatcagtggtaatgaagtcacagaagtgtatatattctcccagggggacctgcagaatggaatcacaggaagtcctcctacagactcatcagggatattaccttggtatgagccagaggacaagctgaaaaccagagtggtttgctctcctaaaagccaaggagtgagaactcttcaggcagaagagagtgagggcagagtgatcagtagctctcacgttatcaagagggtaattcaaactattaaggaagagactgttaggaggagtttaacaaggaggaggccctttaatgactcagaaagtagttgaagtaattttcatagacctaraaatgagtgggaagtgagaaataaaattgaaatatgtagatgtcagagtttatgttttgtggaagcaaaaaaggttttaaatagattggatagtgggagaaggagcaagatggtcaggtttcattgccatttcacttgtagtcaaataccatgaatttctggtaatactaatctgggcagggctgtggrtatgcgtgtacattagttaattttttgcaagcaggtgtgaatgtacagaagttgaacagttcagtggatgcagtgtagatttttttttttttgagacagagtctcgctctgctgcccaggctggagtgcagtggtgcaatctcagctcactgcaacctctgccacctgggttcaagcaattcttctgcctcagcctcccgagtagctgggactacaggcgtgtgccactacacctggctaattttttgtatttttagtagaaatggggtttcaccgtgttagccaggatggtctctatctcctgacctcgtgatccgccsgcctcggcctcccaaactgctgggattacaggcgtgagccactgcacccggcccagtgtagataattcactttactaaaactcacctggaactttggggaaatttctgactgcacctatcttatgatataatggcacctactgttgaggtatagtattgtagcttaatattaattataatataaaatatctagaaaaaataagtcaagatactgtttttctgggggtaggcatgtttagtttgaaattttccataggaagaaattcagtcctctgaaaacgtattgccaataagtgcattgcaggacatgatatataaagaaaatattggacagtgtatatatggagaattttagaatttagaatatgacatgaaatgaaggtgagatttcacttggttagaattttcttgaccagtctctcaacctgaggcaggaccatgaccagggagtaagaaaagaaatgctccttggagatcaaaatagatctatctactttggtccttccactatagaagaggcctttgcattctgttggccctttaggcttttacttgatgtctccatcatcttattttgcaagcccacagataatttgaggaagatgagttgccgcagtagaaatgatagggagaaaaaaaaaactacaaaaaacagaaataaaaaattctaaaaccacagcaatatagtagctttattataggacatgctggataaacaatccaacagctacctcagggagcttctgagagaatgcatgatgcaatgatcagtgaggcaagatcaaattgtgtttgatgttcaagaaaggaaaaacaattcatgtaagtctatccaaagtagtaaatgttttatatttaagtagtgtatattcacttgtcagatgctcagttcacttatctgaaacctatgaaataaagtcttatattttagaatatttgagttcatatttattttaatctatgaaatccactacatttacttaataatcacctcttaccataacatttcttgagcacccacaaggtgggtagagtgtagtagaaaaagaagaacatggtccttgacccccaggaacttgccttttaagagaagacaccctgaagtgacaagctgttataagttagtgttttaaactatggaagaacaatctgagcagagtgctctatactgtagatgacttcttagaggagaagttacttttgaaatgaatttagaaaaatgtggagaaagatgcatccatatatattttaagatcaaagacattaatgctgtctcttcagtttattgtcgaatgtttattcccaaacaaaccaaaagctaataggatgttacttaaaacatgcaaatcccatttcctccactactaccagcactcaggtaaaagcatggaacagtcatttaaaatcttgccaagggccttcctattttttctgtactacctgctgccagaccacagtccatggctgatgaaagtgatatcagtacttcatcttcatgttcctattctcttatccctagatgcctatgaggagccaccaacatttgaagctatggagctcattggtaaaccaaaaccctactatgagattggggaacaagtagattataagtgtaaaaaaggacacttctacgtacctcctcttgccacccatactatttgtgatcggaatcacacatggctacctgtctcagatgagccctgttatagtaaataaactagcctttttttttttgttttctgcttgctctagagatttgcacacattttakggtacatattccactatggagatgatgatttttttttcttgtgaaatgaggtttaagatagcaatgcatttttgcagactttgagaaattgaaatctccaagaaatctttttcttggcaatagattgcctgggtgaacatgaaactgaaatttgcccttataataggtaaagaaagaaaataatatgcccwtgcattcaaarycgcaatgcagaattttgaccttgattccaatctgtttagaaactggattgaaaaaatctcaaaattattttcttttaggaaaaacatgtccatgtataggtgatcctttacatggccaagcagtccttgcaaatgggacttatgagctaggttatcagatacactttatttgtaatgaggggtaagtaagttcctccttagaggaaataaggaaaatgttagtaattttattttcgttttgcttctcttcttaagctttcatataaactttatttaattttgctttctatgtgacaagttatacttctagccaaacaactcttggatgttttatggagacagcaaagacrtagagtaaatagaaattgatattgaaggaaagcataactacttgctatttctgacaataagtctgttgaaagcattaagartgtagtaatcatgagaattcatccttcacaactgagtgtcccctatttaaatctgcaaactcttagagttaaagtagggctsacagaaatgagaaatagaattgccaactaaaaatatgcttgtatccagatgactctgtaaagtgtgacctggttagcctttaccatcatgttgaacaaaagctctcagttgaaaaaccttatttctgagactgctacaatgtgaagcatctcaagaacaggcactgagcactcggtaatagcctttgttctgcaggacttttaaagtcmtrgatattggggatactggacatttaagtgaaatgtgcttttagagagtaaatgtaattttcatagattttctattgctataacacaatacgtgagactagataattcataaagaaaagaatttatttggctcatatttctggaggctggggaattcaagggcatggcagtagtacctggcaagggctttcatgctgcatcagaacatgctggaaagtgaaagggaaattcagcacttgcaaaaaagacaaagcacaagggaggggctctcgctttataacaacctgctcttgtggtaacgaatccaagcctacaagaatgaagatccactccctcaagaattaatgaagaccctctagaaaggcattatccctcttaatgccctaatcatttctgaaaggccccatcacctctcactgctgttacactggcaattaaatttcaataagagttttggtagagacaaaccasattcaaacaatagcaataatacactataatatataaacaaagtgagtcttggaggaaaagtgcactgtgaccatgtaaggcagtttcactaagagtttttaaaatttggtcaagtagaaatattggagtattcaattaatagttacatagagcttgctaggcactatgagggataccaaaagtttaagacatggaccctcctaaaagaagttctaaccttattgagaaacaatatatactgagaggtatcaaaccaaaatactaaatgagaaataccaaataatagaattaatcatgttattacactaagagtccagaaggaggagagattcctgtgaatttaaatcagggaagatttcactgagtataggtgtatactcaatgaaagtattcctatactcaatgagctactcctagaaagacattctgttctaaataatattaataggagctaaaactcgtgtagcactcactatgtgccaaatgctaacttatctaatctcctaaacaaccccacgagctatgtactgttatccccttttaatcaattaggtaactgagtgagaggaactttaagtgatttacccaagctcaagaaactagtaagttgggaagcagagactctaatccaggcattccagctctagggcctgttctctctacagtcttgtccttactgagcaaagtcgtgtgagaaaacgcacagaaatgaatgtgtaatgtgattgcaggaggcagcaaagaggctgggtggaacggcacagcagatttatttagatgtttttgctctcggccaatatacgttcaaatagagaaactctttatttgattaaattgcagatttatttagcactttcattatatagtatgttgtttaagaaaccacccccctcaaattactgcagcgtagaaaataaaccatataaaaagttccttcattattatgtgkcttattaattgctatacaaaacagtaaccctttcttttcccatttagttattacttaattggtaaagaaattctatattgtgaacttaaaggatcagtagcagtttggagcagtaagcccccaatatgtgaaagtaagtaaattcttttttttttttttttaattcagaccagtagtcctcaaagattttttgcctcagggcaccttttacattttaagattaacaaagatcccaaagaggtttcttttatgtgggttatatctrttggtatttatcatattggaattcaaactgagagattttttaaataagtattgattctttttgtttttgtttttgtttttcctaagagagggtaccagtatgtttcccaggctggagcacagtggcacaatctcaggtcactgcaacctcagcctcctgagcagctgagactacaggcatgtgccaccatacctggctttttgtaacttttgtagagacgtggttttgccatgatgcccaggctggtcttgaactcccgtgctcaagcaatctgcccccgtgggcctcccaaagtgctgggattacaaatgtgagccaccccacctggcctgattaatttgtaagaatagatgcaatacaaattaacatatataacattttttaatgaaaaataacaattttccaaaacaaaataaaattagtgagaatagtggcattgttcacattttttgcacatctcttcaacayctaacttaaaggaagacttggatttgggctgttgtgtaatcacacaatatgtagactttggaaaatatcactatacacttctgcccggcgcagtggctcaggcctgtaatcccagctctttgggaggccgacgcgggtggatcgcgaggtcaggagatccagaccatcctgtctaataccctgaaaccccgtctctactaaaaatacaaaaaattagccaggcgtggtggtagcagcctgtagtcccagctactctggaggctgaggcaggagaatggcgtgaacccgggaggcggagcttgcagcgagccgagatcgcgccactgcaytccagcctgggcgacagagcgagattccgtctcaaaatcaatcaatcaatcaatcaatcaatchctatacacttataaggatgagagtgaaaaaagacaatatkttggtggtattgtgaatcaccaatttagaaaatggatatatttaaaaattgcaaaggatttctcagctagcgctcagttaagcatattttctcattaaattgtcagyatttcttgtgataactagaagaaaacttagcatggccttgcaaataaatataggcgtattaggccgttttcgtattgctataaagaaatgcctgagactgggtaatttataaagaaaagaggtttaattggctcgtgattctacaagctgtacaggaagcatgatgctggcatctgctgggggtttggggaggcctcaggaaacaacaaccattgggaaaggcaaagggggagcaaggtgtctcacatggcaggagcaggagcaaggtggggaggacgggaggtgttgcgcacttttaaataaccagatctcccaagcactcagtatcacgagaacagcaccaaggggacggtgctaaaccattcatgagaaatccacccccatgattcagacccctcccaccaggccccacctccaacattgtggactacaatttgacatgagatttggtggggacacagatccaaaccatatcaataggtatttacactttaagaaaatgagatttgttctgaaagttagttactacattaatggtttgaatttgggatgatatatttgctcatagaaaccttcttttaaatccatattgaattcacaaccagcttgtagaaaccctatattgacaaattcactgaagacacagaaattttactaatgctgccttaatcttttacatttctttcctctttttcttcaattttaagagattttgtgcacatgacctccaaaaataaaaaatggaaaacacacctttagtgaagtagaagtatttgagtatcttaatgcagtaactgatagttgtgatcctgcacctggaccagatccattttcacttattggagagagcacgatttattgtggtgacaattcagtatggaatcatgctgctccagagtgtaaaagtcacctttcaatttatttccttcttcatctgtaagtactctggaaatattttgtaaatagttttatctacaaataaagcaggtgtatgtgcttcctcctcctgtgtaattggatctaatttattttaatacaggtcaattcaagccaaaaaatagttctagctagagttctctatttttcacccccacatgttcttgggatttcatttcatacagtgtgaactactgtgtaatctgcatgagttagaagtttttgtttgaaagaccaaaaaaaataataaatcaacaaacactggcttaaaaataagaaaggtggttcttgtattacaagaaatctaagagttctggctttggtagtggtagactgtaacagactaatgctctcaccaataaaaatgataaactctggataaaaaataattttcttaaagaccagagtgaccaaaagtatgaagactccacaggggacttgcccgtttaaacaaagaaatcacagaataacagtgatttaaaagtatatacttcccaagtatgcatgaaacattctccaaagtagaccatattctagacaataagacaattttccacaaatctcaaaaaattgaaatcattcaaaatacattatctgatcacaacagaatgaaagtaggaatcaacaacaaggccaatccccaaagaaatgaaaagtatagaagacactcctaaataatccatgcataaaaatagtagtcagccgggaaattagaaagtgttttgaattgaatcataacacatcaaaatatccaaacatgtaggatacagctaaagcattgcttacaggggaatgtatagcataacatacttacgttagaaaaaaaagaaaagcctcaaatcaatgatttaattttccaccttaagaaactaaaaaagaagagcaaattaaatcccaaactagcagatgtaaggaaatgataaagatagagccaaaatcaatgaaactgagaagagaaaaaaaaaaatagagaaaatcaatgaaaccaacagttgctacttggagatcaataaaatgtgtaaacctacagccagactgacaaagaaaaaaaagacacaaattaaccaatactgagaatgaaagaagtggtggtcaagcacggcaccccagccagcttgaagaccctgcactcctgcagctggcaggggcagtcactcctggacttgtccttttagaagctccagctttaccacttgctggtggagcccaaccactgccgcagggtcctcatcaccaacacgcctggcagatccaagaggagatggcccaggatgggatgtggtgaacagcagcacccaagagtgtggggtgcgtgtggctccactgcctggtttctgcagagatcctgtgccagtgccctgtgcccgccacacaggagccagagggggagcaccatgccccccacttcggagactgctgcacgaaggggccaggtatcagacctttgctgtctcacctcagcactggcaccaggagccctgcaaagcagcatctgggagatggacagccagggggaaaataaaggaagctttcagaagtggctagatgagatatttgaaatactgaaaactaaaaatcccaactgcatggaagagctggcctcagatgtggtcagttcttacgacaacctggacacacagtgctgacccgcatgatgggatgcaccaagctgggcccctgcaacgcacttggaggcttggccctgccaccgccccacctcccagctccagctacaattgcagtctgacctgggcaagcaagagcacatggtggagatcctgatggagacctgagccacacgtgccacagtgctggccagacatggaggatgggatcccgccaagggaactctggccagcctgtagcccactgcccagccttgccggctcctctgctgattcctgcatggtctgcagccccaggcccattcccttccttcccctctgcagagggcaagccggaggctggtctcagcaggagctagggctctcctcaaaggctttctgaccttggggcaggcttgacatccccatrgccctgcatccctcatcccttttcatgtctactggaggacagtgagccatagctgcagcaatcttgtttaaatttaggtagttgaattttttagaattaagttttgtatgttttgagcaataaattgtcttaagatatatattttaggttgcttcaagatagctgaataggaacagctctggtctacagctcccagtgagatcaacgtagaagacaggtgatttctgcatttccaactgaagtacctggttcatctcactgggactggttggacagtggatgcagcccatggagggcaagctgaagcagagcgggatgtcacctcaccaaggaagtacaaagggtcaggggacttccctttcctagccagggaaagctgtgagtgactgcctggaagaacagtacactcctgcccaaatactgtgcttttcccacagtcttcacaaccagcagaccaggagactccctcctgtgcctggctggggaggtcccacgcccacggagccttgctcgctgctagtgcagcagtgtgagatccacctgggatgctggaacttggctgggggaggagcrtccgacattgctaaggcttgactgggcggttctakgctcacagtgtaaacaaagcgccagggaagcctgaactgggtggagcccactgcagctcagcaaggcctactgcctctctagattccacctctgggtgcatggcatatctgaacaaaaggcagcagacagcttctgcacacttaaacgtcccagcctgacagctctgaagagagcagtggttctcccagcacagcattcgagctcctataacggacagactgcctccccaagtgggtccctgacccccgtatagcctaactgggagacacctcccaataggggctgacagacacctcacacaggtgggtgcccctctaggatgaagcttccagaggaaggatcaggcagcaatattgactgttctgcagcctccgctggtgatacccacgcaaacaaggtctggagtggacctccagcaaactccaacacacctgcagctgagggacctgtctgttagaaggaaaacaaagaaacagaaaggaatagcaggtggtgatatcccctttatcattttttattgtgtctatttgattcttctctcttttcttctttattagtcttgctagcagtctatcaattttgttgatcttttcaaaaaaccagctcctggatccattgattttttgaagggttttttatgtctctatttccttcagttctgctctgatcttagttatttcttgccttctgctagcttttgaatgtgtttgctcttgcttctctagttcttttaattgtgatgttagggtgtcaattttagatctttcctgctttcttttgtgggcatttagtgctataaatttccctttacacactgctttaaatgtgtcccagagattctggtatgttgtgtttttgttcttgttggtttcaaagaacatctttatttctgctttcatttcgttatgtacccagtagtcattcaggagcgggttgttcagtttccatgtagttgagctgtttygagtgagtttcttaatcctgagttctagtttgattgcactgtggtctgagagacagtttgttataatttctgttcttttacatttgctgtggagcgctttacttccaactatgtggtcaattttggaataagtgyggtgtggtgctgaaaagaatgtatattctgttgatttggggtggagagttctgtagatgtctattaggtctgcttggtgcagagctgggttcaattcctggatatccttgttaactttctgtctcattgatcgtctaatgttgacagtggggtgttaaactctcccattattattgtgtgggagtctaagtctctttgtaggtcactaaggacttgctttatgaatctgggtgctcctgtattgggtgcatatatatttaggatagttagctcttcttgttgaattgatccctttatcattatgtaatggtcttctttgtctcttttgttctttgttggtttaaagtctgttttatcagagactaggattgcaacccctgccttttttttgttttccatttgcttggtagatcttcctccatccttttattttgagcctatgtgtgtctctgcacatgagatgggtttcctgaaaacagcacactgatgggtcttgactctttatcctatttgccagtctgtgtcttttaattggagcatttagcccatttacatttaaggttaatattgttatgtgtgaatttgatcctgtcattatgatgttagctggttattttgctygttagttgatgcagtttcttcctagccttgatggtctttacaatttggcatgtttttgcagtggctggtaccgattgttcctttccatgtttagtgcttccttcagaagctgttttagggcaggcctggtggtgacaaaatctctcagcatttgcttgtctgtaaagtattttatttctccttcacttatgaagcttagtttggctggatatgaaattctgggttgaaaatyctttyctttaagaatgttgaatattggccctcactctcttctggcttgtagagtttctgctgagagatccgctgttagtctgatgggcgtccctttgtgggtaacccgacctttctctctggctgcccttaacatttttttccttcatttcaactttggtgaatctgacaattatgtgtcttggagttgctcttctygaggagtatctttgtggtgttctctgtatttcctgaatttgaatgttggcctgccttgctagactggggaagttctcctggataatatcctgcagagtgttttccaacttggttccattctccccatcactttcaggtacaccaatcagacgtagatttggtctttccatatagtcccatatttcttggaggctttgttcgtttctttttattcttttttctctaaacttctcttctcacttcatttcattcatttgatcttccatctctgataccctttcttccagttgattgaatcagctactgaggcttgtgcattcgtcacatagttctcgtgccatagttttcagctccatcaggtcctttaaggacttctctgcattggttattctagttagacattcatctaattttttttcaaggtttttaatttctttgccatgggttcgaacttcctcctttagctcagagtagtttgatcgtctgaagccttcttctctcaactcatcaaagtcattctccatccagctttgttcctttgctggtgaggagctgcgttcctttggaggaggagaggcgctctgatttttagagtttccagtttttctgctctgttttttccccatctttgtagttttatctacctttggtctttgatgatggtgacatacagataggtttttggtgtggatgtcctttctgtttgttagttttccttctaacagtcaggaccctcagctgcaggtctgttggagtttgctggaggtccactctagaccctgtttgcctggatgtcagcagcggtggctgcagaacagcggatactggtgaactgcaaatgctgctgcctgatcttcctttggaagttttgtctcagaggagtacccgctgtgtgaggtgtcagtccgcccctactgggggktgcctcccagttaggctatttgggggtcagggacccacttgaggaggtagtctgcccgttctcagatctcaagctgcgtgctgggagaaccactactctcttcaaagctgtcagacagggacatttaagtctgcagaggattctgctaccttttgtttgtctgtgccctgcccccagaggtggagcctacagaggcaggcaggcctccttgagctgtgatgggctccacccagttcgagcttcccgcagctttgtttacctactcaagcctmggcaatggtgggcgcccctcccccagcctcactgctgccttgcagtttgatctcagactgctgtgctagcaatgagcgagactccgtgggcgtaggaccctctgagccatgtgcgggatataatctcctggtgtgccgtttgttaagccattggaaaagcacagtattagggtgggagtgacccaattttccaggtgccatctgtcacccctttctttgactaggaaagggaattccctgaccccttgtgmttcccaggtgaggcgatgcctcgccctgcttcggctcatgcacagtgcgctgcacccactgtcctgcactccccagtgagatgaacccggtacctcagttggaaatgcagaaatcacccgtcttctgtgtcgctcacactgggagctgtagactggagctgttcctattyggccatcttggctcctccctcctattttattcttttcagagtgatctgttgacacctttactgagtttgttcctaytgcaggactctttgattttctggagtgcaaccagtttgagtcttttgatgtaacacatttaaacagggaaatttctgctgtctgcagaacacgacctatatttctgtctcttccctgcctgcagtcttccacacctcataatgttattctttttttctctttactgggcagttttatctggcaatagcaactaaatttatagcaactgaaaggcaggaaaagtccttatttactgagatgaaatagaggactttttgcagggactcctgatcagcagctgtgcttatgactggagagattattttgatatgayggaagggattattgtcctgatttcagcactgctatctctggtttcactttccttgcrgcagaagcaagagactaattgtaggaagagcattagcctgcgyagactatgcttaattaacatcatttctgtggtcttcagtttccatttagtttaatgagattgttgaactcaaatctcaatcactggattctaatttgtttatatatttcctatctccctaatattttaaaggatctaggggaattatgcacgttaacatagtaattagaataccattttataattcctataaaagcctgttaactggtagcctccttagttgagtcctgtaggttttgaggggcaggaagagatggtttttttagtggactgatatatgagcaaaacaagattgcatatgaatttaatactcaataaggtatccaggcttactcacatgctcctagtgggtatatgtactaatactaagtttgttgatacagtcttttgaaagagttaactataagcatttcataaagtgtttataaaacactgatctagcttagtgtttgagagcagaggagagaattgcttgtgagaaaaagtttataaaaaagagaaactacaggggtattttttgaaaaatgacaaatcaaaattcctcatgggattgtcagtcattttttgtcatcagtaagaggaagaataaatagcaagataatgatgttaaggtagatctaaatgtgctaatgtgaaaaaatgtccaggaagtcctaagcggaaaagaggaagatgtaaattatgtagtataataccacttaacagttttttaaaaagatacatatgtttaccccaagcacattacttttatgatttattactkgttatcttctaggatttccattataaaatatgaaacgtagtgagcatttttttggtttttttttgaracggagtctcgctctgttgcccaggctggagtgcagtggcatgatytcggctcactgcaagctctgcctcccgggttcccgccattctcctgcctcagcctcccgagtagctggggctacaggcacccgccaccatgccaggctaatttttttgtatttttagtagagacagagtttcaccatgttagccaggatgatcttgatctcctgaccttgtgatccatctgccttggtatcccaaagtgctgggattacaggcgtgagctgtagtgaccattcttgtacatgcatccttacatacttgtgcaaatatatatgtagattaaattatttttttttctagttggagccttgctctgtcacccaggctggagtccagtgacatgatctcggctcactgcaacctccatctccagggttcaagcaattctcctggctcagcctcccgagtagctgggattacaggtgcgacaccatgccaggctaatttttgtatttttaatagagatggggtttcaccatgttggccaggctggtctcgaactcctgacctcrtgatccaccygcctcagcctccaaaaatgctgggattacaggcgtgagccaccatgcctggcaaagaatgacactgggtgtattaaaaagtatgataagtgacatgatcacagtagacatttcctccaatagaatattgggagaaagcctaatggaaaccaatgaaaaataagaaacacacgtagcctttggaacatagcctttctcacctagtggaggaggagctgagacttgagtaagacagtcagatgaagtaaggcagtattcgggaatgtttgtgtgagctaagactatacatcctgagtgatacacgtgtgttggaccatgtatacatgggtctccattagtgaagccgcactgagtagagaatagttttctacctaaagcatctttactccatgatgaatcagttatgcatggaggagaaagagctaacacgtgtactgaaatatctgctacattatctactcaaccctaattctactcacctttctacagcctttgatatttagagttactccgtcctcacasaactctttccaactccagcactggaaacaattgactcctgtctctaccaaactgtacgtcccagattcttgtcttaggagccatagaactccaaaggtttatggctataactgtgttttgacataattggctttctttatagtcctacgtgatttacttatacattacaaaaaacagctctgagaagggattcataattctgaccagccaggcaaaggtgtatacatgatacataaagatattaagaacccctcatgactattcacaatagcaaagacatggaatcaatttcaatgcccatcagtgatagactggataaagaaaatgtgctacatatccaccatggaatactatgcagccataaaaaagaatgagatcatgtcctcttcagggacatggatggatctagaggccattatccattgcaaactaacgcaggaacaggaaaccaaatactgcatgttctcacttataaatgggagctgaatgatgagaacacatggacagatgtgggggaacaacacatactgggatctattggagggtagaggataggaagagggagaggattaggaaaaataactaatggtactaggcttaatacttgggtggtgaaataatctgtacaacaaacccccatgacacaagtttacctatgtaataaacctgcacatgtacccctaaacgtaaaagttaataaaagaacccctgcatggatatggatcatgtatttccattcagatcttcctttcattaattttacatgcccctcttcaacagtctcattgattcctgtgattttgaccatctcccatccattatcttttacaaaagtcctcttgtgccttttttggaagtccattttcataatcaacaaattacctatattcccaatcttttcctaaacattctcacacctcctggccttcactaaaccccatctgtcccatgcccacatctttctcagtttaaaaaacaacaacaatgaaaaactttcgctgcttaaccttgatggcgctatcccttccccacccaatggtttcctattgctactgtaacaaattatcttgtggtttaaaacaacacaaatctattctttcacatttcaggagatcgtaagtccacagtgagtcttacaggatgaaaaccaaggtgttgaaaagactgactccttctgaaagctccagtggagaacctgtttcttgcttctaaggggcactagcattccctggctcatggcagcaacactctgagctctgttttcatcattaccttctggtctattaccttcctcttataaggatccctgtgatcatatcaggttcacctagctactccaagatactctttccatctcaatatccaactgcaaagtcctaaactgcaaggtaacactcacagattctgggatgtaggatgaggacattttgggggaacattattcagcctaccacgcactcctccttttctctcattcttggattgttttttattgttattttttaaattggctcataatgattgtacacatttatgggatacagcaaaggaaacaacagagtgaagaaaaaaacctacagaatgtgagaaaatgtttgcaacctatgcctttgacaaggggttaatatccagaatatctgaggaactcaaacaactcagcaaaataaaacaaataatattatttaaaagtgggcacaagacctgaacagacatcactcaaaagaagacatagaaatggccaacgaatataaaacaaaatgctcaacattcttagtcatcagagaaatmcaaaataaaaccagagagagatatcacctcaccctagttatcagagctcttatcaaaaagataaaagataacaaatgctgctgaggatgtggaaaatagagacctcttatacactgttagggaatccaaattaatatggccattatgggaaatagtatggaggtttctcaaaaaattaaaagcagaactaccatatgatccagcaatcccactactgggtatatacccaaaagaaaggaaaccagtatgatgaaaagatatctgcactctcacattcaatgatgcactattcacaatagccaaggtatggaatcaacccaagtgttcaccaatggacgaatggataaataaaatgtggtatatatacacaagggaatactattcagccataagaaagaatgaaatcctatcatttgcagcaacatggatgaatctaggggatattatattawatgaagtaaatcaggcacagaaagacaaatcctgtatgatatcagtcatgtgcaatctaaaaaagctcatctcatagaagtagagagtagaatactggttaccagaggttggggtagggagagacaatgggagatggagagagattggttaaaggrcacagggtcacagatacataagaataaattcayccttgaatacttaaccctctgccctacatctgtcactcctacatccatattcattgctaatcctggggctaactcttgattgctttcttctcactactaaccttaagaaaggaagtaaccaaaatccaatacatgagcaactgttcattccatctccaatatctttgttmattgtccactttatccacccagtcagggccaccatcaaacctcacttggatgtcagcaaaagctccctggctggtctcccctctccattattgctttaatctagtctccatactatacacagatttacattttttgaatatatatctaattgtccttccctttttaaaaatcttacaatggcatgacatctcaattcacgataaggaaattggttcttcacattccctgtgcactgtacacatcgcctgcaattgcccttcaacacagagagcaggcatttcattagctgaccttcccacacacattcttgcaaagaggaaaagtcaagcagggtgtttggaggtgagttgccatcatccaccgcctttgtctgkaaggaagcgyagggcctcacacgcgggatccatcggaagcccaagcattgtcaagctctgctgctgcacctgggtcagcaaggtgggctctgccagcgaaactcgttagaaacaatgcaaatggggagtaaacatggccttgcccatgaaggggaagctggtcaaaagcattttgtcccggaaccccgcagccctccccatgctctgggcgcggagcacaaggattggtcactcctctttgcactgcgcttttcctcttatcaaatctggtttgtagatgtgcttcgggaggatgggggtctcttctccgagaagccgggagcctgttgggcagcsggcgcccggtctccccttctgctgcggaggatccctgctggcggtcgtggtgctgctcgcgctgccrgtggcctggggtgaaacgctggggggcgtggggaggcgcccgggctgacgaggcacccagggccccgcagagaactcgcgtgccgcgctgggctgcgctrctctgcgcgcccgggtccaaaggcagcgcgatgggtgggctgagcgcgctacctggcagggcggcgggtctgggatccttctgcgcactggagaccctcgctgcctctaggtaagcgtggagttcccacgtgcaggggcttaagtcgtgacgagcgcagtggaaggcgcagatgctgagcgggtgccgcacgaaattccttgcctttgtgtattcacagcctcggctggctatagccgagcgtggcgtcgatcctagcgaaacgggacttggggatccgacaaacctgagttctggtcctagaaacttaactgtgaggcaagttagcacacctaagtctgtttgctcttctgtaaaatggggacactggtatctctgcattgtggagttgctgcctcagtggcataaagcctgtcgagtatctaacacagggcctgtccccgagtccatttctatcccccaaccgttacctctgcactttgctcccagtggtgtttagacaagcagtcctagggatgtcctgcatggaactgtcctcgtcccctaccccaagccaccaccgccatcatcatgatgcacttgattgacagcatactttaagacagatgcatgccaggcacttggggattagaagagcaagggaagccccagaacatgcaatgtaaccgctgcaggtagaagggacagtagatatgtttacaatttgcattttagtgatgtgtttagtacaaaataaagcctattataactactatggaaattttgaggccacatctcttcctttttttaacttcaagtaggtaaacatcttcagttagaacccttctattattagttttgggctccccagaagtcttcttggttgcctagactcactggcaacatctcacttgaagtgacagtcttggttgttttggtcctgtctcttcctgacaactcagggttcgtccttctctgccactagacgttttgcattcattatttgagtgttccttcttctctaaaagagtaaggggaaaagaaaaccaagttcccccaagagttgttattaatatttgatcttcttaggcaccagaaagtaacctgtctagtgaagagatatgataaaacttacaattttatttttaggagagaagcatgcccagtaagttaagcaatctgttgtcagtgcttactgaggttctcacaataacctccaaatgtgaaacagcctaaactaaactacctagaaattttgttgctggagtaatttcaattttaaaatgcttatggatgcttccggtgtgcacagtcctttggaatttaaaagaaatgtaagagaaagagctatgctcccaaggtgtatgcatatagaagtaggtggtggagttttatgaaatctactttttaggaagccagtgttctggtttttccagactctgctacttaccaactggggctgtggacccagcaacttaagtcacatcactgaccttcagtgtccacgtgtataaaatgagcatgactgacatcctgatttctgagagaggtattttgaaaatcaggtggggtagtgcatgtgacagcgttttgtaatctgaaaaccctcatgcatgtctgaaaaaccatgactaagcagtcgtgcaggactgcaggatcactgaaaagggagaaatctcaactcctatgatcaggaaagggtgagggaaaagagtatgactttactagcacttgaagagtgaatccagaaacaggttgcataggacagtttatgggaatatttatatataaaaaataacagaggaactaggattgttttgtcattagagggtactcctactacccatgaagtggtatggtgctatttgaaagagaacttagattagctgcaaatagatattgcaaacttagggcaactactgaaaaaagtgaaaaaaagaagtacaattgatatgccagtaaggaagagtgaattgcatcatataaaatgctcagttaaaacaataaacggggccaggcgcagtggctcacacctataatcccagcactttaggaggcagggtagataacttgaggtcaggactttgagaccagcctggccaacatggtgaatacccatttctacaaaaatccaaaaattagccgggcatgatggtgggtgcctgtaatcccagctactcaggaggctgaggcaggagaatctcttgaacctgggaggcagaggttgcagtgagccgagatcatgccactacactccagcctgggcgaaagagtgagactctgtctcaaaaataaaaataaaataaaataaaggtcaggaaaagaatgcaagacaaaaaatagaaacagagaacaagagaagaaagacaacaaatagaaacaagtaacatattaaaccaactatatcaaccatcattttgagtgtcaatgatctaaaggcaccaattgaaacagatcatcagagtcgatcaacaaacaaaactcaactatatattgtgtactccctataagaccattttaaatatagacaatatatattaaaagtaaatgggtaaagatataccatgctaatgctagtcacagaaagcaggagtagctgtgttaatttcaaacacagcagacttcagacgaaggaaaattattaggaataaagagggtcatcatataatgataaaggggctaattctccaagaaggcataacaatatctaatatgtatccatctgacagagaaacaaaatatgtggggcaaagctgatagaactgcaaggagaaatagatgaatgcactatcatagttggagacttcagcacctttatcttttctgatatcagaaaagataaaggtgctgaagtctctttatcagaaatgggcagattcagcaggcagaaaatccataaggacatacttgaactcaacagcaccatcaatccacttggatataattgacatatacagacgacttcatccaacaacagcaaaagacattctctggctcacattcatggggatagaccacattgtgagccataaaaatagtatgctaattaagctttaccagggagtgtttaacatagggtagactctggcgccctcacatggtcctcatgtaggatctgatttggttttccctgctaggtaaaggtgcaagatagaaagaagggtaattccaatttgctttctgtgctttgtgatgtattctggtttacatatgctcggatgagtagatgtatgatttatattatctactgttatctaaaataawcttcacattcggacaggcaacatcaaaactgtcctacacagaaatactgggtgaagatcacttaataagacgaactccagaaaacaagaaaatggcagagttgacaatccctctcaccctccctgcaaagacrcatgtatacaaatttcttttgtcagagacattaagagaaacaaatgctgtcaatctaatcacaactgatcacaacttgatgaaaccaaaaaatctagaaagtatcatgaagacagttgaaatacagctttacattcactattgtgaccagaggaactcactgtggctgttttttgtccccttagatgtcaactaatgattgtgttaagtgatcatgattaacagagcatttaaaatgtttattttatctgttttacatttcaaaaatttatatttaggcatataatttatatatttgtgtacatatataatttattactttatatttttgaaagtgcatgctctttttttaagctgacagacatgcctaagcaaagcaagtgcaagtctgttccttaaagggtaagtatgcagaatggaaagcagagtgtacttcgggttgacagctcatatttgcrcagacatgaaagtgatgatgtgttaattgtgcgtatagcacagaataaatcagcttgctttgaatggaagatctgaaccaggagtgcatgaaattgggctgagtcatacaagaaaaaacccgaaatgagataacaaaatatacccactagaatggctaaaatggaaaagattgaccaaaccaagtgttggcaataaagtggagaagctggaattataatatactgctattcggcaggtaaaattacaacataactttagaaaatagttcaaccgtttcttaaaaccttacacacacayctgtcatattactcagcattttactcttaggtttttacccaagagaaatgaaatcatatgtccacamaaagacttgtacatgaattttcataacagttttgtttgtaatagccaacgagtgggaacaatccaaatgtccctcaacaagtgaatggataaactaaattaacatatatttatacaattgaatattacccagcaacaaaaggaaacaatttgtatatgtgcagcaacctagatagaactctaattatgctgtgtgaaggctaaaacatttaaaamaatcggagtgatttcctttatatgataggatataaacgaagtgattcgggttatatgaaattttagaaagtcaaatcaatctgtagtaagagaaaacaggtcgaaggttgcctagagaaggaagtggatgtttggatgcattacagaaggacatgagggaactgtgtggggtgaagggtatgatggaaatgttcattgtcttcatttggtgatggtttcacagggcatatatataagtaatcaaattgtacactttaaatactcatcaaccattttatgtaatacatcttaataaagctataaaaactttttaaacttatggtaggtcttgagtttatggagtttatattaatatatttatcataagaaccagccacaaattgagggattggtaataaagagggaaaggaaactacatcaagcattctttgttgaaggctcatatgttccttttttgggctactaygcaaatttatattattacctatactatgcatwtactactataaaggtaagaatattaggtaattaaggggaaggaacttctttctttccaagaatggttcattatatttgctttgttgctttgatctagttctaacctctcattgcaagctttgttgtgacgtttaccctctctyaatacagcttttggcgctaggagagctccacttggaatctcttcctttgtctagcatcaatgcataagacacatatcaaaattgtatttcatcccacatatcaactagaggaaaggtgaatgcataacactgaaagtcacggaactgttttattcgtktttttttttttatacagtggttctcaaagtgctgttatctatccaaatcagctgtgaaacttttaaaaaatatagactcctgggctctaacccagacccactaaatcagagattctggggacatagcgtggactcttcatttttttttaagttttataagtaattcttcaattatttgatcattgcaacaaatatgcattgagtgcttataactgagtgttaagcacaaggactaggtattaatttagaagtacaaaaaacatgtcatcatttgccctcaaattatacatatctaatatcttttgagagaaatagatacttctaaaagcacacaaaattaaaaagcacaaattgcaaccacaaacaattattgatatgaaaggaaaaggaaagggcctgactagaaattatcatagggtggggcagagggaagtagtttagattccaaatccctgagagggtcagggaaggcatcagactagattgggtgcgttcagggtggtatggccatagacaggccagggaaggcttcgataagaaggtggtattttagcaaacacctggaggaagaattgaagtcatagccaagataaaagtgcatcacacaaaaggaatgtcatagacaggggaaaaatgtgtgtcttcaggaaactgaaaaaggggaaagggccaccacaccttggtgaggggacccagtggtaagagatgaagcaggaaacatagacaagggcatctttgtacaaagccaaaagttggttcttttaagtctaataaaattgacctctggcctcaatctacccaattaattagtggaaggtgtgggaaggaacagaaatgaaaacaaaacaaacaagatatttccaaaactagagtaagatgctattctttttcaacagatatatcttcttgattacatactgtttgactctgtgatttttgttgctttaaattaaatctacaaggccttaaggggcctagctgagtctactatataatatgaaatatctrtgagaaaatacgtcttctttatggtaaagtatagctttagttgttgagctttgttcactctttgtgctcaagattgacgtggcgacagacttccaacattggtggctgctactgagggccaaagaggagatgtgtactcccactgaatctgagtgtccactgagtgtgaaggtggatggtaaaatgcatgagtgtatcttacactcatactttacaagaaagtatgataaatgaggatgggagagaagctacaacacaggcacttactgattaactaaaatttgaagctgtgaattgcagcttcccctttagtgaaagatgatataaatagcttagttttcttcaaactagcagagactttttaaatggatggatgctgattttttttttaaaaaaagagcccatttctaaggcatgttttaaagcaggtgtcctcaacccctggggcataaaccggtactgtccggtggcctgttaggaactgagcagaacagtaggaggtgagcggccaagcattactgcctgagctccacctcctgtcagatcactggcagcattagattctcataggagcagaaaccctattgtgaactgtgcatacgagggatctaggttgcatgttccctatgagaatctaatgcctgatgatctgagtggaacagttccatctcaaaaccatttccctgcaccctccattcacgkaaaaattgtcttccacaaaacgagtctcaggtgccaaaaagattggggaccaaagttctaaaggaatcaatctctttgctattattgttattattattgttaagatggagtcttgctctgtcacccaggctggagtgcagtggcacagtcttggctcactgcaacctctgcctcctgggttcaaatgattctcctgcctcagtctcccaagtagcttggactacaggcacatgccaccatgctctgctaattttttgtatttttagtagagacggggtttcaccatgttggccaaactggtctcgaactcctgacctccagtgacccacccaccttggtctcccaaagtgctggaattacagacatgagccaccacacccagctcccttggctattagtgaagtcttctttttcttttttgatcacatctatgcagtatatttgagagaaagaggaagtagagtgggaatttcagcagggcatggtggctcacacctgtaatcccaggactttgggaggcagaggtgggcagatcacctgaggtcaggagtttgagcctggccaacacggtgaaaccttgtttctactaaaaattcaaaaattagccggatgtgatggcaggcgcctgtaatcccatctactcaggaggctgaggcagggagaattgcttgaacctgtgaggcagaggatcgcaccactgcactccagcctgggtgacagagggagactctgtcacaaaaaaaaaaaaaaaaaaaaaaaagtatggtaatttctccattaacttcgatgctgctgtggtcttgatccccagatcaatgcaatgtcccggaatggcttccatttgccaggcctaccaacctaactgatgactttgagtttcccattgggacatatctgaactatgaatgccgccctggttattccggaagaccgttttctatcatctgcctaaaaaaytcagtctggacaagtgctaasgacaagtgcaaacgtaagtaactctggagtgggaaccyctctgttagtcaaacatctgtaagatctgattcaatttgttcaaattttgtaactgagttgcatacaacaattagtttgctaaggtgcaatacatatgagaattattcttgtagatcataccttgttactgctttgagttcctggcaccttcattacaagtttatttcatgagaaaccgtcattgcaggacatgattgagggaaaayccccattcactgggggtctcccaytttcatgactaaaattaagtaatgaatgacttgggacaagaaagagaagtggattaaataactaaaagatgcgacaatcttgggcyttgagatctttggattatatcagttgaattgaattacagataataacgaagtttacatttttctgggaggcataatatggggatgaaacagatctgaaaggaaagttttttttgaaagggagctgatcctgaggcagtctggtgagtttcctcaaggtagcaaaatctgtggaaccatcagaactgcatgtgttcctcagtaagctataggcaggttgagaccttatgtactaaaaaaaaattcagtttactctacttggcttcaaatttctgtttctttcctgtaggtaaatcatgtcgtaatcctccagatcctgtgaatggcatggcacatgtgatcaaagacatccagttcrgatcccaaattaaatattcttgtcctaaagggtgagttggcatctcttgaaccaacatctcttggttcaagggttctaacacagccatactaccttctagtcacatctcagaaaggacaactaaactattaccatctgctctttaaagrcttcaacacaggtgcttagctcctgactgaaatggacaaaggtatgacaagatcagggggaaaatcatctgtatccttgctggaaaccaaggcagagcatatatgaaaagtgtggcattcattgggtgggaaggaagaaaatgggggaagagtatagtcaaagcacacaatcagccttaacacagattagacattgctcaaagaaagggaaggccattgagcagctgtgtgagagaaatcttaatggtcatagcacaratagtttgctagggctgctgtaacagagtactccaaaacaggcggcttaatacaaacaaagtttttggagttctgttccggaggctggaagtacaaaatcaagatattggcagagccagagccagatccatagccatgctccctccaaaacctgtagggatggatccttctttgcttcttccagtttctgaagccccaggccttggcgtgtggcagcagaactccagtttctgtctctgtctgtcctcacatggctgtcttccctctgggtctctgtcctcctatgctgttctcttatctgtgcatgtctgtgtccaaagttctttttttttttttttgagatggagtctggctctgttgcccaggctggagtgcagtggcgagatctcggctcactgcaagctccacctcccgggttcctgccattctcctgcctcagcctcttgagtaggctgggacaacaggtgcccaccaccatttttttttttttttttttttttgtatttttagtagagacaggatttcaccatgttagccaggatggtctcgatctcctgatctcatgatccgcccacctcacggcctcccaaagtgctgggattacaggcatgagccaccgcgcccagcccaaaattctctctttcaataaggacaccagtcatattggattgcggcccacactaacaacttcatcttaacttgattgcctctgcaaagaccgtatttccaaataaggtcacattaataggaactggggattaagacatccatatatttcaggggtgaggggaacataattctcatgcattgctggtaggaatgcaaaatggcaccatgactttgaaagacattttggcagttttgtataaaaataaacatactcttaacatattatccagcagttatcctccttggtatttatctaaaggaattgaaatctcaggttcacacacaaaaaaatctgcacacagatgtttataacagctttattcataattgccaaaacttggaagcaatcaagatgtcctttagcaagggaatggataaactgtggtacatgcatacaatagaatattattcaataccaaaaagaaatgagctatcaagccatgaagagacatagaggaaccttaaataatgaatcttctttcactattactaagtgaaagaagccaatctgaaaagcctatatagtatatgattccaactatacaccattctggaaaaggcaaaactatagagatgtaaaaagatcagcagttgccaggggttagggaagaaggggatgaataggcagagcacagaggattttgagggtagtgaaactactctgtatgatgccataacagtaggtacatgtcataataaatttatccaaagtcatatgatgtacaataccaagagtggaccctaagataaactatggacttggggtgaccatgatgtgtcagcgtaggttcatcagttgcaaaaaatatttaccaccctggtgaaagatgtttataataggggaggctatccatgtataggggcagggagtatataggaaatctctgtatcttctgttcattattgctgtgaaccaaaaacttgtgctaaaacacaaagtctatttttttttaaactacataaaagtaaatacacaggcacatgtgcataaacagacacgcacacagtcgagtacaggtaaaacaggaaatttgaacaaaactggtggatcatacctgtctcaatatcttgagtttgatgttgcactattgttttgcaaaatgttattattaggggaaaattgagtaaagtgtacctgggatctttctgtgctattccctacaactgcatgggaatctgattatctcaaaataaaawwwttttttttttaagttactactaaatttccaagggsatgggcttcctaccaaagaattgtatattgtgaaattaaatcattcgaacttaaaacaattcaaacttatagctgggagaactttaaattattctgagccatgagaagactgtggctatgcagcctgagtcatgcagcaggcagctgtaacttctgcctttttatcctgtgaatagttaaaaccaaatggcgccagagataagacccactcagatcactacgccttttcagggagcaataatcttccttggaatgtagcaatatgtaaccaatcaaagtgatgtaactatgcatggtcccatatggaaaatataatcctgctaaaatttctctgtctctgcctatgtaagtgataccttacgtcctccactttggaatgctgaccccattcatttggagttggtgtcttccaggtggctacccttaagctgtgtgctcaaataaactctatccttaaatatattttctgaatctcattatttaargttaacaatgtgctaacctaaacaattcacaggatttgttttttattctcattttttcctaacccaaccacctgkttcaaggcacatagattaagaaggaaaatggaaatgggactaatatcccaggcttcactgtccctctycgggccctggggaggagactcccaaaagtctagacatgttcacccacatcctgtatgtggtttctggaaacgaaatgatcatggcwtttcctgaaccatggcttaactttgtgaatccacaactctctcttccccaggagatccaaaaagrtagggtaggatgtaaaggcttcaatctgtttaaatggatatgagagtccctggctctccttaaaataagtagcatggattttgtctctctgccttacttcctcacaaacattctgaatgagaaaagttcaaaccattatttgttcaagtacttaatctactttgggacacaagtttaataaattaaaatattcttctatctgttccctttgatcagtgaacataaagttatcctttgactcatatttaaaatgttcagtactacaacactgaacaatagtatggaggaaaaaaaatgccaatttaagtttgaacttgcttcaccattcctatcccaacccccatgattagaaaatcaaaaagaacactttgagaaataacctcagtggggtcaaaagccagagtctccaggatgtcttgttcttaagacaaatagaaggaggtacaaatataggattgcagacttgtttacttcatttgttctctatttgtgtgcatgtgtgttggcagtgcaattgagaatgctttcatttttggtggtgtactagaaggcattaaaaaacaaaatgagaagtgggaattgaacaatgtgaatacatggacacagggaggggagcatcacactccggggcctgttggtgggtggggggctaggggcgggatagcactaggagaaatacctaatgtaggtgaccggttgacgggtgcagcaaaccrccatggcacatgtatacctatgtaacaaaactgcacattctgcacatgtaccccagaacttaaagtataataaaaattaattaattgattaattaattttaaaaaacaaaatgagtccaggcgcagtggctcatgcgtgtaatcccagcactttgggaggctgaggtgggagaatcacctgaggtcaggaattcaagaccaccctagtcaacatgatgaaaccccgtctttactaaaaatacaaaaattagccaggcatagtggcgtgcacctgtaatcccagctacttgagaggctgaggcaggagaatcacttgaatctgggaggtggaggttgcagtgacattgcactccagcytgggcgacaagagtgaaactctmtctcaaaaataataataataataaataaccaaaatgatatcgaagtcactaataattacaacataatagctactataatgtaacaatgtgtcaagtgtctgcagaaggacccactgttgtctcactattcatttgatctccatttggcactgtttcgttgtttgaataaagctttatgctgccaggttttcctacatatttgtaaaacaaagttctcagccattccaataaccatgactgttacttgacattgcttcattcatgtatagtactatcaagtttgagcctaccctcactatgactagtttggcccaaccatctatcacaacagagggtctcaggtgaagtaaaataaatgttataaattcttccaaatttatggcacactttgaacagtttgagacatactaattgagaattgctaactttaacattttaagtataaaataagtgttcagttctttttggtcagcttggattgcctttggttctagttataaatcattttctttctttctttctttctttytttctttttttctttctttttctttctttctttctttytctttctttccttccttccttccttccctccttccttccttctttctttctttctctttctttctttctctctttctctttctctctctctctccctctgactctctctctctctctaccccgcccctttctttcctactgacaaggtcttgctttattgcccagactggagtgcagtggcatgatcaacactcactgcagcctcaatctcccaggctcaagcgatcttcctgcctcagccttctgagtagctaggactacaggaatgtgccaccatgcgtggctttttaataaaawttttgttgagacagggtctcactatgttgcccaggcttctctcgaactcctgagctcaagcagtcctcctacctcagcctccaaacgtgctgggattacaggcgtgagccactgtgaatggcctactttgatgaatcttactgataaaagcccatccatgcatccatatattaatacttataaggcatagaaatacatacaacaggactrcatacacacatacatatgtatatatatgacagcttccctgcactcaagaagcttgtgttgtcttttaaaaaaatgaaatttataggaaaaactgtaactcatctttgatttatataaaaatgtgtcataagataataaaaaagagaaatcccatccaactgagaaggcatggaagagaaaatgacaaagtcccaagaatgtgaaatttgggaaggtgatagacaattctttgacaagtggaaaatgtccctctgaattctataagagtgtaatctctggaagtagtaatytaattgggtagttgacctgtgtatttagaatgtaacattccttattttttgcctctagataccractcattggttcctcgtctgccacatgcatcrtctcaggcaacactgtcatttgggataataaaacacctgtttgtgacagtgagttgaaatatgcattcctatttcttttaccgatacattctaatttttctctggaataataaaaatcttaaccgaattccttctgtgcaawctgtacttcacatggctgaagacagccataatgttctcagatattcctatggggttcctggcaactctttctttaagttctttcttatcctgggatgtgtcttttctaattctaggggcctaaatacgtaaaaggcttcaaacttgattttacttcaataaacttgaaattatgttggttctaccacctccagtataataatcatcctgcttggcaaatcagtaaagattttaaaaattgatactcttcaaggttagcgaagctgtggaagaacctggactctcatgtaccacgagatcaacacatcctcttgaaaggccccatgcactataaacctcagaagtgggcatgtattttaacctayttcttaraatttrtacttaggaaataatcacacactttttaaagyagtttggtataaacttttcattgcagcattatttatattagttaaaatgttagagtaacctaaatattttaaactatggtttggaaataatctactagtaggaaaaagatgtgttcaaatgaccattayaaagaattccctaagaaacatraaatagctatgcagaatgaaaataagtatatccatacactggcatggtattcagccataaaaaatgatagcataaagaagcacttaatgactagaaagagatgtgttttatgtggaaaaagaatcagatgaacggcatatatggcaagatctcattttattaaaaaaaaatacacctatgtagtgagggccaggctgaggctgagagaaatgcagtgtataacatctttgtcttactcttctctttggataacttggggacttctttacttttcttcttggtatttaaaaatgttgttacttttactagaaagtttacgagcttcagaatctaaatttacaaatgacattggtcacacatttattgctgtttatccactttaagaaacagttttgctattttgtaaaacaaattgggaaaccttccatcttatttgaaatctgtaataagataacatggaattggaataggaattttcttggaaatattaaaaaaaattagtaaaatagaaaaaacaaacaatataataatacacctatacctatatctatatttttatctctgtttctasttctgtaaactctctatacccaaatcctggtaaatggctgtaagtcttcttggagaagactaggggaagatttacaatacatgcttttgactgcgtagcatggtgcttcctcaagagaatccagtctcccatccgttggtgctgctctgggtctataaactattcaagtctaggaattgttgatgaacaatgaacttcttttgcaataattcaagtcagacttcaattcacttgacctaaatctcttatgcttatacaaatcaaataacaccttagtcggctatccctctacttcggttttagagactccatgatcaattagcccaataacaatgttctcttcagtcaaatcattctgattgctgtttcagttctaatagccattacaattgtctctggcaattaagtgctgccaattggactctgtcaccctgagctcctttggtccccaagtgaattcagagaacccagttcaatggcaacagttcccactgtcattcctggcctacagagaatgagccatcgcagaggatgctgaaactccccgtgtgaatgtttttctcaagcctccagtaaaaggtctgtcttctgaaccctccactcctgcatgtgcctcaccagctctatccaaggatgtgactttcagagtggaatggctgttgcttaacctctgcctctcaaatatcaggctaatttctcatgctgtaaccctagtccagaaccatacagagaaactaagtctggaaaacttaattccaaattggcctggttgacactgtacaaaaccaccagataattataattttatttaactctttgtcttcttttctttccttccctccttcccttctgcctgcctgcttgccttccttctttgcttgcttccttcctttctccctcccttcctccctcctttccttccttcctccctccctccctcccttcctccctcccttccttccttccttccttccttccttccttccttccttccttccctccttccctccttccctcctttccttctccttattttctttcttctttaccacacggctaggaccaccagtataacattgaacattggtagcaatagatgtcatccttgtcttgttccacatctcaaagggaaggattaaaacatttcaccattaacctggtgtttacagtaggctttttgtaggtaaccatttttgaattaaggacattctcatayactcttcattattaaaaattttttgtctttgaaacatgttgaagtttatcgagcactttagttatatgtatcgatgtaatcatatctgtttctcttttttctgttaatgtaacaaactgttttgagtacatttttgaaaggcaaataattttgaatttcaattttacattcttaaaatcaactaagtcaatacttaatcatttttatatataacaaatacccttttataatacattttatatgtttctattaaagtataattcatgtatcataaaagttaccttttcaaattacacaattcagtggtatttagtatattcataaagttgtatattacggtctgaatgtttgagtccaccccaaatccatatgttgaaatctttacccctaaggtgatgacattagggagtgaggcctttggaaggtgatgagatcatgagagcagagctgtcacgaatgggattagcgtcctaataaaagaggcccagaagagctcctttgcccctcctgccatgggaagaaatgctgaatctgccagagaggttggtcctgaactccttagcctccacaactatgagaaataaatttttgttgtgtatgagctaaccagtttatagtattttgttataacagcccaaatagactaagacattgggcaaccagcaccgccaattaattccggaacactttcatcatcccattcctgttttagagattagactgtaattttctttcttgtaatgtcctcataagattttgatatcaaacttatgacagtcttataaagccagctggtagtgtttcatatatttgcttccttgtaagagtttatataaaattggtattatttcttctttaaatgtttaaaagaattcactggaaaagccatatagcctggagtttactttgttgggaggtctttttttattccaacaattttcttgtaccatgtagactttttgctgaagtataacatatatatgtagtaaagtgcacacatcttaattatgcagttcagtagatatttacaaattaaatgcacccatgtaagtggcactcagattaagatatagaacattatcagcaccccagaagccttcctgatgccctttcccagttatcttcccaaagtaaccgctattctgatttataacactaatagttttgctgcttcctaaattttataaaggaatcaaaaaataggtactcttctgtgtccggcttctgctcagtgttatatttggaagtcacttttgttgctgcatgaaggatggtcagtttttttattattatattgtatttcactgatgatcttgagtaccttttcatatgtttgtgaagggcctattccaaacttttgtctgttatttactggtttgtctatgattttattgttttgtagaagttgtttaaatattctcttgttttctaataaatgtaacacaaatgttgtctttcaggctgtggcttttctttttctttttcccttcttaatgatgtcttctgttgtagtaagttctacattttaataatattcaatttatgggtctttttttccagttactgctttttctattctacttaggcaattgggccaggtgaggtggctcacgtctataatcctagcactttgggaggccaaggcaggaggattgcttgaagccaggagttcgagaccagcctgggcaacaaagcgagaccctgtctctacaaaaaataaaataaaattagctgggctcagtggcacatgcctgtaagtcccagctacttgggagcctgaggtgggaggatcccttgagcacaggggttcaaggcttcagtgggttatgatggtaccactgcactccagtccaggtgacagagtgagaccctgtttcttatggataggcaattgatctaatatcatttattaaatgttgcaccatggccataagtcaggtgacctatatgtggatgtcattccagggaggttctgttccaytggtttatttgccatacattgtgtttttgtttggtttagttttttgccatactataatggcaaaaaaaactgtagcattacattaagattttaattactatagcatgacattaatatttgatatctggtggcatatatcttctaactatgtgcatcttcaagatttacttggtgattcttggcactttgcattaccatataaaatttagaatcagcttgtcaatttccacaaaaagaatcctacttgaatttgtattgagtttctattgacttagtacawcaatttgtagacattaacaaatttagttttgaagtttaaatttatgaacatgatatatcctcccatttttgaagtcttctttaatttcttttaaaaatatttgttaatttaccttatagaagtcatgtacatctttcattatctttattactacatattatttttaaaattttattctctatttacttcttagatatgcactggtttcacctcagctccagcaattttattaaatttacttttaaattgaatagtttttctgtatatcttttgaagttgctgcataattatgtcatctatgaatctgacaaagtttttaaatcttttcctttcttatgtcttttgtttatttcatctgctttattgcattggctagaacctccagtacaacattgaatagaagagatgatacaagccttttaatggttatcacaaatcatgatgtatgctgtagatttttgtatgatatcctttattagattaaggaaactcccctttacttctgattgctaaaagatttatcatgaatgttcattctaattgatcactctgcatgtattgagattatcatgtttctttttcactctgttaatgtaatatattacattgattgatctttaaagggcaaacaaactctgaattcctagaatcaacctatgttgcttgtgatgtgttatagatgattatcctatcwatgaaatgtgtgtgagtgtgtgtgtggtgtgtgtgtgcaggattgctcatatttttattgtaacgttgtaacattgatttaatatttaaaatcagtcaaggtaaacctcactttgatcattgtatcatcctttggaaatattgctggattcagtttcataatattttgtttagaaaatttgcatttatgttctcaagagatctttggttataatttggttttattttaatgtccttatcaggtttgggcatcaagattatgttgggctagtaaaatgtgttaaaaattgtttatttttttctagtctccggaataatttgtgtaacattaatattatttttccttatatgtttggaagaattcagcaatgaagcaatctggacctgagggtttgttgttgttgttgttaggttttaaattagtgattcaatttctttaatagctataaaagtattattttatatcgtattgaattagtttgggtaagttatatttttcaaggaatttactcattttatttaaattttctaggttattagcataatgctatttattatatcctcagaaatcctttggatgtctgtaaattctgtagtggtactcctatgctaattaatttctgatattggtaatatctttttgcttctttttccttaattagttttactggggctttatcaagtttactaagcttttcatataaactacttttaactttcttgttttttctttaaagtgtgactattttctcttttactgatttctgcttattttcttctactttctttaagctttgtgtactcctccactcctaaattcttgatattgattagataatttgttttcaacctttatttttctaatatatacatttaacctatacatttttctctaaaactattttacttcccacaatctttatatttttattatcattgtacataaaagttttctaatttaccttttgatgtcttctttgacccataggctatttagaagggcattgcttaatttctaaatatttggagatcttctagttatcattctttcattaattcaatcatttgagacatggtttatggcccagaatatggatgattttggtaaaatgttacatatgcacttgaaaagactgtacagttattttgtttcattttctagaaatgtcatttaggaaaatgtggtttagaacagactttttttctccctccacttgttctctcagttatggagaagcatgtgtaaaatatctgtattagtttcccagggctgctgtaacaaattaccacaaacttggtggcttcaaagaagagaaatttactctctcaacagtttggaggccagaaatccagttaagatgtcaataggattggttccatctgcaagctgttctgtgcctctcttcaggcttccttccagtggctgctggcaatcgttgatgttccttggcttgtagatgcatcatttcgttttccgcctccatcttcaagtcgccttctcctctgtgtgtgtcctttgctcttctggctcctgtaaagacactggacatggatttagaagccaccctggcaatccagaatggtctcaactcaagatcattaatttgattgtatctacaaagactctccaaactgggtcacattcacaggtttcagagattaggttaggacacagatattttttaaggaggacagtggttattcaacccattacaatccccaactatgactatgaatttgcctgtctttcctctttgttctagcaatctttaagcaatctttactttatgtattttaaacatgttattaaatgcatgtttaaataattgcatttgttaaattttttgtttattctttctgctgaattgactgttttatcataatgaaatgtctctctttacctctcataatacttcttgccttaaaatctactttgtacattaatatagctatatcagctttctttcttgtatttatattatatatatttcaaatcttttactttcagcccttctttgtcttatatttaaagcttgtctgttataaacatcatatggtaaagttttgttgttttattcagtctttctttgttgttcattagtgtttgaaacatttaaatttaataataaaaagttaaaattataaataaataaatttaatctagttactgataagtctaactcttggttatttgttttctatttgtttcatgtgtttgtgcctttattcctcatttctcacatttttgaattcatcaagtatttttattattctattttccccagtagcttttaagttatatttcattttttattcttaaatcactactctagagacagacatccttgatttactatagtctactaaaattgtgcttttaccagtctccaaacaacgcaagtacccaaactattaatatttaattccatttgtgtcctcctcctctttttgtattgttgccatacgttttgtaaaaagaaaagcttcagctgaattaaatttaaaagagtttaattgagcaatgaacgattcgcaaatcaggcagccttccaagccaaagtaagctcagagactcctgcccagctgcgtggtggaagaggatttacggacagaaaaaggaaactgacgtacagaaaacagaagtgaggtacagaaacagcccgattggttatagctcagcgtttggcttatttgaagacagttcaaacagttagccacatttgattggccaaaactcggtgattggcataagagtaacctacggtctgtttacatcttcactcgttataattcgcagtttacagagaaacctttaggctgagcttaaactatgtaaggctttaggctaaacttgatttaacaatttacatatgttatatatttcaaagacgtaattgttgttgttgtctttataaaaataatatctatttatatttacaccgtagtgaattcttagaatttttatgttgcctcagcatccatttagaatatgtttagctttctcatgccagaagcagggcttagtcacccttaatgccctttctagttctgtacctcctcccaattttgcaacgtggtcgagccagatatctgctttatacaactgcctcctggtgaccacctctccatgggacagctagataaaacctacttgactagcgtccctgccctctgtgccctgcatggacttcgcagttatgctgccgtgaccacctctcagtcgcagcatgactgcctggaacatgtgcctgctttctttaaactcaccaattagaactccccatgggagataccttggcttgtagatgcaagatgctgggtcatactctggtccccaataaaggcattggccgatggatccccttctctctctctctctacgttcctcgcactgaccaacctctttgtgatcttcaggcgtgccatacccccagcccgtaataaaatctttactkccatcttgtgtttcttgtaatgactgaagaggttttctctatcataaagatcctaaatgaaaacatacccgcatatgagctctttctggtgtgtttccttcttattgcaattctatcaatcctatatgaaactattttccttcagcctgaaaaagtctctttggcatttttgtattgtagatcttctgacaacaaattctttaaacatttttctaattgtggttcctttgaaggttattgtctatgtttcctgctgcttttatggattacactttaaaatagattttttacaatattactatgttgtgtctaggtaagtatttctttgtattgcttgggtttatcttgttgcacaactggagtgcagtggcgcgatctcggctgactgcaatctccacctcccagattcaaggaatcttcccacctcagccacctcggtagctgggattacaggcctgtgccactattcctggctaatttttgtatttttagtagagacagggtttcaacatgttggccaggctggtctcaaacccctgacctcaggtgatctgcccacctgggccacccaaagtgctaagattacaggcatgagccaccacgccaggcctgtatagctttttgaatctgtaatcttgcatcagtcttggaaatttctcagttattacttcttcaaatgttgtttatgtctattatctcctctcatggcaggacttcacttaaacatgctaggctttattcttctatatcttggtctgtatgtttaacatgcatttaaggagtttttgtggactaatatatgaccacttttacacagatatcatgttattatatcaaacttagatttgagtaaatgagttgataagttttatacctcttgtgtgttgtgaaatattgaaattacatttggaagcatctgttacttgaaagttcaatagagcttatctttttttttttattcttacatgtttgttgggtaattctagctttctaaatctttttgaatgaatattggcaatttatrtttccatttatatcatttagattttcaaaatatttaacccccagtagtctacagttttataaatattctcatattcataaaaatgtttaaattccttttcctactgtgtatatttgtgtcttctctcttcccttatactttatcttttggcaaaggtttttatattttatttttctaaaaaggctaacctcagttattaacaaaaatgcaaattaagaaagcaaatgaaaagagtaggagaacactgtataaactctataatactataatcaaagggctatttaaaatgaaaagaatgtggatggagttaataaatgcatgcaaatattataggaaatcatataagtaagaaaggcaggacacatcatattatccccaccaaaattacaactttgtaaaaatgtacctacgtgttagcaaagaataaaagcaaataatgaatgtaaaaatagttacagtttagtgactcgtgagatttttgtcattcattatttaaattgactgtgctcttcctttcccaggaattatttgtgggctaccccccaccatcgccaatggagatttcactagcatcagcagagagtattttcactatggatcagtggtgacctaccactgcaatcttggaagcagagggaaaaaggtgtttgagcttgtgggtgagccctccatatactgcaccagcaaagatgatcaagtgggcatctggagtggcccagyccctcagtgcattatacctaacaaatgcacgcctccaaatgtggaaaatggaatattggtatctgacaacagaagcttattttccttaaatgaagttgtggagtttaggtgtcagcctggctttgkcatgaaagggccctcccatgtgaagtgccaggccctgaacaaatgggagccagagttaccaagctgctccaggggtgagtctgactgaggcctagaagggccctgccagtgacatgcattgctgttggatcaggagattagtatttgttcagggggagggatttgtgctgagcagggtcgagaagcaaattttctaggtagtgaacatgaaattcagaaggtgtgtgtacatgcagatgtgctgaaatgaagaagcaaagctaaacctggacaaggaacgtgatgtttctttggagttcttataagcaaatctattaattacctttgagtataataactgctgatagaaaatgagtgattcttccagccaggcaccataatacaggctacatgtgaattttaatccttaaaacaaagttattaggtagttaccagtttttctaggtttgtctgttttgttttgcttgagacagggtcttgatctgtcactcaagttggactgcagaggtgagatcatggcttactgcaaccgccacctccctggctcaagcaattctcctgcctgagcctcycaagcagctgggactacaggtgcatgctaccacrcctggttaaattttttatattttttttatagagatcgaatctcaccatgtttcccaggcttgtctcgaacacctgagctgaagcaatccacccacctgggcctcccaaagtgctgagattataggcatgagccactgtgcctggcctctatgttttgcagagaaaatgtgccttagagaaatcggataactttctaagatattaacttgcagactgaagactgaaaygcaagtccacccgactccagagacttggctttgctagtcagcatccagtcaggaaatcaaaacttactctagatactttcaaggagggagggatttcatgcaggctgtattagactcttctcacattgtataaagaactacctgagactgggtaatttataaagaaaagaggtttaattaactctcagttctgcaggctatacaggaggaatgactgaagactcctcaggaaacttacaatcatggtggaaggcaaagaggaagcatgtatattttcatatggctggcaggagacagcaactagggaggtgctacacattttaaacaagcagatctcaagagaactatatcacaatacagcactagggtgatggtgataaaccattagaaaccacccccatgatccagtcacttcccactaggctcctcctccaacactgggaattacaatttgacatgagatttgggtggggacacagagacaaaccatatcacagctaataggtcacaaagatgttagaagggcaggaaaatcaggcagcctccctagcaataggacgaaggcagagttaccagagatcagggagctgctgtggctcccagtctacacagcacaggagcctggagggatgctcaagtggccagcccctcccactgagcaggcagctccctgaaagctgctaatgctgcaggagccaccacagctgccagaatgcagctgatattgctggagccaaagtcattggcatcgctagaattgaagctgtagctgctcactgaagtcatctatactgccactgcctgagccacctctagaagtagaacagactctgccatcatcctgctttttaatttggtatatatgcctccaactggaagaacctaaccagagcccagctatcaaggaagacaaatgattatagttttaaggtttccattgctagcagccaaaagacagtgcagaagtgtgaggctaggggccaacagaaatttaaccagcacagcacctcaatattacatcaccaggcattgattagtcaagggaaacactgggtgatgagccctgaaaatggacattacagcatcagagtatttacaaactccctaaagaagtcatttttctagtccaatcccccatttgatgcttgagaaagctgaagtccagaaaagggaactgatctgctcaaagacaaactgaaattattttttccattttataacagttttatataatttagttgagacctaaatgtgttctgacttcctgagttccgatcaactatattaagagagagccagcgctgcccttacaatatgttgtgtgaaatagacactctcattatggtgacagtaggtcttttagattttgttcgacagttgcccaccttctcactggagtgaaatgaatgactaggcagcaccttgctgcatagcatgaagggaggagacccatagttctttaccaccctatgtcaggtggccgctgagagaagacttgaaaggagaagagaatagatgtatgtttgttgcaccagtgtgataggtgatggagggacctattagatgagacatgggcaggggcactcctttatggcctaaaatgcaagackaaattggtgatgcctttctagaaaggaagcatggagatataaaaatccatcatccctcccaattttgtactgggtgaacagtaattggaagcattctagaaggaactgtccattgtgaaatcttagttgcatactttagatgtaaaacaatgaattggggatacctctgttttagtcacagttgtgcaatgtgtcagttctatgagtgatggcaagacatcttcctcgccctgtgtatttagtttgttatcaatgtaataaggctgttattctaccttttttgttacatatagatttgtaattattattcccttggccagtttaacagtgagagaaaagttattttcacacaattagcagtactttgtttctctctccccagtatgtcagccacctccagatgtcctgcatgctgagcgtacccaaagggacaaggacaacttttcacccgggcaggaagtgttctacagctgtgagcccggctacgacctcagaggatctacgtatttrcactgcacaccccagggagactggagccctgcagcccccagatgtgaaggtgactagactcttatctggcttggtatttttagcttgcgtctttattctccacatgccagttatttctgttcgtttttctttttttccagtgaaatcctgtgatgacttcctgggccaacttcctaatggccatgtgctatttccacttaatctccagcttggagcaaaagtggattttgtttgtgatgaagggtgagtatgagcttgcctgacctgctggacattgaaattggggttaggaattagtccaaaaaggggagatttgatgtggcttaaaaaaagacagacagacasacacacacacacacacacacaatcagagagatgaacttttgaaagtatatataggaagaaaggaaagacacatatggaactaataayatgagatatgaagaggacactgggccatatattaactggcaaattcaaagacaagtataattacttgttattaatatataggtaacacagtaagtttaaaaaatcctattttcaaaattttagaatttcaaaacagcaaatagaatatgagtaatttaagagtctcagaaaaaattgcaagtaacaaaaaacttattctaaagagctaggatcatttaagaatcatttcagtaaattctttaaaccatcagtaatgaaatttgtaataggactgaaagtgtaaaaatcagcattttaaaaaaatccagtcatatatcgtctggctagtcatgggctctgggctctgagctggggttctgatggctgctgttaatatttccagcaaggtcattaccttgtttatgtccacctagtgctcttcrcagggtgcacatctctacacgggagctgaccagcatgggcaacaaagcacctgatcccaaaatgtaacacagaatcttggcaggctccaaaagccagcacccagtaagagttaggagggcatcggggcccaacagacattgagaattttcaacaattgcgtacaaaaattatgtcctctcttctttcctttttcccctagaatattcgtgcttactcttcagcagcccaaattgcccttttgagccttcttcacgccatcacagatgtggagatgaaaggacaatctctgttctctcgccagctatttcccactttaccactccaaactgggagctgttttacttgctgttccagggtcagagttacgaaggcattgcattagaagactgggtttctaataatgacaatgagtaatcagtgaaactccaagcctgggtcctgggtcaaggagatggtggcyattttgtgaccacctttttcaattcaagcaggactatcatgtgaccaagctactgcattttgccactctatattgctcccttctggaggctgtgatttttccagaataacgtagyctgtgcaactctgccacctgctggcctcaggtcctcaaaatcctgaaattggggctgggccttagattgtgaactaagtgtcctcttggctgaaacagctcrctattcactcctattttcttctttagatttcaattaaaaggcagctctgctagttactgtgttttgkctggaatggaaagcctttggratagcagtgttccagtgtgtgaacgtaagtaataggagtaacatttcaggccaatctctccycttcatctgttcagtatttgacccaygacctcccctaatgtggttcttcaattttctaatctgaattattgatttgaaaatttcttattttagtaatgtttggttgtgaatcaatgtgtacatcacctgtctttggaactatctgatctgtctctgtcattttgtattctatgttctmttgcgataaatcctatggtcgtgtgcttctaggtcaggagagattagataatgtgaagcttttacaatttgctttctttctctacttcttttctttcttctcttctttccttccttcagttcttttttcccttcttctctccctctctccttccttctttttcattttgttctccaatcaatgtgcagtcagtctacaatttgtgtatatatttgataatactcaagtatcaaacatgcctttatttaatcaattatttattgatcacatactttgtgcctctgttcatctagatactggagttatagcaatgaacaagatgagtgaagtccctgtccccatgttgtttttactcaggtrgggagaaggacaaggaaaaaaataagcaaattaaatgctacggataatagatcaaagcaatgaagaatgagggaaaagtggggagtaacattagacagggtgagcagtttgagactccataaattctcaaaatatgtacctaaataatttatgctgagagattcataaataataagtcatttttttaaaatgagcctcatatgttcaataatcagtagactactgatttctcctagtctacccatttataatttccccaatagaagatagaactttgcttcatttcttgattctaatgattggaaaacatgtttctttagaaaaccatgaaattttactaaaatgtttatgttcttagaaatgtacttggacatcttacagtgctttttagagtaaaattttggaagaacataacttatatagagatgcttgctgtctaagaaatccagtgctccttgaggcagcatgacaaatgtctgttctactatcatgcatgaaagctcattgattggactactcaagctttctcttatttttcataactctggtagttaaaataacttcttccaaatgccagttctaatgaaaaatgccaattagaaatgaggaagagactattataaacaaatcagtagatgctagaaaggagtaacaacttgaaacctgacccagaaagtaaaaaaagaaaataaatcatcaacagacsttgacattttcaaaagcaaagcaatctgaatccatttggagttttttataatggcctgaatatgtttcaattcactgtggcagggctattgttatcactgagactgatgatcaatatcagtaagtaatcagtgaaagttttcacctatttaagatgattagcacacatatatacatttgwgaaatatttcccaagaacgtaggcyccttcctcagcactgtgtccccaggatcctgatgagtggctgacacaggataagtgctaaattaakaaakattgactaaatgaatgagtaacccttcaaaacggttatttttcttcttcaaatgttttgctacttcattaaagttgtaaagtaagtaaacttgcaytggatctttcccatgtctgcaaaagcttcttattgaattttttcaattgtgggataagagaaaccttttttcaaaagcgttcagataggtggatgtaagagtttttcttgcaggtcgtctttgattattgcttgaaatgctcacttcaygagaatgtttcaaggaatatttgtagagaaaatcttcattccttatgggaaaataaataataaatgactctatatcaggaaataaarattgtgtaggaagacaaattctgtttgaataactaggtgggaagaaatcctttgaaaactttattggtagtaaataatgccataaatgacctttacattttgataagggatgcaaggtctctacacagatctaaatctagatctagatagatctggagggaaggtctttttgaaagtggggcttagtaggtggctgatcctgaggctctctgatgagttttctcaaggtgscaaaatctgtggaactatcagaactgcgtgttttcttcaggaagctacatgcaggttgagaccttacgtactgaagagagttcagattactctacctggctccaaaacattttctttcccacaggtaaatcatgtgaaactcctccagwtccagtgaatggcatggtgcatgtgatcacagacatcyakgttggatccagaatcaactattcttgtactacagggtgagttggcagcaacatctcttggttccagagttccagcacagyaatactaccttctagccacatctcaggaaggaaactaggctgttgccacctgctcttgagaggtttgaacacaggtattaactcctgattgaaatgaacaaagataggagaagattaggggaaaaatctgtgtccttgctggaaaccagggcagtgcacacataaakagtatgccgttcactggatgggaargaaaaaaaattaggagtatagtagtcaaagcacacaaacaaccctaacccagagtagacattgctggaagaaagggaagggcatgtagcagctgtgtgagagaacaaatcttaatgataacagcatgatcgcttgctagggctgccatcaaaaagtacaggccttcctcattttattgtacttcacagatgttatgctttttacaaattgaaggcttgtggcaacgctgcaacaagcatgtcagttggcatcatttatccaacagtgtgtgttgacttcgtgtctctgtgtagcattttggttattctcacaatatcccagakgttttcattattatcatgtctgtgatagtgatctgtcttcagtgatctttgatgttactattttcattgtttggagtccctacgaactgcacccatataagacagaaaacttaataaatgtgcatgctttgactgctccatggacaagacattccccttctctctccctctcttcaggactccctaatccctgaacacaataatactaaaatgaggccaattaatagccctacaatggcctttaagtgttgacatgaagggaggagtcatgcatctcttactttaaatcaaaagctggagatgattaagcttagtgaggaagatatgttgaaagccaagacaggccaaaagtcaggcctcatgtgccaaacagctagcgagttgcaaaggcaaagcaaaagtacttgaaggaaacttaaagtgctattccagtgaacacatgaatgataagaargtgaaacagccttattgctgatatggaagaagttttagtggtctagatacaagatcaaactagacatatttccttaagctaaagcctaatcctgagcaaggccctaactctcttcaattctgtgaaggctgacagaggtgaggaagctgcagaaaaaaagctggaagcagctgggcactgtggctcatgcctgtaattccagcwctttgggaggcagaggcaggtggatcacctgaggtcaggtgttcaagaccagcctgaccaatatggtgaaacctcatatctactgaaaatgcaaaaattaaccaggcgttgtggcgggttgcctgtagttccagctactcgggagtctgaggcatgagaataacttgaacccgggaagcagaagttgccgagattgtgccactgcactccaggttgggtgattcctgaggtttaaggaaagaagtcatctccataacataaaggtgcaaggtgaagcaacaagtgctgacatagaagctgcagcaagttgtcctgatgatctaactaagatcattgatgaaggtgttaaaataaatagcagattctccatgtagacaaaacagccatctattggamcttcatagctagagaggagaagccaatgcctgggttcaaagcttcaaaggataggctgcctttttaggagctaatctcgttggtgagtttgagttgaagccaatgctcactgaccattctaaaagccctagggcccttaagaattatgctaaatgtaccttgcctgtgtctataaatggaacaacaaagtctgatgacagaggtatgtttgcagcatggtttactgaatattttaggctcactgttgagatatagtgctcagaaaaacagattcctttcaaaatgttacatacagctcattgactttgtatccaatcaggcaagagctctgatggagatggacaaggagatgcatgtagttttcctgcctgctgacaacagcagccattctgcagcccatggctgagcagtaattttgactttgaagttttagtatttaagaaatatattttgtgccaggcatggtgtaatcccagcatattgggagaccaaggtgggcggatcatgaggtcaggatttcaagaccagcctggccaacatagtgaaaccccgtctctattaaaaatacaaaaattggccagcatggcagaatgtgcctgtagtcccaactactcaggaggctgaggcaggagaatcacctgaacccaggaggtgaaagttccagtgagccgagattgcgtcaccgcactccaggttgggcaatagagggagacttcaactcaaaaaaaagaaaaagaaaagaaaaggaaaaaaaaatacattttgtaaggctatagttcccacagacagtaattcctctgatggatctgaacaaagtaagttgaaaactgcaggaaakaattaatcattctacatactgttaagaacactcatgattcatgggaagaggttaaaatatcaacattaacaggagtttggtagaagttgattccgaccctcatggatgactttgagaggttcaagacttcagcggaggaaataattgcagatgtgacagaagtagcaagaacactacaattagaagcagagcctaaaggtgtgactgtattgctacaatatcatgatcaaacttgaacagaagaggagttacttcttatggatgagcagagaaagtagatttttgaggtggagtctcttcctggtgaagatgccatgagcattgttaaaatgaccacaaatttagaatattacataaactaagttgataaagcagcagcagtatctgggaggattgactccaattttgaaagcagttcagagggtaaaatgttatcaaacagcattgcatgctacagcaaaatcttttgtgaaaggaagagtcaatgtggccagttttattgttgtcttagattaagaaatagccacagccaccccagctttcagcaaccaccaccctgatcagtcagcagccatcaaccttgaggcaagaccctccaccagcaaaaagattgtgacttattgaaggtcagataatctttagcattttttaccaataaaccattttttaaagtatgacctttttttcacataattctatttcacacttaatagactatartatattacaaacacaacttttagactcactgaaaaatcaaaaaattcatatgacttggtttgttgtgatatttgttttattgtggtgttctggaactgaacctgcaatatctttgaggaatgtctgtaacacaaaatgggtggcttaatacaacagaagtttttggagttctgttctatagactggaagtccaaaatcaaggtgttgggaagaccatgctccctctgaatcctgtagggtaggatccttcattgcgtcttccagcttctggagccccaggccttccttggagtgtggcagcagaactccaatttcttctgttgctgtcctcagatggccatcttccctctgggtctgtgtcctcatatgctgttctcctctctgttcatgtctgtgtccaaagttttctctttttataaggacaccgggcatattggattagggcctaccttaatgacctcagcttaactggattgcatctgcaaagattgtatttccaaataaggtcacatccacagggactgggggttaagacttcccaacatatttgggggagacacaattcaacctataacagagtccctttgaaaatgtcaagtgtcaggtgctcacagcgcatggtccagctgttggtgctcacccttgctcagcacacagtggaggctctgcctcaatctcactcttcacgggaacagctaagccaggtagtgagtaggggctatgtttgtgccaccgcaacaaacacagaaaggaagcttgtggtgtccagcatatttgccagcctaggcttcagagaccatagcacctagaatctgacaaaataaaattggaataaatccaaagtcctcttttcttttttgagcatttttaaaaatacaattgataaatttcctaactgttccttcctcatcttgcattgtggaataagtgcgaacctccctgcggcatgaggcagaaaaccattgagcttatgacaaaaaacaggaaatacatgtaaaagagaccaattttaaaaaatcaggagaaattttacaaaagagatttactgccaggaaaccaggaaaactttcagaacactctccttttcctatttttaacaagactcagttgtacaaataattctgtgaaactagccatgaagtttgcacacgaatgaatatatgtagtcagtgtgtttatatatttcatttcatatatgtgtcatatatatgtgtgtgtgtatgtrtatatatatatatayayayatayatatataaaacactgaatattgcagaaaattaaagcaaagagtaagaagagttaaccaaattttccctcaatgcagtgggaaaagatgaaaaggagaagataggtgggcacagtggctcacacctgtaatcccaacactgagaggccgaagcaagagaatcacttgaccccaggacctcgagaccagcctgggcaataaggcaaaaccccatctctacaaaaaagtataaaaattagctgggygtggtggcgtgtgcctgtagtcacagctacacaggagactgaggtgaaaggatcacctcagcccgagaggctgaggcttcagtgagccgtgatggcacccctgcactccagcctggatgacagaatgacaccttgtctaaaaaaaaagaaaaagagaagacgtatgtaagacagtgtcaggattcaaattatgtattaaaaaaattccagaagggtaagcaaataagcccatacctagccatcactagggaaatttctgtgtttcagggatagagaaaaaaactcagattccagaaataaaatgtgaaaatgtaatacccgcaaaagaaataaatttattgacaccacattgattctacacaacactaaattgtagaagatagcacttctgttgagccaagctaatattcacatctagaggctccagatacacattaaagaataagcaaagacacaaaaattgtaccatttaagtatgtttcccargcaattaataagcaaatttttaaaaaggagaatgatgaattsctaaagaaatctcaatgagatagaaaagtggtaaaaacaaacaacaacaacaaaaaaccataaacacaaaaactggcaawgtaatcataatttagtaataatctctgtgaagtcatagaatatatcaatagaagtagaaaatgtgagaaagcaggaaaaggtaggctagacttrcagaaaagatgagtagactgactgtacagaatttgactctgaaattgagaaaataggtttaaatatatgtatcaagtgtatatatctacaatatacatgcacacatataaaattaaattcctaattggaaaaaatattaagtttaatttccaaattattagaataactaaaacagctgaatctatctgttccatatagtaaggggagggaaggaaaaagaatagcaaggaatgcatttgtctctgtcatcggaaataagccccatcatgtttgggtcaggtcattttattcattgctttctcctcatcctcatcatgggacatcgtgaaatcatgaaaaaggtagtgaaagaatkatgacaaggccgagcacagtggctcacgcctgtagtcccagcactttgggaggccgaggtgggagggtcacctcagatcaggagttcaagaccagtctggccaamgtggtgaaacaccatctctactaaaaatacaaaaattagctgggcatgttggtgcatgcctgtaatcccagccactcaggaggatgagtcaggagaattgcttgaactcgggaggcagaggttgcagtgagyagatattgcaccattgcactccagcctgagcgacagagccagactccgtctaaaaamacaaacaaacaaacaaagcaaatcaaatatataatttatttcaatccatttggtttaamcttcttgtcaaaaaaccaagtctactagacaggatcaaaagcaacaaatcttgtatttataaaaaacatgcctcaagttaaatggcatagtattacacacacacacacacacacacacacacacacacayayattaagggaatacgcaaacaaaaaatggcagaaataatatgggaaaagacagaacttaagaaagaaattgtcaagcaggtctacaaaatrattgttttattttggtgccaggtacagtccacaatgaagtcaagatattaagaagtaaagtggaccaggagaagttagagcagaaatatctcttttcaatagtgagagcagaaaaagaagtagaaaagctgggaacaataggtaaagtttaggctaggccttagacttctcctatattgtaatccctctggtttgccacatrtgcatgctgtcaggaagttgatgaggtatgkamagcacaattattttccattttttgcctttaggcaccgactcattggtcactcatctgctgaatgtrtcctctcgggcaatactgcccattggagcatgaagccaccaatttgtcaacgtgagttgaaatctctttccccattcaccccaccatttaaccctagagttgtcctcctagaattacaaagaatgaatctcatccctcttggaaatggtatccttctgatatttgaagaatccagtcatatccttaaaatggctcacagcattccaaacttccaccttcacctagaaatgctttttttcttatcttaaggtgtaatttattttaaactagtcttgagctaatttaaatagcccccaatttcatcctctgttgggtgaacacctcccagtttgaagagcattttctttggtgaagtcaacaaatacaaagtcagtgaaagaaaccgcatatcctctctgcaagctgttagtatcacatcagatattcaagccatgcagctctttcttccttcttattctttgtctaaacaggatcatgccatcttccctgtgagttgtttggaagatgagctttctacattttggggagcaaagaggaatgagcaattgcaagctaataaggaatataaaatgtgtataatcctgggtttagtgatggtgtgaggaaatcagcaatttcaaacccatctggtgggagrataagtgggaacaaactttgtagaagggcaatatactggctgggcactgccctacagtagagtaggacacagtattcagttcttccaagatcagatgaaattgggtgcattcagggtggtatggctgtagatcagtatccagttatttgtattacttctgaatctgtaagtatcatgtttattatatgtaatattgtatatttgtgcttgctttgtctttattagttctgccagagcttttgttcttattatttaataaagatgttatactgggccaggtgtggtggctcacacctgtaatcccagcactttgggagtcctaggtgagcagatcgcttgagcccaggaggtcgagaccagcctgtacaacatggtgaaaccctgtctctacaaaaaakacaaaaattaaatgggcatactggcacacgcctgtagtcccaactattcgggagactgagaggtgggaggattgcttgagccagagaggtcaaggctgcaatgagccatgatcgtgccactgcactccagcctgggcagcagagcaagaccttgtctcaaaaaaaatgctatgctgtatgctttattatattaatatccaatagaataaagacacatgccttctatatagagagaactaaattaataatggtgagataacatagttaaattctcatttagcaggagaaatataaatgtgtactataggccaggcacagtggctcacacctgtaattccagtacattgggaggcccaaggtaggtggatcacttgaggtcaggagttcaagaccagcctggccaacatggtgctaccccatctctactagaaatacagaagttagctgagcatggtcgtgcatgtctgtaatcccagctacttgggaggctgcagcaggagaatcatttgaggccaggaaaggaaggttgcagtgagccaagatcatgatactgcactccagcctgggcaacagagactctgtctcaaaaaaaaaaaaaaaggaaaaaaatgctctataataatatatggacacatttagcaaagtaatgttaactacgaagagcacaactcacaatattataaaattgtaagaatatatctgtacattagtaaatattagatgagaatgatattgtgaatatttacttccggtaatttgggatttcagaaaagctattagcataatttacaataaagtataattttaagaaaccatgccgggcacgatggctcacgcctgtaatctcagcatttggaaggcagaggcaggtggattgcttgaggccaggagttcaagaccagcatggccaacatgaccaaaccccaactccaccagaaatacaaaaataaaccagatacggtggtgcgtgcctgtaatcccagctactcgggaggttgaggggggaggattgcttgacctgggaagttgagattgcagtgagccatgatcgtgccactgcactccagcctgggcgacagagcaagactctgtcccaaggttttgttttggtgaacttgcggtctcttttcccaggaattccttgtgggctaccccccaacatcaccaatggatatttcattagcaccgacagagagtattttcactatggatcagtggtgacctaccactgcaatcttggaagcagagggagaaaggtgtttgagctcgtgggtgagccctccatatactgcaccagcaaagatgatcaagtggkcgtctggagcggcccagtccctcagtgcattatacctaacaaatgcacacctccaaatgtggaaaatggaatattggtgtctgacaacagaagcttattttccttaaatgaagttgtggagtttaggtgtcagcctggctttgtcatgaaaggaccccccgcaccgtgtgcaatgccaggccctgaacaaatgggagmcrgagctaccaagctgctccaggggtgtgtttgcctgaggcctagaagggccctgcaagtgacatgcattgctgttggatcaggagatgagtatttgtttagggggagggatgtatgttgaggagggtgggaaagtaagttttgggggaagaagcatgaaattaagaatctggggtgtgcawgcacycatgcatatgtgtcttcattttgaaaagcaagaccttaattagccaagaaaactggtattttggactcacctattaatcaattgtcagggcaaagtaccagctgcaatctctctcaattatattgaaaaattatatggactttatggtcagctgtgccctaagcactttgtatacattatctcatttattatttaaaacaacactgtcttatttaagggcttgtgtttttgatggctcatcttgtctactgatgccacaatagctggcttagcagcggagtgggaggtgttatggcagatacatagggacagagaaagagcttacaattcttctaccaacccatgttagccttgtgcaaccactgagctgggaagacaaacagataaagggatataaagacggatgtaccgaggcaggagatgggcagggcttgtgttctggtcacaatcctgctgaccaaaacagaatctggcctagacaggatgaagtgaaaaaacagcagcaacaggcagatggcgatgaaagcaatcactagctgccctcatattcccatcagcactgtgacagtttacaaatgccatggcaacgatctggaagttaccacccctttccaggaaagttctaaataacacgcccctcaatttgcattgatgtgccccttaacttacctgtaattggctgggcatggtggcccatgcctgtaatcccagcactttkggaggccaagatgggcagatcacctgaggtcaggagttcaagaccagcctggccaacatggtgaaaccctgtctttactaaaaatacaaaaattatctgagtgaggtggctcgcacctgaaatctcatgaggctgaggcaggagaatcacttgaacctgggacgcggaggttgcagtgagctaagatcacacgactgtgctccagcctggatgacagagtragatatcacctcaaaaaaaaaaamacacaaaaaacaagaaacaaaaataatttacatgtaattgaagcgggcttacaggagtataaatacagttgcctgccaggagctcatatgttgctgactctgggcacattgcctgtgagttagccctgctctgcaaagggcaatgcctttctaaaagatcgctgtctagcaccactggctcatccgtgaattctgtcctgagtgaggcaagaacccttccagartaagccccaatttaggggcatgcctgtccccaaacagtatgactgtactttagtcattggtgtgcaatcagagaaatatggggaaatctgtaaaacagacttggtctcmggtgacagtctcattacctgaataatgatggtacaaatacctccctaggaaatatgtagatggagaatccaccaatactaataactccacactggatatccagagctaggagaaaatacttcatgccctgtagatttacaggtgaattttgggccatgtgctagggagaattgtgttctatttctctaccttttactaactatgaggccttcagcaggcataggatatagcaaaagaaattcccccataactaacargtactctggaactgtcctttctacaatgtgtcagcygcctccagaaatcctgcatggtgagcataccctaagccatcaggacaactttttacctgggcaggaagtgttctacagctgtgagcccagctatgacctcagaggggctgcgtctctgcactgcatgccccagggagactggacccctgaagcccccagatgtacaggtgcctctctttccccctcacatggaagtcttactcctgttgttttattttttcttctcgtgaaatcctgtgatgacttcctgggccaactccctcatggcygtgtgctgtttccacttaatctccagcttggggctaaggtatcctttgtttgtgatgaagggtgagtgtgacccagtgttgagaccaaggactcagtgtggagaatcactgagttaatccaattaaggagctgacctagtagataagaagtacccagagagattaatttatggaagggtagttttgaaataagcgttaatccaattaaggagctgacctagtagataagaagtacccagagagattaatttatggaagggtagttttgaaataagggtagggactaagtggcaccgccttcagaaaacaatgaaaaaatggcacatacaactcaatrtcagatacaaacctaaatacagtcactgatcttgggtacacagttggaacttgaaatgaatgggtacgtatttatttggaggcaaaagaacataattttataaaatgtrtgctagaaaaaaaagatgaatgagatggaaattgtttgcctcataataaggcaaaggttgttttaggaaacttaaaaccagtcaatartggaatctgtaatagtgtatgaataactatgttttaacccaattacatatcttcatgtcaagaatggccagtgtaattgttttgatgcaagatttttctcagccactttgccagctggtgacctctggccagaaacatccctgtccaggccttgctctacccaggatcaatgcaggagacacctcatctacttggcccacccaggccgtgccaggcttgtgctctgatgcagagcccatggctgccgcgactacatgctcagcctctgggagggggtgtgtgagtgagcaagtgggggttccagctggccgcgccaagcactggcacaggagcgggctccgtgcaaggcttgtggctggaccaggcatgtcacactgaagggaatgtgttggtgcccaaacaggggtccccacgaccccgaagcccagagggggtgtaacagcatggtaatagctcttagcatttgataatgcctgcagcccaacagatggcggtgtgttaacaactctgtcagttccatcgccctgctcaggcctgcatctccaaggctgacttggcctgcatctccaaggctgacttggcctgcatctccagggctgactggacctgctggtgcttcctgttgcatggaataacttccctcccctaggagacggcaaagagccactgtattacagccttcttcatacctgcgtttggtgggtcctgagttcttgtcccgcatccaagaagaacaagcttatgctgacaatagaagggtgaggagggtggagaagagttttattgagtgacaaaacagcttctcagcagagaagagacacaagggtggaccccagatgaagtcagggggtyattctctcagtgtggctggttctggagcctttatggactcagaattggaagtgtgtgttaattggttggtgagtatgcaaaaaaggctaaaacaaagccaccactcaaaggtgggcacaacagtgcaaaaaaccaattagggaagagcaggtatatgtgaaatagatgaagagtggggatcaatcagaggaaagcacacccaacaggaagagaggttctcaagccagtccatggatttacctggaacttgtagctaggctttaaactgtcttcagcttgaaggtcgggtttcaccgggatccgccccatctgcctgtgatttgtctgcctcctgcttctaccactgtcaagtggtattattcgttgcttatgtgtatccattattcttggtgatacagtatgagtctgggggataactagattgagcaattaaggagttatttttaataatttccaaggattctttggcatttacaaagtccaccacctaataatgatttccaatttcagaacgattttagatttcagaagggaagcagtactcaatagtaagttgagcatttcagggtggcaaagactcctcccctgacccttctttttttcttagaacacatggttcagcatgcttctgtgagcctctttctggcctgttacatttggagtggcgagaagaacagatattcctggctttgcttaccaaatcaaaagctgttctgcctcatgacccactaatgagaataagtgggatgtcagagagccatcaatgaaagatgacacctgaaggttatggctcttgtgcccatggagaagtctggttctgtgttcatgccttctgtaggtgatgctgggctatgaagtttatatggcacttcagctctgattgctttgccagtcacagggtaccatggttctttagaataaattggcctttgagtttctgtcagctactgaagaattcagatccctaatgaactaagacttttagctagacctgaacctaagacccaaatgatagtcaaggaggaaatggtagtgaggaagctgagcatctattagtgaagaaatcaagggagagatgggaattgctcacacatttgctaccacttttttttttctttaggttctgattaaaaggcaggtctgctagtcattgtgtcttggctggaaygaaagccctttggaatagcagtgttccagtgtgtgaacgtgagtagaaagaactaygtagtttggatagctctccttatttttgttttccagtgttttactgcacggaatcacttgtctggatctttacttaactaaattactgattaaaatacttctctgttggaagaatttcaagaagggtcttgtaggacttttctgacatttgttactaatctgtaaatcacttagtttaatgactgtttaattttgtggggaatgtgtggcaagaaactaaatgacataaaagtgcagcacattttagtcagtcatttatttttaattttcttataaggagtaatctttcttacattttttttttcttttttgagacagttacccaggacagaatgcagtggtgcaatcacagctcactgcagtttcaatggcctgggctgtagtgaccctcccacttcagcctcccagtagttgggactacaggtgcatgccaccacacctggctaattttttatattttgtagagatggagtcttgccatattgcccaggctggtctcaaactcctgggctcaagctatcctcccaycttggcctccaaaagtgttaggattacaagtgtgagccacygtacccagccaaattyttatgttcttttatcccctcacktatcataaacaatttagtcagcttgttttttagcctgcagtattgaatgacatagggcttcccatgtgctaggactttccatgtgtagaaaatgcaatgaagagtaaaagaatagtgaagccacctccctactttcctggagtatattttcttgttgggaagaagactaaaaacaataaaataagaaaacaaaattctaaaaattataatatataaaatggtagttaaatagggatgttatggagaaaataaaacagagttatatgataaattagtacagtggaaggagccgggatgacgaatcagtgtctgaaatgatgaggtgtcctaaatttccaaaccatccgcttaaataaaatatcccaaaattcagaaagaattcagaaactcagataaaagtacatatttgacatactaagacattactgatttaccctattctgtctattaaagcaaggcatgatttttttaaaccttttttttcttattggaaaatgtttactttaatttgcattgtgttaaaataacttacagaaatcaatttggatattttatggtgagtattatggtgaagaacattcaatacctgaggaaactcaagtatccaacaaactcaacccttacagagacacatagagctgaaaataaatatataaataaacttaggaaaaacacaagtaaaattcaagcatgagaagttaatcattgtttgatgtactaagtcttttatgtacacataattccgataaacttgggtatctcttcctaaattcatatcaaattagaagcatcaagtgcttttagggaaggaactgttctaaacagaagaaaagaaggaagaaatgatggctaataatytggaagaaagaaaaaaagcctctttggcaccatttaatctgtgtaaaaagagccttaccaatgtagtctgatgacaccactggaaatttggtattggtcctgatgataacagtcttgaatcaccaagaaacatttacattgctaaagatgatagttcatgactattaaagttcatagatttccttggaacttatggtctctgatggccaaaattttgtctgtcttgaacctcattgtcaactcaggaatcttactatgcctgatttaaagtagacaaccaaatgggtgtttgtaaaaaaattaaaaaaaattactttccaaattcattatgaacrtagctacctggatggtccaaaaacactgtctttgggcttttgcaatagactgtaatttaggtctcacaacagttagttgcctctcaacaaaagccttacagatttaaattccatccaccttagttatagtctttctaaaagaaaaaaaattatattcatagcactgtcgcaggtcactaatatttcagtcatcttaagtgaaactctaatagaacttaaaagctcttgttttctttctagaaatcttttgtccaaatcctccagctatccttaatgggagacacacaggaactccccytggagatattccctatggaaaagaagtatcttacacatgtgacccccacccagacagagggatgaccttcaacctcattggggagagcaccatccgccgcacaagtgaacctcatgggaatggggtttggagcagccctgcccctcgctgtgaacttcctgttggtgctggtcagtatccgcttccacatatcctaaatgggttcagaatatgtaggtgagaaccttcatatttctatagtgacagtcatttttgcttgtgaaaatggctttgctgtaactgtcagagacagaactacctcccaagtgaatgacaaatgggttctagataggcacactgtctcaattattggtattctgatggcctttggggtgaggagggtgggatggtaaggagagaagagggtggacagtgaagagaattggtgaggtccagattttgtagagaaatttttgaaagtactgaaaacaaatgctaaagaatgtactcttttattctacccctactatgagttgtctttatcctggagagatggatgtgctgcgcaaaaagtacatgatgatgtaatttacttcagaactgataacgctataaaagtaatttaagaaattcagatgtagggatttatactttttatgttgtttccaagggtttgttcaagccgctgactatatttagttggtccttcacctcaccattaacaaagggaactcgggaggccctggagaagcagagtctgagactgtactcttagccttcatagctccttcctttgatatattactctggctttaaacgacagtacttgacaaccgtagatgcatttgtggctgtgactgcccacacaagctccatcctccagtaaggacagaagagcattgaattataaaaggtgttgactttttaatgtgttcttttgagatggagtcttgcactgtctcccaggctggagtgtaatggcacaaactcggctcaatgcaacccccgcctcctgggtttgagcaattctcctgcctcagcttcccaagtagctaggattacaggcacccaccaccacacctggctaatttttgtattttttagtagagacagggattcacaatgttggcccggctggtctctaactcctgacctcaggtaatccatctgcctcgactttccaaagtggtgggattacaggcatgagcctggtgctgacttttttgacctgttggctaattggacttagaacttctgtatgttgaaaaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaacatcattctcagtaaactatcacaagaacaaaaaaccaaacaccgcatattctcactcataggtgggaattgaacaatgagatcacatggacacaggaaggggaatatcacactctggggactgtggtggggtcgggggaggggggagggatagcatcgggagatatacctaatgctagatgacacgttagtgggtgcagcgcaccagcatggcacatgtatacatatgtaactaacctgcacaatgtgcacatgtaccctaaaacttaaagtataatttaaaaaaaaaaacattaaaaaaaaaaaagaaaaataaataacacagtagatagatgagaaatatatgggaaacacagcaaagggttaatagtgttatcttacaggtagcagtagtggtggttgtggtactagttgtaaaagttaatatataatgaatacttagtaccactgttagataggctggacatggtggcttatgtctgtaataccagcactttgggaggctaaagtgagacgatcacttgagcccaggagttcaagtgcagcctgggcagtatagcaaaactctgtctctacaaaaaataaaaaaaattagctgggcgtggtagtgcatgcctgtagtcacagcttcttgagaggctcaggtgggagaatcccaagcctgggaggtcgaggctgcagtgagctgagatcacaacactgcaccccagcctggacaacaaacaagactctgtctcaaacacacacacacacacacgcacacacacaagatagcttctaatttaattacacaacaacctatgaggaggatagtattcttattgtctcattttataggtgtagaaactgagacacagagggtttaggtaacttgcacaagaccacagaatggggtagcctgggttcagccaagcaatctacttatctgtagagactgtgcwctttaacaataaataaatggtcaacggacctaaatatataattcaacaagagagaatatttaagtactgtcataatgaaatggaaagctatcaggcaaggtcccaaacaccagataatgggcaattcttaagttggatgaaggagatacatacaaagaattagaatgggccaaataactattaaccagcaggttcttggaactcagagcttagtgtaaactcctcgtgaattgggctgaaccacataggaactccttttgtctctctgaactaagactcagactaaaagcagtcccctttgccttcttgttcctagtctctttaccctatctagtcttggcctttgacatcttactgctttgtagtgagaagagacaaagaaaatttcatgatcttagagactatcgaaacagaaaaaattaaacccagtattttttccctaagayttgggatagattgcttaagataccagtcctaggccttcctaaaatggaagatgaggaactaacctggggyggtggtccaggcttggagtgacatgccatagagggttttgagacagaatagcaatccaaagagaaaaaggaacctttgagtactagcatcagagcaggaagaatatcttgggatactcagatcccctatctccccatttcaatggcccagttacatcagaggcctgattcatttcaaaaccttcctcagagcaaggggtaattgccaggtaccctttaaagccagaattaatacatataacccatatttaygctgtctcaagactaattagcatggtgttgcatgctagacaaataagttcaactccagaaaacatgtaaaaactaacagaagtttcaacttgaatatcttaagagaggcttaaagaaaaattaaactatgtgacactcattaaaatgtccccaaatcctctttacccatttccattacccagtgtcccattcattaaagcaactgctttcctagagcctagcttctctcagttccacccagactgtctctcaatagtctccccaccttctggaccttcttagttcacaagaagtctccatgccatttctaaggtaaatggagtttcttcagttctgcatagttcgatgcaacacagccttgaaagtttctgcagggaaatgcrgaaactatcttaggatgcaagatttagagaaagggtgtaaatatctttctactttggcacataaatatacagaaactgtttaacctcactagaactaaagaaatgcaaaaataacaaagtaccctttttttttattatactttaagttttaggatacatgtgcacattgtgcaggttagttacatatgtatacatgtgccatgctggtgtgctgcaaccactaactcgtcatctagcattaggtatatctcccaattctatccctcccccctccccccaccccaccacagtccccagagtgtgatattccccttccgtgtccatgtgatctcattgttcaattcccacctatgagtgagaatatgcggtgtttggtttttcgttcttgcgatagtttactgagaatgatgttttccaatttcatccatgtccctacaaaggacatgaactcatcattttttatggctgcatagtattccatggtgtatatgtgcmacattttcttaatccagtctatcattgttggacatttgggttggttccaagtctttgctattgtgaataatgccacaataaacatacgtgtgcatgtgtctttatagcagcatgatttatagtcctttgggtatatacccagtaatgggatggctgggtcaaatggtatttccagttctagatcgctgaggaatcgccacactgacatccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccgttgcttttggtgttttagacatgaagtccttgcchatgcctatgtcctgaatggtaatgcctaggttttcttctagggtttttatggttttaggtctaatgtttaagtctttaatccatcttgaattgatttttgtataaggtgtgaggaagggatccagtttcagctttctacatatggctagccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgataaagtaccctttttttaaattgtccattaaattaacgacaaacaggtttttatgtgaacacccaataaaaagtaaggatgtaatgtaacgaatattgttgtatattgaaggtactattgtaaattggcaaaatctcttatgaaaaacaattatgcaatgtgtgtggacaataatacaaatattctgccagttagcctcctagaactgcaacctaagaaaatagtgtaaaatataaaatagtttatgcattttattaagggtttcatgagaaagaaaactagaaataaatgcacaatagaagtcattgaatatactatgatgcatctactagattatattagtttgcctttgttgtaacttatatttctagtatataaatatgtgaaaacataccagaagagaatgtatcaaaacacattttgggtactaggatttggggtgatatttttctttagttctgtattataagttttcttctgtaattgtattacttttacgagaaaaatattaatttttaaagtcttcttggcagtggctcgcgcctgtattcccagcactttgggaggctgaggcgggcagatcacgaggtcaggagattgagaccatcctggccaacatggtgaaaccccgtctctactaaaaacacaaaaattagctgggtgtggtagcacgtgcctgttttcccagctacacaggaggctgaggcacgagaatcccttgaacccaggaggcagaggtcgcagtgaggttgcaccactgcactccagcctggcgacagagtgagactttgtcaaaaaaaaaaaaaaaaaatcttctctgagtgcagaaggtaaaatgagagtatatgagtgaaatcaatggctttttataaaaaatattagtctgagtcctgaataaaaatcaggataaattgtcactggctgagaagtcctgttcaatcatgttgcatgccagagtgatgtttttgtgacttttgtcttccttttaggttcacatgatgctcttatagttggtaagttttatgaagtgtttgctgaggaattctgtcatctttaacagtaagtacctacttataatgaatgcaatgtagaaagagagatcaaaatatcttgagttataaattcaaatagaaagaaaattatgatgagtttaggccaggatatggtgaaactggcatcgtcatatgccaggttattgagtaaccttcctcaaaagttctttactatctttgaaccactacaaatgcataatcgttcaacagtgtcaaaaagtatttatttgaatgtggtgggagaatgaaacttcttctttgggttataacctggagtatgcttccagatggtgattgtgcccatttgtacaaatagaaagctacaagaccagtcttccgagcccatgtctgtgatctgcctatgtaagaagaatagttttgtaatagagtttgcttccaagggaatctctatggcatagtattcttacatccctttttatacatctggacactgagacacggagggtttaggtaacttgcccaagaccacagaatggggtagcctgggtctaagcaggcaatctacctatcagtggagactgtgcactttaacaatcaataaatggacaaaaggacgtaaatatataattcaacaagagagaaaattccagtattgtcacagtgaaatgcctgtgtgttaagccttaggcgagagacatgggcagggccatggagagccagtggccagctgtcccatcgcacttctcacttacttgtggaaaggctgatggtggactaaaggttacaaaagaggtcagctcaccccttaactataataaccctgtgggagtgagactaatgctatagaaacccagagtaaagcagaatgtatagttacatcttttaaaaaaaaaagcattggcaatctgtagtgggactggatactaagatagaatttaaaacctgtgagttatattttccacgcatttaattaccttgttttactgcctaggcactttacttggtacgatcatctttattttaatcatcattttcctctattggataattttcaagcacagaaaaaggtaagtatagccatattatcccaagaaatgtaaactgtacttaccccctcttggaagtcaaaagaaagtaaaagacaaacaaacccattgctacataaacagatgtggtaattcttataaagaaggtccttgacacacagtatagacaaagaggtattcacactaaaggaagtatataggatactaagaacaattaaaaaataataataataacaaaaaaccagcattttggccaggtacagtgactcatgcctgtaaattcagcactttgggaggccaaggtgggcagattactagaggccaggagttcgagaccagcctgggcaacatggtaaaaccccgtctctactaaacatacaaaaaattagccgggcgaggtggcacacgcctgtaatgtcagctgcttgggaggctgaagcacaagaattgcttgaacccaggaggcagaggttgtagtaagctgagattgagctgttgcactccagcctgggcgacagagtgagactacatctcaaaacacacacacacacgcacacacacacaaacacatagcattttaagcaagaattgagttttacagaaagagaaagtaggcagaaggggtttttaaaaagttgttcatgaggctgtttgatatcctagttttgctaagacattgcagatactgacctctaagcccagatcctatcatagcactagaagttagattgggtcacttatggcacacataggctgccagtggggaagaactgagactttccattgggtattttaatatatgaacaaatattttgtaattacaattaactttttttttttttgagacagagtcttgctctgtcacccagcctagagtgcagtggtgcgatcttggctcaatgaaacctctgcctcccgggttcaagggattctcctgcctcagcctcccgagtagctgggactacaggcctgtgccactacgccaggttaatttttgtatttttagtagagacagttttgccatgttggccaggctggtctcaaactcctggcctcaagtgatccacccgccttggcctcccaaagtgctgggattgcaggcatgagccaccatgccaggctaccattaactttttacacttgaaaaaaaattccaaaaattaagatctgagtaaagaaatgtctttgacagggaagagaacatacgcagcttttgtactggttgactgaaatataacaacatcaatgaggccagaatcaataatatcaatgttataaggttgatgagcaaattctatatccataaaaaactgagggccaggctcggtggctcacgcctgtaatcccagcattttgggaagctgaggtgggcagatcatgaggtcagaagttcgagaccagcctggccaacacagtgaaacccccatctctactaaaaatacaaaaagttagctgggcatggtggcgtgtgcctgtagtcccagctactcgggaggctgaagcaggagaatcgcttgaacctagaaggcggaggttgtggtgagctgagatcgcaacactgcactccagtctgggcaacagagcagactctgtctaaaaaataaaaataaaaaaactgaatttgcaacttttaagtgaacagttttctacaggaaatattctaaacaagtacagtttcctacaatgagctttacagcaatcgaagttttcgtatttcacagagatttcaatacactttttaaaaagtagtttgtcatagtagatcttgctgtaaacaacctagtcaggaactcaatttcatgggaaaatagtgaattggttgacatttaaatttaaatcattatccttcctaactaatgttctctatatcgtatggcttgacatatagatgttctttgctcttttctattacaaaaagaaaagataagtagctgggcactttaccttaacaaagtacttgtgtcaatacatttttctcttaaagtttcttgttaggtaccactataatttgtgagttatttttattttttttttgagacgagtctcgctctgtcatccaggctggagtgcagtggtgcatctcggctcactgcaagctccgcctcccgggttcacgccattctcctgcctcagcctcccacacagctgggactacaggcgcccgccaccacacctggctaattttttgtatttttttagtagagacggggtttcaccgtgttagccaggatggtctgatctcctgaccttgtgatccacccgcctcggcctcccaaagtgctgggattacaggcgtgagccaccgtgcccagcctatgacttaattttttttttttaatttactaagtctgaattaaagaagttggggcttctaattttctgtatctataccagtctctagttgaaactacacaagggaaatgattatctcttccttttgaaaatattcaagatactttaatatgttgaagatatttgagtatctccacccttctaactatgtcattcttcattccttatggcacattccttgttaatcaactagagggtcagattcccaagcctaactattgatttgtttcacctacataatttaagatcatttcctcatattaatcatcttcaggcataaacatgactcaataaccatttcataaaattatttctttagaaatgattatcttgtatagtttaagcaacctcagagcatataccatttcttcacattttccatctcgtaaaacctgcctactttttcatattcttttaaagtgtaatgtccatggcacaaccattctctctctgaccagtggctaccagaaatgtggcagaaagaaagatcatgatcctcgttagacttaaaggtcagggaggtaaacctcccaaacatctatgtaacccacactaaaacctattctatatgtgtaatccaggaaaatttttaaacattttctaaacttttatttttgacctgtttcacttcttgggattgtaactgtctgacgtgttcttcctgcctgtcatacagacaaaaccaattccctgagatcatggtatattgcagtaaagaaagagatgaattaacacaaggccagtcacgtggaagaactggagttatcactcaactcagtctccccaagaacacaggggctagggtttttatagatcatttggtaggaagggagctagggaatgggtactactgattggttggggatgggggtgtgggaaatgttcctcatgtgctgtgtccacctctagttgggggccacaggaccagttgagtcatgagtcacaggtccaggtagagtcagtcagttgccaaatgcaaaaatctgaaaaacatctcagaagaccaatcttacattctacaatagtgatgttacctataggagcaattagggaagtcacaaatcttgtgacctctggccacctgactcctgagcagtaatgaattataagaactatgcctatattttagcagagttcaggtccctctcctaatcctaatcttttggcctttcattagctttcaggccctgagcaaggagggagctagttttaggaagagactgttattatccttgctccaaagttaaattataaactaaattcctttcatggttagcttggcctacacccaggaatgagcaaagccggcccacctgtgaggctggaagcaagatgaagtcagtcacgttagatttctttcactctcagaatctttgcaaaggtggtttcaggatagtgagtgcatttctctaacaaaacaccattgattttcatgttagaaataacatatagctaaaattggaaaaaagaagtaataaacttaaataatcagaaggcagaggtcccttcttttggaaggagttgggctaattaatcatgcagtcatacctccttgagtgggtgtggccaataagctaagtcattgtggctatgtgaggagggccaattattccttatctggagctcaagctttcctcacagaaagagaagggcataaagggcctcatggcaaagaagaaggaagtcatgtgggaaacacagaatatgagtggagagtatcgtagtggtcatcaagtaagaagagccgtttatcctggagctaaaaaagactgacagatatagaatagtgtagaacaagatggcctgctctatgggagagccacaatcacaccaggactagacagtagcaggctgatgtatatctcaaacactggagacaattcagaaactgcataaacagtctgaagacttactaagaaactaaaatgaggctgggcgcggtggctcaggcctgtaatccctgcatttagggaggcctaggcgggtggaccacctgaggtccggagttggagaccagcctggactacatgataaaaccccatctctactaaaaatacaaaaaattagccaggcatggtggcgggcacatgtaatcccagctcctcaggaggctgaggcaggagaatcacatgaaccagggaggcggggttgcagtgagccaagatcgtgccactgcattccagcctggacaacaaaagcaaaattccctctcaaaaaaaaaaaaaaaaaaaaaaaagaaagaaagaaagaaaaaagaaactaaaataagacagaaatagaagtaattcacacacagaaatcatctcaccttctttaaaatgctcctcaaggaggcctactttaacgatcctagtaaagatggtatgactcgtatgacccccacccccacattcccaatctttcttatcctgctttatttttttgtatacttatcgtttattataattaattaaataattaagtttcttgtttattgtctctctccctccatgaagtcggggatttttgtcctgtcttcaccaatggatacataacaaatctaaactgtccccggaacaaagagagtctcaataaatacttatcaaatgaatgagtgagctaaacactactaagagtgttaccacaaggggaaatttctgctctaattaattctctaccaagttaaacagtgcatctttaacttgtcctaagcttactccaggtttcaaggctgctccttgtactaatataccaactgtctcagtctgttggtatagatacttgggcagttataacagaaactccatagactgggtggattcaataagcatttaagctgggtgcagtggtactcacctatagtcccagctactcgggaggctgagggaggagtactgcttgagcccatgagtataaggccagcctgggcaatatggcaagaccccgtccctaaaaaacattatttcatttctaaaaaccaagcatttatttctcatagttctggtgggtagagcgtccaagatcaaggcaactgcaaattcagtgtgtggtgggactcactttctagttaatagacttcaatcttttctttgtgtcctcacctcagagaaaagcagtgagggagctcttgcgggtctcttttctaagggaactagtcccattcacaaggggtctttgagaagtaattagatactataaattttcaacatataaatttggaaggattcaaacattcagtccattgtacaaacactgaatttgataagcacatctgcttaaatgatatcacatgtgttgatttcatgtgcttttccacctttgtttctaaattccgttaacccatctctgaattcattcaaccaagactctctcccagacaactctagtccaaaataatgtctgtctttgaaactcacatttcctgactatactattttaaaaataaactgggaggagccaagatggccgaataggaacagctccagtctacagctcccagcgtgagcgacgcagaagacgggtgatttctgcatttccatctgaggtaccaggttcatcccactagggagtgccagacagtgggcgcaggtcagtgggtgcgcgcaccgtgcacgagccgaagcagggtgaggcattgcctcactcgggaagtgcaaggggtcagggagttccctttcctagtcaaagaaa

SEQ ID NO: 17923 - DNA, 16747 bp, Homo sapiens
tgcctcccaggttcaagtgattttcctgcctcagcctcccaagtaactgggactacaggcatgcaccaccatacctggctaattttttttgtacttttagcagagacaggttttcaccatgctggtcagactcatctcgaactcctgacctcaaatgatcctcctgcctcggcctcccaaagtgctagcattacaggcgtaagccacctcggcctccctaagtgctgggatcacaggcgtgagccacctcggcctccctaagtgctgggatcacaggcgtgagccacctcggccccccaaagtgctgggatcacaggcgtgagccacctcggctccccaaagtgctgggatcacaggcgtgagccaccttggccccccaaactgctgggatcacaggcgtgagccaccttggccccccaaagtgctgggatcacaggcgttagccacctcgcctggccatcagtttctgactacacaaagtcacacgcaggggtggaggctggattctgatctgccaggaaccactatcattcagagtacatctctaacgcctctactaacaaggtttttgtgaggactctgcattcatatgtgtaaagcacataaaacaggtgcttaacacaagtaaacaccaaatgcatatttattacacccccatgcggttactctcttggacccgtcttcccatgacagaggaagtcctaccatagtggggattatcatttgctttgcttggcactattttttcaaagtttaacatggttcttggcacacaattcacaactaacaacaatgaataaataaatggataaaagagagtaggatcatgacagtactagaagaacattctggccagtgcaatggctcacacctataatcccagcactctgggaggccaaggcaggtggatcacttgagcttgggagtttgagaacagcctgggcaacacagtgacaccccatctctaccaaaaatacaaaaaattagccaggtgcggtggcacatgcctgcagtcccagctacttgggagatgggaggatcacttgagcctgggagatcgaggctgcagtgagccatgattgcaccactgcactctagcctgggcaacagggcaagaacctatctaaaaaaaaaaaacaaaaaaaaaaaaacaaaggacaaaaaaaagaaaaagaacatcatggtagtgtgtggaaaatgacagaaggaaaaagataatactagaaaccaggaaatcaggacttcaagctgcagaggtttggaagagcagacataagaaagcaggaagggagctgaccaagccaggaaggagatttaccaagtgaacaggtgtcctcatggaccctgcttgatgtgaaaacctgaatccacaggagctctgcccagcacagttccccgtattttctcagccaactatgcatgagagcagagaagtttggtcatcagatcacatgtgcatttaacaaacactttaacgtccacacctatgtgccaggcactctactaagcagacaaaagagggcataagtatggtccctgccctggcagaattcacattctagggtggagacaggccacaaacaggtaaatgagttgaagaatggcttgtggccagtcgcagtggctcacacctgcaatcccagcactttcaaaggatgaggtgggcggatcacgaggtcaagagttcaagaccagcctggccaacatggtgaaaccccatctctactaaaaatacaaaaattagctggggccaggcacggtggctcacacctgtaatcccagcattttgggaggccgaggcgggtggatcacgaggtcaggagaccaagaccatcctggctaacatggtgaaaccctgtctctactgaaaaatacaaaaaaattagccaggcgtggtggcgggcgcctgtaatcccagctactgaggaggctgaagtaggagaatggcgcgaacccaggagatggagcttgcagtgagccgagattgtgccactgcactccaacttgggccacagggcaagactctgtctcaagaaaaaaaaaaaaattagccaggcgtggtggcaggcgcctgtaatcccggctactcaagaggctgaggcaggatcggacgcggtggctcaggcctgtaatcccagcactttgggaggccgaggcgggtggatcatgaggtcaggagatcgagaccatcctggctaacacggtgaaaccccgtctctactaaaaaaatacaaaaaattagccgggcgtggtggcgggtgccagtagtcccagctactcgggaggctgaggcaggagaatggtgtgaacccaggaggtggagcttgcagtgagccgagattgcaccactgcactccagcctgggcgacagagtgagactccgtctcaaaaaaaaaaaaaaaaaaaaaagaggctgaggcaggagaactgcttgaacccagaaggtggaggctgcagcaagctgagattgcaccactgcactccagcctgggtgacagagtgagactccatctcaaaaaaaaaacatataaataaataaaattttttttggctgggcgcggtggctcatgcctgtaatcccagcactttgggacaccgacacgggcggatcaccaggtcaggagatcgagaccatcctggctaacacggtaaaaccccgtctctactaaaaatacaaaacattagccgggtgtggtggcaggtgcctgtagtcccagctactcgggaagctgaggcaggaaaatggcgtgaacccagaaggcagagcttgcagtgagctgagatcatgccactgcactccagcctgggcgacagagtaagactccatctcaaaaaaaaaaaaaatttaaatggtttatgataaacattctaaagtgtgtaaggtgctgagatggagaggactattttagatagggtggtcagctgacatttacactaagaccttaagaatgaaaaggactcagtcagccaggcgtggtggctcacgtctgtaatcccagcactttggaaagaggcagagctggctggatcacctgaggtcaggagtttgagaccagcctggccaatgtggcgaaacccatctctactaaaaatacaaaaattaactggacgtggtggtgcatgcctgtaatcccagctactcgggaggccaaggcaggagaattgcttgaacctgggagtcggaggttgcagtgagccaagattctgccattgtactccagcccgggcaacagagcaagactccatctcaaaaaaagaaaagaaaacaaactcagtcattgaaagaatattcccagccaggtgtggtggtgcacagctatagtcccagctacctgagaagctgaggcaggaggactgcttgagcacagcagtttgagaccagcctgggcaacacagtaagatcctcctctctgattttttttttctccttttccttgccatatgaagtccctctttatttaaaaacaaaaaagaggccgggcgcggtggctcacgcctgtaatcccagcactttgggaggccaaggcaggcggatcacgaggtcaggagatcgagaccatcctggctaacacggtgaaaccctgtctctactaaaatacaaaaaaattagttgggcgtggaggcgggcgcctgtagtcccagctactgcagaggctgaggcagaatgatgtgaacccaggaggcggagcttgcagtgagctcagatcgcgccactgcacttccgtctcagagtgagactccgtctcaaaatatataaataaataaataaaaacaaaaaagaagattcccaagtgggggcagaaagcatgaagatcttccaccaagaaaaagcttggaggggccataggttgactggttcaaaagaacaagatacaaaacagcccaaaatgaggctaaaatggagagcagagccaggttcagagaaggaaatttgggttttattctgggcataatggaaagccactgaggggttgattttaggcagaaaacagtgctgtggccagattttaatttttaagagtcacacttgctgctggttggagcacgaattggacgggacaaaaacagggataagggaacccaaataggaaggttttacacaaatccaggccagagacaatggtggcctagaccaaataaaatggacaacagatgaattcaagtgatattccggtggtataactgatggaattcatggatgaactgagtgttaagcatggggcttcactatagccacatttagcttttgcttttggttgaacagcggtgtcattttccgagatgggaaaagctggggtttaagcagaaaaatgaagagttccactttaaatatgttaaatgagatgtttgcgtgacacccactagatgtcaagagagcagctggatatgtaaagtagatttggaggaaagatctaggatggagctgcagatctggtagttgtcctaatacaggcaatatttaaaatcatagaaataaatgacacttcagggtaaatgcatcagaagatgacctaggccccatcctgaggaactcaacacttagagactggatagaaaagaaaaatcaggcaatgaaatagggaaaaaaaatcctaccaccatgtttcaaaaagaaaggagtggccagtccaacaaatgctgacttatgtcccttggatttggtagaatggagatcactgctgatcaagacaagaaacatttaagtgtcgtggacgccagactgagctgggctgaggagtaaaaatgaagcgcaaatatggagcagacagcttaacacaggtctagacagggctgtcaaacatggaagaaacactaatcgctaacaggatagagcatggcaatagcttgaaattggtttgaaaatccaagataaaaaattcctctgacatcgtgatccagacctctcaaacacacaagcatgctcgcaataactgcaataaaagcaataatgctttctagtctattccactacgttagagaaacggctggtcaccacccactcaatcattcacggctcgctgacgggtagaaacctgcaatgacaggtccacgctaatccaacaagggatgatttggggaggcagagatggagtttgaaaagaagcagggagcccgaggacctgcgcggccagagcgccagatagccataggcgtggaggcggtggggcgcccacagccccgggcccggagcccccgccccgcagccccacccgccggcccaccccgcgtcactcccccgccgcccttacctcctccagatactcgcccagctgggccgccacgtccacctcccagttcttggtgaggtcgcggatgggctgcaagaggtgggcgaagcgcgcctccacgtcctccatgtccgggagggaacgggcggcaaagggaccgcagggctgccttccgaggggtacggcgtcctcagcccgccactagttctggcgccattttgctgttcccgcccaggaaaatgcgtaggcgcggcgtcgcgcgcatgtctatgacgtaacgtgggcaaaagccagagaggcgaaccccggcgccgcgcagcgggagctcaccggaagagtcgcggggcggggtcgaagcctccgggagggggggggtgggcggagctttgggctgccaccagtttggacgggagggcttttggggccgccgtgggtcgggcggggcggggtggggcggggcctggagctgccgcgggcgagcgggccgaggaggcggggcttgggggctgccacgggttgggggggcggggcggtgaggaggcggggcctggggcagccgcgggcgggcggacgggccgaggaggcggggcttggggctgccacgggttgggcgggcggggcggtgaggaggcggggcctgggactgccgcgggcgggcgggcgggccgaggaggcggggcttggggctgccacggattgggcgggcggggcggtgaggaggcggggcctggggctgccgcgggcgggcggacgcggagggcgggccctgctctagcgggccgcgtagcggacatggcgggctcccggctcccgcggcagctcttcctccagggcgtggcggccgtcttcatgtttgctttcgcttccctctacacgcaaatcccaggtgaaggcacccagggtgggacacccccagcctcggcgcgggaccctatgtcctcttttctctgtgcccggcactcacgcagtccggggttgggagtgagggccaggccttggcgtggggtagggggcggcggttcgtgtcctgcaggccgctgtgggggtaggaaggtgtgcggtgatccatttcccgtaaggctctggactctgacctggggtgggggacagaactctgagagaggtgggagagaggcttcctcccagacctggtgggacaggtaggagatcgggctgagacctggaagagggcagtgggctctgctgggtgggaggccctgactcaggtagttgagcaggcctctagccctgggacggggttttgacaggtcccgacctgggggacgggctctggagggactgcagactctgacctagggatggaggtatccgcatgctctgacctaggctgggggatctgcaggccctgactcagaggtagtctagtctgcaagggctgtccagggcctggccatgacatgccctcccacaggcctgtatggccccgagggcatcctacctgcaaggaggacgctgcggcctcagggcaaggggcgctggcagcagctgtgggagaccccgacgctgctgtgggaagcgccgagactggggctggacacggcccagggcctggagctgctgagcctgctgggtgcactagtggccctgggagccctgctgctgagcccactgcgccacccygtcatctacttgctgctttgggccgcctacctgtcagcctgccaggcaagtgggacctgtgaccagctcactctatctccaacccccaccacccacccctgcctctaccttacctgagtccacagacacacccgctccctgacagcccctctctccgcaggtgggccaggtgttcctttatttccagtggtgagtgacggctgggcctggggctgtgggaggctgggtagggggtgggggagggctctgcccttcctgggaggactttccgagggaagcagctgtgtggggaggggctcttggtgctatttgctctccccatagggactccctgctgctagagactggcttcctggccgtgctggtggccccgctgaggccagcctcccaccgcaaggaggccccccagggcaggcaggcaggggccctgccccacgaagacctccccttctggctggtgcgatggctgctgttccgcctcatgttcgcctcaggcgtggtcaagctgaccagccgctgccctgcgtggtgggggctcactggtgaggggcccggtctggacctggggtagtctgggggctcggccagccctgactcctgccctcgcctgcagccctcacctaccactacgagacccagtgcctgcccacgcccgccgcctggttcgcacaccacctgccggtctggctgcacaagctcagcgtggtggccaccttcctaattgagatcgctgtgccgcccctgttcttcgcccccattcgacgcctgcgcttggctgctttctactcgcaggtgggtgagggccgcagctgtcagagagaggcagacagggctcggccttcagcgctgctcagcgtgccctgttggggacagcrtggctcccggggacagctggcaaccgctgttgggaaggccttgtagcagaggratgcaccctgcagggtggaggtgggtgcctgccacggggccaggcgtcagtctccgggagcactgagagcgggccgcccccaggtgctgctgcaggtcctgattatcatcaccggcaactacaayttyttcaacctgatgacgctggtgcttaccactgcgctgytggacgaccagcacctggctgctgagcctggccayggcagccgcaagaagacggccacctgtgcgtgtcacttgtccagccccctgccctcccaggggttctcccctccaacaccccyacaggactcccactctagctgcaccccagccccctggctggggaccctctgctgacccatgrctgtcctgccccacagcctggcccaaggccctgctggccaccctgtcgctgctgctggaactagccgtctacgggcttctggcctatggcactgtgcactactttggcctggaggttgactggcagcagcgcaccatccactccagaaccagtgagtgccgacctgggggggccagagggcaggggcggrccagtcctcacacccccctcstccaccagctttcaccttccaccagttttctcagtggctgaagacactgacgctgcccactgtgtggctgggtgtggcctccctggtctgggagctgctgagtgccctgtggaggtacatggcccaggaagcagggagggggcacaggtgtgcagggccggcctgacgaccttgggtccttgcccacaggtggacccaggtgcggggctggctacggaagctcagtgctgtagtccaactgtcccttgtgggcactgcgaccgtggccttgttcctgattagcctggtgggtagcgctgcagggctgggggatgggctgggggcagggcagccctgagaacctcccacytgtctccaggtgccgtactcctacgtggagcccgggacccacgggcgcctctggaccggggcccaccgcctgtttggtgccgtggagcacctacagctggccaactcctacggcctcttccgccgcatgactgggcttggtggacggcctgaggtggtgctggagggcagttacgacggccaccactggayggtgagccctcccagggcgggcagggtggtggggcccaggtcagcgggcccagctgacctcggcctgcctggcaggagatcgagttcatgtacaagcctgggaacctgagccggccgcccccggttgtggtgccccaycagccacgcctggactggcagatgtggtttgcagccctgggcccacacacgcacagcccgtggttcacaagcctggtcttgcgyctgctkcagggcaaggagccaggtgcggagcgggcttggggggtgtggagtgggctggggtggagcggggtggggaggggaggggcagggcgggtactgtgggggccacgctgatgcctctcgctgcagtgatccgccttgtccagagccaagtggccaggtatcccttccacaagcagccgcccacctacgtccgagcccagcgctacaagtactggttctcccagcctggggagcaggggtaaggctgggcaccgggtggggtgtggagcccggggtgcaggggtaaggccgggcaccggggggtgtggagcccggggtgcaggggtaaggccgggcaccgggggggggtgtggagcccggggtgcaggggtaaggccgggcactggggggggtgtggagcccggggtgcaggggtaaggccgggcaccggggtggggtgtggagcctggggtgcaggggtaaggccgggcactggggggggtgtggagcccggggtgcaggggtaaggcygggcaccgggtggggtgtggagcccggggtgcaggggtaaggccgggcaccagggggggatgtggagcgtgaggagctgaggagcaggggtaaggctgggcactggcgatggggtatggagcccggggtgcctccagcttctgaacatcgggtcctgctgcagccagtggtggcggcgccagtgggtggaggagttcttcccatccgtgtccctgggggaccccacgctggagacgctgctcaggcagtttggactacaggtaagggggtgtcagccaggctgggggaggtggcaggggtgaccccagcctcccggggtaaacccagtaagcacttccccaacctccctccctccctccctcccacaggagaaaarcccacctcgcacccgcagcgccaacagcaccctggcccaggccctccactggactcgctctcagctgtctcccctggaggcccccgccctgctctgggggctcctcatggccgtgggggctgtcagatttgtgcaggccctgctagcaccctgttctctccggtcctccccgctggcaccagtcagcggggagaagcgcaggccagcctcccagaaagastccggagctgcctccgaacaggccaccgcagcccccaacccctgctccagtagttcgaggaccacccggcgaaagaagtagctgtgttctcccagctgcacgtcctgagagggccaggtcgccgggagtgctctggcctccggcaggacaggacccagccactgtgccttagctgaccctgcagggccaggcacaggttggggggctgcccctggggtttgcagggtgctgcattgagggctccaggccccacccccacgccagccatgcccctccccaggactcccactattgcctctgtgattggcccaggaggaaaacacgaccaagctcaagacccttcccctgccctgggctgtgggggtytgagtytagagcccccaaccctaggccccgtgccagaggggaagaggctgactcccaggggaaraggggaagcactgtcatcttccacgtcatyttcacaccagcccatcctgccctttagatctgggcaccaataaaggcgtcttttgtgcttggctgtgtgcctggtgctgctttcccaggaggcatgaggatgggattgtctcccctgccccaggcagtgggccgcccagagcacagtcaggctccgccacggcgtggctccctgggcaccctcctgccccgtcctcagcattctctctgaagaggcctggcttggtgttgcccactgcctgatcacagaggagcctcaggcctggcacagcccggtggacctgtcagctccacactccaaggtcggtggtggagccggtccctcacttccctcctgctcccacttcttggcctcaggaaaggacggaagggccagagtgggcaaggggagaaggagagatgaggtgggcaggttagaagaggctcctctgcagagtgaggccagggggagggtagctggaggccctgggttgggacggaggagggaaggtgcatctgatgcccctggcctccatcctgggaagagaacagcagcagagacagcagtcagggcaccgtccaggtttccatttggggtcaggttatcaatcagaggtcactgcccaccctggaaactcacagcacagcttcctctgcctctggcccgtcctcttggtacagcccctgcctcctggtctcctgccagacccctgggcagctcccaatgtacccagctccctcatgtcactgacctccatctggcccacccaggcagagccctgtgctcaaacacagcctgtggcgtgaactctcagatgtcttcaaggggctcctatacatggaataaacaatcgagaagtcagccttggcttaataataggctgggcgctgtggctcatggctgtaatcccagcactttgagtggccgaggtgggtggatcacctgaggtcaggagttcgagaccagcctggccaacatggtgaaacccaatctctactaaaaatacaaaaattagctgggcatggtgtcgggtgcctgtaatgccagctactccacaggctgaggcaggaaaatcgcttgaacctgggaggcagaggttgcagggagccgagatcatgccactgcacttcagcctagacaacagagtgagactccatctcaaaaaaaaaagtaatatgtttaaaactaaaaaacctgttcctaggcttcttggctttctagacagggtctcactctgttgcccaggctggagcacagtggtgcagttgtggctcactgcagtctcagactcctgagctcaaatgattctcctgcctcaggctgccatcaccacccacactccccttgttgcccaggctgatgttcctgagtttttttttttttgagacggagtctcgctctgtcacccagtctgaagtgcagtggcaggatctcggctcactgcaagctccacttcccgggttcgcgccattctcctgcctcagcctctctgagtagctgggactacaggcgcccgccaccacacctggctaattttttgtattttttttttagtagagacggggtttcaccatgttagccaggatggtctcgatctcctgacctcgtgatccgcctgcctcggcctcccaaagtgctgggattacaggtgtgagccaccgcgcccggcctgatgttcctaagctttcaagctcacttgatgaatgcgttctgtgttttgttttgtgtagcagctctcttggtaagtcacgtgctacacaattcacccgttcaagtgcgcaattcagtggctttcagtttattcacagagttgcacgtctatcaccagagtccattttatttacttatttagagatggagtctcactctgtcaccgaggctggagtgcagtggcacaatctcggctcactgcaacctccacctcctgggttcaagcgattctcctgcctcaaccttgcaagtagctgggattacaggcgtgcaccaccacaccgggctaatttttgtagtttattagtagagatgggttttcactatgttggccaggctggtctcgaactcctgacctcaggagatctgcccacttcggcctcccaaagtgctgggattataggcatgagccacggcgcctggcccggaggccattttagaacctttgatctccagaagaaaccccaaaccctttagcctttgccctctgacccctccctgccaagccctaagcaactattcatctaccttctgtctctgtggatttacctactctggatatttcctgtaaattggatcagtaacatgggacctttgtgtctggcttctttcactcagcacggtgttttcaaggccacacccacgtcatagcacgtatgagcgctgtgttcctttagggctgagtcagtccagtgtacggaggggccacgttttccctgtccttattcattcgtatatcgatagacgcttgcgtggcttccgcctttcctatgtgaatagtgctgctgtgaacattggatatgcaagcttttgtgtgggattacaggtgcacgctaccacacccagctaatttttgtatttttagtagaaacggggttcgccatgttggccaggctggtcttgaactcctgacctcaagtgatccaccgccccccccccccccaccatcctgccaaagtgctgggattacaggtgtgagccaccacgcccagcctatatagaactgatttgatgagaagctgagtctctaacagatgcagtgactaagacaccatttggtcaaagaaccatataggctgtgcaccgggaggaaacacacacaggctgtttcctagtaaaatgcaaaaaaaaaaaaaaaggaataaaaccacttgcatttgtcaaaaataaatttttaagccgggcatggtggctcacacctgtaatcccagcactttgggaggccgaggcgggtgtatctcccaaagtcaggagttcaagaccagcctggccaacatggcgagaccgtgtttctactaaaaatacaaaaattagccgggcgtggtggcaggcgcctgtaatcccagctactcaggaggctgaggtaggagaattgcttgaacccaggaggcagaggttgtggtgagccaagatcgtgccattgcactccagcctgggcaacaggagtgaaactccgtctaaaaaagaaaaaaaaaatttgcatggagacatttgtggctgctgtgtatattacactcattagctggaaactgtttatgaggtgatagctaagtaagggatccattaggggaatgagctactgcctttgtgtataacaactgtcgagaagaaatagttaagtgatacaatcataattttataaaaagagaatctgggccaggcgcggtggctcacgcctgtaatcccgccactttgggaggccgaggcgggcaaatcacctgaggtcaggagttcaacaccagcctggccaacgtggcaagacactgtctctactaaaagtacaaaaaaattagccgggtatggtagtgtgtgcctgtaatcctagctactcgggaggctaaggcaggaaaatcgcttgaacctgggaggcgaaggttgcaatgagccaagatcgtgccacaccactccagcctgggcaacagagcaagactccgtctcaagaaaaaataaaaataggccgggtgcggtggctcatacctgtaatcccagcactttgggaggccgaggcgggtggatcacgaggtcaggagatcgagaccatcctggctgacatggtgaaaccccatctctactaaaaaaaatagaaaaaattagccaggcgtggtggcaggcacctgtagtcccagctacttggaaggctgaggcaggagaatggcgtgaacccaggaggtggagcttgcagtgagccgagacgccactgcactccagcctgggcgacaaagcgagactccgtctcaaaaaaaaaaaaaaaaaaacaacaaacggagaagtaggtccagaatttgtcaatagtcagtgactttggaaatgggattttttttagttattttgtgctgattcatatatgcacattcctactttattattacccattacataacacatatgcttgaatattcaaggaaacacacctctataagcaatattcaagagtaactactgggcttgagaataagtgtgtcagaacaaatgagatcctatgagagagaaggcaggagccagggaggacgatcccagggctcggcagggaggcggagccgtcagaggagggcggccaaccaaggaaccaccccccggaggtttgcagaggtcagggtccccgcaggtgattggactgttgtggagtgtccagaagacagcgaaagtctctgagttcaccagataacccagaccaactggaaacccagtggtggttctacagaaaaaactagcacaggattggctgtgtgagggtggggttggcgtctgtcttcgctgcagctctgtctgcagagccagcaccgtaacagctcacactagctgctcagtatgtgtctgaaagtgaattaatatctaggaagggatgaaggcaggtactgctctctgcagagacttcccgcctgaaatgccatagccccagacattggagctgtccaaaaccttggcttgtggagaatttccagaagggggcactgtggacacggttcagcatctgcctcccaaggctggggctccatgtcaaaagaaggtgagacgaccaggcacagcggtcactcctgtaatcctagcactttgggaagccacaaaaggatcacttgaggccaggggttcaagaccacctgggcaacatagcaagagcttctctctacaaaaaaaaaaatttaaaatgtagccagatgtggtggcctgaacgtgtagtcccagctactcaggaggctgaggcaggaggatcacttgagccaggagttcgaggctgcagtgagctctaattgcacccctgcactcccagcatggcaacagagcaagacctggtttcttaaaagaaacaaaaaaagagatgagattggggtgtcctgcttccatgcacgtggaggggagaactgggaactgtggactgtaggggatcgaagacctttggatgggaagagcagctctccagagctgcacaggaaccacgggcagaggccctggctggtgagatgattctagctgtgtggctcgccgagcaggaaaagcaggaacagagaccagaaatgaggctgggcgcagtggctcatgcctgtaatcccagcactttggaaggctgaggcgggtggatcacatgaagtcaggagtttgagaccagcctggccaacgtggtgaaaccctgtctctactaaaaatacaacaattagccaggcatggtggcacatgtctgtaatcccagctactcaggaggctgaggcaggagaatcgcttgaacctgagaggcgcaggttgcaatgagccgagatcgcaccactgcactccagcctgggtgacagagcgagacgctgtctcaaaaaaaaataataaaaataagtaaataaatgaaagtttaaaatggcaagagtggcccaatctagagaaaatgtaatttgggagggaatagctctccctttactgtagccttattattatggtatcgacaaagcaatgtcatattctaactctgcagagataaaattttaaggggcaaaagtccaaggcggaagtcaaaagttttgcaaggaaatcgatgaggttggtgatctgagctgggcgaggttggacaggtgggtgccacggtccaggtgtctgactgtctctgtctggcaagtaagcagagatctagagctgtcctgtgaattaagtgggagattggacaggggtgcacacttgtgtattgaggagaaggtcgtggacaagctggggcagagagctggcagagagaatacccaggaagattttttttttttttttttttgagacggagtcttgttctgtcgcccaggctggagtgcagtggtgcagtctcggctcactgcaacctctgtctcctgagttcaacctattctcctgcctcagcctctggagtagcttggattacaggccgtg

SEQ ID NO: 17924 - DNA, 15373 bp, Homo sapiens
catcaccagttgtaggggcagcaggccgggcccccacaggaggaagagggagttctgatgagagtcctgggaggggtcctgcattgaccattccctccctttgctgtttttatttcagggagatctgggcctccctggcctgcccggtgctcctggtgttgttgggttcccgggtcagacaggccctcgaggagagatgggtcagccaggccctagtggagagcgggtgaggggctgggaacagcatgtaggggcatggtgaatccatggtgggtgaggagggggccctgccttgggggttcccagtcttgagggggcagagggtaggagggttcccaagtcactctctgcctctcttgccccatttttctggtagggtctggcaggccccccagggagagaaggaatcccaggacccctggggccacctggaccaccggggtcagtggtgagtagaggtgccctaaagccccacgtatttgatttcctgtcctcgtgaggacttaggatggggcgggccacactgtggggtgttgggggaggcgctttgagagccacaggaccctcacctcactctgacctacagggaccacctggggcctctggactcaaaggagacaaggtaggtgggacaagtgctgctgactctctcttgtgccctggtcacccccttcagcctccactgacctcccatgaccctgcgtcccccactgattcccctcactgatccccggtgtcctgttggtctccagggagaccctggagtagggctgcctgggccccgaggcgagcgtggggagccaggcatccgggtacgtatgtcttactccacagccgaactcccttcatcccagctcttgcctctgatttccaacctctgagtcaatgaacctaatgtcaccatccagggtgaagatggccgccccggccaggagggaccccgaggactcacggtgggtcccgctggggaaagtgacagtgctgtgacttcagtcccctgcctgtgccctttgtaccccaggactctctgccatcctccctagccctctggccctcctcgtctacccctgtcccctttgtctggtccccactgtttccctcctccccctgatcctcctccgtcctccactgccctggttcctgtagctcacggtcaccttctctcacacaggggccccctggcagcaggggagagcgtggggagaaggtaggaacgtggggaaggtcctggcatgagtgggggggtgagtggatcttgtatgatattagaattcaggcgcggggcctccccagtttgggcgggactcacactcttttgcccaatagggtgatgttgggagtgcaggactaaagggtgacaaggtgagtgtgggcatggggagggcagggcaggggccagggtgctcccgactcctctgattcctgcctgccccctcagggagactcagctgtgatcctggggcctccaggcccacggggtgccaagggggacatggtgagtgggcccacgtgtggactgggtctcccctgggtgcgagagggaccccgtggggctggcccagggcatctgagagctcaaactcccagagggtgagggaccttcagccccttaccgtgacttcttacccaaaccaacccagggtgaacgagggcctcggggcttggatggtgacaaaggacctcggggagacaatggggaccctggtgacaaggtacagggaagagggtggtgtactctctgtggggtcctgtggctgtggtggttccacagcatctgtgagggcaggaggggaggacaggaggaggctttctggggttcagggggaaggggttctgtggctgactatggagtggccgagaggaggggctctagggagggctcaaggccttggtgtgaggttaggagagctctgtggactggccctatgaaggggccctatagggacaggaaaggggctccttgggtgtccccatctgaaggtgcttcagatgggatgaggaacccagtgataagagggcggggcaagggtctggagtccttggggtgagaaatgagccagtctgtggactacagcccccagttccacccgctatggcacaggctgggaggacgtgctgctagggccgttcgggagtgacttgagctctgccccagctggcgggctcgttgtattctaagcccccagcctgatctggtcctgactgaatccctctcctggtcactcccacagggcagcaagggagagcctggtgacaagggctcagccgggttgccaggactgcgtggactcctgggaccccaggcaagttctgccccaggcccaggcccaggcccaggtccagagccagcatcacacacacacatatcctgggggtcctcttaagtgctgggggttctggctcccttgctgccggccccatgtgtgttcacccgggatctgtgtgtggcctgggccctggccgctgagcatctgagtggccacacatgcagcggatgggccagtgttggggacagtcccactgaagggctcccccatctgtgtttctcacagggtcaacctggtgcagcagggatccctggtgacccggtaagatgcccctgctcccacaggggccccctgtccccagagggcccccgtcaccatggtggtcccaccagtgtggtagcttttgaccttatagtgacccagtgctctcatggtgtcctcatgtcacccagggtcccccacctccacagtagccgcctatgatggtgtcccctgcctatggtgacccttgtccccatggcaagccccagtggctctggcctccagaggtgactcccaccccatggtgttccctacccactatccagggcgattctctttggtccctcactgacctcctctgacctcacatggaccctctccctgctagggatccccaggaaaggatggagtgcctggtatccgaggagaaaaaggagatgttggcttcatgggtccccggggcctcaaggtaggaaagaaacaagattggtttttttctggtcaggaaggcctaatgttgaagggcgagggacctggggtcagatattagggcactgggtcagaggttggagtagctgaggcctgtttggagagttagtttcagggtgaagggggtcacagagtgaggtgtctgggaatcacttcttcatctgcttttctccctcagggtgaacggggagtgaagggagcctgtggccttgatggagagaagggagacaaggtacagaggggatgggggctggggggctacgtggcctggggcctaaggctcaccccactgcctgatgcctgcagggagaagctggtcccccaggccgccccgggctggcaggacacaaaggagagatggtgagtgtgggcacgctcagaatgagggggccacgggtggacgggggccaagttcatgtctttttttctccagggggagcctggtgtgccgggccagtcgggggcccctggcaaggagggcctgatcggtcccaaggtacagggtctgtggacagtggacatgacagggagtcaggatggggcagggaagctcatggtcgggtcatgggggtgtagggacaaggaaggctgtagagggttgggactttgggggctgaagtggggctggtctcgaggtgtcaaggtgggttggggtcacagtggagttaggatgaaagcatgggaggtggagggggcatgtgcatcagggcagggggctatagtggagttggagtcatggggatcacatctggttggctcacaggtgcttgggttacagaaggtttgggcattaggccagggagctcatgggagttcagggaggttccagagctgagggaggtcagggcagaaggtctctcatgcttcttctgttcccagggtgaccgaggctttgacgggcagccaggccccaagggtgaccagggcgagaaaggggagcgggtgagttgaagccatggtcatggtgaattgaggggagcgtgcactttgggagagggtccatctctggggcctctgattactgactctgtcctatatctccccagggaaccccaggaattgggggcttcccaggccccagtggaaatgatggctctgctggtcccccagggccacctggcagtgttggtcccagaggccccgaaggacttcagggccagaaggtaaggggccccagctctgactcctgatccctgaaccttccctacccttccaacctcataaccatcttccagcctgcctgccccaacctctgaagctgtggcccccaacctgcctgactctgatccccactgcctctgaccctgctcacttggtccctgtgtctgacagggtgagcgaggtccccccggagagagagtggtgggggctcctggggtccctggagctcctggcgagagaggggagcaggtgagtagggattccaaggcttgggtcagagatcggggtgacttctgttgtccctgaggtcagaggtcacagcctggtcccatctgttgcacataggggcggccagggcctgccggtcctcgaggcgagaagggagaagctgcactgacggtgagtgtgggcctggatgggcctgggagggcctgggtgggcctgggtgggctggggccctacctccctcacccagcaccctgacccctgggccctggctccatgcagtctcaccatagtccctgtattatgtgccctatgtccttcctgtgggccatgggttctttatggtccctgtggtcttctgctcccaggaggatgacatccggggctttgtgcgccaagagatgagtcagcactgtggtgagtggtgcccagcccgcagtctcccactccaccccagcaccctaggcaagggcaggcaggcccctagaacttacagggcaagcagtcaagaagatggggggatggatggatacacagaaggacacatgtgctgcaggactgacacatgacatgtgtccccagtggagggagacacacaggcagatgaggattgccatgcagtgctctcagatgtccagcttggctgtgtggggagtgggatgatggtgggagcagagctggtccccttgggcctgacctggacccggtgggaggggcatcagagtgaagctgtctcttcccgtctctgtctgcaccacctgcctgtttctgtgtctggcctgcttctgtctcttgccttttgttggcctgttcccaacttccctctcctctgccttcttctctttttccatctctctatctacctcccaccctctctcttcctctctctcctgtctgttaccctctcctgctatctctttgtgtatctctacccctctgcctgtgtgtctctgtctgtctctccatcttcccatccttctctctgtcattgtctctctatccctctctgccccctctagcctgccagggccagttcatcgcatctggatcacgtgagtagttttctactcccagaactttcttcaccccaggccctgccctgcctatcaactggggtcctctcaggggggttggctgggatggctgcccatggtgacttcagggccctgaggcccctgctcttggctccaggacccctccctagttatgctgcagacactgccggctcccagctccatgctgtgcctgtgctccgcgtctctcatgcagaggaggaaggtgaggacagctgaacccgtggggcagctatgggtggggccgagacacgcacatgggtgtccatgaatgcagggcacacgccaagcacgtagggtctgcatgcagggcacacgcatgggcactgtgtgcacacagtggaaatcagtgctgcccaccttgccccggggccagcagccactgctcccagcacaccctgccctacctgcagagcgggtaccccctgaggatgatgagtactctgaatactccgagtattctgtggaggagtaccaggaccctgaagctccttgggatagtgatggtgagaatggggggctgcgcccagcggggtctggggaggggcaggcagggctgagccctgctgacctccccctgacctttcaaccctctctgattcccacaaaccctgctgacttgaccccattggcccagacccctgttccctgccactggatgagggctcctgcactgcctacaccctgcgctggtaccatcgggctgtgacaggcagcacagaggcctgtcacccttttgtctatggtggctgtggagggaatgccaaccgttttgggacccgtgaggcctgcgagcgccgctgcccaccccgggtggtccagagccaggggacaggtatgggctgagcccccaccgtggggaactgggcactgagcctgcctggatcgggttctgggggaggagtccttgggccagggttccaggtcagggtcctggaggagacgctccctcgcagtaggggacctggggcagacgcccagaccaaagagctgaatatagagccccagccgtggagcccccagtagggtccccttccatgttccctcctttaaagacctaagtatggacccctctgaggtcagagcccccacttcctgttgtagcctccgctccctccccttggcggtgcctctgcctgagcgtctccggggaaggtcagatggctgacgaccgtttccaacctgtcctcaccaggtactgcccaggactgaggcccagataatgagctgagattcagcatcccctggaggagtcggggtctcagcagaaccccactgtccctccccttggtgctagaggcttgtgtgcacgtgagcgtgcgwgtgcacgtccgttatttcagtgacttggtcccgtgggtctagccttcccccctgtggacaaacccccattgtggctcctgccaccctggcagatgactcactgtsggggggtggctgtgggcagtgagcggatgtgactggcgtctgacccgccccttgacccaagcctgtgatgacatggtgctgattctggggggcattaaagctgctgttttaaaaggctcctgttgtgactgtttgggaagatggggggtttcaagggggaaggttttccttggggggttggtattattctgcatgggtacagagtccctctgcccagtcctggtcactgtcttgtgattctcagtccccaacttgtccccggaaaagagtagatagggtgggggctaaggacaccccygggagggatgagtcataggtggggggctgcctcatgccaggaagcatgtaccagctcccaccccagggggctgagggagataaatgggccctgaagcggggtagagggtcagaccacaggacagtagtgcctggccccagccccaggcagccacagcaggctgccttaccccagaagcagctggtggcggtaggactgggttgggtcgggatgggaagggtcttggaggttgagtggatgtggggtttggctttatggagggcttggacccaggggactctgggatctctggctgcttttctgcctctgagatccgattcctgcccttctgtttcctggatcagctgcaagctctcctgctgagaaccgcctgccctcctgtggactctgtgtttctgtctgaatctttctttccatcatgctgtctgtctctgggatggtttctgtctgtctttttcttctagtctccattttgctctgcctccatctccttcatctccctctcttgctgtccctctgtctctggatttctttgtttctttttttctgtcttgctttctgcctctttgtctcattctggctctcctcttgtctccccttctctgtctctggcctggcctggcctctctaacccctttctcggtgtcttcctctctctccatcccccgctctgtcactctgcccttgccatctgtctctgtccatggaccccagttgaccagagcccctgccctgagcccattttctccttgcagcctgacctcacgatgaccaggtgtgctctgctgttgctgatggtcctgatgttgggcagagtcctggttgtcccagtgacccctatcccaaccttccagctccgccctcagaattctccccagaccactccccgacctgcggcctcagagagcccctcagctgctcccacatggccgtgggctgcccagagccactgcagccccacccgccaccctggctcgcgcattgtcctatcgctggatgtccccatcggcctcttgcagatcttactggagcwagcccgggccagggctgccagggagcaggccaccaccaacgcccgcatcctggcccgtgtcggccactgctgagcctgagagagggggtcacagtgatagggccaccctggatgggaagacctggagggcagccacacagctggayggatgctgccacatctgggcatacagtgtctggacgctgccacatctgggcatacagtgtctggacactgccacatggagccactgtcatgcaggtcatatcagatctgagtgccccacagagtcacagtgtgtctggacagcctggacattggacattgctaagttgggtcactgccacatggagtcttgccatgcctgtktgccccacagacctaatatatgtccggacagcttggatgctgccacgtaaggtcactgctgtggcgagtcttgctatgtctgggtgccccatagtcacagaayacctggacaccgccacatgcagtcatcatcatgttactttcaggagcctcaacacgagagctcaacactgcctccgaccagtccctctgaggcccacaggtctgtcatcccataggccaccacacagagaaatgctggctgagggtcacttgcttgctctgtgccccatgaggcagcacctgccccagatggacggggctgtgaggggtgtctccaggcacaaaggcccgaacacaggaagcctgtgaccatggcagccttgtcttatgggcgcatatgtgcgtgtgtggctgagtctctgacagctgtgagtgtgtgtgagcagggtaagggtacgtgaggggtctgagaggagtgggtgcttgtcccccaaacctgcatgaagcaagaacaactcctggccaggccctgtcctccccacgtacccctgcatccccagcctcgacccagggacatgcagggctcacaggagacagggctcaggctgccggagctccaaccaaactctgtcccacttcacgcacggactgtcctgggcaaaggtgttcacctttccgagcctcggtttccttatctgtaaagcaaagcgacaccagcaagcctgtgagcattgtgtatrtagcagacatggaggtcctgcagcaggaggtgctcaataaacacaaagcgactgaaggatgggatgtgcgagaatcccagtggtgtgcacccaggccgcgacacatggtgggtgagtcatacctggcttctctgccttcctccctagctccccggttaactgacctggtcccttggtttggaaggactaggttttgcctgatttcacagcccaactccattgctgggccagagacagaactgactttccaggcagtgtggacgggcttgcccgcagagggggcaggcactctgggctgtgcagacaactctaggtggacatgaaggcagacgctgggtggcatgggcagctctggcgggagagggagactgtactggccacagcgtggccggctgactggagtgggggcactggcgctgccctcacagttgtaagcagccctgtgggggcgggcctacagtgggctggggaggcggggctgcaggagccgcaggagtcgcttctctctcttcagagtgctaggcggggttaccccactctggagctgcagggggcagtggccctggccagtttggttgcaggatggacagaggctcgttaggaggcagctccctgaccgacctggggccggggagcagcaggcggggtaggcacgggacagcgtggggagggtggagggttagggaaagacctggatgaagtcagggtggtgctggaggggtgcgagagtgttggggggtctctcctggtttaggggtgctctgagggccattcatctgtcagtggcccgaaggagggggaaaactgtcgccctgcaagggagagggggctgggccaagggggaactataaatagtgtcttcctccagcccagggggagggaccgccagctggcgctgcccaggccctcctgctctgctctttgctggcctccaagggatcatgtttgtccaggtttcctcttggggtcacaccagtttggggaagtctagaggctcatttaggatgggtttcacatgatgtggctttagcccttaaaccagcacttctagggtgtctgctgtgtgccctgtgccagtcctgagcttctctgaacacctgctgtgtactcagtttggtcatgaacctctctgaaccctttctgtgtgcccttgctggtcctgaatccctaagcacctactgtacgccctgtggcaggctggaaggaggaagtgcagatcagggttcccaggctgcttggtgacatggttctataacctgaagtcagaacttcacactccttgtgagccctgggcccagggagacacaggggacaatcctttgctggaaatggccagaggaagctggaattcctggaaactcctgaacctcccagtggacagcagggctgggggtggagagatatatgtgggaagggaggcagcagagagcagcaggccccactgcagcctgcctgtctctgcacatgctggggtgcaggacttgtgagtgtgtgtgcgtctgtgtgtgcatgtgcagctgtgccagtgtctctgtgtgcatcagtgtgtgggcctgtgtggcatgcactgaaacccctgggtctttatgctgcaaagggtggtttgtgggccagatgtggtggctaatggctataaacccagggctttgggaggttgaggcgggaggatcgcttgaggccaggagttcaaggctgcagtgagccatgattgcactatgtgctccaggctgggtaacaggagcgagactgtgtgtgtgtgtgtgtgtgtgtgtggtgggatggtttggcagttctgtcaggactggccagtagatacagggactgggaagagtttgagctttgagaactggccaccacatggcttctaggctgggacactgggaggaagtccagtggtcagtgcagagggcaccctgggagccaaccagggtcaggccagccaggttcatggtgggcagaggctgagcagaacatgttcacacgtgtgtacagacatcccagcatacttcccacgcctgggacagaacagctggctcactttcggatatactgaggaggaaaaagccatgagggccagagattctaccgggcatccgctgatgctgagagagcagacgctgggacagcatctccatggagaggacacaggggagtgggagcacacatgtgaaggtggactgtgcgattccactgtagtgtggcaggcaaggtctggaaggctgggagttgagctgagtccatgctgcactgtggactcgctttgtgatcttggacccttctccctcttcctgaccctcagtttcccacctgacaaacagggccatgggaggggagatggagaatatcctcagagcagatgtggacggtggccttggggaggaaccccaggcatctcctgatgttgacctgtggccttccagctggacatagggccttgaaggagggtgcctgggtcagccacgggtagactttctggggaagagaggaaggtgcagagctgttgcatttcctgggaaccaggctcatcctgtctgggtgtgaggatgccttcccagagatagccctggccccctgcccaggccagctgtcctctacccccagcccttgattagcatcccaggaggtctgggaagagaatggacaggccagaggaggtgctgggtgtctgtagatatcagaggagatagcttttgcaatgagtgctgcgggttagacagggtgtgggcatgtggtaatgaggtctcagaggccacggtggccccaagatggccttggcagtggccagaagacaagagggctggctgtgtcacgaacagaatgagtggctttggagaagtagggagcaggtcacgaggggcacccagctcatcaggagccgcccatggatgtgctcagatctgctgggactggggtggaggaataagcgggtagatactgcaaaaggaggatgaggaaggaggaagttgttgactctgcctggggcagggtgttcccagggcaagcagctagagctggtttgggggagggtccagatgggcttccagcatgtggacctttggaatcttcagttcctatgaagtgggcaagacatctgtgtcagtcatcttaagggtccttgccaagctttaaagagctgggtggacttggactgatccaaggcagggctgtggcagggagggcatgggagggggtgctacacctatagcccacgaggccagtcttgttgccagtcccatgccctcaacacctggctcctggctgggtacacactgggcagagagaacctgaggatgcagggcacctgccaggggtgttgtggatgacatcgctagagggcagtgtggctcaggttgaagccgtgttggtgggggctggggcagagagtgtacaaagcttggagaggcggggctggggatcccgaggaggcgggaaactgcaggagtccggtgggggccaaacaagaaagtgagccaggggtttaggaacttctggatctctcccttgttccttgtccccagtgcattttcaaagacaagagggagatacaaatatagtaaaaggcaaccataacgtattttaaaatgaatttcttagagattgacatacttaatttatactgtaatactgtaagatagacaatgtgcacatcccattttcctgaagagaaaatgttattaacatattagtttcaaaaaatatgtaaaactttagttaaaaaaaccaaaatactaaaaatcaaaaaaaaattgtaaaaaatgaaattctggaaagacgattaagatactcccagggcttagtgagtacccaaagtacttggttactaagtgccacgcacggccgggcgcggtggctcacgcctgtaatcccagcactttggaaggctgaggagggcgtatcacctgaggtcaggagttcgagaccagcccggccaacgtggtgaaatcccgcctctactaaaaatacaaaaattagcagggcgtggtggtgggcgcctgtaatcccagctacttgggaacccgaggcaggagcatcccttgaacccgggaggcggaggttgcagtgagccaagatagcgccattgcactccagcctgggcaacaggagcgaaactccgtctcaaaaaaaaaaagtcccacgcatttgctcccagcagccaaagcaaagaaagaggaacaatattgaaatgtgttttgagtctctatccatgaggtaaaagagcttttccagcgtggttgagcatgctcctatggacggcggaagagtcccggggctcggagcagtcaagggggaccccgaggaggggcaggagggcgcagcggagttgacggctgggactgcaggcctactggcccctgtcggctctgaccaacctggccgtgcgggtcacgtaggcctcgtcccactgcatgaaaacccctccctcctgggggccctgggctccctagcaaggaggtagcagaattcacgcgtgccgctgctcagggatgcagcgccagggcggagcccgtaggtggggcctatgcaaatcagcgcgggcaggttgggagagctgagtttgcgcatccggggcgggcctgcacaatccgggccttgaactggggcgggaccagtacaatccggagttgagcatgcgcattctcgatcctggcctgaagaactgggcccacttgttccaaaacgggcgggtaggtgagttgggcatgcgtggtcggaggccgggcccctttcagctggggcggagcctactcactctggggcgggacctgcgggaagatagacatgggctgtcgcggcttgaggaggggcggggcccaaggggcgggacctcgggtggcccgaggtggcccggctgctgggttggaagcggcgcagtccgactcatcccggccccgggatggcgtccccacgggaattgacacagaaccccctgaagaagatctggatgccatacagcaatgggcggcccgctctgcacgcttgccagcgcggtggtgaggcggggtcctctgggaggaggtgggaggtgcaccgggatgggtgggtagggcggcctgggcgggggtctcgcatggagaaggggcgggagacagatggggaaccggggacaggtgaggttgccgtgactggggaggctgctggggacaggtgaggcggtcgtgacagtggtgggccagagacaggtgtggcagagcagggggcggggacaggtgtgtgggggcatatcggcttggcggtggctaggtctggccaccatcacctcggggagggctctggccccctcgcttccctctccaatccccatcgcccccagtctggggaggaccctgtgggcaccccaggcccttccctctctcctggccaaggagtgtgggccgggttgttggactggaactgagctgtgtggccctaggtgaattacttggcctctctgagcccagaactttcaaaggtgggctagttttccaacaggaggaagggtgcctcttggccttaaagctgagcttgggcaggaacttcagcagagatgtgctcaggatagagacagaaaagtatgccgtgtgggcctgtgtctgtgtcccgggacatgtaagtatccacctggggtcatgggtgtacagtaaaactggagagtgaaacagctaggagaatgctgaaattcatggaattgttaaggggctcacctctcctagggtcccaggtgtttaaaccgcttccttgagtttctgcctgtccttaaatgagctggcagttttttttttttttaagagatgagtctcgctcagtggcccaagctggagcaagtgcagtggcgcgatcatagttcactgcagccacgaccttctgggctcaagcaatcctcccacctcaacctcccgattagctgggattataggtgcgccaccacacccagcttttttttttcttttttctttttttttgtagagacagggtcttgctatgttgtctgggctggtctccaactcatggcttcaagtggatcctctggcctcggccttccgaagtgttgagattacaggcgtgggtcctggcctgcaacttttttatta

SEQ ID NO: 17925 - DNA, 23810 bp, Homo sapiens
  misc_feature (1)...(23810): n = A,T,C or G, or insertion/deletion polymorphism (see Tables 1-2)
gaggagccgcctgaccttaccccttcaccccaaagggcgagggaccccgtcggccagggaacctcccagatcccccttcccaccttcctctgatctctccctgtccttcacctccctctctctgtccttcacatctttcctgcctccttccctctctgactccctatctctttcatcctgagcccaccagctgggcctgggtggaggtgggtgggaaggggtccagggctgtaggagaggacactgggggctgctcttggccaagtccctccacctccctctggctggccattgccatggcaactagggtgtactgggctccggagggaagccaagggtgggggtggaccaggacctcttggggaaagcaagggtctgagctgcttccatgggaaacagaccctttcactgctgtgccccatttttaccccacttaccctaaagccatcatgtgcttccttacagccccactctgttcagggtttcacccgattcccttaccccccttcccagggctcactgaagctcagcatcacgcactaaaactgggaccatccttcctcccatgagagggaaactgaggctctgggccagggaggaagagtcaaggtctccccacggggagtcagcaccttattgaacatttggcttttcttctcagcctcctattccctgctccctccctccctccctcctccagtccctcctccctccaaagcctcctctccagggggtttgagcttttcctgctattttcagatactaccactttgccccctctttctcttctgctcaaactctcctccttctccctagttccccctctttccatttctggatgcttctgatgtcagcggtttccccgccttcaggttccctagcacccccttcggtcccagactcctttctcccattttcccagatatgggtagctggagggtgatcacccaggtttggggaagtaggggctaagcaccaagacccctgcatccaggagaccggcaggtaggggaggaaggctgtgatgccatatcccagttcactgtgaaccctcaagaggaaaccagtcttgtgtctcccatcagtagttctgaagagacatttagggacttgaagataggggtggagtagtgctgagcaggggatgttctaagaaggaacctgggagttccagcgggaggaggaagggctaaaggagacagggaggtgggaataccttcttccctagaggtctggaagagtgtggctctcatctgtgtggggtgtttagctgtcagagttaaggcaaaggaatgttctgaatgaccctcagggccttagtaatcagtcatgcctatagtttcaagaaagggggcacaggaggctgattggagaccagcccaggccctacctttgccctctccctcccacatctcatctttcccttgcagcctgtccagggggctgagccccacccccaaatccctggggcatccagaagattcctgactggtcaagaaccagaggcaaaagagacctggaagtcccagcatggggaccagaaccccccagccagcctcatagttgggaaagtagccagcttgcctgccccatcaattgcagggatgcttaaggaaggccccgcccagtatgaaagctgaggattgcctctgctgaccctcagtctcctcccctgccctctacatctgccctcagctgggtccatcatgcaatgctgagcactggggtgagcctgggggcagcctgcctgctgacagggcgaggattgtggggatcatgggagtgtttgtgagtggggctcctgggtgagacctagcccccacccccacagagctcaagggggtggggggctgaggataggatggctcggggcggggcgggggcagaggaggcctccctgcgctccaacgcattgtcctggctggcctgtgggctcctggcgctgctggccaatgcctggatcatcctcagcatctcggccaagcagcagaagcacaagccactggagctgctgctctgcttcctagcgggcacacacatactcatggcagctgtgcccctcaccacctttgccgtggtgcagctgcgtcgtcaggcttcctccgactatgactggaacgagagtatctgcaaggtcttcgtgtccacctactacaccctggcgctggccacctgcttcacggtcgcctccctctcctaccatcgcatgtggatggtgcgctggcccgtcaactaccgcctcagcaacgccaagaagcaggcactgcatgccgtcatgggcatctggatggtcagcttcatcctctccacactgccctccattggctggcacaacaacggcgagcgctactatgcccgcggctgccagttcatagtctccaagatcggcctcggctttggcgtttgcttcagcctcttgctacttgggggaattgtcatgggtctggtctgtgtggccatcaccttctaccagacactgtgggcccggccccggagggctcggcaggcccggagagtggggggtggtggggggaccaaagcgggtgggccaggggccttgggtacccggccagcttttgaggtgccagccattgtggtggaggatgcccgagggaagcggcggtcctcgctggatggctcggagtctgccaagacatccctgcaggtcaccaacttggtcagcgccatcgtctttctctatgactcactcacaggggtgcccatcttggtgagatcggggtcctccccacctgttctccccaatatccaggccccagcatcatcacctgacctccaacttcatcagccatacagcagctccgtcatctctcctccagttccatcatccatcttcctctcctctgtccatcccccactccatttgtggcccccatcttgatcatctgtcttttagttcccactaccctgtttaccccagctccagcatctgcttcagttcccactcctcagctccatcaccgtccttcagttccacgacctgtcctccagctccgtcatccatcctgcagctccacggttcagccgcagacctctcatccagccgctgggctccactctccattccctccttccctctggctgccacatggtctctgagcactcttggctggaaatcccacagggctcaccccaccaccccatctagtcactgttcctgggttcctgtctgtctctacggttcctggtccacctctgttcctctccctcctgaccgcagggctttgtctccagcactctccccgaccttcctctgagtcagtcccttccctctgttcactccatctccacctccggcttcgcctctgttggagcacagggatcaggcattacttctgacgtcttgcccaccagctgcactaggatatggggttcaggtgggctcctcagctctggccctgacccagcccgctcccacccttccccaggtggtgagcttcttctccctcaagtcggactcggcgcccccctggatggtgctggctgtgctgtggtgctccatggcacagacgctgctgctgccctccttcatctggtcctgcgagcgctaccgcgccgacgtgcgcacagtgtgggagcaatgcgtggccatcatgtctgaggaggatggagatgacggtcagaggaggggctgggctttggctttcctggacatctgtctattcccttttctgccgctccttctcagccagaggatgggctgccctggagtgccccctactggacagaatctgcaccaccctgggctcccctttccctaagcaggcaccctgctgtccactcactgcttcccgcagcactcagggctcccttcactgggcctaggctcccctccagaaacccacactgcccagctctggcactatggggaacctgagcttcccgagagaggccccccagctatagggacggctcttgggggagtgcaggcaattgtttcaataacttcatctatatgtatgaagcactccactcaggatttagcactgaacgcagcaaatgctagccactctcactgtcctcttggaacatacatgctaatgggaactaaaggggtctctgggagcttataaaggcagtggtgggaggccgcggtaggcattccctacctgtaaccactctgcccattttctctcctagatgggggctgtgacgactatgcagagggccgagtttgcaaagttcgctttgatgctaacggagccacaggaccagggagccgggaccccgcccaggtgaagctgctgcctggaaggcacatgctcttccctcctcttgagagagtccactacttacaggtatggaactgggggatacatctcctacccttggtgccgctcatcacttttctccagtgtctgttaggcaccccaatcccctcttccctagccctggctttcagggcaccatagagctgggtgaaagaaagctatagcaagagaggcatcccttcagacctcgtggggccaggtttgcccaccggagcaaacgttttgaaggttaagaaggtggcaccatcttccggagtccccacttggttcctgcctctgcctctgtccctgcagcaccttcaggtcttacccgctcctcttcccaggtccccctatcccggcgtctgtcccatgatgagacaaacatcttctctacccctcgggaaccaggctccttcctgcacaagtggtcatcctctgatgacatccgggtcctcccagcccagagccgggccctcgggggtcctcctgagtacctgggacaaagacacaggttggaggacgaggaggacgaggaagaggctgaaggtggggggctggccagccttcgccaattcttggagagtggggttctggggtcaggtgggggacccccacggggtcctggcttcttccgggaggagatcaccaccttcatcgatgagacacctctgccttctccgactgcctcaccagggcactctcctcgtcggccccggccactgggcctctcaccccgccgactctcccttgggtcccctgagagcagagccgttggacttcctttgggactaagcgcagggagacgctgctccctgacggggggtgaagaaagtgcaagggcttggggaggatcctggggcccaggcaaccccatctttccccagctgaccctgtgagcccaagcaggcctgctgaactcagaggagaaagcctgagtgagtaacacctcattctggccgagagtagggcagctgcctccagactctggggagacgggcgctagatttggggctcagaaggccctgctctctcccatccaagtgaccagatgccctactcagcttccatcacccctagcaatatgtattaaagtctgaagtgttgccatggaaacctcagtgtccagtgtactgcggtggaaaggggcttggagggtggagtggctcacaggggacacgacagagcaggggcagcagacagaggcacagaaggacacatggagaaatgatcacatgctccaccaggcagcctcgcacagggaaggctgggaggagcatatcctgctgggggcggggcttgaggacacacatcttcgttggttggggtatgaaggatctctgttcagatttgttgaggtggttttagagcgtggctccagccccagtgcccaactctccttctaacctcaaatccatgcaggggctcactttatgggcaggaaaggttttggggctgatgcagtgtcccgggcctggacacctcctccttgctgcattttaaagctctttctccaaaggagtgcaggggtggatgagtgtgtgtgtgggcgggggtgggagtgcaggggtggatgagtgtgtgtgtgggggagtgcaggggtggatgagtgtgtggggggggtgggagtgcaggggtggatgagtgtgggggggtgggagtgcaggggtggatgagtgtgggggggtgggggggggcgagggggggatcggcgtccacactcctttttctggacccagaagcgtgtgtgtggagggaacacagccccagtagttacccccagacctcaggggctgaagtcaccgctggggctgaagtcatccttcatggatgcccaggcctgctccagttcccgccttttgccctcctcctcccagtttctccctcttattccacactagaccagctttgtccactcagcactcttctctctccatcttttcacatgggcctctcccaccatcgggtctcagccccatcttctctctctctctctctctcggcctccctcattatttctccctctccctccgcctctccatctctccttcctccccctccctccccttcccccctttcctctccctccctctcggctcccgcatttcccctcggctgccggcggctccgacatcatgctccggctcctccggccgctgctgctactgctgctgctgcctcccccggggtcccctgagccccccggcctgacccagctgtccccgggggcgcccccgcaggcccccgacttgctctacgctgacgggctgcgcgcctacgcggccggggcttgggcgccggccgtggcgctgctgcgggaggcgctgcggagccaggcggcgctgggccgggtgcggctggattgcggggcgagctgcgcggccgatccgggcgccgcgctccccgccgtgcttctcggggccccggagcccgactccgggccgggacccacgcaggggtcctgggagcgacagcttctccgtgcagcgctccgccgcgcagactgcctgacccagtgcgcagcacggaggctgggccccgggggcgcggcgcggcttcgcgtggggagcgcgctccgggacgccttccgccgtcgggagccctacaactacctgcagagggcctattaccaggtggggagcgggccgggcagctccgagggtcccagccctcaccacgacgctgtcctactttgcgttgcccaggagtaggcggaatgctgttgcccgggccccgcacggggctggggagcgtaccgcgggcctctgcgtaggagctggctaagcgaccgcgaggacctcttgagatcgcagaggagcagccgagggggagtgcgagcagaatgggaatggggcggggaggtcgtgaggtgggacgggagcagatcgaagatggagggacagggccgcctcttcctaggaatgaagcggaggcggtgggggcgaaaccggctctcggacgggaagtgtgcgtgggtgtgtgtgtgtgtcgggggtggtggtgagtgtgaaccttcgcttggggcaggaggtagcttcggaaaggaaggagcagacggaggcaaggttggggtcctccgaggccagacctctgcgggcggggaggggacagcacgccgcagccgccggtaccgcagcagttgcctacgtggctggggaagcggggcgccggttgtactcacctcagctcagggtcctagagacctgcgggttttgctggtcgctgaggtctcccccacttccccacctcacttaagccatcacttccacctggtctcccaaattgaggtcctgaagtcctgagacccatgtcccacccaactccgacgtctttagatcccctttccctcggtgccagccttctgagagtcccaacgttctggcctctaggggatctgcagttygggcggtgggcggttctgattggccagtcttccatgaggctctggggcacccagagtgtgtgtctggggtagggtggggaggctggccagggggcagaggtctgcccccygtcccagggctctgatgccctcctcccttcgcctcctcagttgaagaagctggatctggcagctgcggcagcacacaccttctttgtagcaaaccccatgyacctgcagatgcgggaggacatggctaagwacagacgaatgtcgggagttcggccccagagcttccgggacctggagacgcccccacactgggtgagaatcccagcaccacccctgtcttgccaccagccttttcctggctggatacacaggcctcactaaactgtgcgttgtgctgcttgagcatacagatggggtaatgatcctcagcgaccctggctgggagtccttctctaggacttcgtttccttcctggatgatcactgaaatctgatgttctaacattatgattctgaggcccacccttattcttctccacggtgaagagggacatggagtccttgccccaaatgagaccaacacccctctcctctctacctcccagtttggcaacccctggatcttaggtgactgactgctcccttccccaacaggcagcctatgacactggcctggagctactggggcgccaggaggcaggactggcactgcccaggctagaggaggctcttcaggggagcctggcccagatggagagctgccgtgctgactgtgaggggcctgaggagcagcagggggctgaagaagaggaggatggggctgcgagccaggggggcctctatgaggccattgcaggtaagggtcccgtgtgtgagggggtgggtcggtgcccagggaggggcatgaacaagctgaatggcttatgggtttcctctgcaggacactggattcaggtcctgcagtgccggcaacgctgtgtgggggaarcagccacaygccctggtcgcagcttccctgtcccagacttccttcccaaccagctgaggcggctacatgaggcccatgctcagggtcagttggggaagggtggaaacggggagtgaagatttgcctctgctgctatcctgagctccatctctctatccctcccatctgtctctggatttgtagtttcactgtcagggctgcatgggaaccatcacttcacaaggactctaatttgccctcctttggcgcctgtgacaagctcaggagatgggcttccttctgccttgctgcttctcaccttcctttattttcccccctcttgctcttctttgaactctccagctaaggtatgtttgcaccagtgtttgaaagaaccggcagctgaacttgtctgccagtgggargggggctcttggagttagctgtctggcctctggagaccaccttctccagcactgcctctgccccaaggatcaatgtgctctaagtattcatcccccaacccctgaccttgtcgctccctctccagtgggcaatctgtcccaggctatagaaaatgtcctgagtgtcctgctcttctrcccggaggatgaggctgccaagagggctctgaaccagtaccaggcccagctgggagagccgagacctggcctcggacccagagaggtaatcccctctccacgctcacctgggaggtagccccaaatcaaacaaatagacctgagaagtaacctggacccccaccccccgctggcctcttacccgagcactctagtcacccaaaggactccaagtccagcatctgacttccgtctccactccctgctccccacggcagcctggagttccgattccagccctcagccccgtctctcttgcctttacttcactcctgcctgccaccagcccccaaactcatgcatacacacacccacacactcacacacactcccaccccctayaccctttccagtttaagtccagatgctctgaagctgctgagggggaacgttgaacagaggaaccggggggcatggtgccaggttcaaggagcatggagcacccaggcagtgycctagagccggcgcttccctgccttcctccagctacccctcactgctcatcatctcaccctcaggacatccagcgcttcatcctccgatccctgggrgagaagaggcagctctactatgccatggagcacctggggaccagcttcaaggatcctgtgagtcactccacttytgcccatctcacccctccgcactcccaggagggatggcactttggtttgcaacagagttttccatttttccaccatgaggcttggagaagagtctgccatcccagttttacagggacggagacagtgtgcctgtagttagggcggctttggggtcacgcaggcctaaatgtcagtcctcctctgccccaaacatctctgaacttcaacttgcctctgcctcaatttccttacctgtaagttggaataatcacatctgtttcacagggctgttgaaaccacatcatttgataacaaaatatagaaagctctgttactgctgcttttatttctcttcttgtagttatgagaggaaactgcggggcggaggttatctatggctaggacyagggcatcaagcaggcgttctcagtcttcctggcgctactgatattttggatctgacattttggataattctttgttggggcagagggcagggcctgtcctatgccttggagggtgttcagcagcttccctggtctctacccagtagagatcaatagcacattgacagccccygagtcatggcaatcaatgtttccacactttgcctaatgacccctgggggcagaagtgtcctgcttgagaacgactggctaaatgtgtgaactctgaagctagttttttttatttttatttttatttttggagacagagtctcactctgtcacccaggctggagggcaatggtgcgatcttggctcactgcaacctccacctcccaggttcaagcgattcttctgcctcagcctcctgagtagctgggattacaggtgcccgccatcttgcctggctaatttttgtatttttagtagagatggggtttcaccatgttggccaggctggtcttgaactcctgacttcaggtgatccacccgcctcggacccccaaagatgctgggattacaggcgtgagccaccggaacccggcctgcagctagtttaaaacctaacgctgctttgggaggccgaggcaggtggatcaccagatcaggagttcaagaccagcctggccaacatagtgaaaccctgtctctactaaaaatacaaaaaattagctgggcgtggtggcgggcgcctataatcccagctacctgggatgctgaggcaggagaatcgcttgaacccaggaggcggaggttgcagtgagctgagatcgcgccatagcactccagcctgggcgacagtgtgagactccgtctcaaaaaaacaaaaaacaaaaaacaacaacaaaaaacaactaaccctgtcatttgtagctgtgtgatcttgagcatgttactttacttctctgtgtctcagggctctcaattacaaaatgagcactttaatattctgtttcatgagactgttgtgaactttaaaggataaattccatttccatgaataaagctcttagaatagcccctagcagatagtaagtgctatatgagttatagttgtacttgttgttacagtttgatccactgcccagggctcctgacattgagtcccgggcttttcctacctccgtcttcctctctggaaacagaagaamcttaatgagatatttcagctctaatgtcagggattccaggggctgaccttggtgggtgatgatgcttttctggactgtcgcaggacccctggacccctgcagctctcatccctgaggcacttagagaaaagctcaggtaggatatgccccrtggtgggaggggcttggcccgagctgggaggctgggtctggactgtcctgggcacccactgagcgcatctctcacccctgagagaggatcaagagaagaggccttgggaccatgagcccgtgaagccaaagcccttgacctactggaagggtgagttcctgggagggagaaggcaggagcctggagggtctgggggctgccagctactgctctgcctgcccttaggggatgctcagccccctctgctctgtcttttccctggcagatgtccttctcctggagggtgtgaccttgacccaggattccaggcagctgaatgggtcggagcgggcggtgttggatgggctgctcaccccagccgagtgtggggtgctgctgcagctggctaaggtaggaagacctgcaagctcatcagctcgttcaagactcttggatacaatcacctgttcccttgctcttggcctgcccccttcattctgcctgtcctgattatccaaccgggactgtgcttaccactgcctctcagctgtggataagttccgtctcrtcttaatttagctgacataggtggatgttctttacaaatgaattttgctagaaattgataggaagaacaaaacaaaaaacatgaaggcataaaaatggatgagtgtgcaggtaaggattgcttggttagccaagagtttagttactggcttggctgatggctcagcagacacgcaggcctttctttccctcctagtttaggttgaatgactcatactcaccaggttgaggctaccattttatgaagcttcaacccttatcttaggttagtgctcattcagtaatatactcactgagtagctgctatacactagaaactgctaggttctagggagaggaagatgattatagactctgccctttgggagctcaagtgtagaggtggaaacagacaaggaaatacataatataagcaggtggtaagtttggtaaaagaagtatgtttttgggctgggtatggtggctcatgcctgtaatcccagcaatttgggaggccgaggtgggtggatcacctgaggctgggagttcgagaccagcctgaccaacatggagaaaccctgtctctaataaaaatacaaaaaagttagccaggcgtggtggcacatgcctgtaatcccaggtactcgggaggctgaggcaggagaagcgcctgaacccgggaggcggaggttgtggtgagctgatctcgtgccattgcactccagcgtgggcaacaagagcgaaactccatctcaaaaaaaaaaaaaaaaagtatgtcaaatagaagcactgaaatgcagttatagaaggcttgctggagaggtggtatttgagctcagtcttaaggatgagttagtcaggcgattgggggtggaatcagtctaagagggagaagagcatggtgcattctgggaactgcagtcaagcacaggggtgagagcagggccagctccatagtcattacctgtgtgatcttgggcaatttattttaacatctctgagcctaatttgctcatctataaaatgaggataataatagtgtttttgtcatagtgtcgttgtgaggattaaatgagttagcacatgataaagctcttagaacacagaatcatcactggctgggtgtggtggctcatgcctgtaatcccagcactttaggaggtcaaggcaggtggatcacttgaggtcaggagttcaagaccagcctggccaacatggtgaaacccggtctttactaaaaatacaaaaaaattagtgggcattgtggcaggtgccagtaatcccaactactggggaggctgaggcaggagaatcgcttgaacccaggaggcggaggtcgcagtgagccgagatcgcaccattgcagtccagcctgggcaacaagatcaaaactccgcctcgaaaaataaatttttttaaataattaattaattaattaattaattaaaaaagaacatagaatcatcagggtgtatgttaccaagagacagtatagggraagagggagagagcccacacatgaaggccgagggacagtgagtgtcttctgtggcctcccaaggagtttgggctttatctgtgtatggtagacagctgttgcaggattttaggacggttgacttttgcattcctgtagtacctggaatcaggtgcagggtctggagtcacctgtaggagtggtagagccctctagtggcagtctgtagaatgcagtgggagaaagacccggaaaaggggagtaattgacgaatgccaccgttggctggcgaggtggctcacacctgtaatcccagcactttgggaggctgaggcaggcgaatggcttgagcccaggagttccaggccagcctgagcaacgtggtaaaaccccgtctctacaaaaatacaaaaaattagctgggcctatgcgcctatatgttcccacctacttgggaggctgaggtgggaggacctctggagcctgggaggtggagattgcagtgagctatgatggcgccactgcactccagcctgggcgatagagcaagaccccgtctcaaaaacaaaaaatgaaaaaaaaaaaaaaaccccaggttagacggcttgggtgactaggtgtctctcagaagtgagatttgtatgcaggcgtaactagatagtggtgcttaaacaaattcaaaaagtagacaaaaaacgggtgtcagaaaagcgaataattccagtgtagacatccagatattaggagacccccaggtagtgagagtggtcgcggaggtggctgggtagttgtgactcagtatcaaggagtgggggagccacgsagtccacagtttctccgagagcatgtcaggtgggaagaggtcagagagggatagcccgctgatgctgtctccctaccgccagtctggcctaactgtggaacttcctcttagggtcctgtttccagagggactcctctattcttggctcatcggggattaatgatcaagcccttcctgcctagttcccagctctgccccacttttccagctgtccctaccctctcagaggcccccttactgctgtaggaagctctcccgagttctctscacagtccccttagtaagcgggattccagcccgtaccagagagggacaatcggacagccgtggcggtgggcactctctgggaaagagcagcagctcaggaagacgagccacaacagaactgtgggagcatctagcttcttctggagagcgggagggccggagggagggtcttgcagccctgcagacagtgaggggctgggggagtgactccacggtaaactccttcctatttaggatgcagctggggctggagccaggtctggctatcgtggtcgccgctcccctcacaccccccatgaacgcttcgaggggctcacggtgcttaaggctgckcaggtgagcacaggaggcacccgggcccgtctgatgcccagacctggaggagaggctgtgcaggaagccgggccccagggcctgggcttttgtgaaggagctttcttgggacygagactacctgataggacccagcgtggagaaaagggatgttctgagagctggggccggggttgttgtcatggagagagaaggagcagtttgggctgatggacagagytggatgctgacagactccaaacccaygggtggagagyggcagagttgggcaggggctagggccgagaccaccctcccmttgccttcctccttttctgccctgcctttcactgcctgcagctggcccgggctgggacagtgggcagtcagggtgctaagctgcttctggaggtgagcgagcgggtgcrgaccttgacccaggcctacttctccccggaacggcccctgcatctgtccttcacccacctggtgtgccgcagcgccatagaaggtacgacagggaccccccactgctcttctccaacctcaggccctgcccccaggacactgcccccaagagccccggggtggacgtgcacggcctgagcccacagggtggcagatgggcacaggggcacagaggtacccccagacccctttgtgtcctaggagagcaagagcagcgcatggacctgagtcacccagtgcacgcagacaactgcgtcctggaccctgacacgggagagtgctggygggagcccccagcctacacctatcgggactacaggtgggcagcccctctagtggtcaggcaggtgggcagacaaaggtcatcccactgccggcctgggcctgggttggggtctcactgcctcttgcttttttccctccccagcggactcctctacctcaacgatgacttccagggtggggacctgttcttcacggagcccaacgccctcactgtcacggtgcgtggagtggggggtgtgacggtgtgacaaagggcccagctgtggggtcaggattcaaaacagaaggctccagaggcaaatgcagggaaatggccagggcttttaaccctttcacttccccgcctccgcagccctcccgctgcttcctccgtagcaaggtctctaagtggccgaatcaaccctaccatcagtatttgtctcgcctcctaaagaagggtgaatgaagcacagcttgcaggtgcctccaggactccatggccctattctagggatttggggaacttgaaatagtccttcctctttgcagcgaggtgagcacagtggctggcgcacagataccagggccgccttgactggggctcggattctgaacctttctgaggtttagtttcctagactggggtgataataatagtacgtattttaaagggtcattgtaggaagtaatttaggtaatgtacctaaaagaatgaggcagcrcctggtaatgataagcaattaatgaatgttaggtgggaaatttccggacacyaggggctaggattgggtaggaggagaggggcagtgattgttcatctgggtgtggggtgtgaaaatggytccaatatctgtatccccttctgcatagagtctggtactgcatgcacagccccagattgcttcaagccctggattcaaagggctgagtgggaaaaatcagggtaccaggggtcaggaaccaacaggagaccatccgtggagacccctttttcctttggttcccaactcctcttgcatttttgctctgcaagttgaagctgatttctcatttgccccaagctagtccckgaattaaggagtaggaagtggtagcgagagagctgatcctctctgtgcccctgtccccatcctgctctagggagtgagggccaagttctctgagagagccaatccctggagctgaacctgccctcatccctccaggctcgggtgcgtcctcgctgtgggcgccttgtggccttcagctccggtgtcgagaatccccatggggtgtgggccgtgactcggggacggcgctgtgccctggcactgtggcacacgtgggcacctgagcacagggagcaggtaaggagcggggtaggaagggatgtggttctcctggtgcrtgaagggtgggcaaggagcccccgagaaggctcacagtcggtgagggtcaggggctgagctgacccagggaaggtgggtgcagggaatgggccacactctcctccccaaccccaggagtgganagaagccaaagaactgctgcaggagtcacaggaggaggaggaagaggaagaggaagaaaygcccagcaaagacccttccccagagccccctagccgcaggcaccagagggtccaagacaagactggaagggcacctcgggttcgggaggagctgtgagtggctgagccagctccttgaggatgtggccacttgacttgtggaaggccatcttgatgccaggacrcacaggaagcccctgtgtgacatcaggagcagaacagcaagctctctgtccctgcacccccaccatcttggggacctacaagggcctggactcagaggacagtgcacaggctagcctggagctcaccaggcctgsggagctgggacggggccccgctgccggacctgcagccctggacagatggggaacmctgtgcctccctgaacrgaaatggcaggggaggaggctgatgctttaaatgaagaggatggtggggttgggaggtataaccctgctcctctctcccagtctgtgcaataaaggtcgtgaagatctctcmgccaggggccagtcaagtgtatcacagattctgtgatggctggaggtgggggtggctctggctggcctgggaggagacaggtgtctttgggcctcccagaggcggggcgcctggagcctgtgatttgtcagggaaatctcagccacctgctcccctcatgcaaatgacccaagcccctggcagctgctccttaggcctccaagtgtaagccctgtcttccctctctgagctttgctgagacttagggccgcctgctttctctctgacccctgctttcacagcctcgagagggcaaggagggggccagaccccagcctgggagcagcgtgcgggccttccctccacttgaaatccgttgcccgcccacaataggggcagacctgtccatccttctctgtgggtcccctgtacctttctcccccaacaggatcagacccagaggcagctggttggggtttgtcgagaagaaggattatccagatcagtcctttctaatctcagctcctgcctgtaccctcccatactcaccaaaccctcttccccaccaccctgagctgaggagcacagtttgaggtactgacaatggggccatctatcacccttatatcccacctcctggcctggttgctaagtggccctgactgccaagatcatcaccatggatgggggccgggaccaggggggccactggagctgtagttgtctgctcctttgcacccctcccaaaccccaacccttaatcctcacagctttgctctaatcctgtggggcctgatgctcttatctctgcctgcagagactgaccagggaagcaccccttcaccccctcctctctcagggcttgtggtgggggctgcccctctctatggccccacactcctgcccccaaccctcctcccggctgggcccaagtctctctggaatccgtacacctccctccctccccccaccccttccccccacccctgccagctgatttcatttgcctgacgttgtggttggctctacccttccctgtcaggcccccccaaccccccgccggtcggggccaggccaggccaggccagctcctctggcagcagagcctgggcaggtgacgggcgggcgcgggcgtcgcagctgagggagtaaggaggctcccaggaaccggagctggaaacccggccgaggtccagccagagcccaagtaagagggagctggcctgggctctgctctcctgggctggggcgcaggcagggctcaggcaggctggggctggacgcaaaggacctcaaacttggagggcctagctggggagagggtgcagccacccagtcgtttccctgtgtcttggagtctggtgtgggcacgaagggcagaagcacagcctggtggggggttcctcaacaccgaccccatgttcctggcaggagccagagtgacccctcgacctgtcagccatgggggagatggagcaactgcgtcaggaagcggagcagctcaagaagcagattgcagtaactccagagccctacccctggggccccagaaaacagctggggacatgaggagcgtggcccagggggagggggctgggtttgctcttgagtgactagaagtgaccagggactttctaaacttggttcgcatatttgagacccccaagccccagagccccaagaccaacctgccctgaaggcccatgcacctgccacccccacctcgcccttgctcccctgatgtctgctttccctgcaggatgccaggaaagcctgtgctgacgttactctggcagaggtaagaccccctgtcccccggaaggcagggcatggggggaggggaagggagctccccgacccgcaatagcgcgttgctccgagcattagtacagcacgtccttggagtgaggaaacccattaattaattcattcgaccaacattttagcgggacctgctctgagccaggcaccatattggatgcgaaagatgcggacacggttcctattctcatccgtagaacaagagtgaccacagccccctcccagggccttgaagatgaagaagcgatagtactttgtaaattataaagcccttgtagactctagctgctagttttctatgctgtattttgtcaattctaagatgcacatttcttcacattttgacatctctgaaatcaaggtgcattcagcaatggatcattgtttcaattagaattgacagcatcttttctttcttagtgatgcatcttagattggattaaatatgttaatagtgaacactttttatgagccagatactgggctaagctgcataaatacctgatttcattgaattttcatgatatctctgtaaggtaggtgctatgataagcctcattttacaccttgagtaaacagactcagggaggtgaagcaacttgcccaagataacaaagcaggccgggcgcagtggttcacgcctgtaatcccagccctttgggagactgacgtgaaaggatcacttgagctcaggagtttgagaccagcctgggcaacatagtgagatctcttcttaatataaaaaaaattgcttttaactttttaaaaaaagatagcaatgcaagtgatggcaaatcaagtctgttcactctggacccccagcctaagtctaaaatgtggttagagctcaaggggcatagtaccacagatttcaggaggtacagttcagggtcatggtgatgccccaggcacccagttaaaaagctagccgtgctgcagcggtgggtgcaagcaggctcctctcggcttgggagagccagctctgtgcatctcttcccaaatctgtttccaatgacctcacattggcagctggaaactggtcaaagtgcaagtattcgtatcgtggaaatcaccttcccaccttcctcaccaacactggagaggtgcttgttaaacacttacaagcaacacacctctggccatgcatgcatctctttcccacatcagtctaagacactccagggcagagacttatttctctaaggctgggggcctgacctagagcctggcacagagcgggaacttgtatagatcagtggcagtgacagacatctgggcacgtaacctgctcaccctgatattcagtgcccctctctctgcagctggtgtctggcctagaggtggtgggacgagtccagatgcggacgcggcggacgttaaggggacacctggccaagatttacgccatgcactgggccactgattctaagtgaggcttgggggggaaccgagaatgggagggtgagagcgggagtgaggaaggcgggaaggggaggcttgcatgatatgggatgccctctccccaggctgctggtaagtgcctcgcaagatgggaagctgatcgtgtgggacagctacaccaccaacaaggtaccagccctgcctccctgagcctccaccactgcatccttcctaagggcgccatgcctaccctcctgtgcccagctgggagcttggctccggtcccatctctgctcaaaccaccctccctgcaggtgcacgccatcccactgcgctcctcctgggtcatgacctgtgcctatgccccatcagggaactttgtggcatgtggggggctggacaacatgtgttccatctacaacctcaaatcccgtgagggcaatgtcaaggtcagccgggagctttctgctcacacaggtgagggagagaccctctcctcccctcctgaggggttcagggaaccctgggcttccagtgggctgtggctctgcagccagggcactgtccttctaaccgcctccaggttatctctcctgctgccgcttcctggatgacaacaatattgtgaccagctcgggggacaccacgtggtgaggctgaacattgctggtgctggggcttgggagtgggcccggcctttctctaacagtctccctccattttggcagtgccttgtgggacattgagactgggcagcagaagactgtatttgtgggacacacgggtgactgcatgagcctggctgtgtctcctgacttcaatctcttcatttcgggggcctgtgatgccagtgccaagctctgggatgtgcgagaggggacctgccgtcagactttcactggccacgagtcggacatcaacgccatctgtgtgagtgcaccccccaccccagcttcactccaactccttccccgacactccccacaacacatacaatacacatcctctgcccctcccatagcttccctagccctttcttactgtattttttttttttttttttttttttttgagacagagtctcactttgtcgcccaggctggagtgcagtggtgcaatcttggctcactgcaacctctgcctcctgggttggagcaattctcctgcttcagcctcctgagtagctgggattacaggtgtgcgccaccatgcccggctaatttttgtatttttagtagagatggggttttgccatgttggccaggctggtcttgaactcttgacctgaggtgatcctcccacctcagcttcccagagtgcagtgctgggattacagatgtgagccactgtgcccagtcttccctagccctttctttctttcctttttttggagacagagtctcacactgttgcccagtctggatgcagtggtgctatcatagctcaccgcagtctcaacctccagggttcaaccaatcctcccaccacagcctcctgagtagctgggactacagatgcgtgtgaccacgcttggctaatgttttgatttttgtgtagagatgggttcccactatgttgcccaggctgagctggaacttctgagctcaagcgatcctcctgcctcagtctcccaaaatattgggattacaggcatgagccaccacgcctagcccattttatcacgtttgctttatcattttttctctgtagagaaatagccatagatacacacacacatacacacttagatgtagatatacattttctttctgtgtcttttgaaagtaggttgcagacatcatgtttctttaccccttaagtacttcccgaaacaaagcccttctgtagcataatcactgtatgattcttaagatcaggaaactcaacattgacacaatactacagtctacagtctatattcaaatttcaccaatagcctcaaaaatgtccataatagctcatgtttttttctgtccaggatccaatccagaaacgtgcattacctttcctcgccatatctttttcgtcaccacctttaaactggaactgttttcccacctttgtcttttatgtcattgacgtttttgaagagtacaaaccagttttctgtagactctccctccgtttgagcttatctgacatttgctcgccgtgagatccaggccttgcatttgtactggaccctgttcttacacaccctgatccagcccacttgtgtagtctgggagtctgggacaacctccgtccgcccttctagccgggtcactgcaggcaagccttggtgctcttgcctgcgacgtggaaatgatgcctgcctgcagcgctgtatagtgcagagcgggcgaggggcatagggaagtcactggcacgtggtatgtgttggcagggctgcttctcaccccaaaccaagggagggacaggcagggaggctgagagcagcggcttgccctggagctgtcaggtgggaggcagagggcgggagaggctgtgggctgcccaggtctgatccctgacccacttgccacccgtgccctcagttcttccccaatggagaggccatctgcacgggctcggatgacgcttcctgccgcttgtttgacctgcgggcagaccaggagctgatctgcttctcccacgagagcatcatctgcggcatcacgtccgtggccttctccctcagtggccgcctactattcgctggctacgacgacttcaactgcaatgtctgggactccatgaagtctgagcgtgtgggtaagggccagccctggctgctgcttcctcagctggaaggaccc

SEQ ID NO: 17926 - DNA, 12646 bp, Homo sapiens
  misc_feature (1)...(12646): n = A,T,C or G, or insertion/deletion polymorphism (see Tables 1-2)
aggctcaagcgattcttctgcctcagcctcccgagtagctgggactacaggtgcgagccaccacgcccagctaatttttgtatttttagtagagacagggtgtcaccatattggccaggctggtctcgaactcctagacctcgtgatctgcccaccttggcctcccaaagtgctgggattacaggtgtgaaccactgcgcccggccttacctgttaaattaatgttagtggaaacacattgccaaactcaatttttcaagtacatgtatcttcaaaatacaaatatacttcaaagctactgtactttgaaatatgttatcttcaaaaatgacattatcactaagaatataggaagccttaagaattgaatatggtggttcaaaattagtatttttcctctttgtaggggaaatcacccaaaagtaacaatcagaactgttaccacctgactggttcttgcccactgcacagataaaaccaaaacactgagccagcaggagttgcagcagagaaagagtttgattattgcaaggcaatagagtgaggaggacgggatacatttcccagatccacctcaccaagaattcagaggctaaggtttttaaggatgatttggcaggtagggcattaggaaacagatgttgtggattggttgggggatgaaatcataggagtgttgaaactgtcttcatgtgctgagtcatttcctgcaggggagtggtcagaggaccggttgagtcagttcctttgttgcagtcacggtcactgttcaagctggtgtcagttgattcacctgaaggcaaagtctgaaaaatatctcagagatcagtctcaggtttcacaatagcgcttgtgactgcctgttacataactcctgagcaataagcaattatagaaaagcaaacaagagaacaatgatgggctatcattcaactacgcctacagcttaagaggtgagctccctggtgattgaaactgcttgcactcctcagttgatccaacttctggaaaatacaaaggcagtctgcatgacttaaagatcattggttctttttctttttttttttttttttgagacagagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcacaaaaaaaaaaaaggactatgttacgtaatcatgcctggtagatgaaaatgtcaaaggggaaagaaagtaagtgtaacaaacatctattagctgtgcctctattttaacaaaatttaggcctctctaaattacaaagtaagtggaatggttgagtgtgggagggcattaggggtgcagattttagaagtattttattagatttagggtttgggattagattagatgaggggtaataaatgattgctagggagaatgactggatcagggaacagaaattaacttgtaggtagttctctttggaatttaaatgatccttggagagagtcagtcattatcttgaaaaagggtctgtttaggtgtggttacattttcggtcttacagatgttaccaaaacacccaagattcagtctaggtcctgttgctcccctcacagaaagccaatcattaagacaatgagtattgccagggaagaaggctgtaatccagtgctgcagcagaggagatgggagatcagtcccaaatccaactccctgactgtctaaaatttgggatttgtatagcagggaagaaatgtaactatgtgtggaaaaacgggaattttagggaggggtaaggaagagaaaggggtcaacaggaagcaggcagtcatgattggtgaggcgtctggctccctttgtccagatgtgatgatctggtaagtttcagctccttgatactgtctgggaggactgatggtttcttttctgagaaagcaactcagataagacagatgtaattttctcaagttttaagaccaggaggataaatttctatgtttattaaaaagaaccataaacatcacctctacaggacaattgggcaggtttcccagggaagggaagaaaactattgttctccttggtgggtctggagcttaggcaggtaaaggaacttgagcctctttggaagagctggtgaggggtgggtagatcagagagaccttgagtcttcttagttcaggatgtaaacatgccatattttggggaattggtttctaagcctcaacattacagacaggaatgaaaaccgaccttgtctggaggagaactttccaagtttggtacagaggactcccacagattatgatgaagccatcaactcacaaactggattaccaaacacacaagaaggcaatcactgtgagagtcagcagaaacaactgatttagatttctcaaatatttctagtattagaattataattacatatatacgacataaaacagctgtgtatgaagtgtttaaagaagtatataatttaaaaagtgagccttcaactagaaacaggaatgaacagaaacattttggaaacaatccaaaaagaaccaggaattaaaaatataatggggtgactcacatctgtaatcccagcactttgggaggctaaggcgtgtggatcctttgagatcaggagtttgagaccagcccagtcaacatggcaaaaccccgtcactacaaaaatacaaaaattagccaggcatgatggcacatgcctgtaatcccaccactttgggaggccgaagggtggatcatttgcggtctggaattcaagacaagcctggccaacatgatgaaaccccatccctactaaaaagacaaaaattagtcaggtgtggcagtgtgcgccttataatcccagctgcttgggaggctgaggcaggaggttgcagtgagccgagatcgcaccactgcactccagcctggccacagagcgagacttcgtctcaaaacaaaaaaaaaaaaaatgaggtcggggatggggaagtggtggtaggaactcagtggagggatgaactagcagattagataactcaagtgagaatttgtgaaccagaaaatatatctaaataactgatccagaatgcacagggagaaacaaggaaatggaaaatatgaaaaaaaggttaaaagatatgtaagataggatgagaatgagacaggatagttcatagttcaaggtcaagtcttgaccttgaccccctttgtgggcaggaactggagtggcttgtttcactcagcctgcagtccgtggatggctaagtgttaacagcccaggctgacagccttctgcacctgcccttcttgacacccgaattcttattcagagtccaggaagaatcaggtcacataaactttttgaagggtagtgtatatggaagattttactgtgtgataaaagtggctctcagcaggatggggaattggaaaggggatggtatgggaagaaactgctctttctctgaagccgtgtctatctgtagtttccgatgctcagctgcatgtattcctgatgctcagcagcttgtatccccgaccacttgcatcagctgctgaggttgctctttttcttccttttgttctgctagctggtctggtatttataggcatatgacagggggtggagcgggccaaaaaagcaatcatttgggtggaaaaaatggggtcagctgtttcacttaggactgaggttccaggcttgagggtgaagtttagcctggagcccagcagttctgcatcaagaagatttaacatacacttagtttcaattagaaagatagtgagaaaagagtagaggcaatgtgtaaagagataatggctgtgaatttcccagaactggtgagaagcatatacccacagatcttgaaagcaaagaaaaaaaaaaataaggaaacagggaaacaaatttaaaatataatttttaaaaaattgcagagaaaaaggaaacgagtctaaaaatgtaaaatggcatattactaaaaaagattccaagtagtcaagagcaatctatgtcctgataaaattattagatttcaaaaagaattatttaaaagccagagaataaatcacttataatgagaaaaacaggctgatttcagatttctccacagcatttgttcttagaagacattatgtatacataccaataaaatcctccagcaaagagatgtgacccaggaattttgtatgcagtcaaactgttgcttaaatataaaggtaggtggtgtggtgcctcacgtctctaattctagcactttgggaggctgaggcaggaggattccttgatcccaggagttcaagaccagcctgggcaacatggtgacaccttgtccctaataaaaataaaattaaaaaaaaatttagccaggcatgatgatgcatgcctacagttccagctacctgggaggctgaggtgggaggatcgcttgagtgcaggagattgaggctgtggtgagccatggttgcaccaccacactccagcctaggtgacacagtgagaccctgtctcaaaacaagacaaaacaaacacacacacatatatatatttgtttatatacatacatatgtatgtatgtatataaagccaaagagttttgaaaacacaacatcttaagggtattgtttgtattaactcacatgaagaatccaccaatggacaaatgttgtcaaaccagagatgactagaaagcactgggtagatagcataagcgctgctggtaaattggcttaaaactaaaataaatgtgggattgttgttattaaacagaacaaatataaacattaagaaacataatataattaacaaaaattgagaagttgtagagagaaaaaggaggtggaaggaagaagaaagctactaatttaattattagcaattatcagaatagggcattgataatagtggttaaagaaagaagatcagggccgggcacagtggctcatgactgtaatcccagaactttgggaggccgaggcaggtagatcacaaggtcaggagatggagaccatcacggccaacatggtaaaccccgtctctaccaaatacaaaaattagctgggcctggtggtgtggcacacacctgtaatcccagctactcaggagcgtgaggcaggagaatcgcttgaacctgggaggaggaggttgcagtgagccaagatcgcgacactgccctccagcctgggtgacagagcgagactccatctcaaagaaaaaaaaaaaagaaagaagatcagacatttgacaaaatacaaacatgcataattatcagaagaaatggacatacaacaaaaacatctcacatacgaaaacatctcacatacgaaaatatttttaaccttgaaaccatgaattataacatgaaataacatgatatagtcatgaccaaacatgtctttcatatcaaaaattttaaacaattgtaataattgtaaatgagtttaattcatctagtaaaaggggaaaaagtcagatagaaccacaaataaaaaataattcaataccataaaaacaaagacaaacctaaaactaatagattcagaaggacagaaaatgaagagaaaaaaagataaatgggcaaacctgtactaggctaatgcaaacgaaagtaattgttatcttaatttcaaatatggagaaaacgaaactactggggaaagggagggtccactgagaaccatcccagtaactcaaccacggctggtcttcgctggacaccatgaaycacactgtccaaaccttcttctctcctgtcaacagcggccagccccccaactatgagatgctcaaggaggagcacaaggtggctgtgctgggggtgccccacaaccctgctcccccaacgtccaccgtgatccacatccgcagcaagacctccgtgccccaccatgtcgtctggtccctgttcaacaccctcttcatgracccctgctgcctgggcttcatarcatttgcctactccgtgaagtctagggacaggaagatggttggcaacgtgactggggcccaggcctatgcctccaccaccaagtgcctgaacatctgggccctgattttgggcatcctcatgaccattctgctcatcatcatcccagtattaatcttccaagcccatmgatagatcaggagacatcactgaggccaggagatctacccatgacctgtatcctttgtactccaccttccattcctcgccctgctcccggagccaagtcctgtatcagccctttatcctcacacacttttttacgacggcattcaataaagtgtacgtgtttctggtaaaataaataaataaataaattcaaatatgactgagtttgggggaataagtgctaaataagacacagacactttatatgctaaaggttgaaattcacaaaaataacagttatgaatatctatttacaaataacatggcattgatataagcatagcccttaaagcaaaagttaaggtgttggaggccatgggctgttgaccccctaaaggtttgctaaaaaatcaccgacatgaagcagattgacgaatagaagaaaaagcgtacaaatttatttaacatgtatacacaggagccttcagaatgcggacccaatttcccaataagtaacagaagcttatataccaccttgaaattgcagaaacaatgcggactcagagtatgtccaaaaacaggatttagtggcaaggcaggttatgggaggaagaaaggaaggaagaggctttgctagcaatggtggccttgttgtacagagaagcctccctcagagggaatacatggtaaaagtttatttccacacctttaaaggtgccagactgccagtctctcctggatcgggaaaggaatagaaaagagaggcagggctgcattagtggagattctgtacagatgcaaattttccccacaaaggacagctttgctaggccacttccgttttctgaccaaggggcagccatttcaaaatatgtcaaagaaatatatttggggctaaaatattttaatttccttcaaggtctacaacagaaaagtagagagaaatacattaatggtgggatactttaactcttctcaaaagtatgcagaaagccaaacaagggtatagtgaatttataattagtaaggtagatatatgtcaaattctgtgcttctgaaaacagaaaatacatatttttatatttccaataaaaaaaccttcaataaatttcaaaaagataaaacagtacagctgggcacactagctcaagcctgtaatcccagcactttgggaggccaaggcaggtggattgcctgaggtcaggagtttgagactagcctggccaacatggtgaaaccccgtctctactaagaatacaaaaattagccaggcaaagtagaaggcacctgtaatcccagctactccggaggcgaaggcaggagaattgtttgaacctgggaggtggaggttgcagggagccgagatagcaccactgcactccagtctgggtgacagagagagactctgtctcaaaaagagagaaaaaaaaaaaaaaaggataaaacagtacagacaactttatctagtaccaaggcaataaaactagaagacaataatataaggaggaaaccaaagcccctacgtatttggaaataaaatatcttggttttaaatagctctcgggcccaagaggaaaatccaaatgaaattgcagaccatctaaaaagtaatgataacaaaaatattgcacatcagactctatatgatactgctgaagcagtgttcaaacattgtattttaaatatctttattacaagttatgaacaatgaaataaatttctgaaattcttttctacacttatcttaaagaatattatatagaattactataatcacctgttgactccttccagcccactgcacagacaaaaatcgatttactgagacctcagcattgcagtagagaaaaatttgacacaaggccaggcacacagaagatggtgttactcctcaagtcagtttccttgaaggctcagagattagggtttttaatggacaatttggtgggcagggagctagggaatgggtactgctgagtgatcagggaggaaatcacaggggtgtggaaaatagtccttgtgcacttagtccacttctggtggagccacaggaccagctgagtcatgagtcacgagtccaggtggagtcagtctgagaaaatctcaaaaaaaaaaaaaaaaaaaaatctcaggttttacagtagtggtgttatctataggagcaattggagaagtcacaaatcctgtgacctctggccacaggactcctgagcaataagagattgtagaaactatgcctacattttagcagaactcaggcccctcccataaccctaatcttatggcctttcattagttttaaaaaggcagtttcagcccctgaacagggagggaattcattttagggaaggattattataatctttgcttcaaagccaaactatatatttttatttttgagacagagtctcactctgttgcccctgagctggagtgtagtggggcaatcttggctcactgcaacctctgcctcctgagttaaagcgattctcctgcctcagcctcccaagtagctgggattacaggcacccaccactgtacccggctcattttttgtattttttgtagagatggggtttcaccatgttggccaggctggtcttgaactcctgacctcaggtgatttccccgccttggcctcccaaagtgctgggattacaggcatgaaccaccgcacctggcccgaagttaaactattgacaactacattcctcccagagttagcttggtctgtgcccaggtatgaccaagaacagcttggaggtaagaagcaggatggagtcaattacatcagatttcttttactgtcataattttgcaggggcagcttcattacaaatgcagaacttagtaataaaagtcatattgttggctgggcgcagtggcttatgcctgtaatcccagcactttgggaggccgaggcggctggatcacgaggtcaggagttcgagaccatcctggctaacatggtgaaaccccgtctctactaaatgtacaaaaaattagccgggcgtgatggcgggtgcctgtagtcccagctacttgggaggctgaggcaggagaatggtgtgaacccgggagacggagcttgcagtgagccgagattgcaccactgcactccggcctgggcgacagagcgagactccgtctcaaaaaaaaaaaaaagtcatattgttagatatgaattctaaacttgttttcaaagaatatgtcagtatgttcaattatttaccttctacttttaaacttcctcataaagcaacctttttcaattacctgctccaccctgactcattttgatcacctgctccaacctgactcatttcaatcacctgctccaacctgactcatttcaatcacctgctccaccctgacgcgttctgattacctgctccaccctgattcattcccattacctgctccaccttgactcattcccatgacctgctccaccctgactcattcccattacctgctctgtcataaccatttttcccgccaaaccactcaccccatcactctctttaaattggccaatcggaattagtttagcctgggcggtctaaccctagccaataggggaatgacacagcagcaggggccacctgaatcagggataagaaccccctccccttccttgtccaagtgtgtgctcaccattgctccatctgtaagggcgcacccttctatagaagtaccttgccttgctgagaattaaaaagaaaattttatattcgagtgctatttcttttgcggcactgaaactttatatataacaatattaataaacaaagcaaggccgggcgcagtgactcacgcctgtaatcccagcactttgggaggccgaggtgggtggatcacgaggtcaggagatcgagaccatcctggctaacatggtgaaacgccgtctctactaaaaaaatacaaaaaaattagccgggcgtggtgacgggcgcctgtagtcccagctactcgggagctgaggcagaagaatggcgtgaacccgggaggcggagcttgcagtgagccgagatcacgccactgcactccagcctgggcgacagagcgagactctatctcaaaaaaaaaaaaaaaaaaaagaaacaaagcaaaaaatttgactgggcatggtggcacacgcctgtaattccagcatttggggaagccgaggcgggtaaattgcttgagcccaggagtttgagagcaacctgggcaacatggcgaaaccctgtctctacaaaaaaattagcctggcgtggtggcaagcgcaggtagaaccagctactgggaaggctaaggtggaagaatcacgtgagcctgggaagttgaggctgcagtgagccatgattgcaccactacactccagcttaggtgacagagcaagactctgtctcaaaaaaaaaaaaaaaaaaaggaagaaacaaaacaaaaaatgtaaaaataaatactttaataatatgccataatgacatgtatactgatccggatttgtatctagggattgtactgtgggagtccaaaaacctgctgcatgtgtaaaatagttatactatttaataagcaaaagtcactagcagcaaaattatccaaaaatcagtggagttctaggaataaagtatctcttgtggtgccaaagcaaaaatgcaagtctagacctcagcaaggcaagactttatcaaaggaggctatgacaataggaagacactcaaagcctaagctagaaacctctcagggaaggggtgtgtgagcagaaactgtggcaaaggcagctgtggaaagagaaaagagaaaagggtgtattcagtttgctaggggaagtcttgaacttaatgaactgtgtcaaaaaagaaaaggaaggacaaggcagcacagtttagttggtggataggtatatggagtggggtttgggtctgagagagagcaaacaagttacaatgcagaaagtttgcataaagctgagggcctagctgtccttgtcaaagcagactgaagttacatgaagcactaagtttaaccatccctgttactggctatctgtgcacacttaaatgattttggcttttaagcagatataaattgcatatattccaagtcatgttgacacaaacgtatcttagaatctggctctacaaatattcaaagtaggtcacatccacaggtgaacaaatcgtaaggcagctggaaaacttcactgtattagttaataagagaataggccaggtgcagtggctcactcctataatcccagcactttgggaggccaaggtgggtaaatcacttgaggtcaggagctcaagatcagcctggccaacatggtgaaatcttgtctctactaaaaaagtaggtgaggaccgggcacggtggcttatgcctgtaatcccagcactttgggaggctgaggtgggtggatcacgcagtaaggagatggagaccatcctggctaacatgctgaaaccccgcctctactaaaaatacaaaaattagccaggcatggtggcacatgcctctaatcccagctactcaggaggctgaggcaggagaatcgcttgaacgcgggaggcagagcttgcagtgagccgagatcgtgccactgcactccagcctgggcgacagaggagactctgtctcaaaaaaacaaacaaacaaacaaacaaaaaacagctggacatggtggcaggcacctgtaatccccgttactcacaagtctgaggcaggaaaatcacttgaacccaggagacggagattgcagtgagccaagatcgtgccactgcactccagagcgagactccatcaagaaagaaagaagatgaaggaaggaaggaaggaaggaagtaaggaaggaaagaaagaaggaaggaagggaaagaaagaaagaaggaaagcatcaaaatgaatgaagttaaagatcagccaaacaaagctaagaaagcaaagaaattgaaaaaataaaaatagaaactacttaattagaaaaaaagtagaattaaatatataatccaagagctggttacttgaaaaataaaaaagataggcttttagctaagttaactaggaaaaacagctaaaatatacttgatgcaataatttggaaattctagataaaatggattatttttaaagaaagtatgacttgccaaaactgatcttaaaaaaaaaaacagaaaatctaaataagcaaataattaccataaaagaagtataaagagctattccac

SEQ ID NO: 17927 - DNA, 34895 bp, Homo sapiens
ggcaaagaacctgaacttcaaagaagttatacaaatgaccagtaaacatatgaaaagatgttcaacatcactaaccactagagaaatacaaatcaaaaccataatgaaataccatttcacaccccctaggatggctattataaaaaacagaaaataacaaatgttggcaaggatatggagaaattggaactcttgtgcattgctgtaggaatgtaaaatggtgcaaccactgtcaaaaagagtatgacagtttctcaacagatcaaacataaaattaccatgtatattagtcaaggttctccacagagacaaaaccaataggctatatatagagagaaagatacaagaggggatttattaggggaattggctcatgtgattatggaggctgataagtcccacaacaggctttctgcaaattggagaccttagaatgccagtagcatggccccattcaagtctgaaggcatgagaacccagggggctgctagagtccaaaggataaagagcctggagtgctgatgtctaagggcaggagaagagtgtatcccacctgcaagagcgagaaaaatctctctgctatttttgttctatcctggctccagctgattagatggtgcctgcccacattgagggcaaatcttccccacttagtccactcacactcacatgccaatatcctctgtaaacacactcacagaaacaccaaaaaataatgcttcacctgttctctagttattccttaatccagacaagttgacacctaaaactaatcatcacaccatgggacctagcaattccacttctgggcacaaaagaactgaaagccgggactcaaagagatacttgtatacccatgttcatagcagtatgattcacaatggccaaaaggtgaaagcaacccaagtgtccattaacagatgaataaacaaaatgtgtatttatatataatatatatacaataaaatattcagtcttaaaaactaaagaaattctgacacatggataacatagatgaaccttaaagacattatgctaagtgaaataagtcaaccacagagggacaaatattgtatgattctacttacatgatgtacctagagtagtcaaattcatagagacagaaagtagaacagtggttgttaggggctacgaggaggggatgggcagttagcatttaatgggtatgaagtttcattttgggaaaataaaaaaattctggagatgaatggtggagactggcgcacaacaatatgaatgtacttaatgaccctgaactgtacacttaaaaatggctaaaatggtaaattttaagttatttatattttactacaaaaaaaaggtaacatactaaaatgatctcatgggttttgtgagaatcaaatgagatccatgtagagaagccttgtagtctatatagcccttcgcaaatgttagctcttcttagtcattatcactccattttccccaatctgataccattatccacacactttacccagccacacttacccaacagcacactgtttgagtttgagtgctatctggtgaatactcatcttcattttgctaaaccctggatgccatgtgctagccaacaatatcctattgttctggttcttaaacaaaacaaaatctcaaagacttcttcctcttacctagttttacccaatgattggctttgaagcagtccttattcagtaataagaggtcaccatgccatggccaagaatagggcaaatcttcctccaattcagttgaactccctggccgtctagcaaacaacatatctcataacacatcctttgagcaggtgaacaactctgaaccttctttgaaggaacaggattctgggaaaggaataaaagaaatgcatgcagtgtgtattgagaataaaatctattagctaagaaataaaaaatgaaaatgctacaacatgatcagttttgatggactagacaactctctgtagagtagccacagggctgaaccctcaaatattcccagaaagtatagacattgctgtagaaccagcctgataatgcagcagtgcagaacttaagaatgatatttctttctagaaagcagaccaattgatatcttcatcctgttattgatcagaatccacgtcagcattcaggtgctctctggctacaagtttccttagctcttgcaggcgctgctcattgaagatttctcttaacacaggtaatgctaccagtctcatctggcacctttttcatgcaatgacaactatccaggagttgctgcctttccagatatcccctgcgagaccaatgagggattttattccatgactctttgaagaggttcaaacatggatcaaacatgaagtagtatgtaccccagccttagaaatttaatcttttatgactgggagaaagaacccaagtctctgtgccttcacagtcttgaatatctctgcttgtttcacttacgtttacctcactcaagattcttagtgtcatcgacatgactggttaagaactcaggacttttcaacaaagttttctgccagtgccccacaaatcatgactgtggtctcccaaattctttgattctccactaggttccctttctcctccattcaaagccccaaataacatttaccctatatatttagtcccgttttttgtagaaatgcttctttgcttgtgttccccctaccttttcatatcatacctacatcgttaactgaggctcagtcataacatcaacaacagcatgaaacatcccaccttctgtcttcattttgctataaactggaggcaaaggaaatgctgtcactcagggagtatatcaatgaagggaaagactctcacaagacaggcactgaggcaggagtcactagcacacagtgtataagtgaaatctaaatataaaaaagcaagcacttgggatacatcccttgcacacacctcctcttttataaccagtagagtgaagttggttgctgaagtcacagaatcaatagtctatttcccacagacggctgatgatagcagaacaagccctggctaagtcccccacccttttcttgagtagctcattgttatgagccacggacccaccatcaccaggtcacatgttctgtactctttcctaaaaacagtgacaaaatatgctgagccatccatatttcctcagttacattgagaggcaggagatataacaattaagcagtctctggagccagagcaacctgagctcaaaccatgccttagcttgcttgttgtgggacctaggcaaagttactgaaacttctttagacatgtttatcaataaaatgggtacagttgactggctccaagatttcttgacctcttgatgtatttgccctgcataattcctaagactgtgattataatggattttactcttatgattaggttttcacatagcacagttgactttaatacagggagattatctgggtaggccttgcctaaacacaagagccatttaaaagcagagttctccccagctggtcaaaagagagaatctctggtcagagattcacagcataagaaggtttcaatgtgccatcactggctctgagatgtagaaacccacatgtaaggaccaaaaagaagcccttaggagctaagagctacagccctccagccaatagccagcaaagaaacaaggacctcggtcctacaaccacagccaaccaaattctgccaacaagaaaaatgagcttggaagctgattcttctcccaaagattccagataagagtacaacaccttgatttcagccttgtgagatcctaagcaaagaacccactcatgtccacccaaacttctgacctacagaactgtgagctaacaaatgagtgttgtaagccactaagtttgtggaaatttgttacacagcaatagaaaactaatacaatgaggacacagcaagtgcttaataaatgttagcttttattattactaactcattgggatcagctacacagttgtaagaaggctaaagtaaaaattatttatgcaaggctggcagtgcaacatagcattcagatccagggtccatttggtctaatatggctgatattaagtgtttctcaaggggagagacattattggcattcagtggggggaggggttcatcctgtagaactgccttggacatggcagtccatttatcatctctggcttctcttcccctagcagtagtcattgcaacaactgaaaatgccactgtacatttccaaaaatgctcctccacaagggttgagaactttgagaactactttaagggaaatttcataagaaagcatgcgtgtcttaaatgctgccataaagctacctcaataactacaatgctactcaaattacctgaccctaagaatcgccagtggcacttgtttaaatataacgattcccaagttctttccctggagtcccattccatagggctggggtggagccccaggaatctatactcttactcaaagaccccaggttaatcttttgtttatgtaagtttgccaaacactgagttagaaatatactcagccgtacatgcatttagcaaaagttcaccacaacggaacaatgacacaccaaaactctttgaaactgtgccttctacagagctgtaaatctccttttggaccattccattacacaaggtgtcctcttggtcacacagtgattgcaaatgggactctagagtcatggaaatgggtatactcttctcaaactttccatctttaccagaattacttcttaaagtgatatgcttcatggtgtaaactagcacttattaattttttctaaatatttatcatatttcatatacttttattttggagatggagtttcgctcttgttgcccaggctggagtgcaatggcagatctcggatcaccgcaacatccatctcccgggttcaagcgattctctggcctcagcctcctgagcagctgggattacaggcatgcgccaccacgcccggctaattttgtatttttagtagaaaaggggttctccatgttggccaggctggtctcgaactcccgacctcaggtgatgcgcccgcctcggcctcccaaagtgttggcattacaggcatgagccaccgcgcccggcccatatacttttaatacatgtggaattaataaaaacgtccatgcctccaattccgtggctattttaccgtcttcctttttcggacaagtccctcaaaggtagcgctcttggctccttcctttgcttatcccctaaccctgtcctcctgaggtgccccctggatttcctccaaccccggcagggtctgcctttccgggatgatacaacgacctgccctgcatgccatatcccaggcgcgtgggcaccaaagtgtggaaaaaccgatgaatgacgttttctgtttccgatactctgcctgccagaatcccctgccgcaccgccccaccacgaagcacatggaacccacggactacacgaggacagaggtctgttctccctttacctctcccatttctttaactatgcttctctcggctggcatgccctttcctcatctcactccacacacgaacaggtttagcaaataatatgcacgctgctgggacgggcccaagcatttccctcccttgatagggcggaactaaaatgcaagccccacagttgtcagcaaaggacttccctgttaccatggtaaagccgctgcgcctttattgtggttgaggagtacttgcatcaacctaagagaaaattaataagaaggaagtctgcaggctgaaacccttcaaattagcctggactcgcctgcatctggctcggaacagagttaatctcaggagtgagaatatagccctccggtggacgcaactcgcgcctgcggctaacagaatgtctccaggggaggggctctgcgtccgttccgcccaggcccttccggctcacgcgccgtacggaagcgtgctcagcgctgggcttgtgctccgtacggaagtgtgctttggcgcaccggaagccgactcaacagagctatggcgggtttgactgtgagagacccagcggtggatcgttctctacgttctgtgttcggtgagaggaattcgttgtagtcaagcttcggggagggactcccctctgcaycttctatctcatgaatcgctaccggagccgctgacggttcggacgtgcagttctccctgcttatcctgtagggcgtccaacctggtggactcatgagcaaagagatattcccattctgccgaggtctcgtaggctttccgcaatatcagtggggaagttagactagcgttcagcttctgtgcgtttctcctttcatgagcttcaattattctctagaggagaaggckcacggyaacagctcctcactgtcccgtactacttctcatcctctgccccagaatacagactatatgctgagggtatagatcctagtgtccacttactgtcctctcctaaggactttcatcctttgctttttatctgtaacattttagtgcatcaatagtggtagcggccacctggtgtcctgagatggcttgtaagtgaatgaatgaatgaactattaagatctcctcagaggaattttaaaaaggatcgaaacgattctgaattatctttttggctgaaataagttgtttttaaaaatacgtgtgattattttagagtaccatttgaaagggacatgacaaagtagttcagaatactttttaaacatctttcactacattcatcgtcattctcccttaaatgttgtatgtgtggaaatacataggaacctgttttaaaaattatattaaataacattgatattttttgtagtcactgatgagacttgcagatctttaggtaaataccagtgccaaagtatttatttgcaccaaagttaaggaaaatctaacacgtgtcagatcagtctgagaactaacatttgagagtacctacacattttgtatttagtttcagtggtatatttcctttgttaagaggtctgaagaaatacaatggaattgggattggagaacactattttgagtcttatatttgatgatataagtttactttctcactaaagatctatgttataaactcagaattttaatgttacctattttcttccttagtggggaacattccttatgaagctactgaagagcagttgaaggacatcttttctgaggttggacctgttgttagtttcaggtgagatccccttttccttcatggtgggagcttcttaaaaatcaccacagatttggctcttagtaataatggcaggttttctttactggtgacttttcacatacattttgttcttgtaacagctttattgagatataattgatacactatacaattgacatttattcttacctaaaatatgtttttttcgttaaaaatgttttttaggcagggcatagtgactcaagcctgtaatcccagcactttgggaggccgaggcaggcggatcacctggggtcaggagttcgagaccagcctgaccaatgtggtgaaaccytgtctctactaaaaatacaaaaattagccgccgtggtggcccatgcctgtagtcccagctactcaggaggctgagacaggagaattgcttgaacccgggaggcagagatagcagtgagccaagatcatgccactgcactccagcctgggcaacagagcaagactccatctcaggaaaaaaaaaaaaaaagttttaaaaaatatttctgtgaggctgtcagagatataaggttatttatgttacagtgggcccaattaaagcatggcaatgttagcaggaaccytgtatgtgtgtaacatttgttcctgacacttggttctgctctccagattggtatacgatagagagacaggaaagccaaagggttatggcttctgtgaataccaagaccaagagacagcacttagtgccatgcggaacctgaatgggcgcgaattcagtgggagagcacttcgagtggacaatgctgccagtgaaaagaacaaagaagagctgaagagtgagtacaaatccaacttggatgcagtatgagttagtaaagatgtaacaatgaagattttccatttctgatatgttttagaatatgctgaaatggttagccacgcagcttgtttattacttgactgacctgatgtgcctgagttaggcaagtattatatatatctttttaaaaactttttataaattttttttcaagtaattgtctgaaatttctatacccttgctctggatggagcagggcaaggcctcaaaccgtttcaaaactgttctggcaagcactgtagggatgcatagggtcactgcagacctaagcatgctggaggcttgctagtaagtgtatatctttaagaaacagataaagttgacattagaaattcttcagttgctccagcctgggcgacagagtgagactctgtctcaaaaaaaaaaaaaaaaaaaaagaatttccattgctaaggagttatttccagttaaagatgaattcaaattcatcaagccattagtagtactaactgtggcattagtcattcctgtcactcttttcaggaatttttgaagttagcgtatttttctcttttaaccttttgtttctgaaatgacttgttaaaagaagtcaatrtgcctagttctctaacttaggttaacattgtccttccatgtgatcatgatccccagctttcctctgagaacagaaaatacactctcactttcctccacagaaacaagaggctttcacatcatttatttctcagctctggagaatctaaaattatcagctggttcttacagcagccctgaaaagtagatatttgaaatgatttagctttttgttttgcctccctaactttcttgtactttcttcttgattaggccttggcactggtgcccctgtcattgagtcaccttatggagagaccatcagtcctgaggatgcccctgagtccattagcaaagcagttgccagccttccaccagagcagatgtttgagctgatgaaacaaatgaaggtgggaggaggcattaggttatgaataaagcaaatcacatcaggttttcaaggagttacttgaattagttccctgagctcaaatagaaattgtctgtagaccaccatttcttgcaccttcaatattctgtatgtacacagtatattttacattttgtacaaagagctttctatttttgtacacaaacacagctatccaaacaatccagctggagttttgtggcccatagatgtcagatgtagatattaaaatttggcttttttcctaaatgataatatcacagtatttgaaatgcctctttcttctcttgcctgccatgaccaaggtttttttgtgccatgcaaawactaatgataaagagcctcttgaatattacatttctcagaggggaatggctctaaatcactatcagtttctaagtcataagtattaaacctgaatctgcttatcttctcagctctgtgtccagaatagtccccaggaggcacggaacatgttacttcagaaccctcaactggcttatgctttgctgcaagcacaggtagtgatgagaattgtggatccggaaattgccctggtgagtgcttctggttcttttatggaaatggtcgggtaaaccttgaatgggataggaactacctgattgctttgttaaacagacagctcataggtttgtcttttcactttttagaaaattctgcatcgccagacaaatatcccaacgctgattgcaggcaaccctcagccagtccatggtgctgggcctggctcaggatccaatgtgtcaatgaaccagcagaatcctcaggcccctcaggcccagtctttggtagggctttatcccttaacatttttttgtatctgtcttagaatgtcattttctttttaggagaatatattgaaagaagaatggtcaggaaccagagatgataatttcaatttccaggcataaaagcaatttccaggttgcagagcacatgacatctgaatgaatatagattcgattccaagtttgtaaaacaaagagatccttcccgtatgcccttttcttataagctaactttgtgtgtatgtgcatgcctggcactgtggttggcacttcgttattccatatgcattatctcatttaatcctcaaagcaattgtatgaggttggcactcttattatctccattcttactgatgaaaaaagtaaagcttgctttcaaagcatgacacaaaaccttaaagccataaaaaattgatacatttgaaaactaaaaaatttctatataaagaaaaaaataagtatcaaagacatgacaaattgagaaaaagtatttaccacacatgtgatggaaaacagactaataaagagcccatagtcattcacaagaatgtttattgccttagagtgaaaaattggaaatgtcctaaatgtacgtcagtggaagaatggagaaaatgtgtggtacattcatccagtgaaatactgtacaacagttaaataaactacacgtatcaacatgaatgactttgaaaaacataattccatacagcagttaagatgaactaggatacataatatcaacacaactccaaaacagtgacatacggacatgaaactaagtgaatatggatgcattcccgaaatgtaggatatatgtttctgcataaatccccaaaatatgtggaatgagttgcaaaataatatattgagtatgtaatgattcatataaaattttgaaacattaagaagacgtcttagtggtcatcaaaggagaagagagcacaggatgcaattggggaagaccgtacaggccattggtttattttatttacttatttatttcctaagctgggtggctattttattttctatatgatttgtatatctgtaatttttcataataaattttaaaaggcctcctataaattagtaagaaaatttccaataacccagtagaaaaatgggaaatagacataaatatttcacaaaaggagaaatataaatatataaaaatttattcaacttcaaaataagataatgtaataaattatcatttatatatgtaatgttataagataatgtaaatagaaactacaataagctaccatttttcatctctcaggttggcagaggtacagggcagggaccagcaaacatttttctgtaaatgatcagacagtaaatatttttggctttgcaagtcacaggatctgccacagctactctgccatggtagtatgaaatcagccataggcaataagtgaacaagtgtgtgtggttgtgttccgttaaaagtttgtttataaaaccaggcagtgagcccgatttggcccatgggtcatagtttgccaacccctgctctaaataaataaatacattttcagagatagaaaaaaaaagctaaggcccagagaggttagctggtccaaaaattgacacaattataagtggcagatctatttctgaacctggttttatctgacctcacagccagttttctcttaactactttcctatacagctcttccttttcttttgtagagttttgtgttccttaaacgtatatgtgattttttttatataacttggcttttattctttatttattgagctgtttctaattcaagggactactcagttttttggggaatgcacagatgaaaagatgacattctctttttctcaacgagttttaatgtagcatttaaaaaaatatatttcacattcccccaaaaccagaattatatctaaggacaggagtgagaaaagattggttaaattaaaaaaaaaatttaattttaaaaatgtggactaccagcagttgttttttttaaaagagtcccagtctccttttatgtttcttgggtttagggcttttttttttttttttttttactcttattggcagccccaatcatgaagttaacagtaggtgttatgtgctgccttgccacacagataagacttgtcaatctctacattgagaatatgttccatcttaaccgtgttccatataaccaggctcatgacrtatattgcttctgtggagtttaaagtgtgtgacaaatctaatgctgcataagacatgccatacaaaaaggatgtttagtagtgtatttggggctgttcatttgaagaggacttttaaggtcgtagacttartatattgagtatccacagaggcatatacatactctgttttttttgcttggtcagggtggaatgcatgtcaatggcgcacctcctctgatgcaagcttctatgcagggtggagttccagcaccagggcaaatgccagctgctgtcacaggacctggccctggttccttagctcctggaggtaagtttcatttagtcttcaccatttcagtacttgctaaagttttgtcatagccactgttgcagtgcagccaaatatgataatgggatccttaggtaaaattaatacacagctagaaagtatatatcttaggtggaggaaatagtagatttcttacgttaaatcctrtatgtctaattataagaacagggaaagggacagtaaagtgaaagagcatagtaaaacttccaagttaacaagggggaaaatggaatgagtggaaacaaaatcaagccagcaaaaatagagaagaggaaaaaagtaagagacagtgtaaaataagtaataataaatgtagagtaagatggaaggaataaaaactaatgtagttgttactctgctaaatatgaatgaactgtcagattaggttcaaaagctcatgaagaaaacagacaaaaaaatacaaggtcacatttgttatagcatattaaactgacataaaattgtattttaacaaacataatcagaacaaacaacaaaagggaaaaagagaaatttaaaagctatgtacatttattgaaaatgtatagatcggcaattaataagagtattgctcatatacttgtaactgttccttgttcaacaattgtaactaagaagattgagtgaaataatgattccccatatgaaacatctgtatgaacacatgatgtattaccaatatttaaagtttttttatgtaacaaacttggtttttgttaatttatctaatctagggtaggttgagtacaacactactcatggagaatgatttaattctaaattgttctgttctgtagagaatccagtctgcagagctaagttgatgaggaatggaagaagagattttttgaagaaatttctgcaaactcaggaattttttgtatctactttaggattgttatgtatctactttatcctaatagagttatacttgtatttaaattatctttcatgacaggaggtccatgggtaagtgacattgttttcctgtattatagaagagcttcctgccaagagtttggtaaccaatgaaatgaattattcttattgaactcactattctgtcactgaaacataaagtacaaattgtaaatatactaacaaaccccatcttctctctcattgcattgttgaatatcttcctttgtaggtttctgcttgtggagcagaatgaggaaatttgtaaactcagccactgttctaatttttcttttccgctgttctaattggtgttttttcttgtctgccctttatcttctaggaggaatgcaggctcaggttggaatgccaggaagtggaccagtgtccatggaacgggggcaaggtaaataaatattaatgtctgactaatgttaattggtcatggaagtgttccacatccacagtatctaatatggcagccactaaccacccatggctatttcaatattaagttaattaaaattaagtaaaatttaaaactcagttcctcagtcacaatagccacattccaagtgctcagtggccacaggtgactagtggataccatacaggacattacagatatagaacatttctatcatcgtaaaaagatctattggacagtgctggtctagactttccacctgrtgattcagagtccagctctacaagaattgataatgaagcaagtggatcgtttgtttcctgattcctagtctaataattccactgacatgttctctctccctgtatggatatctgttgactgagtaaggaattttaataatgagcatgtaaatatgtggctgggtatgtagaagactagatttaaaccccagagaaaactgggagggaatcataggtctgtaacgcctacttaatgaacatatgttgtaccgtggctgtactgctatatacaacagtagctgctgctccaaaatctccatgttgtttcttcatgttactggagtttgaaggacaagaaagtgcagtggttcagttggaaacaatgttaggaggagagatcgtaagaaaagagaaggaactgagtgcatactatatgccaggcactttaattttcataaataatcttgtgagttaggtggcagcacctcagttttacaggcaaagagttggaagctcagaataagttactttctcaaggggacaaggtaagtaaatattaatgtatgagtaatgtggactggatttggtgctcttattttctcttccaactagtaagtggcagagctaagattcagaagtctttgactccagaatctgtcctctttctgtcactccacactgcctctgttaacttccaagcatattcttcagtgtcttctactcttattccttgggaataaaatgatgggaaagactgctttggacaagcatagagaagcttaaggttttttcttttgtagcatatggtttataagtggaacccatttaaaaagcaaaatattggccaggcgcagtggctcatgcctgtaatcccagcactktgggaggcygaggtgggtggattgcttgagctcagaggtttgaaactagcctagacaacatggcaaaaccccgtctctataaaaaatacaaaaactagttgggcaatggtggtgtgcacttgtggtcccagctacttgggaggccgaagtggaaggatcacttgagcccaacaggttgagactgcagtgagccataatcgggcaccactgcactccagcctgggcaacagagcaagaccctgtctcaaagaatatatatatatacacacacacacacatatatatacacacatacatacataaacattaatatacaagcctgtggtttttacactggggttggttgctgaagtgacagaattaactttttcttgttagaagtctgacagcaggacaaactccctggccaaatatctcatattttctctaagcatccaatgcttttgtgctattgtacatccctctatccccaccgcaccactgtcaatagatcatatatgttccccagagtatttctgcagtaatgagaaggtattagggtttcagtcatacttctgcctgtcatggggccagccctcaatccatcaggttttagctgtttaacgcatacttgcacaagacatcttcctattatagttatcttcacctttttgtcagaaattggcaaagggaagtgactcatgttttgagggtatttccaggatgtcttcatgcagagactaagtgagatgagctttcttttatagtttccttcagtacccagcagaggaagcaagagtcttttcgtgtgtgcctagtttgtcttacttttcctgaaatccatgctgcttttaatgctgaaaggagatggagatgtttgagaagatacttcttgcttccctgccatgtttgtttagtgtcggttcccatgtcatctcattagtctttgtttgctgttgtcatgatgtttattatcaaagacttgctgtggcagagtatttcttgtggagtgatattctctttcatcatgtaaagttcattcactgcatttccccatctgatacatttttgacagcagaaatttttgtgctttaaaatgtgacaaaaatagaattgccgtacttcagttatggccgtttcagaatgaatcttgccttccagattcagtgcagtttcttttatgttttgcttctgaaactacatttatgttctttgcataactagaagattcaaaactatcctttttatatatttttttcctaatgatttcataaggagacctaacggaaaactagtagcagaggtgaaaatcgaaaatgtcaggttattcccacctagatcaaaccagtgcccccatgggattccctttcaaaagctatctggtcaaaatggaactatttcagagacccaaaggagctagtgtagtttagggagattttgtagcctggagcaagccgatgaactcttggctttttaacttatatatgtaaatctcaatctccatgtgtgtgtgtttctgcgtgtgtatgcaagctattttaagtgtctgctctttctccttttgaacttactgcttacctaggaaccctacagcactcgcccgtgggacccgccgggcctgcatcaattgagcgagttcaaggtacccattgtatctgtgggtttccttttgcttgtggtgttcagggtgggacgttgagaggaaaagagctgcgtggcagtcatcctcgcgttcagaacccaaaagggtagtgtttttgggtttttgtttttttaattttttcctgttgaggccacaagcctaagattgacctcttcacacagggcagagaacatggatgatatgggcatctgtccgaggctgtactccctccctactggtgtcaggaggcttggatggaatagcagtctgtaaggagacagcgggttcttgcagagccatggcagtgttcacatatgccaagactctacctctgttttgtgactctggtccttgaactaagattgattagaaggaaaaccaggagcataagtttctccaggtcgcagtgctagtccttggcaggttgctccccagtttgctctttatataattccatccatacctctgacatggcacagattctgcctacaccctgcttctgttcttgagctgcaagaggattctgctgtggtgaggtttcacccactctaaggtgtctgaattatgttgtcagtggtatatagagtcatttcttgtttgcttatgtgtctttcacagcagtaactccccgtttgtttccctgtcagtgccgatgcaagaccccagagcagctatgcagcggggatccttgcctgcgaatgtcccaacccctcgaggcttgttaggagatgctccgaatgatccacggggaggcactttactttctgtaactggagaggtagagcctaggtaagcactaacatagaaggaaacagttgaagaaatcagaattgtcccttcttccctgagaacaaaatctttctgtaccagttgtacctgtttgcctacttcaaaaggtagatcaatattcatggccactgtccaagggtaagcacttctcctaaggcagaactatgtacttgagtatgtcattttgagctattatatttttagaaattggaaattttagtatacatacttgaacagggaaatttatagtagtggaaatattaataatagcaataataggccgggtgcagtggctgacgcctataatcccagtactttgggaggccaaggtgggtggatcacttgaggtcaggagttcgagacctgcctggcctacatggtgaaatcccatctctactaaaaatagaaaaattagccgggcgtggtggcgggcgcctataattacagctactggggaggctgaggcaggagaatcgcttgaacccaggaggtggaggttgcagtgarccgaggtcatgccactgcactccagcctgggcaacaagagtgaaactccatttcaaaagtaaataaataaataaaataatgatagtaataataattgacattaatggggatcatgcctctgactctgctctgagtactttacttagatcatcttattaaatccacaagatcctgtgagatggataccattattagtcccattttacacgtgaaactgatgtgtggaaaagttaaataatgtgtccaatatcacacagctaataagtgatagagcctagatttgaacccatacagtctgaatccagagctcatgttcttatgcattgttctgcaaactcatacatataatgaatattcgttgattcctccctaattatgaaccaaataacgaaattctagaatacrtggatttatatctctgtagcttttcttccatctatttggtgttattttcttgttagtattcatagactacatcagctctttgttggatgtttacttactgatctggttggtactttgttgttgttttgttctattttaaaatacaacgtttttctccatctccagaggttacttgggaccacctcatcagggtccacccatgcaccatgtccctggccatgagagccgaggaccacccccacatgaactgaggggagggccattacccgagccyagacctctaatggcagaaccaagaggacccatgctagatcagaggggtccacccttggatggcagaggtaaggggagatcacattgcaaatgccataatgaactcaactgtcttaggctctaatctgggataaagaatgctggaacagtaggtttgcaagcatctttaaggtttatccacaaatctgagaaactggggaggagacaatagtctcatatgttaatagctgaggggacaaatgtgactagaagagatttctatctttcttggattgttcatcattcttgcagtacatgcaagtagctacataatggttttgttacatttttctttataggtggaagggatccccgaggaatagatgcacgagggatggaggcccgagccatggaggcaagagggttagatgccagaggattagaggcccgtgcaatggaggcccgtgcgatggaagctcgtgcaatggaggcccgagcgatggaggcccgtgcaatggaagtccgagggatggaggccagaggcatggataccagaggcccagtgcctggccccagaggacctatacctagtggaatgcagggtcccagtccaattaacatgggggcggttgtcccccagggatccagacaggtatgtgtaacactgacttctggcatccaagtgaaatcttgatctattcaggaattgattattgagcctaattattactgccttctgacttgggctgtttcttagcttgttagaaagggaagacttggatctccctgtagcttctctgtcccttagggtggtgattttctggctatcaggattgtagttcaaaaaaaaacaaccttatcccacaataaatagctattcatttggagcagagcccctgaaaatttaggggttagaaagtagtcttgattggggtacaaaccaacatcatgtacacggttttttccaagatatacttgcccggatctcatccgaggtataactcagaatctcttattagtaggatctgagcatggatagtttgaaaaacttcccccaaatgattctaatgtgaaccctgactgggaaccactgggttagagtatatgaagagctgttagtggccatttagataatcttaggtttagagagacctgtgttaatttattgtcatcacatagcctaagtgaacagtggaatgtgaaaggcagtttattaataatcaccttaaaaggtgtggaaccgaagtcttgtctcctctcttttatttggatctctctgcctgtgtgtacatgctccctcttcatctcgacttggttgtggagaggtggtatgtgtgtttcttccgtgagtttttatatgctggcaccttcatttccctctaactgctccaccttccttttccccccttcctctgcgtacttctctcttctttttttatgtgtcttcctccccatgtctgtgtgtatgagagagagaaagataatggcagagctggaatggaatacatcaatcatctaattccctcagtttatagatttggaaattaaggcccaagaattcaggtgacttgaccaaattcacatgactaaaaagtggcagagcaaggaacagaagccactactttttccactttactactctgtcctgttatctgcacatttgtgtgtgtgtatatgtgtggatatgtgtctaccccctcctctgtaatatgaaatacaaatagagggtttttttgctatgtgtagaataaaactgttctctattgtgtttgaagtgtttgtgggccttgatttttattgtactctctatggtcagtagcctagtaacagaaatggtttttatgcattcattctgtcactcagcaaatatttattgagcacctactatgtaccaaacatagatctaggtacgggggatactgcagtgtgaacagaacaaagccccttcccccatgggcttacattctagttgggaagacagataacaaacaaataactacataatgcgcttacataattttactggtagttctatgatgcaagacattgcaagtaagggttggaagaacatttctggataatattttgctcctttctctctgctggtacttgaacttattaccctaatactaggtttataccatttttattagtagattcgataaagccaattagatctgaggcaagagaaaatacaaattttatcttcaaacctttaaaaaaattttaaattaatatattaacttataaatatatatattcgttcatctataaaagatatatgtattaagaacttcaagccaggcatggtgacatgcacctgtagtgccagcactctggaggctggggcaggaagaccatttaagtctaggaacttgaggctgtggtgcattctgatcgcacctgtgactagccactgcactccagcctgggcagcatattagactcccatctttaaaaaaaaaaaaaaagccagggtagaatcctgtagtcccagctactctggaggctaaggcaggaggatcagtagagcccaggagttggaggcccgcctacacaagatagtgagaccacatcttaaactaaaaggaaccttgcttcctctcctatgcttgtctcccctgtggccctctaggtcctgtagataatcacttttattagatttttcatgttactttctggaaaacatgaatatatattatttttcccctttcactgttctataccttttttttttttaacttaacaacatgtccttaattcatacttttaaattagattttaaaattaactctagtccacttagttagaaacttgtgggcaaaaggcttattattactagggtgattatataatttatcatctaaaggagaacatgaaagaaagtgctgttactttacttggaggcaaaaacataaactgggactatcttagggaaaccaagatgtatggtcacttttgctagtacttgtctgcctagaacaagcacacctagaaacttaaaatggccgttattgagtggttagatcacaattacagtacctcagattaaagcttcaaaaagattatactcaattccgaattgtgctgctataaactcatgtgaccaaacaccacctgttccccaataacctatggaaataaaaaattttaaaaaaaaagattatactcataggtgtttcagacccataatagctcgttaatgttcagactggtctctggaaacttgtctctggtttcagtattgataatgaacagaacagtgataatattctagcagtctatacaaatctgtactaatgtttcatctatccattgtctttgggaaatgagttaatgcatgtaagtgaatgttccagataatagaactattctaccaagttttttaacttttttaataaaaaattataaaaagtatttgatatttcctttcttgaacaggatacaaaaaaatagtttaatcagttttgactactcaaggtcatcattgaatagattcattattgtctataccgtaatataaaacatagttatctcctgtttggtttctggtctccttcactgtcaggccgtcacctggctcttcatattactgaagtggtatctgctcctaacagttatttatccgtatttcttttatgttttgctgcttctaatctgctgggtaagcaggtaacaagtttgttaacaatatgtgtttattaagagagtacctaagctctgggtgaatgcctgagtgtgaacataatgcttgtatagggacattctaacagttagatttggtactcaagaggtcttttccttgggttctggtagtcttgcaaagggttgaactcattgaagatcttaagtaccagtaagtatgatatcactgtacttggttttttcactccagtcagtcatattttttggtctacatttagcagaaagcatctgccatatgttctctatggaaagctataaacagcaaatgttgggctaatagcagtctttttcctggaggccttcccattgcctttctgcctctctgacattatgaacatctctgcctcacttgtgggatagggccctttgggacaaactacctgtatctgattgaactagggtagggggtggccctgtgaatgtaacttccccagtggaccagcatacattttctctagactctgttggctttcatttgtatttccagtgagcactagtttccagggtgttctcagttttcactgtgcttatttggctgaattttgattaattcagtggtatccagttgtgctgtgtaatatttgttgatgatgctggaggtgttgtaagcaagtatgtcgaacttgctagttgatctctggctaaaccctgccttctgctattgctaacagtagaaaatgatcttcagagtcattgatttgctttttttactcatatctgtatagagatcataatttgtcacattattactgaattcaggttacctatacattaaaaatgccaaaaatctctcttttctctttgtacacataggtcccagtcatgcagggaacaggaatgcaaggagcaagtatacagggtggaagccagcctggcggctttagtcccgggcagaaccaagtcactccacaggatcatgagaaggtaagcaacactgtctgactgcctccttatgcacaattctagcctttttgattcctcttttcacagttaccatgtgacgatcctgggtcttcaaagtccctttggaggtgatgtttattctaacttagaactcttttatgatcttgttacctgaaaatttgtgagtctggtcctgaagttcctaatggatgtgaagttcttaagtggatgtaaatggcagcttattttatatttcacactcatctgccaatagcaggtttttcttgttcaggccagattgacctgaaaatccacaccctttttccttccctttctactttatccctaaaaacaatagtagattccccatgattatatctttctgtttttatatttgaccattgtggggagcttatgtctgatggaaaggctaaaatttgtgaaaaagagagactttcaaaacaggattaaaacttgaaggatttccagggctcacagataccatcttagtctccaggaactttgagttcatgaagttgtctgttttgaatcgtctaatcttaggtattttaatttatacttgttcttttcattgtaccttttctcaccagtttttttttattttttattttttttggaggggggctgttggtttttttctgtgtgaaatgttcttcctttttccattttgcttcatatcccactacagtagctttttggacagaagctggtggtgggttttttgttttgttttgtattttttagctgccatcattaaaactcactaccttttttttttcctctgcacaggctgctttgattatgcaggttctacaactgactgcagaccagattgccatgttgcctcctgagcaaaggcagagtatcctgattttaaaggaacaaatacagaaatccactggagcaccttgataggtgagcaaacttaatccccatctgagtaggactagctccttgtctattctgggtatatacttttaaccttaaccaacaagattgttctctcagcggccctcaatccactcagctagactcttctttacccttcagtaggtcagctcctgtagggatagagtaaggctatacaatgtttgttcagttgttgaattgcttataatctttcctaatgacaaaggtaatgtatgatcagtttaacaaaagtaatcatatacagaaatgtagaaggtgaaaggtaaaaagccctgtttcctcaatctcattccccagacaaaacctctaaatatagtttggtgtgtatccttctacaatcaattgtattattttattccaaactgtcctgtcaaaatggaaaaatacaaagcatttcaataaaatgtgtaaatattttgtttcttgtatttattttatagggaatattttgatgttgaactatagtagcacataatttaaggtagtaaatgtccgtcatcaccatcagtttctatatattttggagatcgctgtacccygctacccttatttttcttgctcatcatttaggcagaaagaatccaggggccaagcacagtggctgagccctgtaatctcagctttggcaggctgaggtggaaggattacttgagaccaggagttcaagaccagcctaagcaacatagtgagaccccatctttacaaaaattttttaaaaaattagccaggcatggtgagatgcgcctatagttccagctacttgtgaggccgaggtgggaggactggttgagtccaggaggtcagggctgcagtaagccatgattatgccactgcactctagcctgggtcacagagtgagactctgtgtcaaaaaaaaaaaaaaaaaaggatccaggtaacctgcttcataaataatcatgtgacaacttgattacacatacatgtatcagtgtttcttttttaaaaaaaatttccccagcattttgtattttataaacagttcttttttctaaaaacagtttaaaattcatgttgccccactatcaggtaggacagcacaatttaaatttctactttttaccccatccatattataattcctattcttatgttatataatagtgaactcatttaactattaataattaccactcttacaaaatatatcattttaatccatacttgtgatgtctttaaacatttaaactgcgactatgcatcatatatgtatttagaccttaaatgaattaatgagaagctatcatagatagaaggctcagtagacttttggtaccttaacgttttattccacaaaccccacatattctttttttttagtaaaagtatagactacctattacattcagaggaataaataaaaattatttcttttactaatttacttaagccagagaaggcattccctacaatgtgagaaaattactccttactgtttctggatagtagaggtagaaatgtttctgaaatttctttcattatagttttgcttataggatgtttaatttaaggccttgcatattaaccacaaggcaaagtttttgtctatttttttaccttttatttttaaataatcatagactcaaggaaagttggaaaaatagtacaaggagtctcatgtacccttcacccagtgtagtgcaaaaccaagaaattgacattggcacattactgttaacttgactgcaaactcagttttcaccattttaaaaaaactatcatgatttgtgtatatgtatgtgtggttctatgcaattttatgtgggcaagattttattgtgtgtctactggtgtttgtgcataccatggctaaagtgttgggttttcctccatcctatacctagctagttgtgatccatctctgccatcatggacaggcttctatactgttgtcattagagatgaatggttctcaaacaagggcagttttgccccctaggtgacattgtcttgagacgtttttggtcatcacaactttagggagtatggcatgctactggcattcagtgggtagaggccagagatactgctaaacatcccataatgcacaggatggtccccctcacccacttcccaatagcaactagtactccagcccaaaatgtcagtagtgctgaggttgagaaaccctgctgcaagggctgattgctttgaggagtcaggaggcaggagacagatactttgcaaatctgtcctggtgatttgattatatgcctgtcctccctcccctagcctttttattttttttcctgaagtttttccggaagagagctttgtcttcacttctaatggctttgtcctaacttcttcttacaggttttcaaaaatacctggcaagaaatctggaaattctataattttgttgaaatattgaaaaaagatgacctgcatcctaacccttgaatgactcaaatcagtgccaggtggaggactcccatcaccttctctcagaacaaaatcacttcattttattgtcttagtttgtatattttctgtgacttgaaataaactttgaacacaattttagtacactgcaaattgatacacatgacctttttgcttttaaaaagcttaacactaagggtgaaaccttagatgtgttttctacccttactgcagtattgtactttaacatattgccatagttttgtttttaagttaaccacttattcttcttgatgatatttgagaatttctcagaagcaatgttttctggaacttggtttttgtttagtttgcttccagtaagaattattataaggctttgccctctgaaaatattctagcacttcggagtcttctaggagaaaatatcacatgcttagagctataaaatggtcagaaggctaacagagcaaagagcctagcacagctgtgtgtttagtttagaaaaatccaaatatcaaaatgcatttgtttcaatagcaggtctgaacatgtataattcagagttaagacaaaaattgttttagcactggtttgagtgtgtcagcaacacaagagactgttgacatttacttgtgtgttcttaaacttatcagtctaggcagtcaactttgaaagtttaaaaagccactgatttttcacatgctcaagatgaaataaaaacagaaatcaaatgaacaaaatacatttcatcctatcttccaggcagtccctaacctgcagccctaccctgtaactacgtttattctgggaacttacaacacagaaaaccctaaaacttgtacattcttctcattttaagtggaccaaatgtagagcacagtcagattgctcattaggtctgctcctgcctgcttccttgcggataggtatgaacataattagtgccattagctctaatctatgggtcttattgcctagtatttctctctctcgccgcgccgccgcctcctcctctccccccaccccaaccccatctctctcgtagtggcattaaggaggaacatggtttctctctatcaggccaacctcaagaggttaagagttgccttaataatcagtaaagttctactggaactacttttgagccaatttatattcttggaattctatcccctgggttaggattatggtcaggtgaattaaaagcctggcataggcttagagaatgtaatagcatattgcttacatgtcaagcaaaagaatgcaaagataatcaactttttgagtgacaatgaaattgagggattttctactcatataaacatttataagaaatttgttgattaaggtatttcatattacaactttgcaagaaaaacttgctcaaagcaggtgaggagctttctgtgtatcctgctcatccccagttcaacttggatgttggctatgcataggatttattatattcattaccatgaatataatcacgaatttatgcctactcccataaatattcaagccttgggatattgattttggcagccatcatatcttgaagtgagtgtgtcaatatatttagacatggagaccaagagtgatgcctttctcattaggaactcgttgtaagtttcaagattccaaatcaaggtcattgaagatgaagttgtcatttggtcagtagttgtctaataagaatcatgtcttcaaggtttcattgtgcattttcccaaagccttattaaacctgaattagctgaaatccgggtgaacaaattggcaacagcagtggtatccctccctatgtaaacaaccatcagtattgttttactgttgtaataaatgaaacatgattagccaccatgagttcatgacctacctttattgtgctcagactagtgacaaaaaaaaaccaaaaacagttttatccctcaagccgtagaggttcctaaactattagaaacaaccatttgttcattcgtggtcacttaatggtagaaaaaatagataatataatgctaattcagtacaaccattcttctaatctataatgagttgaattgtctgggcacaatgaagtgtgaggtttctctcttaagagccctgggcttctctccttctagggattcactgtgacgactaacatcccagagccagtgtggtccttgtaggccgaggttgggtagatggcagaaataaaaagcattctgatagagaatgaaggcattttgcttatgttattagctgaatgattccttagcgatataggtaggagtccacaaaaatctatgaaaattataaattgttattttttaaactagacattaataaactcccttaatagtgataaagagctcctcttgactaaataagtcatcctaacatggagttcaagttttcacaatcgcttttaacagaataatacaagatgacagtatagctgacttgcaattataatacaatttcaattacaatgagcatactttctagattttctttcccaaatggagagcccaaaaagaagtaacaaaagactcattcatcaagtgaagaagaaaatcctttattttttgatgagcaaaaataataaattgctgttcacactggataagaccatatcaaaagtgacagtaaacatgtacactgttggtgttatatggggatggggttctcggtaattttgtttattatttatgtttattattatgttttatcattaattattcaataaatttttatttaaaaagtcaccctacttagaaatcttctgtgggggtgggagggacaaaagattacaaaccaaaactcaggagatggtaacactggaattgataaaatcacctgggattagttgtataactctgaaccaccaaacctctgctatcaagccttgctacagtcatggctgtccagaaagatttacagttatttttctgagaaaggatccatgggctttaagaacttcagaactttaagaacttcagaagttcttaagttgctgaagctcaagtaacgaagttgaatgcaatcaaaaaaagaataccagggagtcaaggcttgagaggcacattcttatcctaaagtgactgctcaaacctgacgagaccaagtaaattactgaagatacaaagagacaaaatgcagattaccgtccttattcctataactcaaaaattttctttgttgaagtagaattgaacctttctaggatccagactggaatatcggtgacagcatttgcgcaggctctttgccaaagtccgagggccacataagaaaactcccactacagacctgtaggaacagaacaatagtaagggctagaatgcagcaatgacagaatggagaaactgcctctgttaggcctctactacttccaagaaccttgaataaaaattcggttgtttactcccacgttcttcatggtagttttttaaccttttctgcgcacaaaccccaaatatgctctcagcccttaacactctcagcactcagccttccctgttttgagaacacagatgacagacataagacagtgcagtggctaagtgccagactgtgcagccagtctgtctgggttgtctgggctcaaatctcagctctgacatttatcccacctgtgggactttgggcacatttctttttttcttttttcttttctttttttgagatggagtcttgctctgtcccccagctggagtgcagtggcacaatctcggttcactgcaacctccacctcccaggttcaagcaattttcctgcctcagcctcctgagtagctgggactacaggcacgcaccagcatgcccagctaaattttgtatttttattagagatggggtttcaccatgttggccaggctggtctcaaactcctgacctcaagtgatccgcctgcctcagcctccctaagtgctgggattacaggcgtgagccacaatgtccgacaagggaaaatttcttaacctctctctgtttcagctttcccacctgtaaaatggggataaaaatagtactcaccacatagggttgttttaaggattaaataagaacatgtaaataaattagaaaaatgcctggcacatagcaagtacatatgtattagctcccattaaacccatccactgtgagcttatccctacctcaaaatttctcctagtggagaggtagtgttctttcttgccaaagctaatctttccaactatgctctgggtctcaccgtcttcttccttctctcatacctttctctccccctcttttttaaaaatataattatggtatagtttctataccataaaattcgcccctttgaagtgtgcaatttgtgctttttagcacagccacaaagttatgcaaccatcaccactatctaattccagaacattttcatcatccgcaaagaaaccccatccacattagcagtcctcatttcctcccaactaccctgtcctacccaagacaatcactttactttctgtctctgtgggtatgcctatcctgaatgtttcacataagtggaatcatacaatacatggcctttggtgtctggtgtttttcagcatgatgttttcaagatttgtccatgttgtagcatgattcagtactttgttttttttttaatagctaaataatattccagtatgtgaatatactacatttgcttcatccattcatctattgatggatgcttggcttgttttcacttcggggctattatgagtaatgctgctatgtacatcatgtacaagtttttgtgtagacatatattttcatttctcttgggtgtataacaaggagtgggattgctgggtcatatggaaactatgtgttttttttttttttttttttttgagacagagtcttgcactgtcacccgggctggagtacaatggtatgatctggggtcactgcaacctccacctcccgggttcaagcgattctcctgcctcagcctccctagtagctgggattacaggtgcccgccaccatgcccagctaattcttttcaccttttttttttttaatggaatctcgctgtcgcccaggctggagcgcagtggcacgatcttggctcactgcaagctctgcctcctgggttcacgccactctcctgcctcagcttcccaagtagctgggactacaggcgcccgccaccgcacccggctaatttttttttgtatgtttagtaaagacagggtttcaccgtgttagccaggatggtctcgatctcctgacctcgtgatccacccacctcggcctcccaaagtgctgggattacaggcatgagccaccacgcccggcctaattttttgtatttttagtagagacaaggtttcactatgttggccaggctggtcttgaactcctgacctcgtgatccatctgccttggcctcccaaagtgctgggattacaggcgcgagccaccatgcccagctggaaactgtgtttaacactttgaggaactgccaaagagttttccccgagtgtggtatcatttcacatttccacaagcaatgtactaggattgcaacttctccacttccttgccaatactattgtccatcttttattatggccatcttagtcctctcccctctttcatgtatttattttattttatgtactggtccttgttctgtctataaatatgcttaagctaaatgaacatttcctgaccctgctactcttccaacactattgaccacgcttctctaatatttgctcccttgggttctgtgacaccacttctctgtgtactcctatttcttccctggtttgtctttttcccttcccatataacctaggcagcattccttggtactctgtccctcgctagtctctctctctccctccctctctctctctctcctgacaacctcatactctctcaaaacttcagttacattcaacatgataattagcatcttttatgcttatatgctgctttaaaatttacaaagcattttttcatatattgtctcacttaattgtcataacaaccctgcaagtgagtagagcaggcattcactaatatgacccttgtcttacagatgaggaatcaagatcagagagttcagaagttcaaggtctcataactagaaagtgtcagaaccagaataagggccgggcatggtggctcatgctgtaatcccagcactttgggaggctgaggtgagtgaatcacctgaggtcaggagttcgagaccagcctggccaatatggcgaaaccccatctctactaaaaatacaaaaaattagctggatgtggtggtggatgcctgtaatcccagctactcgggaggctgaggcaggagaactgcttgaacccaggaggtggaggttgcagtgagccgagatggcaccattgcactccagcctgggtgacaaagcaagactgtgtctcaagaaaaaaagagagaaccagcatgaggacccaggatcatctgaatccaagtcactaagtgctctagccactgccttcctgaagcctttcctaatcaccccatgtggccgtagacttttcttccctccagcatccgtgaacctctttcacggagtgcattattctgctttgaggtgattgtgtgcatctcttattcaaatgtatgttccttgtgggcaagaaccatatcctatttctctttcaacctccaaagcttctagaatggtgagagctgagcttataaaaggtaaccaaggcggggcttggtggatcatgcctgtaatctcagcacttttgggggctgaggcaggtggatcacctgaggtcaggagttcgagattagcctgaccaacgtggtgaaacaccatctctactaaaaatacaacaaattagctgggcatggtggtgggcacctgtaatcccagctacatgggaggctgaggcaggagaatcgcttgaacccgggattcggagattgcagcaagcagagatcgcaccactgcactccagcctgggcgacaagagcgaaactccatctcaaaaaaaaaaaaaaaaaaaggtaatcaagaatatttgtagcattgaattgatcatcacctccctacttgttcagggaatctcagcttcatctccttcccattggaatggctgatttcatagcaccaggattttttgtgctgtaacatgtctcaaaaccctccagaaagattgagctcaggtggccagtaaactagataatacctttgttactttaagtagagattattgagtcccctccccgcaaaaatgcatttgaattgctccagttctctagtttgtttggtagtatagatcagaagtgggtccacttgcctcactgtttgaatggagtttgctggggcaaaaaaacctcttttcatcattttcaagatcatgaccctatttttctaaaaccccagatgaaatttcctcggtcttcaccaagaatctaagaatggcacaaaagatttctgccccagagatcttttcttaagagtgttcaacatgttgtaatacctttcctaaatcctaactccgcactcatctttttttttttcttttgagacagagtttctctcttgttgcccaggctggagtgcaatggcgctatctcagctcattgcaacctctgcctcccaggttcaagcaattctccttgcctcagcctcccaagtagctgggattacaggcatgtgccaccacgcctagctaatttttgtatttttagtagtgacggggttttgccaagttggccagactggtctcgaactcctgacctcaggtgatccacccacttcggcctcccaaagtgctgagattacaggcagtaagccaccacgcacggcccctgtaaactcatcttactagaggaaaatatacttacttggggtgggaggtagctattgtagaaaactcattgtcccacattggtctcccaaaggaggttttctgtttcagacctgtcacgatgtcagtggccttgtcaaagtttaatgctgcatgaccaacctggattcagaggaataaaagttagaaaaaccaagtcctaggctgggtgcgtggctcacgcctgtaatcccaatactttgggaggccgaggtgggtggatcacctgaggtcaggagttcgagactagcctgaccaacgtggtgagacccccatctctactaaaaattcaaaattagctgggcatggtggcgcatgcctgtaatcccagttactcgggaggctaaggcaggagaattgcttaaacccaggaggcagaggttgtggtgagccaagatcgcaccattgcactccagcctgtgcaacaagagtgaaactctgtctcaaaaagaaaaaaaagaagaagaaagaaagaaaagaaaaaccaagtcctgatagctgcctcttctttccaccacttttaaacttgtgtgtgagtgtgagggcaggtaggaaatcataagaaataacttctaatccatatgcactatcctttgtctgacattcgtcttatgtttagtaggggaattagtgtgttatttggactcacaatattg

SEQ ID NO: 17928 - DNA, 67697 bp, Homo sapiens
  misc_feature (1)...(67697): n = A,T,C or G, or insertion/deletion polymorphism (see Tables 1-2)
gctaactggggcatgtcctgtaaactttttgtcttgaaataattttagacttactacagtgtttccaaaatagtacagagttcctgtatatcttttacgcagcattccctggtgttaacatcttacacaatcacagtacagcgatcataaccgggaaattaacattcatacaatactattcttcagccattattcaaatatcgccagttttctcactcaaaggaaaaactcctaaatcttcgttaaaaaaatcacaggaacaactgtgtgcagtggctcatggctgtaatcacagcattttgggaggccaaggcgggcggatcacgaggtcaggagtttgagaccagcctgaccaacatggtgaaaccccatctctactaaaaatacaaaaattagccctgcgtggtggcacgcacctgttaatcccagctactcaggaggctgaggcaggagaatcgcttgaacccaggagttggaggttgcagtgagctgagatggtgccactgcacttcagcctgggtgacagagcgagactccatctcaaaaaagaataaataaatacatacataaataaataatcgcaggaacatatcggaaattattgtctcttgaagcaagaactgtcacaccgttccttcaactcatagttcttttcttttttttattatttgtttgtttgtttgtttgtttgttttttgagacggagttttgctctttattgcccaggctggagtgcagtggtgtgatctcggctcactgcaacctttgcctcccaggttcaagtgattctcctgtctcagctgcccaagtagctgggattacaggcgtccgccaccatgcccggctaattttttgtatttttagtagagatggggtcacaccattgttggccaggctggtcacaaactcctgacttcaggtgatccacccgccttggcctcccaaagtgttgggattataggcgtgagccaccatgcccggcctcaactcatatttcattagtcaaagtaactcacaggaaatacatcccttccctagtggggagaactgcaaagtcacatggcaaagagtataaaggtaaaatttggatacagagtatgaaaaactaagaatagtcatgtgatctacctaactgaccttgtgttttttcaaaagtgacaagttgtgaatagtgttgcaacgaaaagataaataaaatcaagtgacatgatctttgacatacagtagtcgcccctaaagtaattggagaaaaacatgtgtttcttacggtgaggatagatctaagggctatggctagattaagagagtactaaaagaaccctcggatagtcacatagtttaacataatttagtcatcccttctctctgttaaacttaactttttctcagtacacctaaaataatttcaaaaagatatgttcttcctcacctacttctaacttgtttcaaagaacataatttgaggcataatgtaaatattgacttttaaaaatagaagttatattactttttctggccgggtgtggtggctcacgcctataatcccagcactttgggaagctgaggtgactggatcatgaggtcaggagttgaagaccagcctggccaatatggtgaaaccccggctctactaaaaatacaaaaaattagccaggcgtggtggcgtgtgcctgtagtcccagctattcgggaggctgaggcaggagaatcgcttgaacccagaaggcggaggttgcagtgagccgagattgtgccattgcactccagcctgggcaccagggtaagactctgtctaaataaataaataaataaaaacagacgttatattacttcttaaagtgtatctaccaaatctaattagcatagggttttggtatattccatcattcatcatacaagagagaaaataacactcttcttcaatagacagacattttatataatttattttatctttgaaaaatttttcattccttttcctcacaaaatttgattttaatatgtgttcaaaagtcttttattaatcatcttatcatatttctctgagcaaaaatgtgtctaagaattgaaattattttaaattgtttttatttcctgtcatcttaaagttctttttttttttttttttgaggcagagtctcgctctcttgcccaggctggagtgcagtggtgtgatctccactcactgcaagctccgcttcctgggttcacgccattctcctgcctcagcctcccaagtagctgggactacaggcacccgccaccatgcccagctaactttttgtatttttagtagagacggggtttcacagtgttcgccaggatggtctcgatctcctgacctcgtgatccgcccgcctcggcctcccaaagtgctgggattacaggcgtgagccaccgcacccagccgatcttaaagttctaagtggtcaatgtttcttctggattaaatgatcactacagttattagtaataaacaaacaatcacaaaaagtaaatacacttttaaaaaataattgttaagcattgtaagagaaacaattctcagagaattgaaactcttggtccaggtccagggacacctgggaagctgaccctgaatttactttcttgcaaaattagttctcaaaatgtactaagttacggtaagtgtagaatgttgtgtggaccatgctttttccacctgaagtgtatctggttgttggggctatttgttgtataacctttcattgaggtgctacagctgctcccaaagaatgttatttatggccgggcgtgatggctcacgcctgtaatcccagcaacttgggaggccgaggcaggcagatcatgaggtcatgagtttgagaccatcctggccaacatggtgaaaccccgtctctactagaaatacaaaaattagctgggcatggtggcatgaacttgtaatcccagctactcaggaggctgaggcaggagaattgcttgaactcgggaggtggagcttgcagtgagccaagatcgggccattgcactccatcctgggcaacagagtgagactctgtctcaaaaaaaaaaaaagttatttattaagttatacacaccctgaggaatgatatgactaataagttataaaaagtcaaagagcagatagtagaagagcttcgcagtgccaaggtggtccatcttgctttaccttcatcccttgtaactgagcatgacccatgaaatgataagcttggaagctgtgcctgggatattgcaaggccttttgctcaaagcagtgcttgcttggatgctgaactacctgtcctgcatcctttgaataaaataagtaaactggtattgaaactgtgtcgttttgatctgggcgcagtggctcatgcctgtaatcccagcactttgggaggttgaggctggtggatcacctgaggtcaggagatcgagaccagcctgggcaacatggcaaaaccctgtctctactaaaaatacaagccaggcatggtggcgggcgcctgtaatcctagctacttgggagactgaggcaggaaaattgcttgaacccgggaggtggaggttgcagtgagccgagtttgtaccattgcgctccagcctgggcaacaagagtgaaactccatctcagaaaagaaaaaagaaactgcgttgttttgttagtctttccatcaatccaggtttgtatcaaaagtggcgattgattccggtgctttgggagtgatgaaaaagaaaaattaaattaaaaataaagtggcaattgatacgaagacctctgaccccgtagaggcaaaaaacccttatgttgtaagaagatgaatagggaacaaataattttgatgcctgaaagattgcttaaccatcatgttgtttgatatgactccatccaagaattgctcttatcagtgaaatttaaaaaaacattgatctaattcactaagaactgattaaatgggttgaaaaaagagaagcaagcagtgcagggaaaagctagaaatactatcccatgttcgtttcttatggcttttttggaaatgaaagcattgacaaagagaagggaaaggaaagccaagagctctaagcctagcaaaatctgatcttcatagcttccctagtacctgtgagggaaagggagggacaacatagttaaatcacactgccatcccactgagatccctccttaatcaaactagcccagatcccaataggggcatgcaaggcgttacagaggacaagcattatagtataaagaagttgagtaattttgttgaaaaataacagcaactgcttaagaaatccttgtgatcttggatccttagataaaatgatcaggatgccaaaaatgtaattgtggattctgcataatgaagcagtttgcatggaataagcatctatattatggaaacaaattgtatctaatgagtccttctgtcattcctgaacttaacactaatagctgagttagtgggtgctccaatatggaagtaaaacattactggaaatacttattttagtgaaatggatgtcgtatggatgctcatgactttttaataaaatgcacagggttcagcatcaaatccatgtaaacctttggcaatgggaccaggcgtggtggctcacgcctgtaatcctagcactttgggaggccgaggcaggtgaatcacctgaggtcaggagttcgagaccagcctggccaacatagtgaaactccatctctactaaaaatacagaaaattagctgggcgtggtggcagacacctgtaatcctatctgctcgggagcctgaggcaggagaatcacttgaacctgggaggcggaggttgctgtgagctgagatcgcaccattgcactccagcctgggcgacagagcgaaactccatctcaaaaacaaacaaacaaacaaacaaacaaaaaggttggcaatgttgaactttacctgagcatcatactcctggaaaatagcaatagtttaaaaatccctccactcttttgcggtcctgaaaatggcttactgcaaaaatccacccttccctatatgatttagataagaccaatggatgacgacccccttgtttacctaagacaaagacaacacaggctctccaaattcccattattttatctcataaatgattagatgaactgtttgcactgaccagtctggacaaaatacctgctaatctgacctgaccaaactctagttaggcttctcttttcccctgaggcccctgaactttggcctactgttgagtttaaacaagcattggaatgtggaacaacctccttaatgacccttccagaattggctgactgcaaagaaaaattgtccaatgtgccactctctgattccatttcccccatactctgttccttctaaccttgtttgctccagtggagtattctttcacaatagctttccccctgccacccccattacataagtctttttgaaaaaggcctttctttatctaagtatggatttgtttttattggactccttgtagcataaataggtagaatggaatagaaggggttttattatagtgatttcattcaattatttgaactctttctgaagtatatgccaaaacccacatagttactgattatcaaaagttgatttttaatgaaatttggtatgtcaactttctcagctctctttcaattttgttgaaagcaaagaattgggaaacatctaacttgcaaaagatgcattactccatcatcagagtcatccacttcctcactggccagcactgatatttagaaatgtatctttcctggagccctggaggttcctcctcccataagcaatgcaccatagtgggtgtatatcagtagcaggagcttggatataaatggggagctggaagagtaggactgggtaacatctgagagctagcatgatagaagatctcttttaagaaaaagcatagacagaagttgagaatctagaaactcattttctaaaaactaactgccaatggtccattctctgtcttcatcagagctgccattttgctgttgccacttgctagtgttgaaaaagcctcctgcttcaggttcactatcagcatgaatgaagaaaaggtggccagatttcaggctcagatccagaatggwgataagggtaccttcccttacagaaagaagataacatatagaatagcaacagctgatgtcaaaaarcctcttttcttttttaaartagyggtgagtaactattactggaatggaatagataaacctaaatagaggtaaaggggtaatcccaggactcaggcttgcctctcttatagcattataattactcatcatgcaaaagccaaaacagtgtcagcaatgctccctggaatattaaggtagctgggcactgacaatgttacaagttctaggaagttagccaaatagtctttctcgtagcaagtattgaatagcaaaacatgaaaagtaggagactagtggctctgtcctcaattactggcttcgcgtttcctttattattttttggattttaagcttgcatacacttactaaataattgcatgtcaatcttatcccgtgtcctaactcttcttactagcactgcagaattctgtcttttcagcaaggttgaaattgtgaatgccctttttgtccctaacaactatgtcaagatataattcacatgcaatacaattcacccatttcaatatattttggctaattcgttattcatttacaaattgtggtaaagtatgtataacataaagtttgccatcttggcttttttaagtgtatagcttagtggtattaatgaatgatattcacaatgttgagcagccaccaccactatttacttctgaaacttcaacatgcccaaaataaactctaattattaagcaataactccccaacctctgataatctctaatctacttttgttactggaaaggggtcctgatcctgactccaagagaaggttcttggatctcgtgcaagaaagaactcagggcgagtctgtaaattaaagtgagaacaatgtattaagaaagtaaaggagtgaaagaatgggtactctatagacagcagccccaagggctgctggttgcccatttttatggctrtttcttaatatgctaaacaaggggtgggttattcatgcctctcatttttagaccatatataataactttctgaygttgtcatggcatttgtaagttgtcatggcactggtgggagtgtagcagtgaggatgaccagaggtcactcttggtaccatcttggttttggtgggttttagctggcttctttactataacttgttttatcagcaaggtcattatgaactgtattttgtgctgacctcctatctcatcctatgaatcagaatgccttaactgtctgggaatgccacccagtaggtctcagccttatttcacccagccccttttcaagatggagttgctctggttccaatgcctctgacatttcccaccttccttttataagagaacccttaatcctaagggctgcagagggacaaagatccattttctgtaacttctttatgctgaataggggcaatgatattcctgcctaactattagggtcttttgtgtttacggtagagaggagcttagttagaaagcattggcctgggygcagtgactcacgcctgtaatcccagcactttgggaggccgaggtgggcagatcacctgaggtcaggagtttgagaccaacctggccaacgtggtgaaaccccgactctactaaaaatacaaaaattagccaggcgtggtggcgggtgtctgtaatcctagctattcaggaggaagaggcacgagaatcacttgaaccaaggaggcagaggttgcagtgagttaatatcgctccactgcactccagcctgtgtgacagagtgagatttttgtctcaaaaaaagaaagaaagaaagaaagcattggtatgttgagggccatttataacttttgagttccaacaaaaggtgatatttggaagattaataagtgtttaagaaaacattgagtaagcttattttgcattgctatacaaagagtacaacagcaatatatttcaccacactaaaacaacataagcaaaattatcccaacttaactaagttagaaggctttctatcaactgggcaagtgttagaaccaagctgatagggggttgctagatgattccagtatgtgcccagaattagatattgattcagattttgacattacccatcctctcgtttcttttgagcagcagttagagattactggttgatttacaggaataagcagagtcagtttaatttgcagggaaaaaaatttaaagcaactgatgagactagaatttaataacaagtgtaccacagttcttgaaacattaagttttctgtctccagtttcccatttttattaaagacaaattatggtaacaccaacttgctttattatacttggcctgattgtttgyataaagtgtagcaagaataattatttttcacataagctttttgtaaattggaactctgttccatagaaggaatcttagataagatttttttagatccgagccctgccattggtttgtatgcttaaatacctatgagctaggtaaattcctctcctcttgaggttccaagataacctggggcttctgggcctgttagaaagtgacattctttacttatcacaggtcagaaaccctgtgcagggactgtgtaggcaaggtatgaggccagttctcccaagggacttgtattggccctataagttaaatttaattccttaaaggaaaacacaccattccagttaaagccttggtaaaataaccagtttttccaattgcatcctgttacaaaagaaaatggatttttattgcacttatgcaaataactatattgccataaattaagaatacttacaaatagtttccatattttagagaaatctggtagagagaaacaaatatgatccacgttttgtttacaggagtatacttaattgttaaaagctgtaaatagcttctattagtttagtccatgcagttaattcctgtttgatatttatgaacatttcagctttccrtgagtccgaaagttttttcctgtattttaatattacagtgttcaaaggtattagaaacctgaatttaagagcacctgttagagtcctatagctgattataaaccatttttttaaagaggaataaaacaacaagtgtccgtggatgacaaaatgtcttaggacagtcacagttaaaaacacaattgacaaagaaatttggttacctctgtggcatacaatgattttatgtaacaattataattattaataatatacactaagttatattagaattattttggaacacataccaataacatatttatacaaatatagcccaaagaagctaaacattattttatatttgacagtgcttcttgtatgatttttatataaaataagccaaatgtcacttttacattagtgtactattactgtcaaacccagtttttaataaaaccttatagacaaatgtatttaatcagtttgaccataaggtaagatttttataaacctcttttataactacctttacaatatttgttaaagagcagagtaaaagcaggtttttgctttaagaaaaacctgttgtgcttttattccaatgtttagtttaaaactgaataatacccctttaactttagccaatctgttcacacatagattttttttataattaatttttttataaaacgtttacaacttgtttaaacctttagaattttcctatttcacttaaagcaatcctttaaccctttaggcaaaaaaaatacatgcccatgcctttttataattttttactaaaaacaaagtttacttttcttacacaccttgcatgtaaaactgtttcttcagtagtcacaaatacatgttacactgttaactcttagtgactttaacttttggtgaaaaccttggtaagttcagggttttaattaggtatggagccgaggacagcagacagaagtgcagataaggtctgatttttttttagcatttacgtgtcccaggccttacctagctgtaaagcaggaaagttttacagttacaagttatagtggcattttatgacacatttaggaagcctaattacctttaaattgtacaacattttttgcataaattattttcatatttttatgacttacacagaccatttatgacatgcttggactttyggacttgtcctaaacatacctcttgtcaaacaaccattttactttagaacaagaatttaccatacaagatcctttgttatataaaatctttttctttataaccttctttgtatagctagggggcatggctaatcccatatatccccaggccttatctagaatttaatgctttaaaatgaattgaggctgggcatggtggctcaggtctgtaatcccagcactttgggaggccaagtggggcggatcacttgaggtcaggagttagaaaccagcctggacaatgtggtgaaaccctgtctgtactaaaaatgcaaaaactagccaggcatggtggtacgtgcctgtaatcccagctacttgggaggctgaggcaggagaatcacttgaatctaggaggtagaggttacattgagctgtgattgtgccactgcactccagcctgagcaacagcatggaactccatctcaaaaataaataaataaaatagaataaaataaattgaacaatttgtaaaagtcaaagaagcagtttatgacctgccactctgcttagcacccaatatcaaactggcaaggctcaaacttgccccctgttggrccccatcatcrttaatccaacctctgaccagagagttttgacttgtgatctctgggaargatggttaccctgagtaatagaaaaaataagaaagggaaaggagagagagaaaagccttgcctgtggcaggatggggaaggtgaagatctcagggagttgagagaaagacccacccattccagcaacactgaatcaaaagttcaggtggccgcttgtcagctgtgaagggatatttttcagcagtcccatcagctctcaagtttccccttttagggaagaaaaagctccccatgtcccacgatcctgttcatgcctaatcctgtcacccatagctgtcagcaaagagtgcaaggcagattatttgaaagagaatagcagttaatagtgtcaaacccattcttagccragaaggactttactgagagaggcctctaactccctaaatcttagaagggataactcttctaatttgggcctctaacccaaggttggttaagcgttcttgccttttattaagatgagtctctaacccactctgtttcaggagagactctaactcccctaagttgcacctctaacccaatcccatcctttacttgggtaccccaattacccaaagttggccaattagtgctgcagtctgtttcctttgggttgagaagtattttcagtattgtcccayttgtggttcatgagaaagatgttatcagaccccaacacttaaccaaagttagcctttgagttgggagtttccacactatagtcccctctgggtcgtcagaaagatgttactggaaaggggttccaatccagaccccaagagagtgttcttagatcttgcacaagaaagaattcagggcacattcatagaataaagttaaagcaagtttattaagaaagtaaaggaataaaagaatactccatagacagagcagccggctgctggttgcccatttttatggttatttcttgacgatatgctaaacaaggggtggattattcatgcctcccctttttagggccgggcacggtggctcatgcctgtaatcccgcactttgggaggccaaagcaggcggatcatgaggtcaggagatcgagaccatcctggctaacatggtgaaacccgtcactactaaaaatacaaaaattagccaggcatggtggtgggcgcctgtagtcccagctactctggaggctgaggcaggagaatggtgtgaacccaggagttagagcttgcagtgagccgagattgcgccactgcactccagcctgggtgacagagcaagactccgtctcaaaaaaaaaaacaaaacaaaacaataacaacaacaacaaaacacatacataccaaaaccaaatggcttacaacaagaattcctttttttttttttttttaggagtcttgctctgttgcccaggctggagtgcagtggcgtgatctcagctcacttcagcctctgcctcccgagtagctgggattatagcatgcaccaacatgcccaggtaatttaagaatttatttttcttttattttgagatggagtttcactcttgttgcccaggctggaatgcaatggtgccatctcagctcaccacaacttcttcctcctgggttcaagcgattcccctgcctcagcctcccgagtagctgggattacaggcatgcaccacccgcctggctaattttgtatttttagcagagatggagtttttccatgtttgtcaggctggtctcgaattcctgacctcaggtgatccacctgcctcaacctcccaaagtgctaggattacaggcatgagccaccatgcctggccaagaatttatttatcttactggcagatctgcaggtcagctgataattgtgcctcagactgacactcagatgcctaggctctggggttcaggttgtgctcatatctgtttcstgagtcttattctgggacccaggctgaagaagcagtgctggtgggacatgttgttcttatgaacaatggcaggactaggagagctatgtcaaaccaagagccaagtcaaacatattcaaggtctctctcctgtctttccattagtagtacatttgccagagcaagtcacagggccaggcccaagaagtataatcttccyacagtagaagggagaggggagtggatattcattgaacaataagccaaactactgatcaacctatcaatcatgctcatgttattaggttggtgtacagatcttacattggtattttggttgtacttacatcgatgttatccatacacaagaaattacatatatattctctcttcactcccttttcaacacataaggtaacattcaatacaaatacctaatgtaacaggtcatctttaaaataaattgtttcctgccagcagaggtgtgctaaatmatcatcatcatcatcatcatcatcataatttatgagagatttggggctttcccaccttcttctttaattcaagattgctgtcccatacatcatcgataattatgctttctgctgacatagtcagattcaacactttaagtttgtcacacacattgttttgatattgagtgcttgatwtggaaattcttacaactgaaagtgttggaaaggatgagatttttaaaaggaaaatgaaggggaatgtccaaaaggagaagtttaagggaaaaaaaacttcagagacattgagacgactgtctgtgaatcttcagcactcctacatgtttcgctcctgtgtgccaggattatctttctaggaatgcctagtgcaagcaggcagccctggagarataaagacaaggacttcccctgaagcaaatgtatttacattcctagataaataaagatcaaaacggtaactttcaccgagagatttacagacatctttccccagaaatatttgctcacattccagtgtagaatgtttctctctggaagggaggatgggcagattttcctgcagccctatgcaaaatgtgagcctcctaaactcagacttcgcctcctgtattgcacctgaaagcacctgtaagtaccatctggccctccctatgttgccttatgggaattggggctcagggaayccaagctctgaagtcaccttggctgctgcttttactgtgaatacacgtctttgtctctgactcagagatctcctgttttctaacacgatgtatataaaaatttgtgggccaggcgtggtggctcatgtctgtaattccagcactttggaaggccgaggtggctggatcacctgaggtcaagagttcgagaccagcctggccagcatggtgaaaccycatctctactaaaaatacagaaaattagtcrggcatggtggcagacgcctgtaatcccagcttctctggaggctgaggcaggagaattccttgaacccaggaggtggaggttgcagtgagccgagatcactgcattgcactccagcctgggcgacagagygagactctgtctaaaaaaaaaaaaaaaaaattgtggcacggtaacttgttagcttgcaagtagcagaaaatctcagacttttcagtttctgacttcacaagaaggaattaagaaaagtcaggaaaaatgtraataaactgaggtatctgtcccatccgaaagtgaccgggtgactctcttagtttaagaggatttatggaactgaaggcagaaatctgagaggccaggtagtttgctgtatttccactcggtgacataagacataaaatatacgtcctcaattaaaaaataaagcatggtccctgcccacataatgtttttattcaaagaatacaaggggcaaacacttacaagaaaaaaaaaaaaggcttttgaaacctccagggaggtatgactccagtgccagattggtgctgggggaagaaaacaacaagaggaagcagctggcaccaaaaataaaccagtacacactaaaakgaataatttscttttcattggaaaaatggcccattccaggtctggggcacagaaatgtccaataaaaataaatctggacttaaggagatcattttttaaaattattttattttwttattawtattattattattattattattattattattattatttgagatagagtcttgctctgtcacccaggctggagtgtagtggcatgatctcagctcactataacctccgcctcctaggttcaagcgattctgctgctgcctcagcctcccaagtaactgggactacaggtgcgtgccaccaagcctggctaatttttgtattttcagtagagaaggggtttcaccatgttggccaggctggtctcaaactcctgatctcagatgagccacctgctttacctcccaaagtgctgggattataggcgtgagtcattgcacccggcctatttttaaagttttatttatttttttgagactgggttatgagactggctaatttttatttttggtagagatggggtttcaccatattgcccaagctgatcttgaactccttggcctcagatgatccacccgccttggcctcccaaagtgttgggattagaggcgtgagccactgcaaccagcctagggaaataatttaactagagagaaagactattgtaatagtgtattagtcggttctcatactgctatgaagaactgccctagactgggtaatttataaagaaaagaggtttaattgactcacacttctgcatggctgggcaggcctcaggaaacttacactcatggcagaagacatctcttcacagggaggcaggaaggagaagtgctgagcaaagggagatctcgtgagaactcactcattatcatgagaacagcatgggggaaccacccccatgatccaattacctccacctggtctctccattgacacatggggattacggggatgacaattcaagatgatatttgggtggggacacaaagcctaaccatatcaaatagggagagcactctgaactcagaaatgtataagcatctcaaactcaaacagaaaaaagtttccttttagggtaggggagaggaagcagagataagagcctcttttaaggggaagctagataagtaagaagaaatgaccagtagatctgacaggaaagtgggctcgatgtgattagccgactcccaggagaagctgataaagggcaagttctacttctttttgctcagatctggaggcaagcagagttcaggggcccataggaaaaagagaaggctttggttaagacaaagcagagggtaagaaatgggcaattgtgaatgcttagttagaaaatacaggctgggcacagtggctcatgcctgtaataccaacactttgggaggtcgaggtgggtggatcacgaggtaaggagattgagaccatcctggctaaaatggtgaaaccttgtctctactaaaaatataaaaaattagctcggcatggtgacatgtgcctgtaatcccagccactctggaggctgaggcagaagaatcgcttcaacccaggaggcggaggttccagtgagccgagatggtgccactgcactccagcctgggcaacagagcaagacaccatctcaaaaaaaaaaaaaaaaaaaagaaaagaaaagaaaaagtaaagaaaatataaggtatgcctggaacatcttgttgtgtccctaaaattagattttctagttacaaatgatgactctaccacttgcagtttgttaaaatgagcctcccaaaattacgtacacaaagacagatgttaagacaaatatgatgaaattaacagtgatcgagtctaagtgaaggacatgtagctaattcattgtattattatttcatttatttatttttttaagacagggtctcgctccatcgcccaggctggagtgcagtggcacaatcatagctcattacaagcttcaactcctgggctcaagtcatcctctcacctcagccccccaaaattctgggattacaagagtgtaccactactcctggcttccattgtacttttaaaattttccttgcatttgaaagtttataataataaaatattgggggaaaatacacacagaacagacatattttacaagaaatttcaagtgcttaggaataaacctaacgaaaggcatataaatccttctttggataaaattataaaatcttattgagctgcattaaagaaaacctaaataagttgagagacataacctatttttggataagaaggatcaatatctccagctgattctgaaagtattgtggaattgctcacagtctttcttttcaacttgaacctggcagaatggcgctggcaaagaaaggagaggtgaagaagggccattttgccatccacaggtggtgacctaagaatactgccatcaatattcataattgcatccatgcagtgagctccaagaagcatgcccctcaagctgtctaagatattcagaaatttgccatagggtgatggggactccaaatgtgtggatggacagcaggctcaaggaagctgtctgggccaaaggaataaggagtgtcccataccgtctccatatgcattgtccagaaatgtaatgaggatgaagattcaccaaacaagctctctaccttggtaactcatgtacctgtcaccactttaaaaaatctacagtcaatgtgaatgagaacaaactactgattgtcaaagttataaaaccacctaaataaacaataaaaagtgttatacaggaataaagggccaagcacagtcaaacactcttgtttgtaagatttagtaggccgggtgctggtggctcacgcctgtaatcccagcactttgggaggccgaggtgggcggatcacgaggtcaagwgatggagaccatcctagccaacactgtgaaaccctgtctctactaaaaatacaaaaattagctgggcgtagtggcatgcacctgtagtcccagctactcgggaggctgaggcgggggaattgcttgaacctgggaggcggaggttgcagggaggcggaggttgcagggaggcggaggttgcagtgagccgagattgcgccactgcmctccagcctgggcgacactgcgagactctgtctcaaaaaaaaaaaaaaaaaaaaaaaaatttagtattagctatagggtttttttaaaaagtaggtctatgaaacagaaaggaaaaccaggaatgaagtcctatgcatacacagaaacatgactggggtggaacaccaccacagatcagaggagaaaaaaagatggctcctgggaaaatggttctgaaacaacagcaacaaaaacacagtttcagagaattaaagccctaaatgtaaaaggcaaaattataacaacttttagaagccaaaataggaaaatattttaagacactagagggggaaaatatttattaaacaatgtgtgaaaaacacaggacaaaggaaaggattgagaaattgaactgcaataaatgaagagcatctatcaaaagataaccataaagtaaatgaaagatgatgccaaaggaaatgaccaacaaaacgaagatatctgcatatcatatcactggaaggattattacccataatatattttatttaacttcaataaaaatggaaaaataaatacacagaaaaatgggcaaaaggcaattcatagataggactcaggaatgtatttttaaaagttcacatggggcgcagtggctcacgactgtaatcccagcaccagcactttgggaggccaaggcaggcagatcacaaggtcaggagctcgatgtattgttgaggaatacatatacactataaagattctagtgtacattccagattggtggtgcaatcatagttcacagcagcctcaaactcctgggctcaaacactcctcctgcctccgcctcccaagcagttaagactacagcatgcactatcatgcctggccaatttttcacctctgtggaaagaacgggtcttgctatattgcccaggctgatcttgaactcctagtgttatgtaatcttcctaccttggcctcccaaagtgctgggattacaggcatgagcctggccagtttattttctttctttctttctttctttcttctctttctttctttctttctttctttctttctttctttctttctttctttctttcttctcttctctttctctctctctctctctttctttctttctttcattcttttttctttttttttttttagacagggtcttactctgttgcccaggctggagtgcagtggcatgattatggtgcccgcctgtagtcccagctactcgggaggctgaggcaggagaatggcgtgaacccgggaggcggagcttgcagtgagccgagattgcgccactgcaatctcaaaaaaaaaaaaaaagattttggaagtttggccgggtgcgatggcccatgcctgtaatcctgacactttgggaggccgagacgggcagatcacaaggtcaggagttcgagaccagcctggacaacatggtgaaacccccacctctacaaaaaacacaaaaaaattagctgggtgtggtgggcacctgtaatcacagctacttgggaggctgaggcaggaaaatcgtttgaaccctggaggcagaggttgcagtgagccgagatcatgccattgcactccagcctggacaacagggtgagactccatctaaaaaaaaaaaaaaaaaatttggaggtgagatgtttaccattttagaacacttcaagggatgacaaagcccaaagctgcactgtccagcagaaatagaatgtgaactacatttgtaattttgaattttctaatagccacattttctttaaaaaaaaaaagtgaaaaggctaggcacagtggctcatgcttctaatcccagtactttgggaggctgtggtggaaagatcgcttgagtccagggcttcaagatgagcctaggcaatatactgggacctctacaaaacaaacaaacaaacaaacaaaggcaaagaaaatgaaagaaaaaaaattagccaggtgtgatggtgtgcacctgtagtcccagctacttgggaggctaaggtgggaggatcacctcagcccaggaggtcaaggctgcagtgagccatgatcgtgccactgcactccatcctgggtgacagattgggaccttgtctcaaaaataataataaaatacaataaataaggaaaaagaaacataaaattaattggaaataattttaataatatattttcatattatatatatgtgtatatatgtatatacacacacaaaatatgcttttaacatataatctattttatttattttttgagacagggtcttgctctgttacccaggctggagtgcagtggaacaatcacagctcactgcagcattgacctcctgggctcaagtgatcctcccacctcagcctcccaggtagctagctagaactacaggtgcatgccaccatgcctggctaacttttttttcttttctttttgtggagaccaagtcccactatgttatccaggctggtcttgaactcctgggctcaaacaatccttctgcatcagtctcccaacatgctgggattacagacatgagccactccacctggcctataatcagttttaacaatgggtatatccagtgattgacagcacagactctagagtcacataaaactgggtttaaatccctggtccatcatttgctatgctccaacaacttaaatcatttatcccttacaatgatatcataaagaactattattatcctaatttcacaaatgaaaaaaccgaagcaaaaagaagttaaacaacctgccaagggttctagagctagctaagtgtagagctgagaaatcacccagtcagcctggctcctgggcgcacaccaatgactgctatctctgctcttctgtacagagcctgacctggtatcccaatggagatgcccaggaggccactgagaatctgtagctagaaaacgttggtgtcctcaaccagtaaccattttatgagtctcaactcagtggggagtatatatgaaaaaattatttttcctcaaatcagtgctttcaaccatattmtactaaatccccttttcctatactttaacaacatgctggacagatatcatgattttccatttagattcctcactttcagtgtgaaaactgagttcagtccagctgaaaaccacaatcacatacctaattcaaaacttccctatctgctatgacctgaatgttgacgtccctccaaaattcgtatgttgaaatcctaactgccagggtgatggtgttaggaggtgagagctttggaaggtgattaggttatgatggtggggcactcatggatgggatttgtgcccttatgaaagaggcctcagagagaccctggccttttctgccacatgagggttcgtggaccagggagtgggccctcaccagacagaatctgctggtgccttgatcttcaacttttctggagaattgtgaggaacaaatttctgttgtttacaagctaccctgtttatgatgttttgttatagcagcctgaatggactaagacactatccttcattccttgcttagagctacagcttgaggaaccaaaagaggtggcggtcaggaggcggggatagagtcaacttcattatttcctctaccacactgaggtgaaatctggctttcattttcttgactcccattccaccccacccacaccctgcctagcctctgactcttactgctggagttcccttacctgaccaactatgtcttggggccagctaaggtccaagaaaacatgtgtatccctgccacccaaccagcaagcagcagcaactactccaaggttgccctctctcttgtgctgccatctcgaagccaaggttcagttgaggcaagaaatgcctgtctggccgggcgtggcagctcacgcctgtaatcccagcactttgggaggctgaggggtggggggtggatcacttgagctcaggagttcgagaccagcctggccaacatgatgaaaccccgtctgtactaaaaatacaaaaaattagctgggcgtggtggcgggcgcttgtaatcccagccactcaggaggctgaggcagaggcagaagaatcacttgaacgcgggaggcggaggctgcaggttgctgtgaaccgagatcgtgccactgcacctgcactccagcctgtgtgaaagagcaagactctgtctcaaaaaaaaaaaaaaaagaaaagaaatgcagccaggcgtggtggctcacgcctgtaatcccagcactttgggaggccaaggcgggtggaccacaaggtcaggagattgagaccatcctggctaacacagtgaaaccccgtctctactaaaaatacaaaaaaaaaaaaaaaaattagccaggcgtggtggcgggtgcctgtagtcccagctactcgggaggctgaggcaggagaatggcgtgaacccgggaggtggagcttgcagtgagccaaggtcgcgccactgcattccagcctggacaacagagtgagactctgtctccaaaaaaaaaaaagaaatgcctgtctacttgttgcaggcacccccagtctctctcagcgtttctactggaggcttctccctcacttagttttttgttttttggtttttttttttcctttgagacggagtcttgctgtgtagtccaggctggatggactgcagtggtgagatctcgactcactgcaagctccgtctcctgggttcaagcaattctgcctcagcctcccgagtagctgagattacaggtatgtgccactatgcccagctaatttttttgtatttttagtagagacggggtttcatcatcttggccaggctggtcttgaactcctggcctgaaatgatctgcccaccttggtctctcaaagagctgggattacaggtgtgagccaccgcgtctggccaccctcacttagttttgtgaaggaaagaaataccacatggccaagggcaactctcatttcctctgtctgctccacttctccccagcctcttttctatagacgggagttgaggatagggtgaaagctgccatgaataaggctcattctgctgttcgttagtaaacccaggggtagaatctagctccagtgatgggtggctctctttaaaacatatctttcttggttcttctttgcctcggcttttgacgttagtccttgattttgattcaacagaagcagccacttttggcatcttgttatagatgcacaggtggtaattgaagccatgagagttaaccaawatataaagaactgcagacagctgagaaggagtgctatcttcgtcctttattaagagtcagctattggccaggcgcagtggctcacgcctgtaatcccagcaatttgggaggccaaggcaggcggatcacgaggtcaagagatccagaccatcctggccaacatcgtgaaaccccgtctctactaaaagtacaaaaaattagctgggcgtgctggcgggcgcctgtagtcccagctactcgggaggctgaggcaggagaatcatttgaacctgggaggcagaggttgyagtgagccaagattgcaccactgcactggtgacagagtgagattccatctcaaaaaataaataaaaagtcagctattagcaccttcggaggctgaggtgggcagatcacctgaggtcaggagttggagacyagcctggccaacatggtgaaaccctctctctactaaaaatacaaaaattagctggatatggtggtgcatgcctgtaatcccagctactcaggaggctgaggcatgagaatcacttgaatctgggaggcagaggttgcagtgagcagagatggagtgactgtactccagcctgggcaacagagcgagactcagtctcaaaaaaaaaaaaaaaaaaaaaagaagattaaaaaaatgtgattatgcactggtgaaatagccattgtagaatcatgtcttgaaatgtcctatgttgactaaatgtatccagaattgccatgtgaaatgtgtgaaggacaagatgttctgtgtttggtaaatgtgtatgaggaagagagaaacaattagaagttctctgtcacacaayctacacactaccaggaagttattctagaaaaaataacgytctctaaaacgaaccatgcaatctgacacccgtcttcyacctctcagggaagagaaacttcaaaggcaggaggcagggccaatgcatgatgtgttctattgtcccaaggagacctgcctgagccttgaccctagtttctgatggctttccgtgttgagtgtagcctaagaagcagaaactgaatctactggaacctttctgaatagggtttatttaatcacatgcactgtttcctgtttaaagcatttcccaaaatggcatagcacctcctctccaatggtggtcaaattgcgatgtgtacccttgggggaacttgaagaatttctatgatgtacatgggcaggaacagcttgaaaggaccaatttctgagtctcagcttccatttgcactccgtaaaattgacctacctgggaatgtgtctatggtctgctagtattccagtcccccttctcctagcatacaaaataaggcagacttctcacccatcccaaaacttttatgttgtgtagggtgcaggggtgaggggctgtacaaactctctgaaacacaaaataaaggtactattcagccttatttcatccagatacccagattcataccttgattaattagctatctatctattgctgcatagaaaattagcccagaacagccaggcacagtggctcccacctgtaatcccagcactttgagaggccgaggtgggcagatcacgaggtcaggagatcaagaccatcctggtcaacatgataaaactctatctctgctaaaaatacaaaaattagctgggcatgcgcctgtaatcccaactacttgggaggctgaggcaggagaatcgtttgaacccgggaggtggatattgcagtgagctgagattgcaccactaaactctggcttggtgacagagagagactctgtctcaaataaataaataaataaataaaaataaaaaaaataaattagccaataacatagtagcttaaaacaacaataaacacaaattccccagggtcrttatggtgggatgcgacttcatcaccagattgacctatcaagtgcaaggaaacttggcttcaggagaggctaacttacttctgtgtagtgtagggggaaaagagaaaamacacacacacacacacacacacacacatgtgcgcgcacgcacagcggtaaagcagaagtttccagctgggttttctgtccctttggccacataatcaagtcaggtgatctaacttgttaaaaccatcagtaaagaaattgaccctggggtttcccagattcagtttttatttttatttattttatttatttattttttttgagatggtgtctcactctatcacccaggccggagtgcagtggtgccatctcagctcactgcaaccttcgcctcctggattcaagcgattctcctgcctcagcctcccgagtaactaggattacaagcgtgcaccacaacgcctggctaggttttgtatttttagtggagacagggtttcaccatgttggccaggctggtctcaaattcctgacctggacagaggcctggcaggtgatctacctgcctcggcctcccaaagtgctgcgattacaggtgtgagtgactgcgcttggcccagattcagattttaaacagcacatgacaaatcttgctgcccttctatccgctaaaggtaaaaaaccaaacgtccataattctccaaaggcaaagatagagtttttccartacagatgtaagtcagcctattatccacacattcccaacaaatggcctttaagagcctttggtgccaaattcaacaaatggaagggttttacacaggttaggaagatcaccagatgcatgtgagtcatgtttacttgaagatcactcttcatgacacatattaaatattcttagtgcttacatacttaatgaagccttataggtattctgtaagtatttattgagaaataggaaagaagaaggaagaagaaaaaatacaattcttgtgggttctattttcctttctgcctctgcgctttccctatactaagcatttttgcttcctcatctacattgtagttctactctcagctgtttacacttcactttcctaaaagcaccagtgtgaccttgatatctggccctaatttagccttttgatgtccatagtttctgttttctccatctgacacatgttcgtttctcttattcttggatgcctaggttctgggctcctattgggttatctttcaagtcatcccaagatagaagatagacttcctgctgagagagaaggcagttagaggctggttaggcagatagagagggagggtctctggagaagggcagtgttcacaagaacgctagcaggacmgtacctacaccgcctctgcagctaatgggaagaaatgtggttaagaacttccccttatgccaggatgttgctcagaagggactgtcctaacttaggcacaggcggaataaatcaacctaagtgtccttggcccagmtcatcatagtgtcattaacatgacatttttgtggttttagccccttggtgggtttcacttaggcactcgtgggtaacaaccaagatggagtcactctggccaatcccaggcatgtgcagatgcaacacccttaggagggaactttacccctcccattttgggcagaacccacagaagacttccttccttcctcttccacataaaagacccagaactcagccccatttctgaaaacttgctttcagggcacctctctttgctgagagctttccttttgcttaataaatcctactctacttactctgtggtgtctgtgttccttattcttcttggtcctgggataagaactcggatgtagctgaactaaggagtgatttagactgcaatgctgctccagaagatagacttcctgctccagaacatagaaatgggtgtgatatcttctcccaaattcaaaataaatgacaatggctgagcacggtaaattatgcctgtaatcccagcacttcgggaggctgaggccagcggatcacttgaggccaggaattcgagacaagcctgaccaacacggtgaaaccccctctctactaaaaatgtaaaaattagctgaacgtggtggctgatgcctataatcccagcactttgggaggcagagatgggcggatcacttgacgtcaggggtttcagaccagtttggtcgacatggtgaaaccctatctctattaaaaatacaaaaagaattagccgagcgtggtggcacacgcctgtaatcccagctacttgggaagctraggcataagaattgtttgatcctaggaggccagatcatgtcactgcactgcagccttggcaacagaatgagactctgtcaccaaagaataaattaatacacaaatgaataataaaaagtaaaataaaataaaacaactcaataagccctacttaccactcttttctaggcaaataggttaaaagagttgtgtaacctttcatatttatgtgatacctttcacgattgatgccattcacttcttttttttttgagacagaatctcactctgttgcccaggtaagagtgcagcagcamgttattggctcactgcaacctctgsctcccaggattaagcgattctcgtgcctcagcctcccaactagctgggattacaggcatgcgccaccataccctgctaatttttttttttttttttagtagagacgggtttccccatgttggctgggctggtctcagactcttggccttaagtgatctgcctgccttggcctcccaaagtgctaggattataggcatgagccaccatgcccagccacttcttctttttttcttttatttcaatagcttttgggggaacaggtggtttttggttacatggataagttctttaatggtgatttctgagatatcagtgcaactatcacctgagcagtgtacactgtgcccaatgtgtagtctttcatccctcagtcccctcccaccttttcccctgagtccctaaagtccaatgtccattttatcattctcgtacttttgcttcttcatagcttagctcccatttgtaagtgagaacacacaatatttggttttccattcctaagttacttcacttagggcctcccactccatccagttgctgcaaatgccrttatttcattcctttttatggttgagtagtattccaaggtgcatatataccacattttctttatccagtcgttggttgatgggcacttaggttggttccatatctttgcaattgtgaattgtgctgctgtaaccatgcacatgcaggtgtctttttcatataatgacttcttttcctttgggtagatacccagtagtgggattgctagatggaatggtagttctacttttaattcgttaaggaatcgccatactgttttccatagtggttgtactactttacactcccgtcagcagtgtagaagtgttcccttttcaccacatccatgccagcatctattagtttttgatttttaattatgggcattcttgcaggaataagctggtatcttattgtggttttaatttgcatttccctgataattagtgatgttgagcattttttcatatgtttgttggccatttgtatatttcttttgagaattgtctattcatgtctttttccctcttttggatggggttatttggttttttcttgctgatttatttgagttacttgtagattctcaatactagtcctttgtgggatgcatagtttgtgaatattttctcccactctgtgggttgtctatttactttgttaattctttcttttgctgtgcagagcttttttgtttaattaggcttcatctatttatttttgtttttgttgcatttgcttttgggttcttggtcatgaactctttgcctaaaccaatgtctagaagagttttcctgatggtatcttctagcactttttttttttttttgaaacagagtctaactctgttgcccaggcttgagtgcagtggcacgatctcggctcactacaacctctgccccctgagttcaagtgattctcctgcctcagcctcctgagtagctggcattacaaacacctgccactgggaccggctaatttttgtatttttagcagagacaggattgcaccatcttggccaggctagtcttgaaatcttgacctcgtgatccacccgcctcagcctcccaaagtgctgggattacaagcatgagccactgtgcctggcctcttctagcatttttgtgctttcaggtcttagatttaagtggtttttttttgtttgtttttgtttttgtttttgacagtctcactctgtccsmaggctggagtgcagtggcgtgatcttggctcactgcaacctctgcctcccgggttcaagcgattctcctgcctcagcttccccagtagctgggattacaggcacctgccaccacgcccaactaatttttgtatttttagtagagacggggtttcaccatattggccaggctggtctcaaactcctgacttcaggctatccccctgcctcggcctcccaaagtgctgggattacaggtgtgagccaccgcaccagccagatttaagtctttaatccatcttgagttgatttttgtgtaaggagagagatgaggatccagtttcattcttctacatgtggcttgccaattatatcagcaccattggttgaatagggtgtcctttccccactttatgtttttgtttgctttgtcaaagatcaactggctgttagtatttggctttatgtctgggttctctattctgttccattggtcctatgttcctatcttcataccagtaccatgctgttttggtaaccacaggcttggcacatagcttgaagttgggtaatgtgatgcctccaggtttattctttttatgttgtattgctttggctatgtgggctcttttttggttccatatgaattttaggatctttttttctagttctgtgaagaatgatggcagtattttgatgggaattgcattgaatctgtagattgcttttggcagtaagttcatttttgcaatattgattctactgatccatgagcatgggatgtgtttctatttgtttctgtcatctatgattcttttttgtttgtttgtttgtttgtttgtttttgagacagagtctcactctgtctccctggctggactgcagtggcacaatcttggctcactgcaacctccacctcccgggttcaagcaattctcctacctcagcctcccgagtagctgggattattggcatgtgccaccatgcccagctactttttgtatttttagtagagacggggtttcgtgatgttggccaggcttgacttgaactcctgacctcaggtgatccatctgccttggcctcccaaagtgctaggattacaggtgtgagccaccacacccagcctatgatttctttcagcagtgttgtgtagttttccttgcagaggtctttcacctccttggttaagtatattcctaagtattttattttatgtatatattttttgcagctgttgtaaaagggattgagttcttgatttgattctcagtttggtcgctgttggtgtatagctgtggtactgatttgtgtacatggattttgtagcctgaaactttactgaattcatttatcagatctaggagctttttggatgagtctttagggttttctaggtatacaatcatataatgagtgaatagtaacagtctgactccctcttttccaatttgggtaccctttatttctttctcttgtctgattgctctggctaggacttcctccattaacttctttacaattatctttgcaatctgagtttactccttattaaatttgttctcaattctttaggaagattgaattttagtgtataaatcctgttgacaaatgaggtwctagaatgatgagaattctctttaagaggccatttctgagataaatctacatagcaagtaggtctagttgctcagtccttacacctccaagggagcctggaatcatgattgacccttggcaaaccctcggaaatgttcttaggatgttctttatgtcactaattgatgattttgttgtgtacacttggagcaatgtaccatgccatrctggcttgctaatttgctttgcacaaacattgagattgatgatgtacccctggtctcattgttgtgatcctgagttttggttgctatggctaatcgcataacaggatatgtctttgtgattggtccctgataaaagccttagactctgaaacctgaatgggcttccctgagcagagacatttcacatatgttcatttctagagagaaaatacatcctgtgtgacttcagatgaaaaaagacttgaaatatatgttggatctctctaaatactgctacagtctcatcaatataccataatgtagtagtctcttgttgtgtagtatcaccaggagttctttgtcttatgaccatgcaaattaaggaatgtggatgcaaagcgtgaggttggagtgaaagtttaataaatgaaagaagaaagctatctatagtggagaggggagcccaagtgggctgccgtttttacagtttaatttaaaaggtttttggkttgtttgtttgtttgtttgtttgtttgttttttgagatgaagtcttgctctcgtcccccaggctagagtgcaatggtgcgatcttggctcactgcaacctccacctcccggattcaagcaattctcctgcctcagcctcccaagtagcgggattacaggcacctgccaccacacctggctaatttttgtattttttagtagagatagggtttcactttgttggccaggctggcctcaaactcctgacctcaggtgatccacccaccttggcctcccaaagtgctgggattacaggcatgaaccaccgcacccggccagaagtttttttgtgtgttttttgtttgtttgtttgttttggagatggagtcttgttctgtcacccaggctggaatgcagtggcatgatcttggctcactgcaacctccacctcccaggttcaagcaattcttctgtcccagcctcccgagtagctgggactacaggtgcctgccaccatgcccggctaacttttgtatttttagtagagatggggtttcaccttgttggtcaagctggtctcaaactcctgacctcaggtgatccacccacctcggcctcccaaagtgctgggattacaggcgtgaggcaccatgcccggcctgattttttaaaagtttttataggaaactcctctcatctctttagttgttgagtaacttatctgtaaagtcgtctgcataactccacactatctacaggtgtgagccactgtgcctggcccaggctgactcttgttagggactaatgcaaccaatgactttaagttggagccagtgctcactgaccattctgaaaatcctagggctcgtaagaattatgctaagttgggccagtcgcggtggctcacgcctataatctcagcacttcggaaggctgtggcaggcagatcacttgaggtcaggagtttgagaccagcctggccaacatggtgagaccctgtctctgctaaaaatataaaaattagccgggtgtggtggtgcacacccataatcctagctactagggaggctgaagcaggggaactgcttgaacccaggaggcagaggatgcagtgagctgagattgtggcactgcactccagccttggcagtagagtgacactacatctcagaaaaaaaaaaaaaaaagaattatgctaaatctactctattgctctataattgtaacaaaaaagtctgaatgacagcacatctgtttacagcatgatttactgaattactattattattattattttttgagacagggtttccctctgtcattcaggctgtagtgcagtggtctgatcttggcttactgcaacctctacctactgggctcaagtgagcctcccacctcagccacctgagtagctgggactacaggtgcataccaccatgcctggctaatttttttatatttttggtagagtcagggttttgccatgttgcccaggctggtcttgaactcctgagctcaacmaatccacctgcctcagcctcctaagtgctgggattacaggcatgaaccaccacacctggccaattgaccgaatattttaatcccactgttgagacctactgctccaaaaaaaaascttcctttcaaaatattactactcatggacaatgttcctggtcacccaagagctctgatggagatgtacaagaaggttaatgttgttttcatgcatcctaacatatccacttagcagcccatgaattaaggggcaattctgactttcaagccttcttatctaagagatacattttgtaagacgatggctgctacagatagtgattcctctgatgaatctgggcaaagtggattgaaaaccttttggaaaggattcaccattttaggtgccatttgattcatgtaagtaggtcaaaatatgaacatgaactggagtttggaagaaattgattttaatcttcatggatgactttgaagagttcaagagttcagtagaagaagtaactgaagatgtagtggaaatagcaagagaactggaattataagtggggcctaaagatgtgactgaattgcttcaatcacatgctaaaaaaagctttaatggatgaagagttgctttttatggatgagcaaagaaagtggtttcttragagggaatatattcctggtgaagatgctgtggatattgttgaaatgataatgaaggatttagaatattccataaatttagttgataaagcacctttaaaaggatttattacaattttgaaagaagttctactatgagtaaaatgctatcaaacagcataacatcctagagaaatcttttgtgaaaggaagagtccaccacagccagcattatactgattggggaaaagttgaaagcattctctctgagaactggaacaagacaaggatgcccacttttattacttctattcaacatagtactggaagtcctagccagagcaatcagacaagaaaaagaaacaaagggcatccaaatcaataaagtggaagtcaaactgtccctgttcagtaaagtttcagaatacaaaatcactgtacgcaaatccgtagcactgctatacaccaacagcaaccaagctgagaatcaaatcaagaactcaatctcttttgcaacattgctggaaaaaacaaaacaaaacaacaaaagcaaaacaaaacaaaacaaaaccaaaaaagccacaaaatacttaagaatatacttaccaaagcaggtgaaaggcctctgcaaggaatatgctgaaagaaataacatgctgaaagaaataacataaacaaaacatgctgaaagaaataatagatgacacaaacaaatggaaacatatcccatgctcatggatcagtagaatcaatattgcgaaaatgaacatactgccaaaagcaatctgcagattcaatgcaatttccatcaaaataccatcatcattcttcacakaactagaaaaaaagctgggcgcggtggctcacgcctgtaatcccagcactttgggaggcagaggtgggcagatcatgaggtcaggagatcgagaccatcctggctaacacagtgaaaccccgcctctactaaaaatacaaaaaattagccgggcgtggtggcgggcgcctgtagtcccagctacttgggaggctgaggcaggagaatggcgtgaacccgggaggcggagcttgcagtgagccgagattgcgccactgcactccagcctgggtaacagagcgagactccgtctcaaaaaaagaaagaactagaaaaaaaattctaaaattcatatggaaccgaaaaagagcccgcatagccaaagcaatactacataaaaggaataaatctggaggcatcacattacccaacttcaagctatactccaagcctgtggttaccaaaacagcatggtactggtatgaagaagataggaacataggaccagtggaacagaatagagaacccagacataaagccaaatacttacagctatttgatcttcgacaaagcaaacaaaaacataaagtggggaatggacatcctattcaacaaatggtgctgggataattggcaagccacatgtagaagaatgaaactggatcctcatctctcatcttacacaaaaatcaacttaagatggatcacagacttaaatctaactcccgaaaccataaaaatgccctagaagataatatcagaaaaactcttgtagacattggtttaggcaaagagttcatgaccaagaacccaaaagcaaatgcaacaaaaacaaaaataattagatgggacctaattaaacaaaaaagctctgcacagcaaaagaaagaattaacagagtaaacagacaacccacagagtgggagaaattattcacaaactatgcatccaacaaaggactagtattgagaatctacaagtaactcaaataaatcagcaagaaaaaaccaaataacaccatccaaaagagggaaaaagacatgaacagacaattctcaaaagaaatatacaaatggccaacaaacatatgaaaaaatgctcaacatcactaattatcagggaaatgcaaattaaaaccacaatgagataccagcttactcctgcaagaatgcccataattaaaaaatcaaaaactaatagatgttggcatggatgtggtgaaaagggaacacttctacactgctgatgggagtgtaaagtaaatgcaaacgcatttaccactacagaaaacagtgtagagattmcttaaagaactaaaaatagaactaccattccatctagcaatcccactactgggtatctacccaaaggaaaagaagtcattatatgaaaaagacacctgcatgtgcatggttacagcagcacaattcacaatcgcaaagatatggaaccaacctaagtgcccatcaatcaatgactggataaagaaaatgtggtatatatgcaccatggaatactactcaaccataaaagggaacraaataatggcatttgcagcaacttggatggagygggaggccattattctaagtgaagtaatttaggaatggaaaacgaaatattgtatgttctcacttataaatgggagctaagctatgaggatgcaaaagcataagaatgatacaatagactttggactttggagactcaggaaaaggtgggaggggagtgarggataaaagactatagatcgggcaccgtgtacaatgctcaagtgacagttgcaccaaaatctcagaaatcaccactaaagaaagtatccatgtaagcaaaaccacctgttccccaagaactattgaaataaaataaaatattttaaaaatgagtccatcaatgcrgcaaacttttttgttgtctgatttgaagaagttgccacatccactccagccttcagcaaccaccactcagatcagtcagaagtcatccatgttgaggcaagactctccaccagctttttgctgatgacacaagatgacaactcaattaaggctcagatgattgttagcattttttcagcaataaagtattttataattagtgtatttatgttgcacatttatgacataatgttattgcatayctagtaggttacagtatagtgtaagcataacttttacatgcactgggaaaccaaaaaatttgtgtgacttgctttatcacaatattcactttatdgcagtggtctagaacaaaacctgatatcacaaaacctgatattcctgatatatgggcttatctctgaagtatacctgtatctcagtgaagatgttattatttatttatttatttgagacagagtctcactgtgtcacccaggttggratgcagtggcacgatctccacttactgcaacctccacctcccgggttcaagagattctcctgcctcagcatccgaagtagctgggactacargcatgtgccaccacaccaggctaattttttttgtatttttagtagagacagggtttcaccatgttggtcaggctggtctcraacttctgacctcaaatgatctgcccacctcggcctcccaaagtgctggggttacaggcgtgagccaccgcgcctggacaaagatgttacttgctttttttttgagacrgagttttgctcttgttgcccaggctagagtgcaatggtgtgatctyggctcactgcaacctccgcttcccgggttcaagcgattctcctgcctcagcttccccagtagctgggattacaggcacctgccaccacgcccaactaatttttgtatttttagtagagacagggtttcaccatgttggccaggctggtctcaaactcctgactttaggctatccgcctgcctcggcctcccaaagtgctgggattacaggcgtgagccaccgcgccyggccaaagatgttattttctataaaggcaaccgttagaaccttcaactcattatttttaggctgacaaaaacatctgttattattatacyacactatgtattgtgaatagtttattttacaagcataatagagtattttgaaattacactctgctagaaccccttgctagttgttaattttacctagaaaagactcacagattctttgttaaaataagaaatctagcaaagtcagacttttctccctaccaccccacccaaccccattatacacaaaagaaaagaggaacagtccagatgtggtggctgacacctgtaatcccagtactttgtgaggtggagagttgggcagatcacctgaggcctggagtctgagatcaccctggccaatatggtgaattctcatctttactaaaaacacaaaaattagccgggcatggtggcccgtgcctgtaatcccagctacttgggaaggtgaggcacaagaatcgcttgaactcaggaagtggaggttgcagcgaacaaccactgcactccatcctgggtgacagagcaagatctgtctcaaaaaaaaaataaataaataaaataaaataaaatataaaaaaaagagatgagaaacaaatgatcagatttgcagagyaatctttcaagaatttatcctatttacacatgcagaaatgtcaattacaacattactatcagggcaacaaattatcaagtaaagctaccaatcagaattataatctatgagaaaggagttcactcagcttatttccaggagtacctggagtcacggtaccaacccttagccaaccacttggggctaagtccttggagttaacatagtcaccaatgaagttgttttgtgctcctgaggcactgaggcatgacatgctcaattgccagcactgcctaacacaaatatcaagatgtgccatgagcacctgcctcctgggtaaagatctgcaccatagattgtcacgtgggaggaatgtgccttgtgcaaccagactcctgtaagaactccgggwcctcagacctaagtggacttacgtgggcagagacatctcatatatgttcgtataatttgtagtcgtgccaaaagcaccttactgtgaccagcatggagggagaacctagaagtctgcacctaatctttcgggtcttcttgtaggcataacttttttctgctgatcctgtataatatcctttgctgtaataggcttttagccatgagaataacctgttactcagccaaatgcgtcctgacaaatctcaaaagtagtatattctcaggacccataaagcacaagcatttttccaaaggtaattttcaaggccagggcaagtaagtttctaagtcttagttttataaaactcttttttcaaagaaaawgacttayaataagaaaccgaagattcacaccactctccatattgcacaaaagagaaaaaagattgatatttttgtcaatatcraccatttgacactttacaaaatcagatattttgaatatgtgttatatctcagaaagacatcctcctctctgtgctataggggagaggagcatatcctttatttatttccaagacttctgttaattacaaaggctcacattgataagccaagctctggattttcattagttagcattataagcaaaaagcaggcctgtgagatcaattttactggcataaatgcagtaaagaatgaataagatataataataactgaaatacagagcctatagcattatttttccacaatatgtaatcacatatttataaatctgaaaataaaagaaatatcattagaatgtcastctgtacaaatttatggcaatatgcacaaaatacactaaaagctgccttatttttaygcagttgcatgctcacatatatatttctgtaacagacaattttactttgatgtgacaggagataatcgatcttgaagttaaagataataaatttgggtgtgactaaggtgtataaatttcagttgatctatatakatttatagcaagatggttaaaatgtgaggttgctcatcagaggyatagggttatcttaattatctctgatatgtaaatcatttacttttcacaaaaggccctctttcttgtgtaaacacaaacaaccataaattaaaataagtagcagatgactagtatgctattttattttgctttatgaacaaaagtaaacctgctttgaagacacaaataatctttcttgtaagtaggtacgtatccggcaccttattacatagaagagagcaccagcaccagaccctgccaaaatgaaacaaaacaagaactggcaaaatgattgtttctaatataagccaggaaattgtttcacaggtcaagaatgaggaaaactttttttttttttcctaagatcttacctcttattgtctttaggagttcctgtttattattgaggtcatgtgttttgttaccaggtcaactagcttactcctgcactgatgatcctggaatgaaagttttttttattgaaagtytatttgcagccaggtgtggtggctcacacctgtaatcccagcactttgggaggttgaggcaaaaggatcccttgagcccaggagtttaagacaagcctgggttacatagtgagaccccatctctacaaaaaataaaaaattagctgggcatagtctcagctactcaggagrctgaggtgggaggattgcttgagccctgaaggtggaggcagcagtgagctgtgattgtaccactgcrctcgaggcttgaggacagagcaaaacactgactcaaaaaaaaaaaaaaaaaaaaaagaaagaaagtctacatccaatagccagargtatgtctctaaggtccttgaccttccaagtataatgcaaaacacagaagagattgttttagaatgataaatttgactactaagcaaaaaattatgcatggcataagtcacaattaacaaagccaaaagaaaaatgacaaatatttaataagaatatctggaagcactcaagatccattaaggcaattggagtgtaatatcaggcagaaagaactagaatgtaactgaactcaatatattgattgggttctaatcctaaaatactgatttttatactgtccaaagaaagtttgcaatcaaaacaaaggtcagaagagataagtaaaggmcagccagagagcaagattttgcactgattagctctcactattcagagtccagagaaatttactatagtggacacaaatactctagttgttccatagttatatactattgtgggataagaatggtttatttcagtttggataaagtatctcttaaaactatataactcctgttattccagtttcactctcctttaagtaaactgattctgtcaatacttaccagttactggacaggcacagcagctcacacttgtaatcccaacactttgggaggttgaggtgggtggatcacttgaggtcaggagttcgagaccagcctggccaacatggtgaaaacccgcctctactaaaaataccaaaattagctgggtgtggtggcgggcacctgtaatcccagctattcgggaggctgaggcaggagaatggcttgagcccaagaggtgaaggttgcagtgaaccaccaagatcacgccactgcactccagcctgggtgatggagtgagactctgtctcaaaaaaaaaaaaaaaaaaaaaaaagatacttaccagttaccaaaaagagaacatgaaaaatatatgtaattttcactataaatttttctggtagatatcctggcttacatagtttcttatgagtttggttatcatgaattctttggttatcctggtattcatggaatctcatcaattctggattcattcacaattttgaattttcacgcctgagaactggggaccagactataagttgataaytcttaacattttcacctctgagcccttgcccaagtagccaaatgatctcaagatatgtctgtttcagttagcctttgttgtataacaaatcacctctagccgggtgcagtggctcatgcctgtaatcccaacactttgggaggccgtggcaggtggatcacagggtcaggagttcaagaccagcctggccaacatggtgaaaccctgtctctactaaaaatataaaaaaaaattagctgggcctggtggcggatgcctgtaatctcagctacccaggaggctgaggcagagaattgcttgaacccaggagatggaggttgcagtgagacgagatcgcgccactgcactccagcctgggcgacagagtgacaccatctcaaaaacaaaacaaaacaaaaaaaaacaaaaaaacaaaaaaaacaaatcacctctaaaattagtagcctataatggcatctgtttattgttcatatttctgtgggttgaaatttggactggaatcagctgagtggtgcttctgctgatctyccctggaaccacttgacttgtcatctctctaagatggtcttttgtttacatacgtagcacttggtgctatcaacttgtatacttcaggcygtggcctcatctttaatacgctatactgagcttctttatacaatagtctcagggcagaattctaagagcaagagcagaagccagragaccttttcaaaatgaaattcagaagtcatcacttctccattttattggtcaaagtcacaagaccagcccaagattcaagaggtgggtaaatagacttcacctcttttcaggaggggatacaaataatctgtagctttatttatttacttatgcgacagagtcttactctgttgcccaggctggagtgcagtggcrtgatctcagctcactgcaacctccacctcctgggttcaagcgattctcccacctcagcctcccaagctgggattagcccgccaccatgcctagctaacttttgtatttttagtagagacggggtttcaccatgttgaccaggctggtctcaaactcctgtccttaggtgacctgcccacctcggccacccaaagtgttgggattacagacgtgagccaccttgcccagctccctgtagctatatttaattacccacaacttgtaacaccgattcacaatagtcccaataatgttctttatagaaaaagaagattctctggtctgggatccaatctaggttcacacagtacatttagttgtcatgtctctttggtctcaatctgyaacaattccttagtttttctttgtctttcatgatgttgacagtttaaaattttgtcttttggattatgtgatgttttgaattttgtaacatgtccctcaatttggctttgttrgatatttccttgtgattagattcagattttgcatttttggcaaaaaactatataagagctattatgaccatctcattgcagtacagcaggagaaaatgatgtcagcttgccccattattggtggtattaactttgattaactgttttcactgtcacattactatttttcttttktaattaattagtrgtaattaattgtgttatgataagatgctccttatcaaactttcactgactagttgtagtatcaattaattacatttaaaaatttaaagaagggccgggtgtggtggctcacgcctgcactccaycctgggcgacaagagcaagactctgtctcaaaaaaaaaaaaaaaatttaaagaagaaacattgttttaaacttarattcaaacatcagtttgctacttatcagctgtgtgaccttagggcaactcaccagatggctctgagcctcagtttcctcaygtgtagattgtagataataatatttttmtcataaaattgatgtgggtaatacatrtaaagtacttagcagagcgattaccatttattttatttcactagtttttacggaaattctttaaattttagtagtgtgtaggaagagatcatctttgtcctaatagagattatactctagtctagagtagaggtgagcaaactttttctgtaaagagcagatggtggctgggcaccgtggctcacgcctgtaatcccagcactttgggaggctgaggcmggcagatcacctgaggtcagcagttcaagaccaacctggccaacatagcaaagccccatgtctactaaaaatacaaacattagctgggcgtggtggtgcatatctgtaatctcagctattcaggaggctgaggcatgagaatcacttgaacccaggaggcggaggttgcagtgagctgagactgcaccactgcactccagcctgggcaaaaagagcgaaattccatctcaaaaaaaaaaaaaaagcagacggtaaatattttaggagccaaatgggcaatacataaatgaatgcattttactgtattccaaaaactttatttataaaacaagtggtaggctggacttggcccatgggctggagtttgctgatctctggtctagagcaaacagaccaacaagaaaatataattacaaacaaacaaaaaacccagccaaacaaaaataaataaaaataattacaaatcataagtgttctgaagggaaaagataggttttaggggattatataacagtgacctcaccttgtctagaatgtcaggagtagcaacgctaaagcagtagcatttacactgagacctagaaagcaggtagtcattaactaaatatgtggtggcagggagcttatcaggcagagcaaatagcatattctaaggaaatgagggagaaagttacataactttttytttcttttttttttttgagacagggtctcattctgttgtccaggctggagggcagtggtgcaatcatggtcagctggagccttaaactcctgggctcaagcaatcctcctacctcaacctcctgagtagctgggaccacaggcgttctccatcatgtccagctatttttgtatttttttgtagagatggagctctcactatgttgcccaggcttgtcttgaactcctggactcaagtgagcctcctgcttcaccctcccaaaatgctgggattacagacataagccacagcaccagctgaacttttttttctgagacggagtcttgctctgttgccaggttggagtgcagtggcaagatctcggctcactgcaacctctgtctcctgggttcaagcgatctcctgcctccgcctcccaggtagctgggactacaggcgcatgccaccacgcccagctaatttttatatttttagtagagacggggtttcaccgtgttggccaggattgtctcaatctcttgaccttgtgatccacccgcctcagccttccaaagtgctgggattacaggtgtgagccaccgcacctggccagctttgaattcttaaaaaatgttcagctgaggccagacacggtggctcacacctgtgatcccagcactttgggaggccgaggctggtggatcacaaggtcaggagatcaagacatccctggctaacacggtgaaannnnnnnnnnnnnnnnnnnnttagccaggcatggtggcgggcgcctgtaatcccagctactcaggaggctgaggcaagagaatcgcttgaacccgggatgcggagattgcagtgagccgagatggcgctactgcactccagcctgggcgacagagccagactaagtctcaaaaaaaaagaaaaaagaattcaaagccaatgtaactagagggcaaaaaagaaagaaaaatgatgtggggaatctmtgaatgaataatcatttgttaaaagattccccacatcatttttcttacttttcttgctgtgtgctaggcattattctagctaaaaggaatacactggtraacaagactaataaggtccctgcctctatggagttgacatttgggatagaggtgggtgttggagatggacaataaacacgtgaatacataattacatatttaatatgtaattatatagacgtatgtgcatgtgtaaatgaatgtgtttacaaattacaagtaccaagaataagatgcattttgttctttgaaacagggtcttgctctgtcacccaggctgaagtgcagtggtrcaatcctagctcactgcagcctcaacctctcaggcaatcctcccacctcagcctcctgagtagctgagactacaggtgcacgctactacatccagctaattttaaacaattgtttgtaaaggtggagtttcaccatgttgcgcaggctggtcttgaactcctgggctcaagtgatcctcccaccatggtcttctaaattgttgggattacaggtgtgagccactgtgcccggcctggagagggctttctgaggaagtgacatttgatccaagacttgaacactgagaaaaggccaaatacatgaaagcagaaagaagaatgttaacaactgtgaaacaacaaaagcagatgccctgagacaataaagaaccactgctgaggaaggaacctagagggagccaaagggagagggctgtgaaacaaaatgggagaggcaggcaaaggccagatcacacagcactggagttcatggtgagaactttggacttcatttgaaatgcactgaaaatcaaaggcaagattttactgaagggagtgtgacattacattttaaaaagattattctgggtgcagtgtgaggaatgcaatagagaaaaaacaagattgaaagcagaaaggaagttaaaaggcttttggactaatcaggtgagaaactataaggtagttaaaatgagggtggtgacagtatagatggaaggaaatgaacagattagaaagatacttaaatgataaaattgatggaacttggtgatttgttagatatgaatactaaaagagaaagatggtccccaagctcctgaaaggagaaattggatgaatgttggtgccattcaatgggatattcaagtggaaatgttaaatgtgcagttgaatataggcgctcaggccgggcrcggtggctcacgcctgtaatcccagcactttgggaggccgaggtgggtggatcatatgaggtcaggagtttgagactagtctggctaacatggtgaaccccatcgctactaaaaatagaaaaactagccgggcatggtggtgcatgcctgtagccccagctacttgggaggctgaggctagagaatgacttgaacccaggaggcttgaacccaggagccgagatcgtgccactgcactatagcctgggtgacagagtgagactccgtctcaaaataataataataataataataataataataataataataataataataaaaggaaaataggagctcagaggctgggcacggtggcttgtgcctgtaatcccagctgtctgggaggccgaggccagtagatygcttgagctcgggagtttgagaccagtctgggcaacatggcaaaaccccttctctacaaaaaaatacaaaaattagctggtgcttggtggctcatgcctgtagtcccagacacttsggaggctgaggtgggaggatggcttgagcactggaagtcaaggctgcaatgagccatgatcgcaccattgcactccagcttgggtgacagagtgagaccctctaaaaaaaaaggaaaataggagctcagaggagaactggggacrtatttatccacaggtggtaatcagagccatggatgtggttaataacctggccaacgtggtgaaaccccgttgctaattaaaaaatacaaaaattggccgggcatggtggctcacgcctgtaatcccagcactttgggaggctgaggtgggcagatcacctaaagtcagaagtttgagactggcctgaccaatatggtgaaaccctgtctctactaaaaatacaaaaattagcctggcgcagtggcgcacacctgtagtcccagctactcgagaggctgaggcaggagaatcactggaacccaggaggcagaggttgcagtaggccgagatcgcaccactgcactccagcccgggcaacagaggaagactccatttcaaaaataaaaaataaaaaattagccaggcatggtggcacacgcctgtaatcccagctactcaggaggctgaggcaggagaataacttgaacctgggtggcggaggttgcagtgagccaagattgcgacactgtactccagcctaggggatagagtacgcactccagcctgggggatagagcgagactctgtctcaaaaaaaaaaaaaaaagaagaaaagaattagctgggcctggtggcaggcgcagctactggagaggctgaggcaggagaatcgcttgaccccgggaggctgaggttgcagtgagctgagatcgcgccactgcactccagcctggactaagagcgaaactccgtctcaaaaaaagactggcagaagagcataaactgacaaaggagtctaaaaagaaatgagcagagatgcaggcagaacaccaggagagcatcatgtcacagaatgctgctgagagttaaggaatacgaggattgaaaaacagccactggatggaaagacaaaggggtcattgatagcgttgggaagagtcattttrggggagtggatgaagctagattgcagtgtcaagggaataagtacaagtgacagggagtgkagatgactgtgagaaacgtagacataaaagggaagagagataggccacagactcatccctccataaataacagttttgttattactatttactagtcatttttcaaaagcaaaactttgagacatttatttacttccccacattaccaattattacatcataattctgagtggctgtcttatatcttctcagaaaaagtgcactattgagtggctggcatctcatagagagcttcagtctttggtcatagcattaggagcccttggtttcacaggtcatttaatagattgtttaggtacttacacttaagattttctttctttttttttttttttgagactgagtctcgctctgtcgcccaggctggagtgcagtggcacgatctcggctcactgcaagctctgcctcccaggttcacactattctcctgcctcagcctccggagtagctgggactacaggcgcccgccacygcgcccggttaattttttatatttttagtagagacgggttttcaccatgttagccaggatggtctcgatctcttgaccttgtgatccacccgcctcggcctcccaaagtgctgggattacaggcgtgagccactgcacccggcctacacttaagattttcacctaagtatccaatttacttgtttagtggattttttgattaattaattttttttggaaacagaatctcactgtcacccaggctggagtgcagtggtacaatcatagctcactgcagcctcgacctcccaggctcaagtgatcctcccacctcagcctcccaagtagctgggaacacaggcatgcacgaccatgcccggttaatttttttactttttgtagagatgaggtttcaccatgttgcccagtctggttctcgaactcctgggcataagtgatccacctgcttcggcctcctaaagtgctaggattacaggtgtgagccactgtgcccagcsttaattaattattttaacattaattttatttttttaaaaaataagcaggccaggcatggtggcccatgcctgtaatcccagcactttgggaggccraggcaggcagatcatctgaagtcaggagttcgagaccagcctggccaacatggtgaaaccccatctctactaaaaatataaaaatcagccgggcgtggtggtgcacgcctgtagtcccagctactcgggaggctgaggcaggagaatcgtttgaacccgggaagtggaagttgcagtgagccgagatctcgccactgtactccagcttggtgacagagcgagactccgtctcaaaaaaaaaaaaagcaatacatccaaatgcttcaaaattcagaaagaggccaggcacggtggctcacacctgtaatctcagcactktgggaggccaaggcaggcggatcacctgaagtcaggagttcragaccagcctggccaacatggtgaaactccatctatactaaaaatacaaaaatkagccgggtgtggcgatgcacacctgtaatcccagctactcgggaagctgaggcaggagaatcacttgaacctaggaggcggaggttgcrgtgagccgagatcgtgccactgyactccatcctgggcaagggggagactctgtctcaaaaaaaaaaaaattcagaaagaactaaaagttcagtgaaagtttacttttcaccgtattcctgaacccctagtttccttcctggggcagctgtactttatttaaccaggagcctagtgatgaacatttgcttgttaacagtcttctattatgaatgaarcaatggataatcttgtatatgtcattttgtgcatacgtgagtgtcttcagtctatttccctagaagctgagactggtggagcttcgtaggcaagtgatttattaggaaagtagtctaggtagaaatctaggagggtgagggagggaagcaggccaggggaggggaagaaggaaagcaagaatggtttcaggggaagtctagactcagcctattcctaccgggagccctgaagcataaagtgcaagcagaatctgtctgcccttaggcaagggaccagaacatttgtaccctaccatagacagtcactggttaaagcagcacataactcccatgaacttcatgtccaggtggctctaatcatccaagtccagtcccctggggttgtaggtacaaaccattaccagcagcacccacagctcctgggggaatgggcaccacaaaatggtagcagggatccccagggattgaggtggggacaccaacaggtttctgccacagtggatatgttgatgaaaagagtcaaactctgttaaatatttgaagagatttattctgagccaaatatgagtgaccatggcccatgacacagscctcaggagattctgagaatatgcgcccaaggtggtcggggcacagcttgggtttttttttttttttttttttgagacggagtctcgctctgtcacccaggctggagtgcagtggcgtgatctctgctcactgcaagctccacctcccaggttcacgccattctyctgcctcaagcctcccgagtagctgggactacaggtgcctgccactgcgcctggctaattttttgttttagtagagacggggtttcaccgtgttagccaggatggtctcgatctcctgacctcgtgatccgcccactttggcctcccaaagtgctgggattacaggcatcagccactgcgcccggccagcttggttttattcattttagggagacatgagtcatcaatcaaatacatttaagaaatacattggtttggttcagaaaggcaggacaaygcaaagccggggcttccacgctataggtaaatttaaatactttctggttgacagttggttgagtttatctgaaggccggggatcaatggaaagaaaatgttcaggttaagataaaggattgtggagaccaagttttattgtgcagaggaagctctcagatagctgacttcagagagagcaggttgtaaaatgtttcttattgaacttagaagggtgcctggctcttagctgattatctcctggatctggaaaggaaggaaggaaaacaaagggggaaaggggattctctacagaatgtggatttttcccacaagagactttgcagggctgtttcaagatatggcagagaaacatgttttgcagtaaaatattttgattttcttccttgttatgccagagtcagattggaaagtaagtcacaatatacaggattaaataaaacccatctgatgagaattgatgatttgtagggcatgactccccagaccccttagataggaatttgggcaaaaaaaaaaatcagagcttagtcctcatatatcactataggatacattcctggaggtaaaattgctggatgaagtcaacactattagttgcctatttaaaaaatatccccctctacacatacacacacacacacacacacacayacaccccattttttgtaatagaaccctgcttttatttgaaatagccatgtgttcaatttaaaaactcactttcccatcctcatttgcacttgtgctggtcatgtgacgctgctyttagcaataagatgaaggtggtggtttctgagggtagtgtccttttcagaataaaaagacaaagcytatttgccttcttcttcctttactttatattcctctttctgccaggaatataaatgtgactctgtggtgtcacgcgcatccgtgtgaagagaccaccaaacaggctttgtgtgagcaacaaggctgtttatttcaactgggtgcaggcgggctgagtccagaaagagtcagcgaagggagataggggtggggccgttttataggatttgtgtgggtagtggaaaattacagtcaaaaggggtttttctcttgcaggcataggtgggggtcacaaggtgctcagtgggggagtttctaagccaggagaaggaatttcacaaggttaatcgctcagttaaggtggggcagcaacaaatcacaatggtgggatgtcataagttaaggcaggaatgggccattttcacttcttctgtgattcttcagttacttcaggccatctggatgtatacgtgcaggtcacaggggatatgatggcttagcttgggctcagaggcctgacatgtgggtacagcagctatcttgtgaccatgaaacggaggcaggaaaatgaagacctgtgcaccaaaatgcaggaagtcaacgtcatatgtattaaaatacactgcggtaagtgtcttctctttcccaagtctcggtgcataattatgtcaacaaaaagagtcaaactctgtaaaatatttgaagaaatttattctgccaaacatgagtgatcatggcccatgacacagccctcaggagatcctgagaatgtgtacccaaggcgaatggggtgcagcttagttttatacattttagggagacatgagacttcaatcaaatacatttaggaaatacactggttcagttcagaaaggcaagacaactggaagggggctgccaggttgcaggtagatttaaaaattttctggttgacaattggttgagtttatctaaagacctgggatgaatagaaaggaaatgtctgggttaagatgaaggattatggagaccaaagttctgatgtgcagaggaggccttcaggtagtgggcttgagagagaataggctgtaaaatgtttcttatcagactgaattctgtgttgatattaatgccggagaggtataacaaggcatgtctgaccacccccttccatcayggcccgaaccagtctttcaggttaaattttaaaagtgccctggccaggagaaagtccattcagatggttggggggccttagaattttatttttggtttagaattattacacaactttactttcatttatatggtattttatgaattacaagtatgctttcacagaccttttccttccacctcactttatttttacagtgtctcccatccacatgacaagtattggtgagaggtgacagcgtgctggcagtcctcagagccctcgcttgctctcggcacctcccctgcctgggctcccagtttggtggcatttgaggatcccttcagcccccccactgcactgtgggagcccctttctgggctggccaaggccggagcccactccctyagcttgcagggaggtgtggagggagaggcacgagcgggaaccggggctgcctgcggcrcttgcgggccagctggagttccgggtgggcgtgggcttggtgggccccgcactcgggcagccagtcagccctgctggccccaggtaatgggggacttagcacgcgggccagtggctgcggagggtgtactgggtcccccagcagtgctggcccaccggygctgcgctcratttctcgccgggccttagctgccttcccayggggcagggctcgggacctgcagcccgccatgcctgagcctcccaccccctctgtgggctcctgtgcggcccgagcctccccgaygagcaccaccccctgctccaaggcgcccagtcccatcgaccacccaagggctgaggaatgcgagcaaacggcgcaggactggcaggcagctccacctgcagccacggtgcgggatccactaggtgaagccagctgggctcctgagtctggtgaggacgtggagagtctttatatctagctcagggattgtaaatacaccaatcagcaccctgtgtttagctcaaggtttgtgagtgcaccagtcgacactctgtatctagctgctctggtgaggacgtggagagtctttatatctagctcagggattgtaaatgcaccaatcagcaccctgtgtttagctcaaggtttgtgagtgcaccagtskacastctgtatctagctgctctggtgaggacgtggagagtctttatatctagctcagggattgtaaatacaccaatcagcaccctgtgtttagctcaaggtttgtgagtgcaccaattgacactctgtatctagctgctctggttgggccttggagaacctttatgtctagctcagggattgtaaatacaccaatyggcactctgtatctagctcaaggtttgtaaacacaccaatcagcaccctgtgtttagctgaaggtttgtgagtgcaccaatcgacactctgtatctagctgctctggtggggccttggagaacctgtgtgtggaaactctgtatctaactaatctgatggggacgtggagaacctttgtatctagctcagggattgtaaacgcaccaatcagcgccctgacgaaacaggccactcggctctaccaatcagcaggatgtgggtggggccagataagagaataaaagcaggctgcctgagccagcattggcaaccagctcgggtccccttccacaccgtggaagctttgttctttcactctttgcaataaatcttgctactgctcactcttcgggtccaggctgcttttatgagctgtaacactcaccgcgaagatctgcagcttcactcctgagccagcgagaccacgaacccaccagaaggaagaaactccaaacacatctgaacatcagaagggacagactccagacgygccaccttaagagctgtaacaccgcgagggtccgcagcttcattgttgaagtgagaccaagaacccaccaattccggacacattggtactcttgaaaaaaaaaatctccygcagtactaaaagctaataattcattgatgactaattttgacttagtttactttccttataacaactagctgagatgagctactctaaaagtataggatgtaaaatatgggaaaagtaatcttgtaacaaagagtcttttgggaagggatccataccccaaaatagaagtacagggtagagtccggtgagagcaccaaagatcaaaaaaaagatgcagtaaatgggagggaaggagggcagaagggatacccatgtgttactgaagtcaacttttatytattctgaagttttgcactatagtctgtgggaaatacattttctctgtattactgagtgttcctgcaaactcaggctcttgaaccacagatattaatctactatgaaaatgaaaatgcttgctttcatttcccccataaatatttgttctctacaaccttcattatagagacactggcttccacttaaaggataataaaacttctcttacctggaggcagagccttacattccaggatagggaacttcccctcctccctagaaagatctctgaaagaatgtagagaactatctctccatgagtttgcaagtcaaaagtggagaaaagcctcaaagaggctgattttatcttcccagtagagatagatacttagattccaaaaggtgagaatccacaaactcctttcctttttgttcctaaggaaaatgtgtttaccttagggaacaaagcttttccctctcctttgaggagagtctctttcctatatgaattctcaggcttgaggacaactcagcaatgtcgctgtggctactcttattgctgtgagtaaataaagctctgatctttgactagacgaaacctgatgtttcgtctagtatctatttatcatctctatctatgtgcttatttatgactatgcaagtggggtaagatctcacatccatcacagttgcctttttttttttaagagacagggtcttgctatactgcccaggctggtctgaaactcctggcctctagcaatcctcccacattggcctcccaaagtgttggtattacagacatgagctaccttgcctggtcccatcacagtttttgatttgacataatcctcctttaaaaaattggtaaattatgcttgcttcagcatatatatgtgtatatgtgtgtacatatgtatatatacacatgcgtgcatgtatgtatatatgcacatgtgcgtgcacgtatgtatatatgtacatgtgcgtgcacgtatgtgtgtatgcacataktgtgtgtgtgtgtgtgtgtgtgtgtgtgtatttttttgagacagagtctcgttctgttgcccaggctgcagtgcagtggcgtgatctcggcccactgcaagctccgcctcccgggttcacgtcattctcctgcctcagcctcctgagtagctgggactacaggtgcccgccacggcgcccggcttattttttgtatttttaatagagacggggtttcaccgtgttagccaagatggtctcgatctcctgaccttgtgatctgcctgccttggccttccaaagtgctgggattacaggtgtgagccaccgygcccggcctagcatatatattaaaattggatgttacgaagaagattagcatgcctcctgtgaaaggatgacatgctgacgtggaaattcgtgctccatattttttcttaactggtaaattactatttaatagtgaatcacccaacattgtggggtttttttgtttttttgttttttttttttgagacagagcctcactgtgtctcagcctggagtgcagtggcatgatcttggctcactacaacctccacctcctgggttcaagcgattcttctgcctcagccacctgagtagctgggattacaggccggcccatgccaccacacgcaactaatttttgtatttttagtagagatgtggctttgtcatgttgcccaggctagtctggaactcctggcctcaagtgaggcccacctcagtctcccaaagtgctgggactacaggcataagccaccgctctgggcctgtatttctaatatatatatatacaagatcatttatgtagtttactgccaaaaatggaagaaacctcatcatgaagagacatttagaaaacctaaattgatgaacattctaaaaatctatttgtctgtgaagactaagctctgatttttttttttcatcttgcctaaattcctatcttaagggtctggagagtcatggcctacaaactataaattctcatcagatgggtttgatttaaccctatatatcgtgacttactttccaatctgactctggcrtaacattatgtgacaaagaagaaagtcaaaatattttaccccaaaacatgtttctttgccatattttgaaatggccctgcacagctgtcctttggaggggaagattcacatctgtaaagaatctctattaacatagctatatctttttcttccaggccctccgaaccctgaagagatcatcatatatatgtgctgccgaagcgagcactcctgaagagattaactaagagtctagcaccttttaaggtctgaataggaaacatctgtcatctattctctctaagggcagccactataagagttcaaaagaaacttgctcgccacaatctttttttttttttttttttttttttgagatggagtctcactctgttgcccaggctggagtagagtggcaccatcttgtctcactgcaacctccacctcccaggttcaagtgatcctcctgcctcaggccccctagtagctaggattacaggcacgcatcaccatgcctggctaattttttttttttttttgagatggagtttcatgctgttgcccaggctggagtgcaatggcgccatcttgactcactgcaacctccatctcctgggttcaagccattctcctgcctcaacttcccgagtagctgggattacaggcgcctgccaccacgcccagctaatttttgtatttttagtagagaagcggtttcaccatgctggccaggctggtctcgaactcccgacctcaggctatccgcctgcctcggcctcccaaagtgctgggattatagatgtgagccaatgcractggcctaagtgctgggattacgggagtgagccgctgcgcctggcctaagtgctggggtacaggcgtgagccaccaggccagcgaagtctccacaatcttttttttcttttttttttgaggcagagtctccctctgtcaccaggctggattgcagtggcgatctcggctcactgcaacctctgcctcccaggttcaagcaattctcctgcctcagcctcctgagtagctgggactacaggaacgcaccaccaaccccagctaatttttgcatttttggtagagacagggtttctccatgttggccaggatggtctccatctcttgacctcgtgatctgcccacctctgcctcccaaagtgctgggattataggtgtgaacgaccgtgcccagcccccacaatcttttatcttaacctgagcatttcctttctatggatcccaggtctttagacaaactcatccaattgtcaaccagaaaatgtttaaatttacctatagcctggaaggccccccgaccgacgccctcccgcccccgcccccgccgcccctccactgccttatctgctttgagttgtcccgcctttctggaccaaaccaatgtacttcttaaatgtatttgattaatgtctcatgccctccctaaaatgtataaaaccaagctgcacccaaccaccttgggcacatgttctcaggatctcctgagggctgtgtcacagaccatggtcactcatatttggctcagaataaatttctttaaatattttacagagtttgactctttttgacaacactgtgcacttaaaaaaggtcatgtcataaaaaccaagnnnnnnnnnnnnnnnnnnnngagttcaaaagaaacttgctcgccacaatctttttttttttttttttttttttttttttgagatggagtctcactctgttgcccaggctggagtagagtggcaccatcttgtctcactgcaacctccacctcccaggttcaagtgatcctcctgcctcaggccccctagtagctaggattacaggcacgcatcaccatgcctggctaattttttttttttttttgagatggagtttcatgctgttgcccaggctggagtgcaatggcgccatcttgactcactgcaacctccatctcctgggttcaagccattctcctgcctcaacttcccgagtagctgggattacaggcgcctgccaccacgcccagctaatttttgtatttttagtagagaagcggtttcaccatgctggccaggctggtctcgaactcccgacctcaggctatccgcctgcctcagcctcccaaagtgctgggattacaggtgtgagccaccacacccagccaaggaagcctattattttggagtatgattatggacattttcttcacttggcctctgcaatatcattgtatttatttatttatttatttatttatttatttattgagatggagttttgctcttgttgcccaggctggagtgcaatggtgtgatcttggctcacagcaacctctgcctcccgagttcaagccattctcctgcctcagcctccagagtagctgggattacaggcacgcgccaccacgcccggctaattttgtatttttagtagagacagggtttctccatgttggtcaggctggtctcaaactctcgacctcagctgaaccacccgcctcagccacccaaagtgctgggattacatgtgtaagccaccgctcctggccgtctctttttatttattttcatttttttatttttgggacggagtcttgctcttgttgcccaggctggagtgcaatgtcgcgatctcggctcaccgcaacctccacctcccggatttaagcaattcttctgccacagcctcctgagtagctgggactacaggcgcacaacaccacacctggctaattttgcgtttttttgtttgtttgtttttgtttttgtttttttgagacggagtatcgctgtcgcccaggctggagtgcagtggcgtgatctcggctcactgcaagctccgccattctcgtgcctcagcctcccgagtagctgggactacaggcgcccgccaacacgcccggctaattttttgtatttttagtagagacggggtttcaccgtgttagccaggatggtctcgtgatccgcccgcctckgcctcttaaaatgctgggattacaggcgtgagccaccgcgcccggccagggacactttcatcacatatccatatggcttrctctctcatttctattcagataccaccttgacagcggagctgtcccagactacccttgtgtaaagcagtatttccacacccctcccctggactacctgtcctccttacactataataattttctcccataacacctattatcatttctataatagacacattatctatctattgtagtttttgtgtcacccaattaaatgtaaactccttgacagtaaagacttagtttcattcactgatacagccctagacctagaccaacacctgttgtatatactagacactcaaaaaatatgtgttgaatgyatgaatggttatagtatgtaaaaaaatcccacaaaggatttacacagaattgtaaataataactgtattaggttaagaaccttggaaaataaagaacaaggtcatatagagcgggtatgtggaggatttttagttccatggaaaagtcgccccagtcagcagtgagggaggaagttgaatagttggttctcggacatgagataagagaatgaaaaccgaattatgtttcggccgtaagactaccagatctccagtaagtcaagaacactggaagctggccaaaaaggtgggtaaagggccccacacaatgggacttcccgggcatgtcctggttactgtagaagtgtctcctcctcaaggcaatgttataacgacaagtgagggaaatagtcaacaagggctgcaaagcacgttggtctaattagtgcccccttgcctagagatctggggagaagtctgaggagggagtatccaaagatgacataacctgagtgcagattttcaattgtaagtgaaaagtgagctgagcctgtgctcaaggacttcctgcgtgctgagcacccatgctgagcactctctctcactagcttgctgattggggtttgggtttataaatttcatgttttactcaccaacactaactcattttatacttcaatcgaaacagaatgtgtgagtccaggcgcggtggctcatgcctataatcccagcactttgggaggcagaggcaggcagatggcttgagctcaggcgttgtagaccagcctgggcaatgcagcgaaacaccatcttcaccaaaaatacaaaaatattagccaggtatggtggcatgtgcctgtagtaccagctactctggaggctaaggtaggaggattgcttgagcccaggaagatgagggtgcagtgagccaagatcgcgccactgcactccacccagactctgtctcaaaaaaaaaaaaaaagtgggttttttttttctggaaggaaatagaacatattctctaatattctctaagtggtttgtgtgctttggcacacaaaagaatgaaatgacgatggcctttctcactggttggtttgctgttcccgcagttagaagagactgcccacatagggagagtggcacagaggagagtaacatcaatcaacagcgaatatgcacttgatcgcggtctaatcagcaccaggcacctcagggcagcagtattgtcagacgcattggaaccagagggactccatcttgaataaggtctgggtaaaatgaggctaacacctactgggctgcattcccaggaggttaagcattcttagtcacaggacaagataggtcagcaggacaagatagaggtcataaagaccctgctgataaaacaatgccataaagaaggcagccaaaacctgccaaaaccaaggtggtgatgaaagtgacctctagttgtcctcactgctcactatacgctaattataatgcattagcatactcaaagacactcccagcagcaccacgacagtttacaaacgccatggcaacattaggaagttaccctatatggtctaaaaggggaggaaccctcagttagggtaaatccctgcccttttcctggaaaactcatgaatgatccaccccttgtttaacatataatcaagaaataactatacgtgtactcagttgaacatcccgtgccactgctctgcctatggagtagccattcttttattcttttacttctctaataaacttgctttcactttactttatgaactcgccccaaattctttcttgtgcaggatccagaaccttctcttggggtctggattgggacccctttcctgtaacagtattagtcataactattatctgaaaaagtatatttatatggtactttacaaattcaattttgcacaatagactctgacttatgtcattctcacaatcaccccataatgtcaatcctcccatttcacaataaagaaattgaggctcaggctggagacggtggcccacacttataatcccagcactttgggaggctgaggcaatgggatcatttgaggatcggagtttgaaaccagcatgggcaacatggtgagattccagttctacaaaaaaaaaaaatgtttttggccgggcgcggtggctcacacctgtaatcccagcactttgggaggccgaggcgggtggatcacgaggtcaggagatcgagaccatcctggctaacatggtgaaaccccgtctctactaaaaatacagaaaactagccgggcatggtggcgggcacctgtagtcccagctacgcaggaggctgaggtaggagaatggcatgaacccgggacgcggagcttgcagtgagccaagattgcaccaccacactccagcctgggcaacagagcgagactccatctcaaaaaaaaaaaattgtttttaattagttgggcttggtggggcgattctagtcccaggtacaagggacactgaggcaggaggattgcttgagcccaggagtttggggctgctgcagtgagccgagatcacaccattgcactttagcctgagtgacagaatgagaccctgtctcaaaaaaaaaaaaaagaaaagaagaagaagaagaagaaattgaggctcaaggaggttagggtgaattgctcaaagccattctgatgtgaccgacacctagagtgaacatatgtcctgatgtgtccaggacagcctcagtttatgcctgcctattgtcctggtgtaattattaatagcaccttttcactccccggagtatcctggttggatagtaaattatatggtcactctaccaaaacctgtttctttcattcacttaaatccaatcttttatttcattactgccttatttcctccacttaggcagcttcaggatgattataacagctgaaaaggctggcttcagaccatggtatcacttctatgagagaggacatttcaagttgcaaacaaacaattcaaccagtgacttttaaatttgaaaactaccagtatagtacggcagtgaagagatcagggtctgaatctccattagcatagacattattcaaaatgtcaggcctgagaaggagctaaaaaacggcctgtcttgggggaagaaacggcaagaattttatcgaacttcagctggagtgggagaggggactgtcagccagaatgcggctagtttggggaagagttggtcaaagagattcttgaaagagggaggaattgttgttgcagatgagcagccactgtttgggcactttggattgatcagcctggacaggaggaacagttaggggctaagatcctgcacaggaagaggtggaaggaacaactacaggcaaaggggacctgcaggggaaaatgttccatgtggaaaatgctaggacttcagggtctcttaggttagttaactcttctgagcctcattttcctcatctgtaaaatgaggatgttaacagtttaaggttgattctgaggatggaatgtactcagtacataagtgttcagcaaacagtagtagctcttattgtttgagtctcttccccgccttgtgcccctagtgtagtagtaagggtacggattttcttttttttgtttgtttttgtttttgtttttggaggagtctcgctcagtcgcccaggctgaagtgcagtggcgcgatctccgctcactgcaagctccgcctcccgggttcacgtcattctcctgcctcagcctcccgagtagctgggaccacaggcgcctgctaccatgcccacctatttttttttgtatttttagtagagacggcgtttcaccgtgttagccaggatggtctccatctcctgacctcgtgatccgcccgcctcggcctcccaaagtgctgggattacaggcgtgagccaccgcccggctgggtacggattttctttacgctgtatataaaagtctgagaaactatcaattgtttataataaagaatgaaaactccaaaggcatctggggtgaggttgagggtctgcacagagattatgggggaaggggacgtccaaagctgtcattggattcaggcactcaacagattggaacacagtgtagagatttatggtagtgtgaaggtgctttatttgttatgaattactcagagattttactatattttaacctggggcggggaacccttcctttttttgcccttttgaaaataaggtagatttcttcagatgtggaaagtatcaatggtcaatccaatagcttttcgttattttatttttttatttttggaggcaaagtctcactctgttaccctggctggagtgcagtagtgcaatctgggctcattgcaacatttgcctcctaggttcaagcaagtctcctgcctcagcctcccgagtagctgggactacaggcgtatgccaccacgcttggctaatttttgtatttttagtagagacaggttttgccatgttggccaggctcgtctcaaactcctgacctcgtgatccacctgcctcggcctcccagtgctaccattacaggcggagccaccacacctggctcactttgtggcatatttctagaagttaaaaaactcacctgacaaaagagatactttgtggccaggcacggtggctcactcctgtaatcccagcactttgggaggctgaagtgggtggatcacttcacgtcaggagttcgagaccagcctggcgaaaatggtaaaacccccgtctctactaaaaatacaaaaattagccaggtgtggtggcaggcacctgtaatcccagctacttgggaggctgagacaggagaattgcttgaacctgggaggtggaggtttcagcgagacgagatcgtgccattgcactccagcctgggtgaggacagtgaaactccatctccaaaaaaacaaaaaaaaaaaaaaaaaaagagagagagagagaaactttatgatttactccatggaacaaatatcatatagaactgtaacatttaaaagtcagatttctgtttctaaactttaggtttatacctcttggcagatgactagatgattctttccccattccaagagtaacagatattcagccaacttgtgtgtgtgtttatcacatgtgattccacatttcagtttgtttctctatattttttgtattttaaattggacaagtattacttttataataagaaaaaagataattactaaaaataaatgagaaatacatatacatgtagaatttgcatagtgtcaagtaaatgataagggtagaaagagtgcagagaaaaaaaggatgaaaacgaaggtggctgaagaatgctttgtgacggaggtgggattgaaatgagctttgaaaggccgggtgcagtggctcacacctgtaatcccagtaatttgggaggctgcggcgggcggatcacctgaggtcaggagtttgagaccagcctggccaacatggtgaaactccgtctctactaaaaatacaaaaattaaccaggtgtggtggcaggcgcctgtaatcccagctactctggaggctgaggcaggagaatcgctcgaacctgggaggtggaggttgtagtgaaccgaaatcacgccactgcactccagcctgggcaacaaagcgagactccgtctcaaaaaacaaaacaacaacaaaaaacgaaacaccgaaatgggctttgaagaatggaagggatgcagataaaagagaggagggcgcagagcggtttggtcgttcgttggaccagtgtcggttcttcgctcgcgactgcggctcttcctcgggcagcggaagcagcgcggaggtcggagaagtggcctaaaacttcggcgttgggtgaaagaaaatggcccgaaccaagcagactgctcgtaaatccaccggtgggaaagccccccgcaaacagctggccacgaaagctgccaggaaaagcaccccctctacctgcggggtgaagcctcatcgctacaggcctgggaccgtggcgcttcgagagattcgtcgttatcagaagtcgaccgagctgctcatccggaagctgcccttccagaggttggtgagggagatcgcgcaggatttcaacactgacctgaggtttcagagcgcagccgtcggtgcgctgcaggaggctagcgaagcgtacctggtgggtctgttggaagatactaacctgtgtgccatccacgctaagagagtcaccatcatgcccaaagacatccagttggctcgccggatacggggagagagagcttaagtgaaggcagtttttatggcattttgtagtaaattctgtaaaatactttggtttaattggtgactttttttgtaagaaattgtttatatgttgcatttgtacttaagtcattccatctttcactcaggatgaatgcgaaaagtgactgtttacagacctcagtgatgtcagcactgttgctcaggagtgacaagttgttaatatgcaaaacggatgcgtgatatttcttgcttctcatgatgcatgtttctgtatgttaatgacttgttgggtagctattaaggtactagaattgataaatgtgtacaacagggtccttttgcaataaaactggttatgacttgatccaagtgtttaacaattggggctgttaagtctgaccatacatcactgtgatagaatgtaggctttttcaagggtgaagatacaaaccttaaccacagtgtaacttatagtttcctttaaaaaaaaaaaattaaacctggcagctatagaatacaatatgtgcatttataatagctattttatatattgtagtgtcaacattttcaaattaaatgttttacattcacaagtggtggggagtcttgtcattaaggtgtgtgtaatttagagtccagttggttttcttctgactgcacttgttctcatagtagtaaaatgctatgtgcatttataccttgcataaatcctcattctaccacatgttaactaaccctctagctgataatggaaacactaactgggggattttatttataagggctctagaaaaaaatatgagttattcacaccagcatcatctgttaactaatattctgaactagtgcagcttttcattgtgttgtgtggttggtctcataactaggttgagttttctcctctgctaagaggaaacagtactgaagttctttttcttgtggcatttgtattataaaaacttggtgtaggggaggagcacaaagctctagcccactgaacctctgctggttaagatggtgttaggttagg

SEQ ID NO: 17929 - DNA, 21525 bp, Homo sapiens
  misc_feature (1)...(21525): n = A,T,C or G, or insertion/deletion polymorphism (see Tables 1-2)
acttgaaccccagaagtcaaggctgcagtgagctaagatcatgctactgcactccatcctgggtgacagagcaagaaccctgtctctaaggaaaaaaatagaaactgctgtcattgaatttaacattatctatgggtctttagtttgccatgaattgtcatcagcagtcagcatgagatacccaaatacaaaagtacaaaggaaaaaatacttttcactttgtaaaactgaacgcacacagcattacaaaagtgccctttgagggccgggtgcagtggctcacgcctgtaatcccagcactttgggaggccgaggtgggcgaaccacgaagtcaggagttcgagaccagcctggcgagggtggtgaaacccctctctactaaaaatacaaaaattagccgggcgtggtggtgcgcacctgtagtcccagctactcgggaggctgaggcaggagaatcacttgaacctgggagacggaggttgctgtgagccgaaatcgcaccactgcactccagcatgggcaacagagcgagacatcacctcaacaacaaaaaaaagagtgccctttggaaaggtgaatgtctacatagtgtgagtttaatggagtcacatttgtctaaatagaaattcctctcaacctgtcattgcactctcttgccactgtgaacgtccaccaatagtgtcccatttgaaatatacaaaggcagtaacgtaggccccagaaaaatagggttaaaatatactgggattaaaatgttgccgaggagtcaaatgggtaactgaggttagcgttgacccattagtacatgttaggcagagaattagctattcaccttggtgtagaattgatgtttgatttctttgtgggatcagagggcccacccctaacaggaagtgaccaagggtcatgtagagtagaataaacaaagcatgtgaaacagcatgagaggcacagagaggcagcgtgtgtggtgagaacacttactgaacacattacagaaaattattattactgccgcttcctaagctgtaaacttttccaataaattaactaagttttataagcctcagtgtcctcatctgtaaaactagggtcaccatagcactgtcttgagattgttgtggaagctaaatacaaaatatattactgagctattttgccattgaaagtaatggcaaaatccacacttttggaccaacctaaatatataaacatgagcatacaagacctggaatgcactttaaaatgtgtactgccaaagctgggcacagtggcacgtgtctgtagtcccatctgcttgaaaggctgaggtcggaggatcgcaggaacccaggagttctgggcagcagtgaacagtgactgcgattgtgagtagccttcactacggccgggcaacataacaggattctgcctctaaagaataataaacataaaattaacttcctacccactgtctttcagggcaagccataactgtgaagggaaacaagttaaggaggacaactgactgcctaaggaaggttctggagtgtggacaaaggtggagatggctacttccactgattaataaaagccttctaggccaggcgcggtggctcatgcctgtaatcccagcactttgggaggctgaggcaggcggatcacctgaggtcaggagttcaagaccagcctgaccaacatggagaaaccccgtctctactaaaaatacaaaattagccgggtatggtggcacatgcctgtaatcccagctactagagaggctgaggcaggagaatcactttaacctgggaggtggaggttgtggtgagctgagatcacgccattgcactccagcctgggcaacaagagcgaaactccgtctcaaaaaataaataaataaaataaaataaataaaataaaataaaagccttcttcatgtcactattataaacagtacaaaccctcagctgctacttttggcaaactttttttttttttttttcctgagatggagtctccctccgtcacccaggactgagactggcccaatcttgcctcactacaacctccatcttccaggttcaagtgattatcctacctcagcctcccgagtagctgggattacaggtgcacgccaccacacccagctaatttttgtatttttagtagagacagggttttgccatgttggccaagctggtcttgaactcctgatctcaggtgatctgcccacctcggcctcccaaagtgctgggattacaggcgtgaaccaccatgcccggccttggcaaacttttgtaaagggtcagatagtaaatattttaagctttgcagtaaatatttttactcactattgcaactactcatgccagacattgtagcaaaataaaaagcatttcataggcaatatataatatataatgcatgagcatggcagtgctccaaaaaaacttttttttttggagacagggtcttgctctgtctcccaggctggagtgcagttgtgagaccatggcccactgcagtcttgacctcctgggctcaagcaattctcctgcctcaggtcccagaatagctgggactacaggctgcgccagcacaccccactaaattttgtatttttagtagagacagggttcagccatgttgcccaggctggtctggagctcctgggttcaagcaacccacccatctcagcctctcaaagtgctgggattatagtcgtgaaccactacgcccggccattttttttttcttttcagataggatcttgctctgtttctcctgctggaatgcagtggcacaatcatggctcactgtagcctcgacatcccagactcaagtaattcacttcagcttccagagtaggtgggacaacaggcgtgcccactgagcctggctaattttatttttgtagagatggggtctcactatgttgccaaggcaggacttgaactcctgggctcaagtaattctcctgcctgggactcctgaagtgctgggattacaggtgtgagccactgcaccctgcctccaataaaacttaataaatactaacagttacttccccaagcattgaaaactcttctacaacatgagttttaatgatggcataacagtccatatagattttcatgatttatttaacaaagtctttaatgttggacatttagtttctctttatttgcttacctcaatcggtactcataattattttgtaacaatttctttttttagacggaatctcgctctgtcacccaggctggagtgcattggcgagatctcagctcactggaacctccgcctcccgggtacaagcgattctcctgcctcagcctcctgaacagctgggactacaggtgcccgccaccacgcccagctaatttttgtatttttagtagagatggggtttcaccatattggtcaggctggtcttgaactcctgaccttgtgatctgcccgcctcggccacccaaagtgctgggattacaggggtgagccaccatgcccagcctatagaaattatttttaaagtcgggatgagaaaaaaaaaaaaagaaaaaagaaagtggggataagaaaaagaaaaattgctcatagaccatttattcagagattataactgccctcctcattattatatatgcttttcaggcttatgattacctttattatttatttatttatttatattttttagacagagtcttgctctgtcatcacccatgctggagtgcagtggtgcgatctcagctcactgcaacctccacctcccaggttcaagtgattctcctgcctccgcctcccgagtagctcacattataggcacgtgccacaatacctagctaatttttggttttgtgtgtgtgtgtgtgtgtgtgtttgtttttgtttttttttttttttgacggagtctcgctctgtcgcccaggctgtagtgcagtggcatgatcttggctcactacaacctccacctctggggttcaagcaattctcctgcctcagcctcctgagtagctgggattataggcatgtgtcaccatgcatggctaatttttgtatttttagtagagatggggtttgaccatgttggtcaggctggtctcaaactcctgacctcgtgatcgcccacctcggcctcccaaagtgctgggattacaggcatgagccaccacgcccggcctaatttttgtatttttaatagagacaggctttgccatgttggccaggctgtattatcacctttaaataaagctggggttacactgtacatcctatattgtaacctgaattttcacttcaccacagtaatgaaggtcttctccccttctgaggtcctaaacttagaattgctggtctctgacttccattattctagttttacttctgtcttcccactgtctcacatctactcccataagggagaccacactgaccatctgctcctcttggcattatatttcttactataaaactacacattggcacctggcttgcacatctgtctcttaggagtttggttactgttagctctgtgagcctgagtgatcacctcaactatcctagcaaaataggagagttggggccctccaaagctgagaatttgggcattatgacctaaataaagcaacacaatactgtctgagcaactagtcaaacccaaccagcctccttctctgacaactttattttgctttctttaagtgccataccaattattataagtgatgactagtatttatcattttaaatggcaaacaaccctaaatggcttggtggagggcaagttcagacattgtcctggagactggctgagagtagaagcccctctgcagtgttctttgaagtgctgattttagttatataaaatgctaaattgcctctcccactgtcagaatagccttttatttatttatttatttatttatttatttttgagacggagactcgctctgtcccccaggctggagtgcagtggcaccatcttggctcacagcaagctccgcttcccaagttcacaccattctcctgcctcagcctcccaagtagctgggactacaggcgcccgtcaccacgcctggctaatttttttttttttttttgtatttttagtagagacagggtttcaccatgttagccaggatggtcttgatctcctgacctcgtgatccgcccgcctcagcctcccaaagtgctgggattacaggcgtgagccactgtgcccagcccaaaatagccttttatacctcttcctgtttatgttatcaagaagttagtatgtagacttcagaactcaattttgatctgctcttgattaaaccttggtttacagaactacggtagtttttcacattgtagagaaaaagttgaactattttaataatggattttctgtgtgtatagaaactcctacaattgatttaaattttttttttttttgagacagattcttgctttgtcgcccaggctggagtgatctcggctcactgcaacctccacctcctggattcaagcaattctcctgcctcagcctcccaagtagctggaattacaggcacccgccaccacactaatttttgtagtttttagtagagatggggtttcaccatgttgcccaaggctggtgtccaactcctgacctcaagtgatctaccctcctcggcctcccaaagtgctgggattacaggcgtgagccaccacgcccaaccttgagttaaatttctaaaaatctcaacataatgtgtttggctcctcttcttattatgcttagagttaggcactagcacatactagacctaaacttgactgatttgaaaagaccactgaaatccatgatttgctgcggatcctctgtgtctgctgtggccaatataaagaaacttggatgcacttaatttatgaagacaagctttgttgatctggaagttgaatgataaatgtgaatccaatgacgccatacccctgcggataatggcaggctggatgtagcatgttagccgtcatattctgtgtgctccctgcgatgtgggcacttcccttccatcgtggtgaggccaaagcaaaggcacagagasctgaacacaaacatgaaaaacaccttaccacctgggagtcaggggcaggttcaggcacatccattcctctggcatttgagcagctgttttccacagcattaactcagcacggcagggtaagtcagattaaaaaccaataaaagagtagtatcctcataccaccctcaacgtcttcctgcttcaccaaaaaaccaataaaagactgaatgtggccctttatcagctagacctcaaaatcttctttgctttctatgcgtatttccaataaaaaagtacaaggrttgttaaaagtccttatttatttatttatttatttatttatttatttatttatttttagaaccagggtctcactctgttgcccaggctggagttcagtggtgcagtcatagctcagtgcagcctccaactcctgagctcaagtgatcctcccacttcagcctccagagaagttgggactacaggtgcatgctaccacgccaggctaatgcttttggttttttaagagttttgttgagtcagggtcttgctatgttgcccaggctggtctcaaattcctagcttcaagcagtcctcctccctcagcctcccaaagggttggtattacaggcatgaaccactgtgcctggccttaaagtccttttgaaacacaagacaagaaacatttggccgcgcacagtggctcatgcctgtaatcccagcactttgggaggccaaggcaggtagatcatgaggtcaggagttcaagaccagcctggccaagatggtgaaaccccatctctactaaaaatacaaaaaattagctgggcatggtggcacgtgactgtaatcccaactactcagaaggctgaggcagagaattgcttaaaacccaggaggtggaggttgcagtgagccaagatctcgccactgcactccagcctgggcaacagagcaagactctgtctcgaaaaaattaaaaataaaaatacaaaaattagctgggcatagtggcacgtgcctgtcatcccacctactcaggaggctggggcaggcgaatcgcttgaacccgggaggcggaggttgcggtgagccaagatcgcgccattgcacgccagcctgggcaacagagcgaaactcagtctcaaaaaaaaaaaaaarggaaacatttattgaacacctagtacattccatgcactgtagtgtgtgtggttttatttaatttcatctctgcccaaccctgggaaacggtctattagcagacgcagaggataaggcacaggacgatcaggtaacacacccagggccaaatatcataaatggcagaattcaaattaaagccaccttccaagccatgtccctcccatcgtcacaatactgcatgtctacagcacagttgatgggcataacccttcttagcaacagcaagcagctgagcagaaagtaattgcaggaggcagagccaagaggaaaacygctgagagtgctgacggtaggtggagagaacagaagcacacaccgtagggtgcaatcttagtgagctttgttttccttcaatagaggtgagttcagacccaggcatgtctctccaacattcatttcccctgcttcggcaccatagacttgaaggattggactcaggagttggggaggacacgggggaagttgctttcctggtgctgaggmccccggccaccgtggtagtgtacagcaagtacagggtaacagaagggccagcaggaggacacgsygcaatggtgtaccgagggacaggagagtgaatcagagccacaggacagagctccacctgtytccagggaagtgcatggggggctcccggaagccaaaggcagcgcccagaggcagtgtgaagaggccttcctcagacctcagggtttcggcagggatagtgggtgacctgtgtgctggctctccagaaactgaaagcagcaagagacacttgggctccttttttagtttttctggtttgttttgttttgtttttttgcaggcactcggtggttagctggaaataaaggtggaggaactgggcagttcaaaggcagagacggcttcccccacccccacctcacctcccctttcattcagaaaagccacaaaagcgtggccccagggtgtgtgtgaaaggagggaggagtgactccacctagctcctctggagtaaagagaggctgtgggcctggtgtcgtgcgtgcatgcctgcatgtgcctgtgtgtgtgcatgcttgcctggtgctcaagggtcaggggaagctggctgagaagactgaggagatggagggaggtggaggraagtgtaatagaaggaggtggaggaaggtggctgccatagagctttggctctggctggcctgagtctcttcctgaagttgcagctgcactttggggccaggcgctgttgacactgtgggtataaacatgtggccagcagcagaatagagactcagagtcttgagaaagaaagtggtgacttcccactcctccttccttctttcctgtacagagtctgccatctgggggcagagatatgggcaagccctcattataatactagcagtgaagggctgggcatgacaggtggaaacaccactgactctagaactcagagcatggaatttggtatggtggcaggcaggggtccagaggtagtatttgttatctattgctgtgtaacgaattagcttaaggtatagcagttcaagagaagaaatgtttattatctcacaatttctttgggtcagaaatacaggtgtggtttagctgaatgctttctggctgaaggtgtttcaggacgttacagtcatgccaccagctggggctgccaactcatctgaaggctcaacacagggggaccggagtccaagctccctcacatggtcaccagcaggattcagttcctcgaaggctgtcatttagaggcctccctccrtccctccttacaggtccttctcacagggcacttcgtgacatggcagctgactttctggrgaccatccaagtgagaaagagcccttagaaagaagtgacagtctttatataacctaatctcagaagtgacaactcatcccttctacaaggttctattattcaaaattgcatctgtaaatccagctcactcaagggaaagggattactaggagataggggtcactgggggccattctagaggctccctgtcacagcatccaagctgagacctacagaatgacaggagttcaccaggcagggaggcaggagggagttgggggacggcaggtgcagtgaaccatggttgtaactcagtatggctgcacagagagcactgcctgagggtgagcagtgctgtggagaggccagcagggcccagaacttgtaccatcttttaacccaggtttgtaagggtggactttatcctgcaagcatgaagatcctaaagcttgaggctaacggttaagatttggctttagaaagattacactgctggcccagctcagtggctcacgcctgtaatcccagcattttgggaggctgaggtgggcggatcacctgaggtcaggagttcgagaccagcctggccaacatggtgaaaccctggttctcctaaaaatacaaaaaaattagctgggcatggtggtgggtgcttgtaatcccagctatgcgggaggctgaggcaggagaatcgcctgaacccgggaggtggaggaggytgcagtgagccaagatggcaccgctgcactccagcctgggtgacagagtgagactgtatctgaaagaaaggaaagggaaaaaaaagaaagaaaaaaaaaagaaaagaaaagaaggaaggttatcactgctgtggggagaatggattgaagagagtaaaagagcagaggaaggccagctggcgggtgcggcaggtggggggattgaactgaggtgctggagaggctgaatggctggcagcagcgctgctgcagagctggcgtccctgggtgtaggaactgactgcttatgtccgtcttcctcctctggaacataagctcaatgaggacagggattcttgtttgtagtctctggtatccccagcgtttaggacagtggcactagatgaatgactaggacaccccaaggtttctggcttgagtaactgggtggagctattctctaagctgtgaggcacagagggcaaacatggacagaaacttaatatttgagaaatactgagtttgaggtgctttgtaggccatctgagaataaatgcctcgtaggcagttgacatgyggggatctggaaagcctcttaaagaaatggtgagagatggagacttgaaaatccaagcacctagacgcccgtgatgggagtagttaacatggccctgggaccctttcccagagtttctaggacaccttacgcagcaacagtgcttgctttgaaagatagtaaaggaagaaagtcttgccaattgtcattcacaaaagaaagtcaaaaatatgttgccagagaggacaggagaaagccaggaatcacgggaagccagaagagagcttcgagtactatgagaacagcacagtaggttaggtaaggactgaaaggaggccggtgagttgaagcccactgtgggtggggaggaaggagaaaaggaatgttttccagaaatgcaaagcattacttaatatttattttattttatttttttgagatggagtctggctctgttgcccaggctggagtgcagtggcacgatctctgctcactgcaacctctgcctcccgggttcaagtgattctcctgcctcagcctccagagtagctgggattacaggcgcccaccaacatggctggctaatttttgtatttttagtagagatggggtttcaccgtattagccaggctggtctcgaactcctgaccttgtgatccacctgcctcagcctcccaaagtgctgggattacaggcgtgagccaccatacccggcctattttatattatatttattttattttatattttttgctctgttgctcaggccgaagtgcagtggtacaatcatggctcactacagcctccacctcctgaktctcaagcaatcctcccaccccagcctcccagagtgctgagattacaggtgtgagccaccacacctggcctccattacttaaaaatgttttaaaggctggacacagtggctcacgcctctaatcccagcactttgggaggctgaggcaggaggatcacctgcagtcaggagtttgagagcagcctggccagcatggtgaaaccccgtctctactaaaaaatacaaaaattagctgggcgtggtggtgggtgcctgtaaacccagctacttgggaggctgagtctggagaattgtttgaacctgggaggcagaggttgcaatgagtggagatcatgccattgcactccagcctgggcaacagagtgaaactccgcctcaaaaaaaaaaaaaattaaaactgtcacttccaaacaccattaaaaaacaaagtgcctgattcggccgtacatgtactaaaattggaacactggaacggtaacagagaagattagcatggctcctgcacaaagatgacacrcaaattcatcaagcattccttttttttttttttttggagacagtgtttcactcctatcaccaaggctggactacagtggcgtgatctcagctcactgcaacctccacctcccgggctcaatggattcttctgcctcagcctctggagtagctgggactataggcatgcaccactgtgcccggctaatttttgtatttttggtagagacggggtttcactatgttacccaggctggtttcaaactactgagctcaagcgatccacccgcctcagtctcctaaagtgctgggattacaggcgcgagccactgtgcccagcctcatactttttatattcattttgaaaaaaaccaaacatacaaaatatagataagcatttagatcacaagttccccaaactggtctttgtagcagcaatttaggaatcacctgggtggtttttaaaaatacatattctgccrggcacggtggctcactttgggaggccgaggcgggcggatcatgaggtcaggagatcgagaccatcctggccaacacggtgaaaccccatctctactaaaaatacaaaaaaattagccgggcatggtggcgggcgcctgtaatcccagctactcgggagactgaggcaggagaatgtcatgaatccaggaggcagagcttgcagtgagcggagatcgagccactgcactccagcctgggcgacaagtgagactctgtctcaaaaaaacaaaacaaaacaaaaaaaaaccagattctgggtttgccccaattccataaaattaacctctcaagggtgaagcaggagaaactattttttaatgtgccaagtgactttgaagtgtgacaagctttttaaacattttatttggagttttctgcttttattatttttaattgacacataataattgtatatatttatgcggtaccatgtgagattttgatataggcatacaatgtgtaatgatctaatcagggtaattaacatatccatcacctcaaagagttttgacatcactcatttaaacctctaagaaatacttttcagctgggcgcagtagctcacgcctgtaaccccagcactttgggaggccgaggcgggtggatsacctgaggtcaggagttcgaaaccagcctgaccaacatggagaaaccccatctctactaaaaatacaaaattagccaggcatggtggcacatgcctgtaagcccagctactcgaaaggctgaggcaggagaatcacttgaacccgggaggcagaggttgcggtgagccgagattgcgccattgcactccagcctgggcaacaagagcaaaactccttggccgggtgcggtggctcacgcctgtaatcccagcactttgggagaccgaggcgggcggatcacctgaggtcaggagttcgagaccagcctgaccmacacggtgaaaccccatctctactaaaaatacaaaattagccggtcatggtggcacatgcctgtaatcccagctacttgggaggctgaggcaggaaaattgcttgaacccgggaggcggaggttgcagtgagctgagatcgcaccactgcactctagcctgggtgacagagcgagactccatctcaaaaacaaaacaaaacagaaaacaagagcaaaactccgtctcaaaaaaaaaaaaagaaatactcatttttctttgactttaagcccttttagaataaataaagcggtacaaaatattcatagattactaaactgttagaagccaattgttaaatttaagactttaatagggaacttaaagcaatcaagaaaataaactctccacaaagttttaaaaaacaactataaaatacatcctgtaggccgggtacagtggctcaatcccagcactttgggagaccgaggcaggcggatcacctgaggtcaggagttcgagaccagcttgaccaatatggagaaatcccttctctactaaaaatacaaaattagccaggtgtggtggygcatgcctgtaatcccagctactcgggaagctgaggcaggagaatcacttgaacccaggagatggaggttgcggtgagctgagattgtaccactgcattccagcctgggcaacaagagcgaaattctgtctcaaaaaaaaaaaaaaaaaatcctgtaggtttgttatcaagaaaatgctgatgactataattaggaytataaatttagttgagagtgagagctagattagtaaataaaattgtctataaacatttgtaaatcagtcatcctcctgggtacggtttgtaaaagaacccagtgcttaagtgaagagcagggacagctcctggctctggatgggggagaagtcttccttgtttcatagtcaaggaaagctcccagctgaccatcaccctcttctcttggaaaacgccacacctaccttcttgccattcctagagcgattttccagcctgagtggtatgactgcttccatttcctcgccactcttgtttgtccctggcagttcactttgattctcaaaagtccattaaaaccccttccaggtcctccgggatccctggccatgtaagctctgccaccaacagcagcctttctagtacaaagtctctagagctttccacagcctctggcttggtctctccctctccaggctggccacaggcccccagggacctatctgccatctcttggaaatatctttctaaattccccactccccctcctgcctttccacgactttgagttgcaatagtttgcccagttccccttttccttgtagtctttaaagataagtccacaggtttttcatttgtttataagatttactctccatcaggaaatgaaaataaacatagggaagctgataagtcacagctccccacccccagccgttgttccggggaagcctctctagcaaggctcagatgtttccatcttaaggttaaatcacaccaaacaatagaagccctttggtttcacctcagtgggcgggatgtgcctcctttcatggatctcctgccccacacaggatttctctggactccttagagtgtttcttcaaaactagttcaatctcgatctaattagtccccaaagagatgcaaaccaaacgagatgcgatttttgttctattaggagggcacamaaataaaaaataaaaattaagcctgataatagcctgtttgggccagcttgctgggaagcggactcatttttatactgctggaggggttcggaatcaagaatcttaaatatgtgcatccccttcaatccagtaatcccacttctaggaaaatatcctgaggagataatcaagatgtgcagtcaagaatttatgaacaaaagatactcactgcagagccataattgagaagaactggaaaggacttaacatgcctcccaggtggggcttggctctgcaaatcctcatctgactctatgatggaatgggatgcatccggtcatgcagtcatccgtgcgacaaatagttcttcagtacctactctgcgttaggtaaacaatgcagagtattgttaacttggctgggtaaacaggtaagttctcagcccccctggaaaatccatgatctcctaaagtaaagcaatttaaaattgttcacattatttgtgtgtgagtgtgagggggcgctttatcaccctccacctctcatycccccaccacaagcagttgccaaattcaaataatttttccttcaatgcctctcccgtgtgaccgctccttttctttcaaaagtaaatcctatgtctgggaggtaacccgatcaccgcggaaagaacgccgacatggaartcttaggattggtttctcgttccaggaagttgcgctactttgggcaaatcacgtcacctctgggactgtttctaatcagaataaagaaagggctggaccaatctttcagatcctttgaatccaatcatttttggccttatgacggaaccgtctgtagatgagggcatctgaatcctagttaaagggaagggacggtgaagcccttgaagatctggggcatatttcctgaacaccaaaacgggaaagggctgtctagagtgaaagtataagacagacaggccctgttccaggaagctccctgcactctgctcttctccccaagccgaccccaaactcacagccagctttagcaagcaggcccgtcatccttccaggtgctatgtaatattaagaagcagcagctaacaattattagtgctactaggggcaggagatttgcagttccctcgctttcacacaaaagtatgaggtctgttttattattcccactctaaaggcaaaatggaagctcacggagattacagaacttatgggaagtgacagggctatttgccacgtttatactggccagtcttcctctttttctcaaagggtggggtgggagagcagcctcccgtgttatcaccctctcctgcggcagaagacagaagcataggtcattttggtagtacgggtttgttgattaccaactgggagacagaggtgaggtaaatcacaagcatggatgttagcagggctgcagaagtttataaataaatgatcttagaatctccagcagccccgttctttcatttggtaaccggcctcctccctgccctcatccctgtagcgcccttcccccatgagggtgaagggtcagctctaaaaatgcagtcaggaaggaacaatgagagtcctctccccgcctgggagaaatgcaatttgcatctcagatgagctcagattggtgaagcctcgtttggactctgatccttgcagtaaggatctgctctgggaatctcctgtgacctgttgaggtttgctgctccaaaggaataaggagtctttgacattaatgtccatttaactcagggatctaaaaaggcaggttagtgttagagttctataggcaccccagaattgtacctaagagtgtgtgtgtgcgtgcatatgtgtgttttcctggggatggtgtagctttccttagattgtcaaaggaatttatagctgcccaaaggttaaaaacttgtgtgacaagtgagtgtgataaaggaggaacagtggtgcagatcctgtgggaggggagaatgacttaacaaacccagaggtgggggtgggagggaaagaattcaggtgagactgcactcagaggtaggattcctttttcttttttgtaggtaacattttttgttttcttactgtgtgccaggcattgttctaaactaaatatacaaggccaggcgcagtggctcactcctgtaatcccagcactttgggaagccgaggtgggtgggtcacttgaggtcaggagttcgagaccagtctggtcaacatagtgaaaccccggctctactaaaaatagaaaaattaaccaggtggctcgtgcctgtagtcccagctgctcgggaggctgagagaggagaatctcttgaaccccggaggaggatgttgcagtgagctgagattgcaccactgcactccagcctaggcaactgagaagactctgtctccaaaaaaaaaaaaaaaaaaaaaaaagacaaatacgtaaactaaaatctatgagaattaggtaattctctctttttttttttttttgccagagttttgctcttgtcgcccaggctggagtgcagtggtgtgatcttggcttaccgcaacctccgcctcccgggttcaagtgattctcctgcctcagcctcccaagtagctggaattacaggtgcgcaccactaggcccggctgatttttgtatttttttagtagagacggggttacaccatgttggccaggctggtcttgaactcctgaactcaggtgatccacctgccttggcctcccaaatttctgggatgacagaagtgagccaccgcgcccggcctaattttttttttttttttttaagagacggagacttgctctgttgccaggctggagtgcagtggcgccatcttggctcactgcaagctccacctcccaggttcaagtgattctcctgcctcagcctcccaagtagctggaattacaggtgcgcaccactaggtctggctgatttttgtatttttttagtagagacggggttacaccatgttggccagactggtcttgaactcctgacctcaggtgatccacctgccttggcctcccaaatttctgggatgacaggagtgagccaccgtgcccagcctaattttttttttttaagagatggagtctcactctgttgccaggctggagtgcagtggcgcgatctcggctcactgcaagctccacctcctgggtttaagtgattctcctgcctcagcctcccaagtagctgggactactggctggcgccaccacgcccagctaatttgtatttttagtaaagatggggtttcaccatgttggccaggatggtctccatctcttgacgtcgtgatctgcccgcctcggcctcccaaagtgcttggattacaggtgtgagccactgagcctggcctaaattttaaactatttgtagagacagggtctcgctatgttgctcagaatgttctcaaactcctgagctcaagcaatcctcctgccttggcctcctgaagtgctgggattaaaggcatgacccactgtgtccagccttttgtgggctttttgacatccttttatgtttttctttggtgaagtgcctattcaaatcatttgcacgcttttttttttttttgagatggagtcttgctctgtcccccaggctggagtgcagtgatgcgatctcggctcactgcaagctccgcctcctgggttcacgccattctcctgcctcagcctcccgagtagctgggactacaggcgccggtcaccacgcccggctaatttttttttttgtatttttagtagagacagggtttcaccgtgttagccaggatggtcttgatctgctgacctcgtgatctgcccatctcggcctcccaaagtgctgggattacaggcatgagtgagccactgcgcccggccatttgccctttttttgttgttgggctgtttatcttattattgcattttgagggttcattatatactctggatacaagccctttgccagatatgtgtgttgctaatattctctaccagtctgtggcttatctttgcattctcctaaatttctttcagagagcatacattctggtagaagagtacttagtcctgggcctggcagatttatttctttcaggacccaaggcctctgctgcaaacatgttccaccagatctttggtcagaataagaagcatatgagcttgatcattgttatggtcacaacttttgtatcccctcaaaattcgtacattgaaacctaatctccaatgtgatagtattaagagttggggtcatttgagaggtgatgaatgggcttcacgcccttataagagggccaaaggagattgtttaccccttccaccatgtgagtgcacagctgtaaggcaccgtctgtgaggaataggctctcaccagatactagcaccttggctcttggacttcccagcctccacaattatgtctgttttttgttttgttttgttttgtttttgagacagagtttgctcttgttgcccaggctagagtgcagtggcacaatctcagctcacagcaacctcttcctcccaggttcaagcaattctccagtctcagcctcccgagtagctgggattacagccacccgtcaccaagcccaactaatttttgtatttttagtagagatggggtttcatcatattggtcaggctggtctcaaactcctgacttcatgtgatccgcccacctcagcctcccaaagtgctgggattacaggcatgagccaccacacccgacctgttgtttattctttataagtcatcccgcatatggtatttttttcttttctttttttgagacagggtcttgctctgttacccaggctggagtacagtggcatgatcatggctcattgcagcttcaacctcctgagttcaaacaatgctcccacctcagctttccaagtatctgggacaacaggtgcatgacaccatgcctggccaattttttgatatttgtagaaatggggtctccctatgttgcccaggctggtattttcttatagaagcctgaatgaacaaagacactgtccatctttttcttttttcttttttttttttgagacagagtcttgctctgtcacccaggctggagtgcagtggtgcagtcttggctcactgcaacctccgcctcctgggttcaagcgattctcctgcctcagcgacccaagtagctgggattgcaggcaagcgccaccacacacggctaatttctgtatttttagtagagactggatttcgccatgttggccaggctggtcttgaactcctgacctcaggtgatccacctgccttggcctctcaaagtgctgggattacaggtgtgagccactgcgcctggcccatcttttttttttttcttttctttttgtagagagagagagagagacagagttttgccgtgttgctcaggctgatctcaaactcctggcctcaagtgatcctcccaccttggcctcccaaaggatataatcccatgcctggaattacaggcatgaaacaccatgcctggccattcttaattttatgacatcctcacacttgtaatctcagcacttttggaggccaaggcaggtggatcaactgaggtcaggagttcgagacctagccttgccaacacacggtgaaaccccatctctactaaaaatacaaaattagccggtcatggtggcacatgcctgtaatcccagctacttgggaggctgaggcaggaaaattgcttgaacccgggaggcggaggttgcagtgagctgagatcgcaccactgcactctagcctgggtgacagagcgagactccatctcaaaaacaaaacaaaacagaaaacaagagcaaaactccgtctcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17930 - DNA, 12957 bp, Homo sapiens
aggaggcagaggctgcaatgagcaaccatttattgcattccagcctgcgcggcagaatgagactccatctcaaaaaacaaaaaaacaaaaacaaaaattagctgggcatggtggcgcatgcctgtactcccagctacttgggatgctgaagcacaagaatcacttgaacccaggaggcagaggttgcagtaagcagtgatcccgccactgcactccacagcctgggcaacagagggagactctgtctcaaaaacaaaaaaaattcagtaacatttctatatgccaacagggaacaatctgaaaaagaaattaagaaagataattccatttacaatagctataaataatataaaatacctaggaataaactttaccaaagaagtgaaagatctcaacaataaaaactataaaatactgatgaaagaaattgaagaggacacacaaaaacatgaaaagagatttcatgtttctggattggaagaattgatattgttaaaattccgtactacctaaggcaatctacaggttcattgcaatccctatcagaatactaatgacattcttcacagaaattctacatcctaaatcttaggacttttgtaaaaaaaatcataaaatttttatggaaccataaaagacctaaaatagccaaatctattctgaacaaaaagaacaaagctggaagaatcacattacatgacttcaaattatactgcaaagctatagtaaccaaaacagcatggtactgtcataaaaacaaatacatagaccaatggaacagaatagagaacccagaaacatgtctagggtgaactcatttttgacaaaggtgacaagtgtatacactggagaaagcacaggctcttcaataaatggttctgggaaaattggatatccatatgcagaagaatgaaactagaccctcatctctctccatatagaaaaatcaagtcaaaatggatgaaagatttaaatctaatacctcaatctatgaaactattatatataagaaaactttggggaaactctccagaacattggtctgggcaaagatttcttgagtaatacccaaggagcacaagaaaccaaagcaaaaatggacaaacaggatcacatcaagttaaaaagcttctgcacagcaaaggaaacaatcaacaaagagacaacccacagaatgaaagaaaatatttgcaaactacccatctgacaagggattaataaccagaatatataaggagctcagacagctgtataggaaaacatctagtaatcagattaaagaacgggcaaaaagatctgaatagacatttctcaaaagaagacatacaaatggcaaacaggtatataaaaaaggtgctcaaatcattgactgtcagagaaatgtaaatcaaaactacaatgagatattatctcaccccagttaaaatggcttttttccaaaagacaaacaataataaatgctggtgaggatgcggagaaaagagaaccctcatacactgttggtgggaatgtaaattagtacaaccactatggagaacagtttggaggtttctgaaaaaaactaaaaatagagcttccatataatcctgcaagcccactgctaagtatatatacaaaagaaaggaaatcagtatatcaaagactatctgtgctgccatgtttatggcatcagtattcacaatagccaagatatggaagcaacctaagtgtctatgaacagatgataaaaaatggattaaaaaatgtggtacacatacataatggagtactattcagccataaaaaagaatgagaccccatcctttgcaacagcctgaatggaacaggaggtcattatgttaagtaaaataaaccagacacagaaagacaaactttccatgttctcatttatttgtgggagctaaaaattaaaacaattgaagtcgtggagatagagaatagaataataatttttaagtgtgtggaaaaaaataaggtaaaaggaaaaaaatttttttgaaagagagagagagaacagaatgatggttaccagatgctgggaagggtaatggtgggcaggatgaggggtggggtgggaatggttaatgggtacaaaaatatatttagctagaatgaataagatctagggatcttgtagtttttagcacaaagagtgactacagtcaacaataatttattgcacatttaaaaattactaagagagtataattggattgtttgtaatacaaggaaatgataaatgcttgaggtgatggatacacatgtaccctgatgtaatgattacacattgtgtgtgtgtataaaaatatctcatctaccccataaatatatatacaccagctatgtacccacaaaaattttaaataaaaaaataaaaaaaacccaaacatagtttcttttcagggtgcctgactttgaaatctcagaatgaagtgcccctgtaaggacgaatgaacaaatccaaaaaaaaaaaaaaaaaaaaaaaaaaccccagtagctcaagccaaatgccctcagtgctttcttagccatttacaagcagtttgttgtaaggcccagcaacccagttatacttgccaaattctattccagaagaaatgtgtacttttgttttagatacacaaactcagtagcaacccccacctacttctcttgcttgtgtagcgcagcatgtattcaacacttgcactacttaatccccccagattttcctctcctctgcactcctttttttccaaagcctactgtcaaaccacaaatcccctctttacccctgtgcacagcggtttccccaggttttagtcgaaccccaaatatgtgactcttaccttgctgccctggggtgtagagaggtttgtcagtctgtacaaaggtgccgttcccctgcctctgaattagaacctttttcttctcctcaaagctgatgttatttccaactcccgacacccggattgtggccacttcttctgtgccaccagcaggaggtggtacctgaccaagaaaggggacttctggggaggggtaagggattgggggaacagaatcaactggtctcaacccaacagtgagttaaaggaaagagctgagttagatgggggtagcaaggatagagacataaaacaaattaccacgaggaagaattaaggtcaggaactaaagggagaaatcctaggtcgaggaaaccgtgggtgagttatagccggggattgaggttaagttgagaaaaaataggtttagaggccgtggcaaaagataacagaaattatacttaaagtagattatagtgagcctagggaggagaataggcaagtaagggattcgagtgagggctgagtctgtgcttacaagaaaggagatacaatgtaagtgcctcttcttcagtccagagtattctagcaacttctgggtcttgtccttggtctccagagtaaccgtgaatttaacatcactgtacccagggctcaggtccaaacaaaccttctgaacggaggggaaatttagccgggctggtaatgtcaccaggtagtttctattaaaggagcagaaggatttcagggcaataatgattcattcactcgaaaaatccagcactctcctaagcgctcagcaagtagcagtgaattagacagaccaagcccctgccttccttatgcacctcattttctacaagaagcagaggggcaacgactcagtgcacagtcctcaacttccgccatcaggaggccctcaccgagcacacatgcctagagcaccaaggaggaaattaggcctatttcagaaaacagggcacattttaatatttatcttttttaaagcttcctcttcatgcgtcagcctccctctctgggtaaaggatcagtggaaccaaagaagagaaaaaaggaggaggaaattaagataaaccaaagttgatctccccatctccatataaatgtttgagaaagttaggcgaagaagccgctgccctaataaaccaattctgacaccaagcactcacggaagttcttctgcaatggctggtgatagggccaacattcctagaaggagctgagcccacatctttgtgggtgagacagatttttccagggtcaggggcagagatcgctccgcgtagctttatatactaattccaggtagggtgtgcagtgatgactgatgctatagtcagtcacctcctggcacctggaacacaggaggactgtgttcctccttctgtaaccaccaggttaggtggtggaccagggtagggccactattcacttctttaaagttgtttctgcctggaacatccatactggttcagccagttttgggggaaaaccagagctgagtattcataatggtaaagctctcagaacatattttgaactcctccctttttttctggtctcattccaattcctgttctcatttaatgtccttattttcttttattattcaattaaggtgtagttgggaacacgggtatgagaacagtttcaatagaaaagcggtaaacttggccggtcacagtggctcacgcctgtaatcccagcactttggggggttgaggtgggcagatcaccaggtcaggagttcaagaccagcctggccaacatagtgaaaccctgtctctactaaaaatacaaagaaaaaaaaatcagctgggcatagtggtgggtgcctatagtcccagctacttgggaggctgaggcaggagaatcgcttgaacccgggaggtggaggttgcagtgagccgagatcatgccactttactccagcgtgggtgacacaacgagactctgtctcaaaaaaaaaaaaaaaattaatactactcagtattgttgtgactgtatggaaatagggacacacacagtcctagagaaaatagaatgtggataactttctcatggcaattttgtaatacacaccaaagcctttgagatttgcatattctttcactcagcaactcctactctggaaatgtttcttaatgaggaaaaaaaggacagcatgcatgtatgcacaagtgtaacactgagttttttcacactgttctttcttttttttcttttctttattttttatttttttgaagtagagtctcactttatcacccaggctggagtgcagtggcacaatctcagcccactgcagctttgacctcctgggctcaagcgatcctcccacctccacctcctgagtagctgggaccacaggtaggcaccaacactcctggctaattgttttgtatttttaatagagacagggtttcaccatgttgcccaggctagtctcgaactcctgagctccagggaccacctcagcctcccaaagtgctgggattacaggtatgagccaccgtgcccagcccacagtgttctttatgatggtaatacttagaagtcacctaaaatataaattagtctaagtgcagtggctcatgcctataatcccagcttttgggagtcagaagctggaggattgcttgagcccaagagtttgagaccagcctgggcaacatagtgagaccccgttttgtaaccacccaatggattcaccttgcttgctgcctagacagagccgatttatcaagacaggggaactgcaatggcaaaagagtaattcacgcagagccggctgtgtgggagactggagttttattattacttaaatccttgagccttcgtggatcagagtttttaaagataatttggcaggtaggggcttgggaagtggggagtgctgattgctcaggttggagatggaatcatagagggtcgaagttagattttcttaatgtcttctgttcctgggtgagatggcagaactggttgggccagatgactggtctgtgtggtgtcagctgatcccatggagtgcagggcctgcaaaataactcaattactgatcttaggttttacagcagtgatgttatccccaggagcaatttggggaggttcagactcttggagccagaggctgcatgacctctaaactgtaatttctttttttttttttttgagacagagtctggctctaccgcccaggctgragtgcaatggcgcgatctcggctcactgcaagctccgcctcccgggttcacgccattctcctgcctcagcctcccgagtagctgggactacaggcgcccgccaccacgcccggctaattttttgtatttttagtagagacggggtttcaccgtgtcagccaggatggtctcgatctcctgacctcgtgatccgcccgccttggcctcccaaagtgctgggattacaggcgcgagccactgcacccggcctctaaactgtaatttctaatcttgtagctaatctgttagtcctacaaaggcagactggaccccgggcaagaagggggtctttttgggaaagggctgttatcaattttgtttcagagtcaaaccatgaactgaattccttcccaaagttacttcggcctatgcccaggaataaacaaggacagcttaagggttagaagcaagatagagtcggttaggtctgacttcttgcactgtcataatttcctgttacaattttgcaaaggcagtttcagtctgtataaaacatttctttaaaattagctgagtgtggtggtgcacgcctgtagtcccagctactctggaggctgagatggtaggatttgcttgagcccaggggttcaaggctgcaatgagccatgatagcaccactgcactccagcctgggcaacagtgagaacttgtctcataaaataaaataataaaatagattagccaggatgctctctgggaccaatgatcatcctatatcaaaccagcctaaacaaaaaagtgtttttggtaactggaatggatccaacaggaagaatgagcttatggaaccagagcaccttgaaaaacttgacagcccaggagtggagacgtggtgcagccagggccgactcctcccagtccttctctcttgtgtacttgtctctgattggttcattttctcctactgcacacaagcttttcttcaagtcgtagggaggacggcagctgggagccctcaagccatattcgttcagctccacgaccccaactgacaaaatttttcacctatgttatagaaattcccgaagaaggactgtgttcctccctctctcgctggctcacctctgaatcagtcactgtagtcaggagggtatgataggcagggcctgggtcattctcccacctaaaggccagggtgatggggtactgtgattggccacccctttagaaccacagggagttggggaggggaaattgttcaaagaaatcactacagtaggaaaagtgttggtgtaaagagctgcaaacataaaacattaagtctattgcaatgccccataaagagttcggttgaataaactgtcatgttaatataaagcaatactctgctgccattaaaaataatgttttcatgataaggggaattatttgcaatgctaattgaaaggggttggggctggtgcagcggctcacacctgtaatcccagcactttgggaggccgatccgtaggagctcgagaccagcctagtcaacatggcgaaaccctgtctctaccaaaaatacaaaaattagccaggcatggtggtgggcgcctataatctcagctactcgggaggctgaggcaggaaaatcacttgaactggggaggtggaggctgcagtgagctgagagcataacattgcactccagcctgggcaacaagagcgaaattccgtctcaaaaaaaaaaaaaaaaaagaaaagaaaggggttggggaaagtgatacaaaacgacatgtggcaagttccactttaacttggaatttgaaaggctagaaagagtgtggcttggtggctcgagcctgtgatctcaacactttgggaaggcaaggtgggagggttgtttgaggccaggagttcgagatcaacctgggcagtatagtaagaccccatctctaccaaaaaaaaaaattaaaagttagctaggtgtggtgtcacatgcccagctacttgggaggctgaggcaggaagatcactagagcccaggacttcaagtctgcagtgagccatgattgtgccactgcactccagcctgggcaacagagcaagaccctgtctctaagaataaaaaataaaaataagctggaaagtgcattgccccctctctgacaatatgaaaaagccagacaaactgcaaaatcacttttcttaaaccaaaagttgaacctaaatgctgagctgggccgggggcggtggctcacgtctgtaatcccagcactttgggaggctgaggcaagcagatcacaaggtcaggagttcgagacccgcctggccaatatggtgaaaccctgtctttactaaaaatacaaaaaaattagccaggcatggtggtgcatgcctgtaatcccagctactcgggaggctgaggcaggagaattgcttgaacccaggaggtggaggttgcagtgagctgagatcacgccattgcactccagcctgagtgacagagcaagactccatcacaaaacaaaacaaaagaaaacaaaacagctgagctgaggttgcaggtaagctaagtagcctgaaattcaaggacatgcaatcctcatgagcagagaccagatgggtggagtgtctcatcagtgccagagtatgggaggtatttgggccatcatacaagcatgcaagaagaaagcagctacatttttcataaattgctagaggcctagtgcagactagagtgactataaggagcctctgggtgtcacagaagcaaggagggctttacttacccacaggctcctttccatgacctctaccaggtgttcacaggaaatactgggggccaagtgggagactacaaagagccccctcagtactatgggcatcaaggaccgtatttgctatcattgcagaaaaggccccagctgcccatgctcctctctcgaaagccttaagaccctggggaggactggcaaatactgttgctcccagggcacaggtgttaccaagggaagagcagggaggaccctagtccgagggagggacaaggagcaattgtgagcccagagttctaagctaatacttttagaggtctcctgaaactgaaggaggagcacaaaaaaatctttcccacccaagaccagccacaaattcaaagcagggtttggcagcctggcataaggagtggggcagaaatactcatcccccagggcccaggcatataaacctacctaagatagaagatgaagagggcaacagagaagcaccctgtcccctcaccattacccgagcaagagcaccaagtaactaagcagtccgccactggcagagggcatgaacgtgcagagagacgacctctgtggggtctgctgtgtggtgtacagaggagaacgagagctgagggtggggcacaaacactgagaaatagccagcactccagatgccaccctaagcataaggcatcacaaaaggaatttgaagcctatgatgtaccgaaagtaaacttggcaattacaaaacctgcacagttcaccttttaactagattaactcaatccaccaagctaactgcctgagaagaggtgtgtccatttctagtcacaaatactatttatttaaatctctcctgttctacacaagatgtttggcaatcaatgaaaaattacaagttgtatcaaaagaagaagaagatgacaacaacatcctgtgaagatacaaagtaatcaatggaaccaggctcagagctgccctccatgttataataaaagagagagactttaaaatgcccaggagtcatatgtcaaaggagctcatgaaaaaaaaaaaaaaggacaacagacatgaggagatggtgtcaggggtggatttcaaaagaaaggtggaagtgatcgacttcctgaaatactaaacatgacagactttatagaagtttcaaaaataagatatgcaatatcaggccaggaacagtagctgaagcctattaatcccagcactttgggaggccaaggcaaaaagatcacttgagcccaggagtgtgagaccagcctaggtaacatagtgaggagactttgtgtctatgtaagataaagacattagctaggtgtggtgacttatatctgtagtcccagctacttgggaggctgaggtgggagaattacttgagcccaggaggccaaggtcgcaagcaagctgagatcgcaccactacactccagcctgggcaacagaacaaaatcctgtctcaaaaaaaaaaaaaaaaaaaaaaagaaaatgctgtatcagagatgagcagctccttcttcaggctcattaataaccttgacaatacgaatatagctgaggaaataatcgattgccttgaagttaggtcaatagaaattacccaaacaaacacaacaagaaaaaagagtgaaaatcatttgaattcttttcaaataatttgaatttttatagcacttgaattatcttcaagtgctataaaacaatatcaaatggcttagcatacatattgtcagaatcttagaaggagaaacgagaaagaacaagcagaagacatgtttgaagagacaagaaatgagaattttccaaaaataatgaaacacatcaaagaatagattcaagaattataaacaatttctccatgtttcccctaattcacacacactaggcacatacatacatgcacgcaccgtctcttggttaggttgtaaaattgtgatggtctctggaggctctgtttgatttggacacagggaaaaccagtatattcaattgagttttgggtcactctaccactctacataaactccataaactttttttttttgagacaggatctcgctctgtcacccaccctggagtacggtggcgtgatctcagctcactgcaacttccacctcccaggttcaagagattctcctgcctcagcctcctgagtagcagggattacaggtgcgcgccaccatgctggggtaatttttgtatttttagtagagacagggtttcaccatggcctcccaaagtgttgggatgaccggcatgagccactgcggtcttgttttccttggttcccatcactcttcctgctaagagcaatcgcccaggtctgtgaacacccactcctccgtagatggtgagtgcccctccagctagagctgctgactccctttaccacttccatcagtcaaatcggcccaccagtgatttttatctcttctgatccattttaaaatctatttaaatgcagctatcagtctgataacctgtctggaatttggtgggaggaaatgtccagggtttaataatctcccaaagttaggctgcataaaaccctactgttgacatctcatgtggtgcatatgggcgaaacggagccgtgtggaaggctattctgtaaaggggttagcgtgcttggatttgctctgggtatcagaatcctgacttgagacttttagcttagatagacaccataatatgttacttcgaaggcttcttacacttggacctttattgtaaataatagaagtatttctggagtaagaattacatcaattatatattatcatgttatgctacatattaggcataacatatatatatatatatatatatatatatatatatatatagtttttgtttgtttgttttttgagacagagtttcactcttgttgctcaggctggagttcaatggcacgatctcagctcacgacaacctccgcctcctgggttcaagtgattatcctgcctcagcctcccaagtagctgggattacaggcgcccccccaccacccccggctaattttttttgtatttttagtagagacagggtttcaccatgttggtcaggctggtctcgaattcctgacatcaggtaatcatccacctcggcctcccaaagtgctgggattacaggtgtgagacaccacgcccggcctataatatatattttttaattattatccaagggtgctgacataaatttccaatttattcatgccaaaaaattagtgatgataactgccaatcagtacagctaaagaaaatgttttcattctggtgtatttggaagtcttctgtctttatattatcccagccttcctcactcatttctgtgtattttatactttgtttcacaccattctgctcaagggtattattttcgcatttccatattatttctatttttcacaggtagtctttggtcttacatctgtgaacatcttctttgactattttgcttttccacgaagggctttccaaaaactattagcccactttacttggtaacctcccaggagacagcttagtcctgtctgctaagggatgctattctcagcaagtcagttttctgctctcctcactgcaagggaggccagaggagaagagcctgtttctgttccacccaggactgttgatttgaggttctacctccagagagcatggggctaatcaaaccaagacacaacactaaggaaaagaaaagaaagaacaagcagaagctggggccactccttgcttgccactgtctcctccctccttcttactaattataggcttcactctgttcctttttcaaatgtattcaagtgaatatgcaatgtaccaaagtttgcatatgaatgcatcagggaaaataagggtgctacccaaccccacccatgcttagacagcacataaaccaacatttggcttcctaaagtcagaaatgacagaaaactgaaagttcaaagagggaaaaaagaaacatggagatcacatgctcagattatacctagggggaaaaaccttttttttccaacaaatatttattgaacactgctatgggataaattgtatccccctcaaaatttatatgttgaagtcctaactcctaggatctccaagtgtgacttaatttggaaatagggtccagcctgccctggagatattggacttgccagcctccacaatcatgtgagccaatt

SEQ ID NO: 17931 - DNA, 16063 bp, Homo sapiens
ctggttatatttttggtcaaagcataaccagttcatgccagccccatagcctttatatttagtgagtggtaaataaaaattcgtgtttaaaatgttgatctggaaatgtttcaggatcctgaatcatccaagttttatatacatatatatttttctgataaaagggaaagtgctgcaatgttatgatgtttctatcagattaaaatatatttttaaaaaactcaatttaagcattaaatcatattcaatgagattttagattattttagattctgccttaccctgaattcaattttttaaaggcagccaaatcctcctgagatgaaatgcccagtttaacctgaattctgtggggaacctaaaccctcaccaatagggagaattcctaattcaatttggttagactgggttactcacagtttagagacttcctatataatttctgaagaagatcataaaatattgctatgatattgcttatctgtaatcataactacaccttcccccattaggtacacctttggccaacctgtgcaaggggaaacccaaatccgggtgtgcagagagtatttttcttcaagcaattgtgagaaaaatgacaatgaaatatgtgagcaatttattgcacaggtacagaccatgatctttactccaaaaaaagttctcactcatttttcattcttattctttctttgatttcatttataaggggaacttaacaatactattttcattttattgataatggagtttgcagctaaataaagtgaagaaagagaagaaaatacagtgcttaaagcagttttttattccatagaccatgtaaattgttctccacctatagattcatgggatttttagaatatgaaaggtatcgtgggctttgttgttttgtatatcgcctaggtggccttcctgatttttctttggagaatcgttaatcatcctttaaatgagtctgtgatattactctccatgccacctggatttttttttagtggaaacagcttacttgcaatcaactgcaattcagagtacccccactatattactttagacttgcagttcatatgtgaagtcatcatttgctctatctgcagcatcctaaccttaagtgaacaactcttcctatctctttgaaattgtcttttgactccccaaagtgaagcttgtgtacgccacatagttcatattttaagtccaattgtcctaaagttactcatcaaatttagtgaacatcctctaggtaaatatcaataattgacaaagacaagcagaatcctacctttacataggaaatgcaggcaaagaaaactagggtggaatttctccatgtcagcagtacattctgatagagttcagtcaactgttttacacaatgatgggtgttccctcagcaaatggtttatttttttcccccatgtgaaaaaaatacccataaacaatctggtagaggctaggagcagtggctcacacctctaatctgagcatgttggaaggccgaggcgggaggatcatttgactccaggagatcgaaaccagcctgggcaacatagtgagccccttctctacaaaaattagccaggcacagtggtgcacatctgtggttccagctacagggaggctgaggcaagagaatcactggagcccaggaggtcaaggctgcagtgaattgtgttcgcaccactgtactcaaggctgggcaacagagcaagacctgcctcagaaaaagaaaaaaaaaaaaaatctgtccggtggaactatctttatatatgagaggctttatttacttgaaataaatttcttagagtgagtttcctgagtcaaaggaaatatagataatgttcatagacagataattttaattttaataaatattagcatattgctctcctaaaagtttttaggcattcaaattcctgtcagaagtacatgagaatactatattttccaaattactttcagcaatatatttagaagttttaaaagtttttgtcattttgatagacacaaatttagcttgttttaacttgtgctatctaatttctatttagtttgagcaacttttcatatttttgttatcaatttggatttgagaactcttaattacccatgtttttctgttcatgtgaaatggaaactttcagtgtaagtactgccttccatcctacaagcattttttttcaagcctgttatttaaataggcaactcatttactttgtcatatttttgacatacccaccttccttatgttcctgggtttccagccttagaaaaaaaatctcactggcccctgtgttgtacatgtggctatctaagtatgctcttaagattgtttacaattttctaatagacataaagttcacttccaatgatgttctaaaatgggaatttttcttccagatgtgggctgtgttgtgttagcacctatctcacaattttgttctctctcactctttgtcctaaatcatgcccacgaaagtttcgtctattttattggttcttatttttactattttctttcttttattattttgtgttcctaaataatttattttctctttcatcttattaattcttttttctaatatttgtagttgattttgttggggtttaaaaaatatattagctgtttcttttagtaataagcacattcactgttttacatttcttctgaactgcagctgaataccattgactttgatgcgaagtattttttcattactctaatatctggattcttattggtttactttatgtattctctttgtttcaaggattcctgaaaaaaggcttttctcttattttcgaaataattaaggttcttctgatcactttctatgatttcattttaatttgactatattatcattagacaaaataaaattgcttttgttgttgatgtaatggctgttaatttaagatagagaagcacatactctggagccagagcagctcctcagcaccaccgtctcttagctgtgagatcttggacaggttacatgatggacctagtttagtttcttcatctatatagtaagataataacagtacctagctcatgtaatagttttgagtatcaaataaactaatatatccttataacattttaaatctggaataaacactgtgttataaaatataactaaatttatatttctctaattattattactgatgatagattaactatagattttttgttattttaaataagcaatataccttaaaaagtgtttgttttgttgttacacatgtgctgagcgcttctgttccatctgttttagtgcctttctagatgattagaatttcttcctcttaaaacactgtgaaccaaaagtatctgagacagatgtcaatcaatttgcaaagcttatgttgccaaggtgaaggatgtacctatgacagcctccagaggtcctaccaacatgtgcccaaggtggttgggctacagcttgcttttatacatttcagggagatgtgagacatcaacaaatatgtgtaagatgtacattggttcggtccagaaaggcaggacaatccaaactaagggggtttccaggtcataggtagataagagacaaacagttgcataaagaagaagtctttgaggccaggtgcagtgattcacagctgtaatcccagcactttgggaggccgaggcgggcagatcacgtgaggtcaggagatcgagaccagcctgaccaacgtggagaaaccccatctctactaaaaatacaaaaattagccaggcgtggtggcaggtgtctgtaatcccagctacttgagagactgatgcaggagaatcgcttgaacctgggaggcggaggttgcagtgagtcaagattgggctatttcaccccagcccgagtgacagagcaaggctctatctaaaaaaaaaaaaaaaaaaaaaaaagaataagtctttgtctttgatcagcctttcactgaatacacaaattacatgtgagaggaggatagaggaatagtcactcctgccttagtgtggctcagtaaatctgcatttttacataaactattaggcagaggaagcaatcagataaatcagatatgtatttgtctcaggtaagcagagggatgactgagtctgtcttttgtcccacgcctgtaaagataagctatgaatttatattgccagggtgaatttccaaagaactgttttaaggaaaagttcttgaggcccacaaagaatttccttgtgggcaaattgtgagggaggtatgtagtttttatctttgtagctaccttatttgggaataaaatgggagacagatttgcccagctgttcccagcttgccctttccctttagcttagggatgttgggctcctgagatttactttcctttcacaataccattcagcttcatttccatcctttaatcttttctcatctacaatgtttccaggagaatttccttgaaatctgtaaaatacagattacctccttcccttatttaaaatgctgatgtaaatattcgcctcctcctactcctcctttaattctttggccatttcaacaagtttatgaggtagagccgtggcacggggtggggatgttaatatatttgtgcaaaaaccatattttaaaagacacttaaaaaaacctcttggatctctaacattttaattataccttctctttatttttcagttggaaaatggttgtgtttctcaaattgtaaatacaaaagtcttccaactctaccgttcgggattgttcatgacatttcatgtcgctgtaattgttacagaatctgggacaggtaattactgtattttttggacgacctggggatatatgtatggcaacttactgggagaagcttgttgagttagcactaagtacaaaattcagattatttctaatttaatacaactgggaatagttgcaagtgcaaaaattattactgaaaaatttacaagattgcacaaagtgagtgttcaataagtatttgttaaaagaatgaaagaagaggccgggcacggtggctcacgcctgtaatcccagcactttgggaggccaaggcaggtggatcacctgaggtcaggagttcaaaatcagcctggccagcatggtgaaaccctgtctctacaaaaatacaaaaaattagccgggcatgatggtgaatgcctgtaatcccagctactcgggaggctgaggcaggagaatcgcttgaacccaggaggcggaggttgcagtgagctgagatcgcactattgcactccagcctccagcctgggtgacacaccaagactcagtctcaaaaaaaaaaaaaaaaaaaaaaaccagaaagaagggagaaagagattaattatttaatttggagtgggaaaatcagatttaactactaattatttcttgttatttaaaaaggagtttgtgattatgccattgtaaagtgctctatataagcatacttgatcaatatcatgatgctattcacactgggcaagctggtcacatttatattgctgtggatggtaacttagatattttcactctgctgtgttcatcattccttacaggtatgcagatcagtgagaagacctcagtttttatcactcaattgcttggaactgtaaactttgagaacatggatactttctacagaagagggatttcttattttggaactgtaggtttgactaaagaatacatgcttccatttcattttcttggatcatagattgccctttgaaaatttctggtcacttttttcctacttttgtaatacattttaagcactactatgtctgaggtgctagaaagtgtcctagattgaaagaagcaatagataacagtatcattttttccatactttatattatatatctatgtatttaatagagcatctttctgtctgttggaatttaggaaaatgactagggatcacatttatgagtagaaaactatttctctgtaaaaatgtaaacattttgtgttttaagtcatgttaattattcttttctcgtacagcttaaattttcggatcccaataatgtacctatggtgaacaagttgttgcaactggagctcaatgatgaatttataggaaattacactacggatgagaatggcgaagctcaattttccattgacacttcagacatatttgatccagagttcaacctaaaagtaagacatcaaagaacagaagaagaccattagacatcccacagaggatttggatatcagaaatgttaaacattaggaatatctcaaaagatagcttgtatacagaatmtattttaaagaaaatttaaaatgtaacttattttataaatttgcttgttcactaaataatacatgagaatacttgttcaagaggatgggaagctaaaagtctatcacgattgttataaatttgctaacaactaatattttcctytaggaaacaagaagtagctcatgaggatgatttgactttcttcctcagatcatttcatgcatagataggggagatcctatactttctgtttattttcygctgcttaaacagaattttgcagttaaataatttgtcagtgttcacatgtagctgaaagaaacagaactgaaacccaattctgtggcttcaattaaagtgtaaaaaacataacaattcaccatcagtctaatgaaatatttacacartctttcatggtcacgttttgtatacaaagagcaggtgctattattattttgattccaataacttaacattaaaacgtcagccacaagctgagattcctccctactctggagagttgagaagcctccattctcagtaacaactgtcttcggatgtcatgatactaagacccttcactttcttttgtcatctcaggccacatatgttcgacctragagctgctatcttcccagctggttgacgcctcagtacttggatgctcacttcttagtctcacgcttttactcccgaacsaacagcttcctgaagattgttccagaaccaaagcagcttgaatgtaatcaccagaaggttgttactgtgcattactccctaaacagtgaagcatatgaggatgattccaatgtaaagttmttctatttggtaagtctcagtcagtgggttcctggaatcctgttcaattgcacgtctgcttagcccagcacagcttagaaakcatgcatcagtcatgccacggtgaccagagtaagggcagccttctcactttgctggtgaatactgttcgatccattaacaacaaacaaacacatagaacgatctaaggcaattaaagtttccctaaggttgaagaacttgctgttcagagtccacttgtttaagcattcaaatgtaactcatatcaagtatttatgacactttgtaatagtaaaatattgggcagatgccagaaagtaaggtggaaagcttatkttgataagcagtaaaaggactttattctcttggttctgtccattttgtctttctaaggaggagcccccaacctttgtggcaccagggactkgcttcatggaagacaatttttccacagatggggtggggatggtgggatggcttcaggatgattcaagcatattacatttattgttcactttatttctattattattacatactcaccataatgtggaatcagtaagaaccctgtgcttgttttcctgcagctagatggtcctatctgttggtgatgggagacagtgacagatttttaggcattagattctcataaggagcgcacaacctagatccctcacatgtgcagttcacaccagggcttgtgctcctatgagaatctaataccactgctgatctgacaggagctcaggtggtaatgcttgctcaccgcactgctcacctcctgctgtgtggcctagtacctgacaggccatggataggtacctgccggtacacagcctggggactggggccttctgctctaagggctattgaagagtgataagacacagacctggaaattaagacattaacttgaatcccccaccctctcctagttagcatgcaagttagtgcatcttggacggattgtttgaactctttaacccttggcttcctcaggtgtacagtgtaattggagattataagacttacctcttagggtaagtgttctgtgtcaggcactgttataaagattgtatatgtgttaactcatttaattagccttatagatatctccattttacagataatggaacagaggcaaacaggtaaaacatcatgttttaagtcacaaagttaatgagcaggtgaaggcgtatttgaaaccggacagccttgacaatttcagagctttatgtgccactttgcacagtgcattgcacatagttcacaaagtttccagtacatgatagaatctcaatcagttttagtcactttctctgctcttttccaacttacgcaaagtctatttttaatatttgcttgtggaagctaccctatcttatggaacagaattaccattaagtaatgaattacctaatctcaatatgagaatatgatgacatcagataatatattgcatgttatgttttctttgttccacacagatgatggtaaaaggagctatcttactcagtggacaaaaggaaatcagaaacaaaggtatacataatgtattcattttaaaatatgtgctctaacttcattttttcttgttaaggatatatagacattatatatatgggaattatatatattaagaaaatatatttagtcaaacatatatgtgtgtgtatatatatgtgtgtatatatgtatgtgtatatattatatagtgaaaagaagttagaacgagcacttatttcaatttgtggatgaaggtaatagttagcacagcctgagggaagctactaaatgtcttgacgaaggagagttctacctgtttcttttattgtcagatcattgagtacattagaaaagaggtgtacaaccgcatattctcactcataggtgggaattgaatggtgagaacacatggacacaggaaggggaacatcacactctggggactgttgtggggtggggggatgggggagggatagcattgggagatatacctaatgctcgatgatgagttagtgggtgcagcgtaccagcatggcacatgtatacatatgtaactaacctgcacattgtgcacatgtaccctaaaacttaaagaataataataataataaataaaaaataaaaaaagaaaagtggtgtacaaaatcccagtattgttattatctaaattatgcagtcttctttatttgtgtatgtacttcctattatttgatttatttgtcttgaaaacagggcccaatttactctttctgtccatgagctattctcttttatctaagtgtaccagtgattcaggaaactttcagcatcgtatctcttcgtctcctatttacacagcctggaatggaaacttctcgttcccactcagcatcagtgctgatctggctcctgcagccgtcctgtttgtctacacccttcaccccagtggggaaattgtggctgacagtgtcagattccaggttgacaagtgctttaaacacaaggtgatgtttctcctatttctggcctgagaagtgggaacagtttgctccctgctgtcttctcgcctgactgctatcaccttcacgtgggaaacttacactcagtgctggcataattgaattattaggggatgtgagaatcaccaaacacaatgcatgatccttggcagcagtgccaatcctgagacggcagcacgtggtgaagggggtctcctgcaaagaaagctgagggtgagagtgggcaaaggaaatacmgtatagaaatctataaggatttattcaggagagattaaatgtattcagatcatctttacataaaatggtctctactctcatctcttttttttctctactttaggttaacataaagttctctaacgagcagggcttacctggttccaatgctagtctctatcttcaagcggcgcctgtcttattctgtgccctcggggctgtggatgggaacgtccttctactgaaatctgaacaacagctgtcagctgaaagtgtaagctctctgacttcctcgtttttcatgtttctctggactaccagaagtcttatccttcagatgatgtcttgaacatgttgaaaatattgaatgttttcttcctttgttccttcgtggattatatacgtatttttcttggctatcctaagagcatgcttataacaatacagaatttgatagataattataacagtttaggaattttacaactgtgatttttaaaaatcataggtgtaatcacagaagtggaaacttggaataaaatgaaatctctatgttcaaggatatgcttggattcagtgtaaagttattatctataaatggatattgtattttcttaaacatttccagacctggaattccagaagttcacatccaatttatttcgcttaacaattgttggatattttccgtttatttctaacacaattacatataaataactattgaaatttatgatcatatttaaatctaatttaaattgtgtactttgtgcaaagtatacaaagacataaagaaggaaatctttaaaatcatttatagtcctaacacttaggcatctttatagttttgctgtaatttttcaagtctcttttctgaaggcatatatattttacaaacttgagatctcaccaaaaaatagttttgtattttgctttcaacattctgtagtaagtccagttttaagtataaaattatagaattcagtaataatattgaataactatagatcattatataaaacatttttctcaatgcaaaacataaatacatttaagttttctattacagggagcaaaaatacttttagttagaagctttcagaatctgaggggacatcaacaaataaaggataaatttatctataaatatggaatatggccatgtgctgtgctcacgcctgtaatcccagcactttgggaggccaaggcgggcagatcgtttgtgctcacgaggtcgagaccagcctgcacaacatgatgagactctgtctcccccgaaaatataaaaaatgagcagggcacagtggtgtgcacctgtgatctcagaaacttgggagattgacatgggaggatcacttgagccctggcgggggcagaggttgcagtgaaccaagatcgtgccactacactccatcctgggtgacagagcgagaccctgtctcaaagaaaaaaaaggaatatgtatatatatatgtgtgtgtgtgtgtgtgtgtgtacatatatatgtttatatatgtacacacacacacactccttttttttcccttgagagtttcatggattcagagtaaatagcttctgctcattctttctacagttggaggtggcaatatcttaggaaaactgcctcaagaaaagaccatcaagggacctcaaaaagaaaattctagaggcattattcaggggtctcagaatatatcagagccaaaagaggttgcccttgtttattattgatagctatattaatagtataaatcaagtgaagttctataaatgagtgaattccaatttatattctataagtttatgttattttttgtattatctatgtaagcttagtttttagttttaaataatttttaaaagtgcaagaattacacagagaactcccgtagacccttggcctgattcaccagtttgtgaacatttcaccgtacttgttttctctttctcactctctccacccctacacacacacacatacatacacacacacacacacacacacacacagagtttatgccatttcagttttttctgaatcatttgagactaggttacatacatcagtctattgtgaaagaaaaatacaaacaactccggaccccaattcacgatgctaaaaggacaaaaaatgaggctgaaaactgagtcatggaagaagttgtttttcttttgttcctaagcagatagctactttttcttccttgttagattagttggtggtttacctattttgccgagttttccaaaaacatataattttaatttattaatgtgatgtaatatgatgtgaggttttttgctactccatcacattaatttctatttttatctttattatttccttactggtgctgtattttgttgttatttttagctttttcacttagaaatttacttcattttcattaatttattttattgggctaggtgtttttaagcctataagtttttccatgatttctacttttgaagtatctcatagatcctgatacatagcaattgcaccatttttatttttcagaaattccgtaatttctgtttgtattaaccctttcactgaaaatttacttactggagtactttataattttcatataaaaaggaatttattttagagttttcttttaaatttcaagttctatatcttcatggccagcaatatttccaccagtatatttttgtgcccaaatatataatgagtttttgcgaatatatctcatgtgttgagaagatatagtctctattatcagtttgttttctatccacgaggttggattattttgatcctttgtattcttacttattttgtaaaatttatttaaccttcttctgctgagtgatgtgttaaaataccctacaaatagtgctctgtttcttcttgcatcttctgtagtttctgcatagataatcataactgttgtgcctttattatgaattgcagcttttagcagtaagtattcttctctatcttgtttgatgtcttttggccttacttctacgatttccgataacaggaggattgcagcctttgcattcttattattttcctttacttttcctttggatttcaccttttgaagtatgcacttcacttgttttttgtatgaagtacagcattatgttttgttttaaatatgcatatctttgtcttctaaaggagaataaagtctattcactctattgatatgatgtatgtgttaggcctcagctctatcatactatttttcttatgattctgtattgtatttaaagctactttatttctttagcttttatgtttgtttgttgttatcttgcttaaagcttctttgagtattcaggctagcttgaatttttattttagtggttatttttatatttacatattttataatatcctaatatcctaatctcattttttcttgcttaaccttaatatctagtcagttatggccgggcgcggtggctcacgcctgtaatcccaggactttgggaggccaaggcgggtggatcatgaggtcaggagatcgagaccatcctcgctaacacggtgaaaccgcgtctctactaaaaatattaaaaaattagctgggcgtggtggcgggtgcctgtagtcccagctactcaggagactgaggcaggagaatggcatgaacctgggaggcagagcttgcagtgagccgagatcgcgccactgcactccagcctgggcgacagagcgagactccatttaaaaaaaaaaaatctagtcagttatttttaatctttgagtcttaactgctacctacacaacagtcagtaatctctagtttccacttttctctccctcttctctcattttattgttgcatctttccttttttgtcagaatatataatgtttacattctgtattgtttctcctattcatcaagtcttactaatttcctgagtcatcttttggttacataaagctcattctccaggaggctgggacgggaagattgcttgagcctgggagatcgaggctgctgtgagccattatcataccactgagcttcagcctgggcaagagaatgagaacctgtctcaggaataaataaataaaaatttttaaaaagtgcattctctgctagagtcctcaggatatcacataagtatagaattctctgacattttcatattcagaattattttttctaaagccttaataaatgaaagacaggtatttgtatattaaatctttggtttatacattttaaaattttttgaaatgctaccttactattgacttgctttgaatatgccttttaatagtgctgacattagtttaattcattttccattatgggctactttatctctatgtctgaaggccttgaatgttttttcccctttatacttagtttcagtaagaatgtgttattctgtagaagttttgccaggtacacagtggagtcatgcaatatgtaaactcaaatcttcttttattttcagatagttcccctgaattataattgtaaatattggtctttccattttttttgttctaaaaaaatctctgtacatttgttggatcttccttgcctgctttccaattcaatcactttgtgacctgttttaattcattctttttcagttttgttctgttgtttttcctctgtgctgcttttaaagttttctctgaacaattttctcttgatgtccttgtactttagagtttatttatgatataattttgtctagttttcctgagttcaataaagcctcattttatttcttcttgggttttgtccatttctgtattttcttaattgaatttctgactcatggtgccttttaaatacctcaaatacatgcttgagaatatttcactcatgttaaattattttggcatggcttttctttgtttacttatttatttacttagtgactttagtggagaagtttcattagctgaagtgttttggtttgcatttcctattttctcttacagaagctttgtatggagttgattttttctagttcttgatattttgtgcagggtgttcataggtgaagagcgccctttctatttttttttttttagtaaaatgcattatttttaaaatgttggtgatggaaatgagggtggagggagttattttatcctatgacatcctttccttttttaaattccctgtctccaaggatctgcatacctcttcttgtgatctgattatttccccttagccatgttttttggaagcttccacttccaggcccattcagtccaagccctttccctgtgtgctgtactgggaactgttgagtccgaaaactatgatttgtatttttaacaatgctagactttctcttacctggagttgacttggtgtgtgtttcttctcatttctccatgccattctgctctctttttctctgcagtctcttaagccttccctctgcaatagcagtagaagctctcttggcatttggtgtttgtttctctactaagaaataatttgaagatcatggtattctctgtattgtagtaatgttaaagatattagtcatgagtatccttacttgttctctttgttgattttatgttttcttcagaagattatgtaagaagatttaaaatcaggcagctaagattattctccagacttagaaattctagcattataattgactgtgtgtacaatgggccttggattaatcaatagtcaggcattgctttcttacattctctcttaaatcctgcgcccaagctgagaaattctgtgaacatgacatcagttgcctaaaacaaaactggtttgctcttttgaaaggaagagcttatgtgaaaatactggattaaatatgatggccgtgctcttaaagaaaagaacaagaataaatggtacagtagacaatttgccaattttgtaattttaaaagaagtgcttaaaattattgggaaatgttttttctcataggtgtataacatggttccaagtatagagccgtatggttatttctaccatggcctcaatcttgatgatggcaaggaagacccttgcattcctcagagggatatgttctacaatggtttatattacacacctgtaagcaactatggggatggagatatctataatattgtcagggtaagatcactaaggattttggaaaatatttcatcacaatttttagtattcataatgcatattaatgttttcttaattatgtagttttcttcctatactttgagattcgtgtctgtaatctgccaatagagtacatagaaattgtcttataaaaaggagatattaattttgttga

SEQ ID NO: 17932 - DNA, 12893 bp, Homo sapiens
cttagcgacctacaaagagacttagactcctacacaataatagtgggagactttaacaccccactgtcaatattagacagatcaagacagaaaattaacaaggatattcaggacttgaactcagctctggaccaagcagacctaatagacatctacagaactctctaccccaaatcaacagaatatacattcttctcagcaccacatctcacttattctaaaattgaccacatatttggaaataaaatactcctcagcaaatgcaaaagaatggaaatcataacaaatagtctttcagactacagcgcaatcaaattagaactcaggattaagaaactcactcaaaactgcacaactacatggaaaccgaacaacctactcctgaatgactactgggtaaataacgaaattaaggcagaaataaataagttctttgaaacccatgagaacaaagaaacaacgtaccagaatctctgcgatgcagctaaagcagtgtttagagggaaattcatagcattaaatgcctacaggagaaagtgggaaagatctaaaatcgacaccctaaaatcacaattaaaagaactagagaagcaagagcaaataaattcaaaagctagcagaagacaagaaataactaagatcagagcagaactgaaggagacagagaaacaaaaaaccatgaaaaaaaaaatcaataaatccaggagctggttttttttaaaagattaacaaaatagaccactagccagactaagaaagaagaaaagaaagaagaatcagatagacagaataaaaaatgataaaggggatatcaccactgatcccacagaaatacaaactaccatcagagaatactataaacacctctatgcaaataaactataaaatctagaagaaattgataaattcctggacacatacaccctcccaagactacaccaggaataagtcgaattcctgaatagaccaataataagttctgaaattgaggcagtaattaatagactaccaaccaaaaaaagcccaggaccagacagagtcacagctgaactctaccagaggtacaaagaggagctggtaccattccttccgaaactattccaaacaacagaaaaagagggaatcccccctaactcattttatgaggccagcatcatcctgacaccaaaacctggcagagacacaacaaaaaaagaaaatttcaggccaatatccctgatgaacatcgatgcgaaaatcctcaataaaatactagtaaaccgaatccagcagcacatcaaaaagcttatccactacaatcaaatcggcttcatccctgggatgcaagcctggttcaacatacttaaatcaataaacgtaatccatcacataaacagaaccaacgacaaaaaccacatgattatctcaatatatgcagaaaaggccttcgataaaattcaacacccctttatgctaaaaactctcaataaactaggtattgatggaatgtgtctcaaaataataagagctgtttatgacaaatccacaactaatattatactgaatgggcaaaagctggaagcattccctttgaaaactggcacaacacaaggatgccctctcttaccactcctattcaacatagtattggaagttctggccagggcaatcaggcaagagaaggaaataaagggtattcaaataggaagagaggaagtcaaattgtctctgtttgcacatgacatgattgtatatttagaaaacccagcatctcagctccaaatctccttaagctgataagcaacttcagcagagtctcaggatacaaaatcaatgtgcaaaaatcacaagcattcctatacaccaataacagagagccaaatcatgagtgaattcccattcacaactgctaaagagaataaaatacctaggaatacatcttacaagaaatgtgaagttctccccttcaaggagaactacaaaccactgctcaaggaaataagagaggacacaaacaaatggaaaaacattccattctcatggataggaagaatcactatcgtgaaaatggccatactgcccgaagtaatttacacattcaatgctatccccatcaaactaccactgactttcttcacagaattagaaaaaactactttaaatttcatatggaaccaaaaaagaactcatatagccaagacaatcctaagcaaaagaacaaagctggaggcatcgtgctacctgacttcaaactgtactgcaaggctacagtaaccaaaacagcatggtactggtactgaaacagatatatagactaatagaacagaacagagacctcagaaataacgccacacacctacaaccatctgatctttgataaacctgacaaaaacaagcaatggggaaaggattccctatttaataaatgggtgttgggaaaactggctagccatatgcagaaaactgaaactggactgcttccttacaccttatacaaaaaatgactcaagatggattaaaaacttaaatgtaagacctaaaaccttaaaagccctagaagaaaacctaagcaataccattcaggacataggcatgggcaaagactttatgactaaaataccaaaagcaatggcaacaaaagccaaaattgacaaataagatctaattaaactaaagagcttctgcacagcaaaagaaactatcatcagagtgaacaggcaacctacagaatgggagaaaatttctgcaatctctccatctgacacagggctaatatccagaatctacaaagaacttaaacaaatttacaagaaaaaaacaaacaaccccatcaaaaagtgggcaaaggatatgaacagacacttctctaaagaagacatttatgcaggcaacaaacatatgaaaaaaagctcatcatcactggtcattagagaaatggaaatcaaaaccacagtgagataccatctcacaccagttagaatagcattcattaaaaagtcaggaaacaacagatgctggagaggatgtggagaaataggaatgcttttacactgttggtgggagtgtaaattagttcaaccattgtggaagacagtatggctatttctcaaaaatctaggaccagaaatactgtttgacccagcaatcccattatcgggcatatacccaaaggattataaatcattccactataaagacacatgcacacatatgttgactgcagcactattcacaatagcaaagacttggaaccaacccaaatgtccatcaatgatagactggataaagaaaatgtgacacatatacaccatggaatactatgcagccataaaaaaagaatgagttcatgtcctttgcagggacatggatgaagctagaaacaatcgtcttcagcaaactaacacaggaacggaaaaccaaacaccgcatgttctcactcatatatgggagttgtacaatgagaacacatggacacagggaggggaacatcacacaccggggcctgttagggggttgggggctaggggagggatagcattagaagaaatacctaatgtagatgacgggttgatggatgcagcaaaccaccatggcacgtgtatacctatggaacaaacctgcatgttctgcacatgtatcccagaacttaaagtataacaaaaaataaataaataaatagcaggaaattctgtcatttgcaacagcatggatgaacctagagaacattatgttaagtcaaatgagctaggcacagaaagacaaatacagtatgatctcagcttatgtgtggaatttagaaaagtcaaattcatggaagtagagaatagaatggtagaagtagggaaaaggtggacaaaaagaaaaagaaaaaaaaaaaaacactcccaccagtgccatgacagtaaatttacagatgctggcaactcctggaaattactctatattgtctaaaaatgggaagaactcttggttccaggaactaccagcttctttcctggaaaactcatgaataatgcatcccttgcttagcatgtgatcaaagataaccataaaaatagtcaaccagcagcccatggggctgctctgcctatggagtagccagccttttatttattccttcactttctttctttttttttttttttttttgagatgaagtctcactctgttgcccaggctggaatgcagtggcgtgatctcggctcactgcaagcttcgcctcccgggttcaagcaattctcctgcctcggcctcccaagtagctgggattacaggcgcctgccaccacgcccggctaattttttgtattttttaatagagatggggtttaaccatgttggccaggatggtctcgatctcctcacctagtgatctgcccgcctcggcctcccaaagtgctgggattacaggtgtgagtcaccgtgctggcctattccttaactttcttaataaacatgatttcactttactgtcagcttgttcttgaattctttcctggaggaagccgagaacccatgtggcctctctggccgaatcccaattttggggttcacccagtaataaaccaaagagttgttttgttttttagactttagacaaactggataaagaatatcaggaggaaatgatttttccattgctaaagataaacaatatcctcaagttcagtgatattaaaaaaagggcaataagaaatttacatcagacagaaaagtacagagattaagagcaggggtttaaatcgtcactcccccacctactagccatgtgaacttggagaaagtatttaaactttatgggcttctgcttcctcttctgtacgatgagggtaatagttcccactcgtgatgactaagcaagtttatacatgtggagcacttagaacagcatctaaaatgtaagtactcagtaaataatagctgactcaagtttataattaagaaggctaaggaagtagcaagatatatgaaaatgatattcatatatactatgtttttaatttagaaaagggggaggggaatttgttagtgtattttctcagttatatagtctgggagagtatttaataaactattatctagaggcagtaaatactgtgcaactacattttaaaatttaggccaatctacatttcaatgtcacataatttttaaaatactgccaatttaagaagctcccaatttgggaggctgaggcgggtggatcacaacgtcaggagatcgagaccatcctggctaacatggtgaaaccccatctctactaaaaatacaaaaaattagccaggcatggtggcgggcgcctgtagtcccagctacttgggaggctgaggcaggagaatggcgtgaactcgggaagcggagcttgtagtgaaccgagatcccaccactgcactccagcctgggtgacaaagcgagactctgtctcaaaaaaaaaaaaaaaaaaaaaagcagctcccaatttcagagatgcttcaatgtgaaaaaaaaatgcacattttagattgaatgaaatagattaagagatggaaaacagtaacagcaatattccaagcatcagatgttttatagtctcatctttttctttttttttttttgagacagagtctcattctgtcgcccacactggagtgtagtggcatgatttcggctcactgcaagctcagcctcccgggttcacgccattctcctgcctcagcctcccgagtagctgggactacaggtgcccgccaccacgcccggctaatattttgtatttttttttagtagagacagggtttcaccgcgttggccaggatggtctcgatctcctgacctcatgatccgcctgcctcagcctcccaaagtgctgggattatagacgtgagccactgcgcccggcctatagtctcatctttttctatacaagctgtgaactaaaatccagtttctaaacatgcatagctgcttttgttttgcttttgttgttgttggttttttgttttttgcttttaaagcaaagcccactagagacagcaccacatatgtgactggtaaggcaacagcagaagaaaggagtccttttatyaggagtcttgacctaaaaagccaagtcctaataatgaaaaaacaatgagcaaagaaagaggaagaaaatggctgtgaaagaagagaggacagtggaaatgggatatgatagagaaagctacaagataaaagaaatacagaaattcctgacaatgtaacaaagcattctgggggctttcagtggaggagcagccagatcctacagaccagcatgctcttgaaataaggccctacgacaacatcagaaaggatgccaagaaaattggaactgttaaactaaaagggacataaagaaagtccagtccatgaatactcaaagagaacaaaaagtatactattctctaatacaccccagcacaaaattgctacacattgctgatgcgagtatatgratggtgtagacacacaaggaaagctgagtaccactgatgttatttagtttgcaagctgggattacaggtcagaaagagttacatctggcattccatctcctctatagcaaagccactaagtcatctagcctctccttgaatatccctcattattaagaaactcatgatcactgcagaaccctaattccactttctgacagtgttggtagaaaattcttatgtttggttgggcatggtggctaatgctggtaaatcccagtactttgagaggccaaggcagaaggatcacttgagcccaggagttcgaggttgcagtgagctatgatcatgccaccatactccagtccaggtgaaagagtggagaccctgtctctttaaaaaaataaaaagtaaaaaataattattacattgaaccaaaatgtaccaactagtttggggttcttctgtttattcaatatctattgagcccctgaatggactttgagaggcccttgaggagcaatggatgactacagaattaggggctatagggcagacacagagcaaaaacaagaagtttggtgaagaaattgaggtgactgacaacagtgaaagcaggaggaattttttctagtcagggaaagctagaagagggctgacctcaggtcccaaccaggagatatgtgggtcataaaagatgaacaaccgtcacttgagtgtcaccagggaatcagtaatgtgggagaaagccaggcttcatgcagaaaactgtgtgggtctgtgttgaaattcaggttttagggaattttctaaacataaaactggggttgctcaagacagcacagaaggaaagactgaggaaagtggtcagcaataaaaggcagttttggaaggggctagggaggcaagggctaagccagagggattgaaagggaacggaaagacatgcccggaagagcttgcacctagggcagtaacttgtagtaggtgctagatccttgtaaacaaacatgatccaatgagacaagcattagattagagatacacaaaagctgccacaaggaactgttagggcatgaaaacaataccccaaaatacggcactttggcatgctgaactaaggcagcagccacaggggcagagcaagatgatggaatagaagaagcctacactgtttgtcacccccctcacccccaggaggaacatcaaattttaacaactaactacatacaaaaggcagccatctcaaataaccaaaaatcaggtgagcattcacagtagctggttttaatttcatatcactgaaagagacattgaagagaataggaaagacagtcttgaagtgccaatgccagccctcccccttctcccagcagtggccacacgtgcagattttgtgcttttgggagatggacagcacagcagttgggaggctttgctttgaactcagtgctgccctgtcagtgataagcagaaccaggctgcactcagatgacatctaaccacggaaggagcatttggactggccttagccagagggaaatcacccaccatagcagtcagagcttgagttcccacaagcctcacaaccacaggccagagtgctctggggccctaagtggtcttgaggggcaggttaggccacaaggactgcaattcctaggcaagccctagtgctaagctgggcccagagccagtggactagagtaggaggcacacagcctactaagacaccagccagggtgactaagggagtgcttctgccatgcctcccccacccccagcagtggctgcgtggtggggagaaatctgtgcatttagtagagggagaatgcagtgactggggcactttaacttaactcagtgctgccctgtcacagaggaaacctggcaggatttaccccctgctgactaaagagcgccaaggccctgaattatcaacagcactatccaggtagtataccataggcactgggctctgagacatgctggcttcaggtgtgacccagcacattcccagctgtgagggctacagtgaaagactcctgtttgagaaaagcagggggaaaataaaggagactctctgtcttgcacctcaggtattagctcagctacagagggtagagcaacaagcagacttctgaggtcactgagtccaggcctaggctcttggtcagcatttctggacctgccctgagccaaaaggtgagtcccagagctggcagcattggtcacaagctgacggaagagcccttaggctttaagtatcagtgatggcctggcagaacccccccataagccagtggtgatggcagccacagggagaggatcttctgcccgtggaaaggggagggaagagtgggaagcaacttgtcttgtgggtcacgtgccaccttaaccacagtagaacaaaacaccaggtaaatatctaaggttttgacttcaatccctggtgttctcagacagcatctatgaaccaatctggggcctaggggaactcaccaccctggagggaagggcacaaacctggctggctttgccacctgctgactgcagagtcctagggcctggagtaaacttaggtggtagccaggtagtggttacaccgggccttgggcaagatcgagtgctatcctggcttcaggtctgaaccggtacagtcccagttgtggtggccacggtgtgctggtgacaccccaccccccaaggtccaggtggtttagcacagagagagactccatttgtttgggagaaaataaaggaagagaacaagagtctctgcttggtaatccagagaattcttccagatcttatctaagatcatcaaggtggtacctctataagtcggcaagaaccacagagttattcagtttgggcccacatcccctcaaatacctgaaaagcctttccaagaaggatgggcacaaacccagacagtgaagactacaataaatacctaactcttcaatgcccagacatagacaaatatctacaaggatgaagaccatccaggaaaacatgacctcgcccaaagaactaaggcaccagggccaggcgcggtggctcacgcctgtaatcccagcactttgggaggcagaggcgggcggatcacgaggtcaggagatcaagaccatcctggctaacacagcgaaaccccgtctctactaaaaatacaaaaaattagctgggcgtggtggcgggcgcctgtagtcccagctactcgggaggctgaggcaggagaatggcgtgaacccaggaggtggagcttgcaatgagccgagattgtgccactgcactccagcctgggcgacagagtgagactctgtctcaaaaaaaaaaaaaaaaaagaactaagacaccagggaccattcctggaaaaaacagagatatgtgacctttcagacaaagaattcaaaagagctgtggtaaggaaactcaaagaaattgaagataacacagagaaggaattgataattctatcagataaatgtaacaaagagactgaaataactaaaaagaattatgcagaaactaaaaatggaattggcatactgaagaatgcatcagagtctcttattagcagaacagatcaagcagaagaaagaattggtaagcctggcgttggagaccagcctggtcaacatgaggaaatcctatctctactaaaaatacaaaaattagccagacatggtgacatgtacctgtaatcccagatactcaggaggctgaggcatgagaatcactttaacctgggaggcagaggttgcagtgagccaagatcgcaccattgtactccagcctgggtgacagagtgagactctgtctcagaaaataaataaataaataacatataatggagctccaatacatctagcacttttcagtggaaaccttacaggccaggagaccttacaggcatgacatatttaaaatgcggaagaaaaaaaaaatttaccctagaatagtgtatccagcaaaaatatcctttaagcttgaaggagaaataaagactttcccagacaaacaaaagctgagagattttgtcaacaccagacctgtcctacaaaaaatgctaaatggtacttcaatcagaaagaaaaggacgttaggccaggcgcggtggctcatgcccgtaattccaacactttgggaggacgaggtgggtggatcacgaggtcaggcgtttgagaccagcctgaccaacatgatgaaacctcatctctactaaaaatacaaaaattagcagacgtggtggcatgcgcctgtagtcccagctactcaggaggctgacgcaggagaattgcttgaacccaggaggcggaggttgcagtgagccgagattgtgccattgcactccaacctgggtgacagagcaagactccatctcaaaaaaaaaaaaagaaaaagaaaaagaaaaggacgttaatgagcaataagaaatcatctgaaggtacaaaactcactggtaatggcacacagaaaaacaggaatataacatggcaatttttggtgtgtgaaatactcttaagtagaaagactaaaccatgaacccatcagaaataataactacaacttttcaagatatagacagtgcaataagacataaaaagaaacaaaagttaaaaggggaggagaaagttaaagtatatagttttattcattttcttttttgcttgtttatttctgcaatcagtgttgtcatccatttaaaataatgggttacgagatagtatttgcaaaccgaatactaattgttgtgttttatgtgtgtccattgtgtgcatgtccaacgtacaatggacacccaaaaaataaaaagaaattaaagcgtaacattggagaaaatcatcttcactaaaaggaagacaggaaagaaggaaagaaagaagagaagaccaaaaaacaaccagaagacaaataaaatggtaggagtagtgcttacctaccaataataacactgattgtaaatcaactaaactctctaatcaaaagacatacagttggccaggtacagtcgctcacacctgtaatcccagcactttgggaagccaaggtgagcagattgcttgagcacgggagttcaagaccagcctgggcaacacagggaaaccctgtctttacaaaaaatacaaaaattagctgggcatggtggcatacacctgtagtcccagctactttacttggaaggctgaagaaaaggatcacttgagcccaggaggcagaagttgcagtgagctgagattgaaccactgcacttcggcctgggtgacacacaacacaaagacatggagaggctgaatggataaaaatgcaaggcccaatgagctgttgcctaaaagaaacacacttcatttataaagatacaaatagactgaaaataaatgaatggaaaaagatatttcatgccaatgaaaacaaaaaaagagcaggagtagctatacttatatcagatgaaataggtttcaagagaaaaactgtaagaaaacacatataacgtcactatataatgataaaggggtccattcagcaagaggatgtaacacccagatataaaggaaatattattaagagctaaagaaagaggctgggcgcggtggctcacgcctggtggctccgcatttgggaggccaatgcgggcagatcacgaggtcaggagatcaagacaatcctggctaatacggtgaaacccgtctctactaaaaatacaataaattagccaggcgtggtggcaggtgcctgtagtcccagctactcaggaggctgaggcaggagaatggcgtgaacccaggagacggagcttgcagtgagccgagactgtgccacagcactccagcctgggtgacacagggagactctgtctcaaaaaaaaaaaaaaaaaaaaaaagagagacagatcccaatacagtaatagctggagacatctaaatcctactttcagcattggacagatcttctagacagaaaataaacaaggaaatatcagacttaatctgcagaatagaacaaatgaacctaataagtatttatgaaacatttcatccaatggctacagaacatcctcctgagcatatggatcatcctcaaggacagatgacatgttaggtcacaaaacaagtcttaaaacattcaaaaaaaactgaaataatagcaagcatcttctctgaccacaatgaaataaagctacaaataaataacaagaggaattttggaacatatacaaacgcatggaagttaaataatatgctcctgaatgaacagtgggtcaatgaaaacattatgaaggaaattgaaaaatttattgaaacaataataatggaaacacaactaccaaaatctatgagatacagtgaaagcagtactaagaaggaaatttacacctatgagggcctacatcaaaaagaagaaaaacttcaaataaataacctaacattcatcttaaagaactagaagagcaagagcaaaccgaacccaaaattagaac

SEQ ID NO: 17933 - DNA, 18567 bp, Homo sapiens
  misc_feature (1)...(18567): n = A,T,C or G, or insertion/deletion polymorphism (see Tables 1-2)
aattttatttttggtttacactacaacaaaagtataactttcttgtgccaaggtgttgcatttaccacaggcctttcccaacagagtgcattcggtcctaaccacactctgcctgagagactacctctgcttccactagtaagaagctctggaaatgtttataacttgttgtaacggctttaatgccaaataaaacaagtttacacaccctgattatgttcagtagtggtaactcagaggagagcactgtgagcctgccctcatgacacagccccaccacagatacttatgcttgtgggtcttcacacaaagagaggccttaagggagagaacagatgagcattgcttaccattggttggtatgaaccagctgcctactgaggctctggacaaagggcttctcaagaacaggttttgcagagggaatgacgggttcccatttgtcccatgactcatggtaagttcctggcaaatttccctaaacccttcatcaattggctacgaagaaacactgcatgctttgcaaagtgatcacagccaaaagttgcaaaatgatttgaattatttccagaagctttgtattttcttaatatcaaaaatgatcaatactacctaaagattcatactttaaagaaagtgaagcaagaaaggtggtgaaaacacaggagagaagttatattctgaaaatgactttggaagagtgaatagatcttcactaagcttggaagcataatttattctttttcttatttttctttttacttttcatgagtatatattaatttttattttttaatagtatatattacctataaacttcagttactttgcattgtagggaaaggcatcttgaatataaaatgttttcttatattaaatatatgaatattcactgccataaaagcagacaatgtttattaataacattattccaaagtattcacaatatactcagacttggacttatgtcttacttgtgttttattttgacaattactgaactcatttttttaatttcataaaataaattgctgctgttaaaaaattataataaaaggcatcccagatgcatttttttaaaacattagagcaatgatcttaaagttagaagcattgatttagattttgtttagaatccttttttgtagtaatggtaaggaggctttagcccagcattgcacttttatagttgtaatgaaacacatctctgctttacaggatgaggaagtgaacattggaatgtatgtgaataaagagggatttttttcatatgctggaaacggcattcccagtttgcctaacagacaacccacaccatcatttttcccactctctccacacccttaactttatgaatgagatccttcttgtctagtaaatgatgaaatcttttcccacagtagaaggggatttcccatgcgtagactgagaattagaaacaactgctctgtatcctgtatgcaaataacattgttattgtactgtaaaaaacttacgtatgtctgtgttcatgtgtatatgtgttctgttattcttactgtttcccatttaaacagttagaagacttttaccaaatttagaaggtgtattagggaggtctatatttatatctatctctcaatttggataatgtttatgtacaaagttcacttttgagatctgggggaaaatctaaaaaaatgaacaatcataccttaagtcagatgtaacttagagagttggaggcaagtataaataatattaatagaattactccatatgtattataattccatggaataagaaaataaatcataattctaaacatgagtcccagatagaaggttagggcatttactccaaattttaggtgctaactggcaatctagaaaattctcatatgtgcaagtcagtgtagtatgctcatatatttatttatcagaggggtattattcaaatatttaatagttatgatttcttcaatcaaatcagatagatgagattgtatgtgtgtttataaagatgaatttaattctccttataaaagataagtgcactgcaagatccaccttctactcaacaaattcaaacatttgtactaatttgtcttttggaaatttcttatattaactttcctgttatcgatgttagatttggatttctaaattgtaatgggttaataaagtctgagaaagcatttgatctccagatgtgccctactattggtatgatttatattttgcattttaattagtaaagatgctctatatgtaagtacatgcctgactgtgttcctcaaatagtaagtgatcattttagattcacactttggaatgagtgttgtagcaaggggtaacgaaaccccaaggaatcagtaacaggcaaacataaagagaggtaggtttgggtgttgcttttcacaaagaacaacacaagtagtcactaatctgagactgttagccaactgggatataaagaggaaggagtagattgaaagcataaagtccattgtcttagtcaaatgattaagggcaattgtctttagatttggccaaaatttcataggtaaagaagtgcatgataacaggctttttagaaagggttatgtgaaaatagagtaacaataaaataaaagctaatgtctcattaagttgaccataccctaaatacagatactggctttaatcttttctagttctctgtaatatatagcagtgggaaaccagcagaagacattattagtcagaaagatgcgtctgcttctcactgcattacaaaacctgtgtaaaacctctggatagaaagctagcaccccaataatgggtttgctttaaaagtctgggagtcaagagtgcttacttcaaatgcagcataggatgggttgaatggaaagaagtgaatggaaagaagctctcctcctgggagggttaatattctcctattttgctccccaagaatatggttagttgtacacagacacaagattctatggaaaacctgagactgactaaaagtcatgattgactcaagaagtgcttgcattcatataccacccattggaaattcaacaatgaataaaacatgcaggctgtatctctgagattcccacagccaagtggcatgtattacataaaaactaaatatttgtagtgtgacatgacatcctgtaatagagatgagtacctgtgttatgggagctaaaagcagcaacaactaacttcagcttgggaattatgaaagtttgaaccgaatcacaaaagaacaaggaggatatatgtacctggtagacaggaagtcatataaagagaggttctagacagaagactgagcccacaaatacacatgtagagatgaaagggtgtggcacattgctggtgttttcagggaagaaagcagaacgtctgtgggcaagcagtgggggctataggtagataagagccttaagaaacttttttttctaaagagtttggaatttatcttgtaggtaatagtggaccattaaggatttttaaagaggatatgatataattaacttgaattttaggaaaaaacagttggtaaatagatttcctgctgttttcagtaaaagggcaatgtcagaggctgagcccaatgaaaccactttgtgatacttgataaagtcacagcaatcgtgcgattgtcttctaagagcatcttatttagtcaaaactctaaagacaaagaaacacaaaatacctggcaataattttggtaaaggaaaagaagaaaatgaaatgcaaaaaaagaaaaagtaatgcttcaataaactttcctaccaggatacttttatataaaaatatgtcgtatggaaaatacaacatcaacaattagtaataaaaaagacatggtaatatttaattttttttcaattagagcttccttaagcctttgttatttttacattgcttccattgtaataactatacagagcattgccaaccagaaattggtactgagttctcaaaatagatttagctctcaaccaagaaataatagtgagatacaaattaatttacaatgattgaatttactgaaatgggatttaatttgttcttgaaattttcactcataggcattgtaaattatgtctaggaaatgctgatgcaagactgttttgtaaattagataacacacctaatgacatgtaacacactgggagatggctaaaatttaaacatgacttaaactttaagaatgactcaggaaatactggcaaaatctcctgcatggatatatagtcccatactcggcttccctgactagtgagaacgtctgggctcctagaacactgacctgtatgtggatctagcagacacggcatattgactttttcttcatctcattggatcatgatgtggaagataatacatctgggtgtttttctctttcatctgtctctttctcagtctccaaacttgtcagtgattacacagtttattatttcacatggaaggcaaatagagcttggtattaaaaattcaggctgggcacagtggcttacgcctgcaatcccagcactttgggaggctgagatgggcggatcacctgaggtcaggagttcaagaccagcctggccaacatagtgaaatgaaaccccatctttactaaaaatacaaaaattagccgggtgtggtagcatgagcctgtaatcccagctactctggagtctgagactggagaatcgcttaaacctgggaggcggaggttgcagtgaggcaagatcgtgccactgggcactccagcctgggcgacagagggagactctgtctagaaaaaaaaaaataaataataataataataataattaaacattacatttttattgcagtgatttgattttaaataattttatcattttacaatataacccaaaatatgctcatgggactagtaaatttcaaatttggttggcatcatcatctctgcctcgtagatatccagaatgctgagtaagagctgtaacagtgctatatttatgttgaggaagaggtgtctgacagctgctggggaaggaactggacaaacagtaggcaaatataaaacagaatgtgctgtgtcagtttgggggcaaaagcattgtacaagaacactgatgatgttaacctttatagaactaatgacaaattacctgctgatttttaattgggatttcctttttgacttttaaaaatttaattcatatgccaacatctttctgtttcatacagatttagccatttgatgtatttctaacatttaaaaataacatacttctcttaaactcaaaaattcttcaattaacacaataattgctaagtaactaatcacacattcaattgtaatggtcttgcttgaattttgtaggcagtatgttctgctgattccttctgttctacaagaaggctctttggataaagcttgtgcccagctttttaatctcactgaatctgttgttttgacggtctccctcaactatggtgaggtccagaccaaaatatttgaagaaaatgttactggagaaaatttcttcaaatgcatcagctttgaggtaaatacttctttctgcttaatatagaaaagaatattacaggtgcatgaacaccacccacataactgattttttagggacagagatcaggctatttgactgtatgtgtaaagttattttaatttttaaaagaataatatagtcctcagtatgagatgatgttaagtacagtcataaatggtaacaagggcaagagccaaaacatttgattttatgatagaaaattgttgaagggaataagacatatagaaagaatgactcttgtgcagaaaagggaagttttaagaaaggcaaaagaatccatttaaatggtgagataaggaagtgacaaagcaagagaaataaacaaggttggttattgaagaaatagatatgacaaattatgaattaaaacttttagtgataccaacacacagtgatagagatttcttaacaaaaaatcagtttcatggagtatttatttgttccctaggttcctcaggccagatctgacccactggcatttattacattttctgctaaaggagccactctcaacctggaagagaggagatctgtggcaatcagatccagagagartgtggtctttgtacagactgataaacccacctacaagcctggacagaaaggtgagtgtacctaaatcaggttaccctcaactaatgtcacttatatgatatttgaattgatggtacacaatacaagctcagaaattttattgtattaaagtttattagagaacctgcttaaaaatacaaaataaaaatatagattacatagcctaaatgttagagatttcatttccatgagtctggggkggggagcctcagaaagtgyatttttaaagagcaccttattctattctaataatatccatattattctaataatattctaataatatccgtattattctaataacattctaatcacatatttggggattttgaatttaatttacacaaacttacaagcttatggttgaaatagaaacaaaagagcaacaaagtatgtcatgaacatgtaatgagatacccctagtgactagagaattgcccaagtaatagaatgatcagcatgatgttgaattaagctgaaaagcctcctctctcctcctgggtacagaaggagttgatgaatacagattacagcagtcagaagatagacatttctgatgagatgaatggtacataaaaaagcactgaggtagaattaatttaaaaaccatgccgtaaaatgagaagtagatagacttatttggagtaaagaaacccaaatgtccatcaatgatagattgaatgaagaaaatgtggcacatatacaccatggaatactatgcagccataaaaaaggatgaattcatgtcctttgcagggacatggatgaagctggaaaccgtcattctgagaaaactattgcaaggacagaaaaccaaacaccacatgttctcacttataggtgggaattgaacaatgagaacacttggacacagggtggggaacatcacacaacaaggcctgtcgtgcagtggggagagggggagggatagcactaggagaaatacctaatgtaaatgacgagttaatgggtgcagcacagmaacatggcacatgtatacatatgtaacaaacctgcacgttgtgcacaagtaccctagaacttaaagtataataattaaaaataaaataaaatgtgatataataaaagaaaaaaaaaggaaggaaaagaagctgcagtgaatagaagagttaaaggaaatccctgaatatagaactaaagaggcattttcatgtagttaagtaacacccatgaggagtcactacagatgtggggatcatggcttgaggaggcagtcgtggatgaactgggaatcacagtaatcagagcctgcttaggcaccaacacactgtgatcccagaacaacacaagcagagggaggtgagggatatgtgctggagatggaggaatgcactgcatgcattgtgctatccccagccttccactcctcttcccctgaccctttgcctccctccctcacttcacaaaagagggcattcaggtcagtatttaggcaccagagaaagaaggactagacaagaaagacagggcatggctgtacagtttgggctggcaccaacaacggtggaacaaacattacgagagcatgcatgctggcgtgggaggtgcttatgagggggaagagtatatgtgcttgacacaagaggatgtccaaggaaggcttctaggattcttgctaaggagagctatagaaggcagaggtggggaaggtggctgctacttcaaagagcacagaaacattaaaccttaatttaaaattgcttttttaaaatttcttatccatccacagtctagtaaagagtctaatgcacagaggaaaggttataacatagcaaagaaattgagccaggagtcttacacaattgagagatattcagttttcaaaaaattgatcattacaatctgagattataatgctacaaatattcataatctacycagcatcatgcttctttttgaataaaaatatggtgtgatattaactatgattgctaaaacctcattgcacagtttattgttgcttcatatttataatgcartatattaactactatatagtggcatgaacaaaatatgaaaaagcatagtaaacagataaaatagaaagtgagaccagactaayatggtgatggtagtctaagacagtatttcagcagaagactacaatctagctagcgacaatctgagaaccaaggcgatcaacagtgaaaactgtcaaaagacaacgaatyatgacctggacttcagtctttacaacaggatacctgacaaatttcatttcatgtagtttagaaacctgttagaactaagcattcttttgtggtctctcagatcaatctatcaactgagcgcagttacgaagaagcttctgaagcttacagaagctgtgcagatggtttctctgttagtgccttttcctccctccaaattgtacttcatccttaagacatcgtcacttttaatccacctcctttccccatcttctatagttatgctacattcactagactgttgcttaattttaatttccagagcaggaatctaatttttagtgctccaaagaccttgtagtaatctaaatccgaaatcacttcngtaagatagcatgtggttcctgttctccttggttcatggttgaagcttctatttctaagaatgcaactcctctatttaaccaangcagtgagaatttctactgcaatcctttgacaatcatccttgattggaagcaccatggggaagtaaaggncttcttgaaaatcaaagcagctgcagcattatcataactcccttattagttctcaccccccgaatgttgacttattattgtcaattaggccaaatatgattanccaactccctgctttagtaataactacatttgcataagaacaggattaatggactgttccctcaaatatgggtcatagataagaagatcrtttgtaccaaatgtttatggcaaggagtttccatggcacaacaaactgcatgtgcttatgtatagagatggaaattgatgtagcatttccaaaaatgatggcagctaagagattatgtggttttatctttgcaagccagtgtttctaattgctggacattatctggttcagtattccatttagataaatagattcaatgcatggctggcctatgagatttgggyattcataataaatttgactacataataaaaatatagtaatgatgcaactgggctcattatcaaatgagccaagatatrgagcatatacctagtttcttctgcccaaatcytacatcggtcttttctttcattttctgcaatttcattgctgatggtgcctttcttttcctttaagtcagtgttttgtagartattcaaacatactttttccagaaagtttcatttgcatcaagaagtttcagatctttctttaaacttatcttaagacctggaactactagtcctctaaaaagaggccctgtgtatggacagggagagatagtatgaaccagaaggggacatgaaggagttgttgtattggttcttggctggtttatacaagatttagtgcagacagtcattagtgactasagcagaatcagcctcattttaataattgtttttagagaaaaatcaagcagcttagaacaatgaaaatgtgattttactaggttcttgttcactagttttttgaaatagaccaagctgagtttaaaaaaaaatctaaaaaaaaargacaaattaagtaataaaaactaaatttgttgaacacagttgaagccatctgcattggaagtattacaaatagcaaacaaaaagggatagtactctaggttcatttctcattattagaatctcatccaaatggttaacgtcttcccatggcacctttgggtaatatawtcattttcttcctatgaggaaatctcatgagaagctctacctctcttaatgcttgagttaatgttgcagcagtagctttcttcaataccatctcaatatttcatcaagattcaattccatgaatttagaataacaagtaggcccttaattcaactgttatatttctcagttccaagaattctggacaaggtttatgaatcctgttcytatctccagacacattacgttttattagtgaatgaatgctgcaattagtgggaaggagcacttagcaacttggggagtgggcaaaggaccctatgtactcatttttaaaattctcatcagcctattcacatgagggcttctggcctaggagtctttaatttcaacttgttagttttaaggtcctgagagaaaacactaagagatgaaagtcaaactgttgactataggtttagagggggcaagagtggtaaacatggagagaactgagaggagatacagagaggtggaaggagaaggaagaaggagaggaaactctgcaagggaaacttgggcaaatgtctacrtttatttacttgtctgataaggaaatggtggagtataggaatggccaataatctaagacaaaaamaattagtgctagatacagaaatcaaaattgaagcatttcaaaaagaggcaaccagcagtgtaaaacattgcaactgtcagagtgaagactgaccacgaatttgttgataaggaagttatkattcatctaagagggcatttttattatgttggagagacccaagggcaggrttgcttactgagactgcagggtgtatgttgtgaaagagagagaagtaaatgaaaattcttgaaaactaggcagatgagtttcaatataatcaatagatattcaaactttcagtcagaaatcagtatttgtttgggttgtcctaaatgtgtttatgtttctttgcttmataatagatttataattaacctcttcactcatctagaaaaaaaaccttgagttcatatattaacattatttttatttttatttcagtatccagtgatcacccttcaggtaagataactaatagttgaagaattgttttctcattttttgaacatctctcyaaacctcaaaatcaaaaggcagctcacagggaagattgtctatttaaattgtygcagaattattaatttcatgyagacagccycaagaggacagaaataggtttccacccccaccaccatgtgattcatattagcatgcacccattaatacagacaataataatatagacaacgggcaagtatgattgtatttaatttaatgtttagttgttgaatgtatataaatgtacacttaatgttttatgcactggggataaaatatggctcgcctttaagaaatcagagattgacacagaaaataaatgtaaaaaaatcacagctagctctaaaatatactaagtrctgtaatatgcatctatgtgacctcagataggagagtaaccaattctccttgggtgatgtgaggacgcactcatgttttgaatcctaagtaagttggaaacctaagtaggaaacaccttgctgaaactttataatgaataaaaacatccagcatgcaaaaatacgctttcttattctcaggatccagaaggcartcgaatacaacagtgggtgaatgaggagtctgtgggagggattctacaactctccttccagttaatctcagagcccatcctcggatggtatgaaatcaccrtggagatgctcaatgagaagaaaacatatcactccttctctgtggaagaatatggtaaataatagcaatgaaaatattacctatyaataaaaaaattataaaatmtttccaattttgcaagggcargattattaaataatgaattttcaagtgagtatctcttcctttcctctttccttgtcctctgttactattttagggttctccatctactgtgatttttatctcctagttcagcccataatcttcctgcaattctctgttaacctaggctatctatcttccttttgtagtatctggattctattttatatgatagtttctgggatgtaaagcacttcttatgagaagaatggaattaacattagtcatatgttagccattagtcccttcatattttctcctaaaatcttcataaaatttctattgtagtatctttattactattttaaagatgaagatattgagaaacactttcccaagttcaacacctgaraagtgatgaatttggaattcaaaatatgcatttttctatccaattccaaaatccagtcttaggcacttcarcgtcctcctcacactgtttattaatggcaaacataagcaaaggttgatggtttgtaaaggagaaacaattgttttgtatgaatgtatttatgttaatatgtatttatgttaataatatataatatacacattataatataatatatattttttttttactggcagtgttacccaaatttcaaatgactgtggatgcaccagaaaatatcttagttgtggactctgaattcaaagtgaatgtctgtgccttgtaagttgaaattgtacacaatagaataatgtattcatagaaagatattagaatgggatagatggctaaaaagaagtaaaatataaatgtgtagaaggtaagggaaaaagaaggtgttaaattattttgctgattttatgaattcttccatgcatctataattcttttaatgcatgttatgacacgtggttttatgtaacagtttaagacaactgactactgtctttcttacatcataagataacatattgttttgcaccagccaatacagtagccgtgaccacatgtggttatttaagttttaattaaaactaaatattcagttgcgttagccacatttcaagctgtcacatgtgactagtggccactgaattggagagcatagacataaaacatagaacattccatctcccagaaatttccattggacaatatcttctgtttatgatgatttctcaattcaatctttatgtattacatgattataaaagaaagctgaagctcaagatgtatcacagagaaaactgctgtaagagttacaagtggctctagggtaatggcggggcacagtgtggaggatactaagggcagacagggacttaggggcaaatagtgaggattaacgtgtggcaggagtagcagtgaagcaggtcaggttgttttcccctcttgtcactaagttaagcaacattcacagagtttatataaccagcaaagagagccagggtgcaaacattaaaactttgtctcctcagacctgatgtgtactacttttccctgactcatgtgtactacttttccttttaattttgcataattaaaaataaaaaagtgacctggaaatttctagttattaggagagcttcactacagtaatctaaaattccatgccaaactttaaggtgaaagctttgcctgtcctccttcctgtgtctactttaggctggaagtctttaagagtcaagaagaagcatggctaactttttgatgtcactaccttgtgcttcacctccagagttggaagaatacagaaaaggcagagactgaaaagtctcattgtagttgggtcataaaggcagggaattgccagcattgctggaaaatcccctgagtaacagaaatccccaaagcccaaatgtctaggtacttccctatcacagtggctgtgtgttggctcctgtgtcatttttactggagaagtattgcataagcaaaataaagcactctaggacaagccagctgggaatcccaaaacataagcatgaatcactaaatggttgaagattctaatgacttgaaatcaaggtattatataaacaaaaaaaagagcaatatatacctgagaaaactgttgaacatcaatcagaaaaaaatttagaaataagtaaaatgtgtatactcagatatgagtcaatagtgtaactttaaaaataattaaagaccttggaagtaggcatattattaatttaaaaatatatgtgtagaaaggctgactagaaggatcgatgatgcttaagagagaattagtaatttggaagatgaaattgagaaattgtcataaaacgtagcccagaggaatctactgttattccttacaagcaattttgttctttgctctttctacctatttaaaattttttaaattatactttaagttctagggtacatgtgcacaacatgcaggtttgttacaaatgtatacatgtgccacgttgctgtgctgcacccattaacttgtcatttacattaggtatatctcctaatgctatccctccccactgcccccaccccacgacaggccccagtgtgggatgttccccacccggtgtccaagtgttctcattgttcagttcccacctatgagtgagaacatgcggtgttcggttttctgtccttgcgatagtttgctcagaatgttggtatccagcttcatccatgtccctacaaaggacatgaactcatccattttcatggctgcatagtattccatggtgtatatgtccatctatcattgatggacatttgggttggttccaagtctttgctattgtgaatagtgccgcaataaacataagtgtgcatgtgtctttatagcagcatgatttataatcctttgggtatatacccagtaatgagatagctgggtcaaatggtatttctagttctagatccttgaggagtcaccacactgtcttccacaatggttgaactaatttacagtcccaccaacagtgtaaaaatgttcctatttctccacatcctctccagcacctgttgtttcctgactttttaatgattgccattctaactggtgtgagatggtatctcactgtggttttgattttcatttctctaatggccagtgatgatgagcattgtttcatgtgtctgttggctgcttaaatgttttcttttgagaagtgtctgttcatatccttcgcccactttctgatggggttgtttgattttttcttgtaaatttgtttaagttctttgtagattctggatattagccctttgtcagatgggtagattgtaaacattttctcccattctgtcagttgcctgttcactctgatggtagtttcttttgctgtgcagaagctctttagtttaattagatcccatttgtcaattttggcttgtgttgccattgcttttggtgttttagacatgaagtccttgcctatgcctatgtcctgaatggtattgcctaggttttcttctagggtttttatggctttaggtctaacatttaagtctttaataatctgtcttgaattaatttttgtataaggtgtaaggaagggatccagtttcagctttctacatatggctagccagttttcccagcaccatttattaaatagggaatcctttccgcatttcttgtttttgtcaggtttgtcaaaggtcagatggttgtagatgtgtggtattatttctgagggctctgttctgttccattggtctatatctctgttttggtaccagtaccatgctgttttggttactgtagccttgtagtatagtttgaatcaggtagagtgatgcctccagctttgttcttttggcttaggattgtcttggcaatgcgggcttttttttggttccatatgaactttaaagtagctttttccaattctgtgaagaaagtcaatgttagtttgatgggaatagcattgtatctataagttactttgggcagcatggccactttcacgatgttgattcttcctatccatgagcatggattgtctttccatttgtttgtgtcctctcttatttccttgagcagtggtttgtagttctccttgaagaggtccttcacatcccttggaagttggattcctgacttcaaactataccacaaggctatggtaaccaaaacagcatggtactggtacaaaaacagatatatagaccaatggaacagagcagtggcctcagaaatagcaccacacatctacaaccatttgacctatgacaaacctgatgaaaacaagcaatggggaaaggattccctatttaataaacggtgttgggaaaactggctagccatatgcagaaaactgaaactggaccccttccttacaccttatacaaaaattaactcaagatggattaaagatttaaatgttagacctaaaaccataaaaaccctggaacaaaacctaggcaataccatttaggacataggcatgggcaaatactttatgactaaaacgccaaaagcaattgcaccaaaagccaatattgacaaatgggatctaattaaactaaagagcttctgcatagcaaaagaaactataatcagagtgaacaggcaacatacagaatgggagaaaaattttgcaatctatccatctgagaaagggctaatatccagaatctataaggaacttaaataaatttacaagaaaaagcaaacaaccccatcaaaaagtgggtgaaggatatgaacagacactgcttaaaagaagacatttatgcagccaacaaacatatgaaaaaaagctcatcatcactggtcattagagaaatccaaatcaaaaccacagtgagataccatctcatgccagttaaaatggcgatcattaaaaagtcagtaaacaacaggtgctggagaggatgtggagaaataggaacgcttttacactgttgttgggagtgtaaattagttcaaccactgtggaagacacagtggccattcctcaaagatctagaaccagaaataccatttgaccagcaattgcattagtgggtatatacccaaaggattataaatcattctactataaagacacctgcacacgtacgtttattgcagcactattcacaataacaaagacttggaaccaatccaaatgcccatcaatgttagactgggtaaagaaaatggggcacatacacaccatggaatactatgcagccataaaaaagaatgagttcatgtcctttgcagggacatggatgaaactggaaaccatcattatctgcaaactatcacaggaacagaaaaccaaacaccacatgttctcactcagaagtaggagttgaacaatgagaacatatgggcacagggaggggaacatcacacaccggggcctgtcgggggttgggggcaaggggagggatagcattaagagaaatacttaatgtagatgatgggttgatgggtgcagcaaaccaccataacacatgtatacctatgtaacaaacctgcaccttctgcacatatatcccagaacttaaaatataataataaaaaataatgaacagttttacttctttccaaaacaaacaaaaagaaattaccccaaaatctgatgacttaaaatgacatttataaaaaataaataaataaatataatttacattttaaaagtaaaaaccataaaatatgctcataatagcagtttaaaaacaaaaaaactaaaagaagcaaaatgttattttatttcattttttgtttttcaatactccattgctatcagtatgcaaaaaatattatttttaatgaaataatgactgatgtatttttttgtttttttgtttacattgtattttagtgacttagatatataacgtctacatgcctatttcaacctttttaattaaaatatatttttgcctaaagcattcaactcaattttagtccataccattgttttagatttcctccagaaaataaaatttatggtaactagctatttaaatgttgttacagtgctggtttcagctactaaataaaggtttcaaaaccctatacagattaaaaacgaccttgacctctgtaattgtgttattgttatattcttctattagatatacctatggtgaacctgtggacgggaaggtccaacttagtgtgtgcagagaatctacggcttatcattcatgtgctcatcttatcagttcactctgtaaaaattttaccattcaggtaagaggtatatcagcaaaattataaataggtttgcgttaactttttatcctcaccttccatttaccttcctttcttcttgttttcctctttacagttaaaatatatacttttattctatatttctattcctatttgtaaattttatattcctcttttgtcatgctaagtttcattttctattgactgacaaaaagcaaattatagtatcagaaactgagtagtaaatttcgattcttaattaaaaatacatttggtttcatatcaaaatctacaccctatcaatttactgggaacatatgtcctgttctttattttatactttgtgaatttagtcagggagatgtgatgtttctgcatattcaagagtattagatgtataattattttcctctcaacctattctcactggaaataagtgtatataggagctccagatgggaaccctatcagtcaggttcttaaccactaaagagaagaatcaacttttccaaactgacaaaggaggaatttcctaaaagatctacttggaaggtttgagaaccaacattcagaaaac

SEQ ID NO: 17934 - DNA, 42385 bp, Homo sapiens
  misc_feature (1)...(42385): n = A,T,C or G, or insertion/deletion polymorphism (see Tables 1-2)
cccaccttactaccttgtatataataaaccctaaattgctgcatgaatgaatgaatataagacagaaaagcaattttaaggggcaccactgtatttcaagatgattcagattttcatatcagatgataaggaataaaagtaatttgaatcagttagctcttatttaccacacttgatactgaaaaacactttccacctggttttcagactgtattgaggctccattaaaaaaaaaaaagtgaggcacttccatttcaagataaatgaacattgcctctccaagagtggttacatttattttagccatatttgtggaaatatttctaaagtatacaatagaatttttaagctagcttagctaacgatggctttacattttaaagataaaaccttttcttaacaacctggagaattataaacatcttgtcaaaacaggccatggaaggcatgctagcagagattcccttgctgtggggacatctctaagggattagccgaggctgcctggcaaaggtgggcttggttccagaagtgaacaatatccagagtgagctattccagtagctgggacatggccgtgggaggggtagcagctaccatttgctgaatactaagtatgtgccagactaaaccacatgctaagtatgtgttagatgccatatgcgtcatctaagggcacaacaacaggatattattatccctattttgtgggtgagaaatttgaggcttagagagttaaatatttgctgagagtgaatatgaactaggaaatggtggagaccagattcaaacctcaggctgtcaggcccaaaccatcctaaagaaggaaagctctgggtccaaggcaggcagttttgtaatttctcttgaaggagaacccaaactacaggtagaaattaattgtcttctttcctctccaggaagggtatggcaagataagtggagaagaacgttaaggcaccaggtaaacaggtgggaatccaaccagagccccagttcaggaggatggtcaacatgatgactctggcttggggacacaaacacccagtaatgacggacacaccaaataccgggtctctggcagccaaacaattccagaatcgcacctgctggcgaactgattcactctgcacatttctcgccagaacgttcctttgggaccaagtggttggtgctgtattaatagacaaaggatagtagtggctgaagctgaacaggactgagaggacacagttcttacaccatgctattatagtgatgcctgaaaggggtcctgggatgtgcagtgtgttattgtgtcttccttaaatagccccagacaactatgctttttatagtatttctctcttccatccctcatggcctactagtagtcactttttgctgtcagcatgcctgaagagcagattctgtgtcccctactctctccacatggcttctcaaaaaaatacacatcttcgcagctagtttatatgctaggaaaccgataaatcaaacgtttgatgagccaggtgcggtggctcacgcctgtaaatcagcactttgggaggccaaggtgggtggatcacatgaggtcagaagttcgagaccagcctagccaacgtgatgaaaccccgtctctattaaaaatacaaaaattagctgggcatggtggtgcgcgactgtaattccagctactcgggaggctgaggcaagagtattgcctgaacccgggaagcggaggttgcagtgcgctgagattgtgccactgcattccagcctgggcgacagagcgagactccatctcaaaaaaaaaagtttgatggcgtacaaataaccatacaagttattggcccccctttcacgcactcactcaacaagcatttcttaagcatgcttaatcaagagtggcaagtgctgtgcaaggccctaggaaaacaaaaccaaagaacacaatttttgcctttgaagggctcacaaaccaatggagatggagaggtgggaatgtaaatttcacactgcaggatgcagcagaggttctaacaaagctctgcataagtgtgaaagccacatgagaaggaagcaaagccattcatgagaatcacagatgactgtccacaaataaagtacatgggcttctctccacacaggaagagggagcaagtctgccaccttcagagttccaagaaaaagaatagctaatatttgttgagtgtttcctatataccagaggtattctttccacatattaactcacttaatttttttttattttaaatttttaaatttttcttttttatacaggcagggtctcaccgtgtcgcccaggctgatctcaattcctgggcttgggccaggcacggtggctcacgcctgtaatcccagcactttgggaggccaaggtgggcagatcactggaggtcagaagttcaagaccagcctggccaacatggcaaaaccctgtctctacttaaaaagtacaaaaatcagccgggcatgggggtgggcgcctgtaatcccagctactcaggaggctgaggcaggagaatcgcttgaacccgggaggcggaggttgcagcgagctgagattgcaccactgcactccagcctgggcaacaagagtgaaactccatctcaaaaaaaaaaaaaaaagaaaaaaaaaacccctaggctcaaattatcgtcctgtgtaagcctcccaaagtgctgggattacaggtgtgagccactgagcccagcctcatttaattcttaagaaaacttaaaggtgttgcttttttaaaaatttcattttacatctggaacctgagccacagaaaagttaagtaatttgcccagggtctcacagctaatagtggggagccaggacctaaacaggcagtcaaattccaaagaccacaccttaaccaagaaactgtattaccacctccaaccatcagcacactgcagtgaatacgtggaaacatttaaaatatgggaataggttaaaagtaaaatctctaaggtaaaattcactaagctttggccaaagacagaaaaaagggggaagaagaggaaaagtaggaaaccagctgtcatgctgagaggatgaagggaatggtggcaaggaaatttggggttaggtggcccctgcaaccacccaacaggtatccttgggcacccaggaatcttggtagcttccagaagaagcagaaagggtggagagcacccttgattgatcacttttagtatttacacatagagtatgtggacctctgtttgcctgcttgctccagccccccagaatctttaggaatgtgtctgaaaatttgttaatacaaagtatccaaaagtaatcataataatacacctgcatttgctctaccaacatttcatcccttcaatagagggtaaactccttggcatttgtacaaatgggactggattcttcattaacgtctgcatctataataaagggtagtattaaaagacatgcattaaaaaattaaattcaaattgacacacaaaagtagggatcaagtacttatctctgaaaataagactctggacttaattataatagacaagagtaatttctagacagtttcatctcctgaatcaatatcaaatattttcaaaacttgtaccattaacatccaattttattattttttaagcctatgaaaaccagacctttgatttagaaaaataataacgagcacatgtaattatgccagtaattatatcccaggcaacagttcaaagtgttgtatatttactaactcatttagtatatgcttatatgtgtatgtatgtgttataaaatgtatgtgtgttatacatatatatatgaaaaacaattttacagaattttcctgtttggagaggagaattcaaacagttggaatgtttcttgaccactagtaattttcaaataatatatgaagaacataaaatgcagctttgcctgcttctaggattgttccaagcagttctcttggctgatctaaacatgagtgttctgcaatacacacatctcctccgtggggtaaataataccaagcatagggatgccatcatggcactatttcaaaatgtaaacttgacagccagttaacagctcttcaggaaagagtaataagtacctggagcccagaagaccaaaaagcaaatgtcagaattttaggggaaatgatctaggttgctcccaaaatgctgttcacggtgatctcccagagagtgcctcattctgagtcaatataaccctaatgtgctttccttcaattactgtaagcatatcctgagatttcagtaatgtgacagctggtaacctgagccccaactaagactgccctcggctatatctctttattaattcatcccgggagctggaattgagctatgctgaggagcagagaaagtggcattgtgtcctccctgacaaagcagggcaagtgcaggcacctcacacacagaggtatgtttgtcccaccattcaaacagagctgcttgcctgctgcctgaactgtagcgtgccttgacactgcatatgaaacgctggaggagcaataatatctatgtgtgcaattttattgcaaaaaggcctgattctgctgttgtctctttacaaatgtctgataatccactcctgtcacagactgacaagagctgctacttcatttccagctgttggggaatacctcaggagaatacttatctctcaatgggcagcaacagcagggctatttcaagacctcactccattgtaaaggtgttatgtgtccacacagatctataaatcaccatgcaacatctttccagaagtatgtgctggtctgcagaattgctagatatgtccaggtgggctgggatcactggaaaggcctggtacatcttgcctgacagctaatttaaatggctcttttagggttacgtgtcataagaaagggggagataactttaaaagattataaatcacttttataaaaccacttaatgtaaatgactatatcttaatatcttaacaaatgttgctcccaattttttttatgttttaatgcaactgaaatctgaaagcattttcttattttccctttttttctttcaggcaatttgaggcacaaacaagtgtaaaaaccaaggaaaggtgcagctgctttgctattatatagcaacaaaagcgatctctttgtattttacaagaactttcctttctctgtagcattttgttttacaataaacaagtatttttgactttgagatgttcttacttcaaggaagacggctgtactttaatctgtgagaaacctaaaagatgagtgcctgaactagatatcatgattttaaaaatttagctgaaatcctcagcctattaaaggttgaatttgaatctccatagctggacagctgaaattctcctttttgcatatcaattagatttagtctctctaccttatggcattaccattcacagatggttactccagggatggatgcatttcagtaacagtttgaaatgcccctgggtaataacaagtgtaaatgattgcttgtgccgttgaaataatgcaataagactgtcagtggccgatggagtacagctgtggacgaagtctacacttgcttctagggccttatctacactgtggatttaaaaacttaaaatacatttattaactgcaaaaataataaatgtcattcaaataactggatttttttaaaaccacaacttactgaaaaaaaaagcagcacttcagagtaaaaaaagcaaaaaggttgacttcacagatgcttatttttctgtctaattgcagaaacaatgtggggtaaaatgtttgaatcagaggaaaaactgacgagggatcattttaattggatacaggataaagcaggaggtttatcgacaacccatcaataaagataccatttagtgtatgattaaggtgactttgagtaccaggctatgctagattttgtacaggataccaaagacattcctcctcctaagaaaatgaacatctactttgatagaaaagacttcatttatacaagacaatatatagtcaagtattgggttataagcagtagagataagagaacaggaatttggaaggaaagaacaccacgagctacattcattgggaatgcttggtggaaaaggtrgttctcaaggcaagttaaggaagaattttcagcaagacctgcaaagtcataaaaatgagtacgaatgtgacagataaggagacactggctgctcagaattcaggactcacaccaagtaatggtgagtgctacatgccagactaaggagcttgactgtcaagaggaggttgctgacaaaagtgggagttkaagtggtgtttaaagaactgatctaacagtggtgggtaagaggcactgggaagaaaaccagagcagtgattcttaaccaagagcacgtatcagaatcatccacgaacagctctccaatagacctcgccttttatttttcaagattttcttgtcactccagagagtctacggagcccagaacatatacataaagtaataaaaaaagggttagacccaaaatattgagaactggaaaaatcataatattaactttatcataatgaacttagagaagtccatcaaaaaaatcttagagttgggtgagtcttttgtctgttttttgcctgcacagcaataacttgttaggcaactgggtgacatgcttaattctctccaaagtgagagtccctttcccgtctgcaactttataaaagctcatccctgggactctcccaggagtatacgacaataaacaatgttcacatggctaccgcaagcattcagtgatggtgaccagaccagagttggttagccttgattccaacccctgatttcaagcattggagggctaataaacatcatatatacatgatgtttattacatatatattatatatattagrtatgtaatatatatgtattacatatatacacacacacacayayatatatatatatgtacacacacatatatatacaaagtctggctctatcacccaggctggagtgcagaggcacaatcttggctcactgcaacctctgcctcccagacccaagccagcctcccacctcagcctcctgagtagctgtgactacaggtgcacgccatcatgcctggctagttttgtattttttgtagagatgaactttcgccatgttgcccaagctggtcttgaattcgtgagctccagtgatccacccgccttggcctccatcttaactgatttaatgttcttgggtttcctcttctgccaggtgggccttgttgactcacttaacaagaatagtttcaggtatatatccgtaagaaaacaaaccactctattaataccaaaaagacaagggcactcacatgtttatcgcagcactattcacaatagcaaagacacagaatcaatttaggttcccatcaacagtggcttggataaagaaaatgtggtatataaacaccatggaattctatgcagccataaaaaatcaaaatcatgtcctttgcagcaacatagatgcagctggaggccattattctaagcaaagaaatgcaggaaaagaawracaaataccgtatgttctcacttacaaatgagagctacacatcaggtacttatggacataaagatggcaatactaggcactagggatgcctagaggtgagagggagagaggagagcaagggttgaaaaactactgtatactatgctcagtgtctgggtgatgggaccattcatacccaaaacctcagcatgacacgatatacctcagtaaaaaacctgcacatgtaccctctgaatataaagtaaaagttgggggaaaaaagagcagttttgctactgaagcttctggaatgtaactgaacaaccttttctcagatccagstattggataagaaatcaaatccagccatacgtggctgtgtacttctttgactatattattatcatattaagtagacttgatttcttaaaaagaaaataaaaggttatgacatatgcctatagaaataattccataaataaaagaatttattctaatgttgctcaaatctctatgttttgagggttgggcctcagcagccaagtttatatatataaatgtctccctggttatagaagaatggaccagaagcaaacacctggtccctggtgggccaatcaatttctctctccctgacagctagaattgaaatttgaaaataccagyctcagccaggtgcattggctcacgcctgtaatcccaacactttgggaagctgaggcaggaggatcacttgaggccaggagttcaagactrgcctcagcatcatggcaagaaaattagctgagcatggtggcatgcacctgtagccctaggtacttgggaggctaagacgggaggatcacttgagcccaggagttcaaggttaaagtgagctatgatcatgccatggcacaccagcctatgtgacagagcaagactgttaaaaaaaaaaaaaaagttaaaaaaaactagtctctgcctgtaatcccagcactttgggaggccaaggcaggtggatcacctgaggtcaggagttcaagaccagcctgggcaacatggcgaaaccccatctctactaaaaatacaaaaattggccaggcatggtagcgtgtgcctgtagtcccagctactcaggagtctgaggcaggagaatcacgtgaacccgggaggcagaggttgcagtgagctgagaacgcgccactacactccagcctgggagacacagcgagactctgtctcaaaaaacaaaaacaaaaaacamcaacaacaaaaaaacaagtctctgctgactgcttgaactgaagacatctagtctcaggaactgtgaagcctccatcttccactatggccacagggaaggagaaaaagggaaactgggggtagggaagaaagaagcagatgtgcaggcagaggtagggatgccctgcaaccacagattccactcaggtattgctcatatgcctcagtgtactctgactcagtggctttcagtccctgctcctcttccttctgctgtccctrttatcaccactggcatttctgttcctttccttctatgtctctccaactcccagagggaggatttgaccaactgtgtttggtcatcacccaatatcaaatcaacataatgtacacttataagctagggatgcctgagaacataaccttcgatgtatctatttagtgcttgcaataaacagtgtgccatttatygtacttgggttggcacgtgcatgtctccaaattaataagaatgaaaaatgtaagtgatttagccaaagctgtaccataatccartgatcatattgcatgcaagtaattaacaagttgcacctggtgagtaggaaggcaggcagccagaggctccagagccatcagaagggctgtcagggcacaagactgccaagaaagaaggaaagtgactgtctactggaagaatctgtgcaggctccatcacaggcagctgcagctctgtatgagggcctctgggggagctgggaacctgtgcttctatrtgggaacatgctccactgtttccagctttgtatagaaatttctaatcatataaatctcagtattcttggacatcaaggaagtcttayatttttaagcaacyctgtctgctaccatcttcccaacaaccccaccaccatstgttttgatgcctacacagaagatataagccagtggatcctacatttttttcaagtatttgctgaaatacaaagatttatcaaaattgctaagaagcagggtaccattgatgttaagattacaaggaagggctataatgaaaatgacaagaaaatgctcggacagaagagtcaatgaatttgccatgagtctcacgtgccttctttacctgtggaaggggttcttgtctctgcaatatctttgaacaagagcctacagattcttatgttatttttttttaagatatcagagtatcatacactcaccgacatggactgacccaaggcccctgtgtcaggttgtgcaggtctgcactgcataactttaagggtaccatttccatccctactccccaaacttgtgccacacarcagccctggaagttacccgtctatagcatggaaaagcragtacatgaattcatagatgttaacaagcagtgcatttgtaaagctaaaaagaaacattttacctggtgtcctttcagatcatcagtctytctgctcagtcaagcacaattcttttaatccctatyttcatccacttgtctctmtmaaattgattgggcttctcctaggatcttcatgtttgtacaaagaaagcccaagctaaattttcaaggtcaaggaaaaaacatacgcttttccctgcctagataaaaccttcagacagaccaraataatggactagcattgctactgtccagatgttcatgtccycccaaaatttgtatgttggaacctaaaatccaatgtgatagtattaagaggtatgatagttgatacagtttggctgtgtccccacccaaatctcatcttgaattgtagctcccataattcccatgtgttgtaggagggacccrgtgraaggtaattgaatcatggggacaggtctttcccatgccattctcatgatagtgagtaagtctcatgagatctgatggttttataaaggggagttctcctgcacacaccctcttgcctgctgccatgtaagaygtrcctttggtcttccttcaccttctgccatgactgtgaggcctccgcagccacctggaactgcaagtccattaaataaattacccagtcgtgggtatgtctttattagcagcatgagaacgaacgaatacgatagtattacaagtaggtgctctgccttcatgaatgggattagtgcccttacaaaaaaggcttgagggagsctgtttgttccctttcaccatgtgaggatgccataagaaggcaccatctgtgaagcagacagcaagctcccaccagacactgaatctgctgatgccttgatttggacttcccagtctccagaactgtcagttactctctcttcttaagatcacatgaccagaattctcctaagtcagatagggtcaatgttttgccttaattcctgacttgcatctttttaactctgacactaatttttctcttggttcacctaagacatctataatgtaactttattgtkctacatttcagatcattttctggcaatgcttctttgacawakcatacamattttgcaacatgaagcaatatacatttcttgacttcaaaaaaatatggtttccccataatgtrtatgaaaacatatcaaaggtgggttacattattaaattctgtaacttgtatattaataacttatgaagtctatgaattattatgtaccaatgatgcaagaacatacagcaaaattaatgctatcattcatagtggaccccctctatcatcacagagaaaatcattgatgaccagcactgactccaatattacccargatctatatttagtatgtctttakgagcatcatggttccttattcagaggatgagattgtatggaaatggcctatcccatgcagttcagcacaaggagayccagtgcagtacasgaacamtgtatgaaatgcttaaaaatgactattcattgcacattagagaatgcctatgtcacatttttacaattacagaactcttttttttttttttggagacagagcctcacttcgtcacccagggtggagtacagtgacgtgatctcggctcactgtaacctctacctcccgggttcaagtgattctcgtgccttatcctcctgaggagctgggaatacaggtgtgcaccaccatgtccagctaatttttgtatttttagtagagacagggtttcaccatgttgcctaggctggtctgaaactcctgacctcaagtgtttctcccacctcagcctcctaaactgctgggatwacaggcatgagccactgtscccggcaacattacagtctatcatttttataaaaatagcagcaacctgtaaaagytcccagtggaaagctgcatggtcatacagggagggttcaccaggaaagttcctacctgcctgtctgccaagtgaccttaaaagggagcataacttggtgaatttgacatgattcaggtcatgattcatgggctgggaaactgtattccattccaggctcattcaggctcgaggacgctcttgcatgtgaattaaacccacaggagactgatgcacaaaaccagaatagagctttattttacaataagaattgtataactgccgagaggtcagagaaggacagtgggaaaatcacattctctgctcaaaggcagactctccagaaagccagtttaccgggtgcctgttgcggggaacatggaatcagaatcagtatgagatttgcctaattcgaatgtaactgcatcagactctgaaaacctagtgtgtctgtctccacaacacaggcctgtcagaaatgaccactacagagccaggcagggtgcccacccctgcttagcacctcagtgaatatggccagtatctgcttctcagattcttttttttttttttttttttttttggagacggagtctcgctctgtcacccaggctagagtgtgatggtgtcatcacggctcactgtagcctcaacctcccagactcaagtgatcctcccacctcagcctcccaagcagctgggaccacaggtgtgcaccaccacatttgactaatttttcttattttttgtagagatggggggtctccctatattgctagggctggcctcaaacacctaggctcaagcagtcctcccacttcagcctcccaaagtgctacaattttaggcrtgtgccacagcacttggcctactgcagtagagatatagatacgaatacttttcttaagggtactgtacagttagsctgccctggaaccattmtgtctctttgagtttccttctctactctgaactttaagtgtctattttcttattttctagttcatagaagacatttcactatcacaactgtgtatttactgcccacattaactaaattattgtgtacttattcatgtttctagaaaacttgaaaaagattttttaaaattatcaacataaaaactctgaaggagccttgaagatgtttttaaaaaattaagtgagcagttgaggtaaataatgaatgattttacaatcacagatcatttaactttaaaatagcataaaaattcttcttagtaaatcgtaactaacaagaagaaggaaatataatggtcgataattaatcaaatatccaaaatgacrgctaagggaaaaaaatccaccaccgccacctgaacgacctttcagtgaaatgagcgttgtggattttagaattcagaattctctgttcttgttcctgtgagtctctcaatctagctgctttccagtcctaatattacttggcctgtctggcaacattggtctctcttgttcttgaaagcttcccacagccgggcacagtggctcatatatgtaatcccagcactttgggaagctgaggcaggaggatcacttgagttcaagattagcctgggcaacatagggaggtcccatgtctacaaaaattaaaacattagctgggcatggtggctcacacctatggtcttagctcctcgggaggctaaggtgagaggatcacctaagcctggggaggtcgaggctrcagtgagctatgatcataccactacattccagcctgggtgacagagcaagactgtctcaaaaaagaaaaaggaagaagaaggaggaggaaggaggaagaaggaagaagaagagaaagaagaagaagaggaggaggaggaagaagaagaggaaggagaaggaggaggagaaggaaggaaggaagggagggagggagggagggagggaggaaaggaggaagggagaaagagaagcagaaggagaagaagaaataagaaagcttccacgctggtttccatgagccactckgtaatcctcctcatcactgctctctggccacacttcgtgggctctgtcactgcgtgcccttcctctgtctgctctgaggcctggcactccctaggtctccatctgtacctcttttccttcttcctctacttaatctcattcactcctgtgactttaagaactacttaaatacaatgatttgaaaccagacaaaatgcataagcacagcataacacacattaatagtcccttgttgttcattttcttgcttttcattagtcatcctgagattcagaagtatatttccacctgcctaccagcacctccacttgaccatagttccctttaactctttaacttcatctgctcaaaacacttttttaaaacatctcaaatctcttctcccatgatctctatctgagctcatgatatcrccatccacctgcttccccaagcccaagctttggaagccacagtgaatgtgaggcactattggctaacatgtaacagtgaccatgygacagtaattgttaacagtgtgcaagagaaaactgtaaggctggctgctaaatatgcctgataaataactgtcaacttaacgctggtagtatgattaggaagaagagtgaaagggaagaataattgggttctgagagagcctttgttcatatgtatatgtcatttctaattataaatatggaaatttgattaattctgtttttcccactcaactctaagttctataagagctggacccatccctgttttgctcatcactgcatgcccagcacctaatatagtgcctcacatatagtagatgctcagtaaacacttggttccaattccctatgaccaaagctgacaattcagactgataaagacaaacattatatgaattatttatgtacaagaattagtgtatctataaatgtattgtcatgatgtacaaatatacagaaaatagaaatctgctgtcttctggcattttgtccttttccttaaaatcctgcatttacaaaaataatattcactccagccttaaaataaactgaaagacttcctctccctaacccctcatctgatcatcaaattctatcaacttggtcctctaaaattcagctcaaaaactgctatctctgtgtaaagttattggctatgttccaaatgcattctgcatattgtcatgtataatagtaacatattgtaattattttagtgtctcctccttccttccctcttccaagtccaggagctacttaaagattttcaggatctcttgtgcaataactgggctgaacatagtacctgataactaattgacagtcaatacatcacaagtcaaaagaaaaaagaaataggatttgggaacacaaacataggattttgacagccacaatgaattctttcattcttcctactctgcacctgtctgtggccttttcctctaccatgttctgtcacatccacatmattatctygtgtcacagagccttccctgtgacttctgtgatgtatggctatgggcatggaatggatgtacttaacattatggcttttttattctttcttcctatttattctgtcccttatcagaagcaaagaccacaacatgtagaagtctaatacaaagtgctgaaatatgcaaagataatatatgcacaggggtgctgattaaaacattgacaaaaatgaaagaatgttgctttcaagacactcaggtctctttctatacctaagtatattattcaaccatcagaaaagaaccaactccttcctagataagagacaacagcacttgcccctacccatactaatgccacggctatttgtccatcaaagkaaatgaatggctttgtatttgaatagaaaagaggggcactctgagctctgaggtgacagataatgcactgatcagtcactctccagtgggggtatcagaaaagtgaggaagagaaagtgattctgagtagtttggattaatatttgaatctcaatctttatgaaagaaataggagcttaacttgctatataaaaggtttcagtagataatagattttttgacattgttatgcaagtagatagaatattaacctgcctggattaatgaaagcaattactaagtgctgttactataagtggaatagtttcactgtatcacaygtcctggtgattcttcatttagcccagatgatgccaggggctatttgacaaaatgtttcgtatatctaagaagacatattttgctggtttaaaccataatctttgacatttgtacccactgtggatttatgcctcttgtacactcattacaatttaagcagaaacatttttcatgagcagaaaaggaaaaatcttagatttcattagcgaaaaagccactgtccctactgtcctattgtgatatgctaatattcaccctggaaagaataatttaagaactcaagcctctatatatgcaattcaactactgtagattcaaagatggtcacaataatttatatactcaaagttatgaagggttaaagaactaattatgaaagacaatttttgtccttcttccctacatagggaaaaatttcttaaagacacaaaaatacataacaaagagaaaaattaataaattcaattacattcaccaaattgagaattttatcaaaggacaccacaaaaagagtaaactgcagagatgaagatatttgcaacacatacaaagaataaaggactaggggccagaatatatattatacaaagaactcctatagatcattttgaaaagacaggtaacatttgaaatggctgaagacttaaacaggcatttcataaattaggaaatcgaaataaaaatatgaaaaattgctcaagcttattagtaactagggataatgcaaattataagtaccataggataccattatacacccatcagttgagccaaatgttaaaatctgacaatatccaatgatggtgagaatasagaattctcatamactgctggaaggtaaataaattggtatgatcgctttggaaaatacaggcaggttgaagattggcaattctacaccacygtgatcacgctcatagaaattcgcaaacatgttcaccaggctatatgtacaacaggtrcagagcagcactattcataatagcccaaacaatgaaagcaagtcaaaacccatcaactaaaaaatggataaactgtggtacaatcatacaatgggatactataccataacaaaatgaaataactagcactgtgtacaacaacctggagaatctcacacacacacamamaaaaatgttaaatgaaagaaaaagcattaaataatatatgcaatattattccattcatgtaaagttcaaaaagcagacaaaaactaaattatgtgtgataaaactataaaagaaaattaagtaaattattacaacaagttgtggacaatggttgtctgggacagagaaagctacgatggagaagggcacaaatggagattstgcggtgcttatgatattctatttccttcatctgggtggtggctacatgaatarcaggtttatattatttgttaaactgtatattcatgtttgtgcactttttctgtatatatggtatatttcccacaggatgtttttcagaaaggttatatagacatatragactagatggtctggtaaaagaatgacaggtgatagacaaaaggcaaacaaaaaatataatcagraggtaataagtgctatgaagaaaagaaaagcaggataggggaataggttgrgaagagagaactatttaacggcttgtagcaccaggatctccatagttaagcctcatggagtgccactgtgaacacagcaaaggcaatgcaaattgaatgcacaatgaagtttcaaattgtgctgcatgcaagrtttcataaagtccacaagagatggctccaacaacatcaaaagtccctgacarataaagatctggcagcattagactgtcaacaattgaagaaaagaaaataagaaaagctgtctatattttgggtgcttcatgagagaataatcttaatgatgaaatwtttttaaggcttagaaaactaatgaagccctcaaatatggtgtgagatctctttataagaatgctgcaagagtcakatgtgaagcgaaggctgttgtaatatgccttttttatagaaaaacaatcatgctataaataacaataaagcatttttaatttgaaaaattagttgactgctatttttatctagatagatagaccaatagatagatagatagatagatagatagatagataggatagataggatagataggggtggttttgttktttttttttttttttttttttttttagacagagtctcactcttttgcccaggctggaagtgtggtgacacgatctcagctcactgcaacctctgcctcccaggttcaagcgattctcctgtctcagcctccccagtagctcagagtacaggcgcctgccaccacaccyggctaatttttgtatttttaatagagacggggtttcaccatgttggccaggctggtctcgaactcctgacctctagtgacccgcccaccttggcctcctaaagtgctgggattacaggcctgagccatcacgccaggctgtcaataaacttttatgttgacatacttcaatagagtttcagwcaatccctcttttccctccctaatttttcctatttgaaaagaatccgctctctcctgttttgttcagcaaaatgtaaaacattgataagatttatacctttttgaaaaaaatagactatggttgagcccatacattcgatgaacatttgttcgtcacctactatgtgctaggctctggggagaaacaaaaacaaatgaaacaagaatcaccaagactcaagaagcttacaacgaacggcgaataaaaaggctagaaaaccactggcttcgggaatctgtggtaagtgctattcaaaatgggtgtccaggccaggcgcggtggctcacgcctgtaatcccagcactttgggaggctgaggcggatggatcatttraggttaggggtttgagaccagcctggccaacatggtgaaaccccacctctactaaaaatagaaaaattagctgggcgtagtggcgggcgcctgtactccgagctactcgggaggctgaggcaggagaatcgcttgaacccaggaggtggagggtgcagtgagccgagattgcaccactgcactccagcctgggcgacagagcaagactccgctcaaaaacaaaacaaaacaaaaagtgtgtccaaaggaagggcctctaaatcagatttctcatggggcattagaaatatagaattttgtttttgccatatttttcatacaatcttagcttaataacaaaaacacaaattagtcacaggcagtcatcaggacaaaaaaaaatcagaaatataaattctgaataagctataaactagataacaaggccttgaataattccattttcttaactttaagttgatatctaataagacaggagtgcaacatcgaaacgctgtcttgtttgaattataaatcttcactttaaagcggcagatggagcgccttatgttcacagaaagcaagccaagggctcagaaaaggtaaccactccgccaaagggaaagacacaaaacagaaaacatggctctgaacttatatgccctcgaagggttaacagatgcctgaatttgtgagaattttacagaattagaatggaactagtacaaagtcctccaatgtgttttcctttctgggtcatgcaaacacgtacgttctacggaagatttcaagtacaacaaaaaaatccgggtttcccatcacagaacctaagtcgccgcatttcctctggtgtataacatgttgttgatgcagttattgtcctttgttttttttttagctctgtttccttaaatgccaaaactacacacacgaagtatgtaatacgaacactgtgacaatgaggagatgcaagtaacattttattcacctgaagaaactaaamcccaacattttgctttttgtctacagacacagttcctgtaaacacagaatcaaatacggtgcgcgtagaaaataaaaagatcctcccacactatggcacttccttcaatggaggctactcgggaggctgaggcagcgaattgcttgaacccgggaggcggggttgcattgagctgagattgcgccactgcactccagcctgggcgacagagcgagactccgtatcaaaaaacaaacaaaacaacaacaacaacaacaaacaagatgttgtattcttgacatttaggcawtttctaaaatattacattttttataaaatttctctgccatggaaaaaaaatccacctttgccagagcaaaggaagccagtgaaagaagtaattcattgggagtataattataagcatttagcattgttttgaacatgasaaaaaggcaagctttcatctaacagattttcataatctcaagaaataattcatctgccatttattttcagggaaatgtggtgcttcttggaagaagcccagaggatcctgctgttaaaccaagacccatgcaggaaaaaaaaattatccactccacaataacatggcaggtaacacaaaggcagtggtacttctccagccgggagaggccccctcaaaacaggaactcctgccggctgacttaattacagcacagcaagggaatccactacaaaggcaggagccactgaacagagagctgytgagatccgtcctcggtacacggacagatggttctgctgcttctcggctggtataagaccttatagaagactctgaaaactgaaacacgccaacaagttttctgttaccagtattttttttttaactctgtgcccaggccaggmgcggtggctcacgcckgtaatctcakcgctttgggaggccgaggcgggcggatcgcgaggtcaggggtttgagcatcctggccaacatggtgaaaccccgtytttactaaaaatacaaaaatcagctgggcgtggtggcgcttgtctgtagtcccagctacttgggaggctaaggcacgaggaatcgctcgaacccaggaagaggaggttgcagtgagccgagattgcaccactgcgctccagcctggcracagagcgagactccgtctcaaacamacaaataaacaaaaaaaccctttgtgcccaccgtatgctakcgtaaaagtaatctgaatttgaaagtcaatcagcaagtatttactgagcgacgtgtaagggataaggaaaaggtctaaagcagcttatctagtttagggacatggattaaactctgatttaattttagggcttttgactttttcatcatcacacacagacacacacaaacacacacacacaaaattagaggagaggccatgaaagcactgccttgaaaattctcagacaaatttacagaaacagagtgagtccatgtaagaaacctgaccttatacacagggacgatgcactgaaacctgtttcacagcaaagggaactgaaagtttytaaagcagtcaccacagcagccacgtggcttagaacacaaaacagacagccccctaaattatgaagtcatacacacagctgctaaataacagcactgagtaaactctatcttgtaaaaaatgtttaaacaaaatgaaaatttaactacaaacattatttatggaattaatatacatgcaaattttctgcatgcaaactctaccttcctggtcactttgaaggatataaattaatcaaaatcacaaaattcttcaatcttatrtaagaatgtacaataatgccactgaagcaatttagaacttacaatgcccatagcatagaatctattatatatagatatctaattatatctatctaaacacayacatatacagatgctcctcaactgatgatgagattatgtcctagtaaacccatcatagtttgaaaaatatcataagtcaaaaatacatttaatacgcctaacctatcaaatacagcttacttagcctcacctaccttaaacatgctcaaaacacttacattagcctatatttgggcaaaaatcacctaacacaaagcctatttaaagtaaagtgttgaatagctcatgtaatttgttgactggtgtactgaaagtgaaaaacagaatagacgtgtgggcacccaaaatatggtttatataaagtcaaaaaattataaagtcaaaaaataattataaagtcaaaaaatcattaagatgaaccatcgttaagtcagggaccatctgcatacatatataaatacatacacatacatattcctatttaatactgatatcaactctataaactaaaaatgcacagcttggtgagtctgaatgagttaatatatttaaagcacttggagaacttctatcaatacaagctttgaagtcacactgcctgactgagattttggttccatcgctagacaaattaatttatctgtgctgcaattttctcatctatgtaagtggaaataataataaaagcctctacttcataggctaatgaggcatatgctatctggcatattaaatatctagcacaatacccagtatgtggtaggcaatgaacacaagcgagctatttttaaactttatatatttggccaggcacggtggctcacgcctgtaatctcagcactttgggaggccaaggcaggcggattgcctaagctcaggagtccgagaccagcttggccaacatagcaaaaccctgtccctactaaaaacaccaaaaattaaccaggcatggtgatgcgtgcctgtaatcccagctacttgggagactgaggcaggagaatcgcttgaacctgggaggcggaggttgcagtgaactgagatcgcgccactgcactccagcctaggagacagaaggagactctgtctcaaaaaaaaaaaagtttttatatttggcctccagtaatggaggcctttttacaaagggaatccgaattaaaacttgggtctcctgataaatttgagaatactttctacagccatgctgctgggaaccatacaaaggaggcatttaatcaaactgatacgactaagtattattatgatacagtagcaaaaagtaacaatggttgcacatgatgacactaaatgccaaaatctttacatgatgtcagaagataaggtcaagtgctccttcagaacatatgccctacaacacgttaccttgttcttttctgctatgattctctttgtaaaaagttatatatctgagtaataaattgctacactaagtatctgagagtactgctttgggtcacaaaagcaaaataatttgcttataaaaacaattaaccttaggccaggtgcggtggctcatgcctgtaatcccagcactttgaaaggccgaggcaggctgatcacttgaggccaggagttcaagaccagcctggcaaacacggcaaaaccctgtctctactaaaaatacaaaaatcaaccaggtgtggtggcgcatgcctgtaatcccagctactcaggtggctggggcacaagaatttcttgaacccaggcagtgtaggctgcagtgagccgaaatcacaccactgcaatccagtctgggcaacagagcgagacactgtctcaaacaaaacaaaaacaaaaacaacaacaacaaaaaaacytaacttaaaaatactaaatattcagtgaaaactagagtcatgctaaaccaaaacagtgttttagctccaggtattaatggccacttctggagccataagcaaagctgataatatagctcctaaataaagaactggaatatggytggcaaagaatcaccttcttaatttcttaagaatgttcaactctggcacaaagtggacaaggtgagtatgggtgaatatccttctagagagatragactagaagactgaggatctacagaaggggatgcccagttattctctctccccctactctcgaaactcactcattaattcatgtatttatcaaaatggcatgtcaataccctgagcagccactcaggacaggactcctgcattgctacaataccgatcccccagcctctcctctgcccctcaacctgccttagctgctgtcattttatctacactggacaggacctgtccatttcctgtcttccttccaattatgtttgtccatgtctggacctggctggttgttccctgcagccccttgctggttaccttactctgacagtgatgcagccagaggcactaaagggttagcccaagggccccagccctgcatttggcccatgaaggggcttacgatcctcnttttctgggtttgggtgatgttagaggaaagtgccccagcccagcaccattcctttttgcttctggtttggagctctagaccasagccttagttctggtcagttgttaagtaattatttaacagtgtgacgttcagacctgcatgacatctatacagtgtccagtaaagaaagagaaagccatggtccctaccttcaaaaaagaaaaaatgccacgtaggtgcttggtgatacaaagttgagtaagacacacataatctggtggaggaaacagacctgaaaatcaataatcacagaacagtggaacattatagttgcctcagtctttacaggggaacacagaggagcaccagctaaagaatgtgtactttggacaaagttatatgccaggtactcctatatatatgatctaatacaaaaataaacatcagtcctatactgttagatgaagaaataggttccaagatttaagaggcagaactgagaatgcaagtcctgcrctatcatcctccacacgcctctcctttgtccctctccaccttccttccccctttattttcctttcctagaagggaaggagggtgtcagcatctcaatcaaragtcaaaactcacatgtcaacaggtaagtgacagatgatgtaaatgagggaagmacagagatagtgagataactcagatgagatggaatggtggggactctggtgaattagagattcacgctctttctaaaagaaaggtgaaggttcatgcctgtaattccagcmctttgggatgtaaaggcagaagatcgcttgaggcaaggaatttgagaccasgccagccaatatagtgaagtgttgtctctacaataaatttaaaaattagccaggtgtggtgatgcmcacctgtagtcccaggtactcasgaggctgagatgtaaggatcmcttaaacccascaggtctaggctgcagtgagctgtgttygtctcactgcactccagcctaggtgacagcgcaagagaccctgtctcaaaaaaaaaaaaaaaaaaaaaaaaaaaaaagccacgcatggtggctcatgcctgtaatcccggcactttgggaggccgaggcaggcggatcacctgaggtcacaagttcaagaccagcctggccaacatggtgaaagcccatctctactaaaaatataaaattagccaggcatggtggcatgcacctgtaatcccagctactcaggaggctgaggcaggagaatggcttraacctgggagatggaggttgcaatgaactgagaccacaccactgcactccagcctgggtgacacagtgagactccgtctcataaaaaaaaaaaataaaggaggggagmggggaaggggaggggaggggaatggaggggaggagggggagaggagaggagaggaggactcattcacctctagccctctgatgccacacagaaatgtggrcccaaggctctgtgaaatcttccagttttttgagactggcctgaaatcctgtttatgtgattctgtttcttgaaaaaagcagctccctaaatcaaaatgtttatcaatcaccaagcctgactgtggccacgggataycagcttgcaatatctgctgtagaccaaaggtggccaggcttgtcggcattgctcccgacactatggtgtttcacttagaaagtttaacaaccacacagtcatcgcaaaacaaaccacaggactggtgccactactgttatcaagactttattctaattctgaggtattaaggagagaggcacacaatgacagagtcgcggtgctgaaaacacctgactcacttccttgacatccctaccaagtagctttttggctctgcttaagcatcatgatgagccaacagggaagtctctctctcctcagatggcctgctcactttcactctgctcttagacattagagaaggtctttttttatattaagttgacctctgtatccctgtatctgccacccattggtctctggaccactttacctagaacacaatatcccaggagcaagaaaccaacgttatcatcacattacaaacagtgtttctgttcatacaaagatcatatcagctttttacttggactarcacacttgcctccctggccctcggggaccatagcatgatctagcagtgccagtgagttaacaaaggcttaccaagttccatggtagggcacagggagagctgttatttccatcagtcacatgttttactttaattctagctcaagaatatatttatgccccagtctccatgttcctaatctacagtgcacaactgcttcctataaataattattttaactttggtttaaaaagtactggcatccagccaggcacagtggctcaggcctgtaatcccagcactttgggaggccgaggtgggtggatcaccaggtcaggagatcaagaccatcctggccaacacagtgaaaccccgtctctactaaaaatacaaaaaattagccaggcgtggtggcaggcgcctgtagtcccagctactcaagaggctgaggcagaagaatggcgtgaacccgggaggcggaggttgcagtgatcagagatcgtaccactgcactccagcctgggggacagagcaagactccatctcaaaaaaaaaaaaaaagaactggcatccatttcagaaactggataaagttggtttcacagaatgttaaaaagtatccatggctagtttgtttgactttataggaataaaaatgacttaacagtttagctttataacagaaactaagaaatatggctccacacttaatatgcatcatgaaaggtagccaacttaggtccagtaaattacatcatagagcattataactatagaatgctgcttgtttttctggcaaagtcatgaatcccttccaaatgagaaacattttggcagactcatcttttttttttttcccagatggagtcttgttctgtcgcccaggctggcttgcagtggcacgatcttggctcactgcaacctctacctcccaggttcaagtgattcttgtgcctcaacctcccgagtagctaggattacaggtgtgcaccaccatacccgkctaatttttgcatttttagtagagatggggtttcaccatgttggtcaggctggtctcaaactcctgacctcaggtgatccacctgactcagcctcccaaagtgctgggattacaggcatgagccaccccgcctggccaggagactcatcttaaaattatttttcagacaaagtatcaatattggtatccacaagaattttcaaattcaaataagcaaatatttcgtctcctaaatttaagtgtgaaatattattttattcctttttatatctccttatcatatgatttctttacattcttcctagctccttataagaaacctaggagccatcctgatttctccaccttcttttgcctcccatatttaattaattagcaaatctttcaacatataccctgaatcagatcacttcttaccctcaagtagattctctctcagtctaagccaccatcatctcttacctgaactactgcaatagcctcctaacttggctcactcttycactgtstgcaaggartaaccasagtgatcttttaaaaacatgtrtgaaatcacatcactcaggcggcttaaaataaaatccagacttctcaccagggctcagagaacctgcttgctgactccctctccactgcccctctcacattccccctccccaacaactgccacactggagtcttttggggtcctggttgaaggcagtactgcccccttggcgttggggcgggcagtgggtgtctagaatgtgtgactgtttttgtaatgacagtgactagggatgctaaccgtcccgcattgagccacacagtcccacagtgcacagcacagttccgagccgcaaaggcttgcagtacccaaaatgccatttgccattttcacaaaaacccagttcattctcatytcaagatctttttttttttttttttgagacagagtctcgctctgtcgcctaggctgcagtgcagtggcacratctcggttcactgcaacctccgcctcccgggttcaagcaattctcctgcctcagcctcctgagtagctgggattacaagcgcctgccaccacacccagctaatttttgtatttttagtagagacaggttttcaccatattggtcaagctggtctcgaactcctgacctcatgatctgcccaccttggcctcccaaacagctgggattacaggtgtgagccacagtgcccagcccccatctcaagatctttacacttactgttacttttgacccaggaactgaaatattttcccatcttgctcaaatattttcccaccttgctccttctgaccacttgggattcagctccaacatcatctcctctgaaaggccatgcctggccctcatttctcaaatagccaccccagccagcacccccgccagtcttgttattcctccaccttgctttatttastttttagcacatatcaccctgtaaaattatgcatttacttgcttaagcttttgttgcctttctcccccacaagtgtgtcaacccgctgagggcaggaactttgtaccctggcacctaacaatggctggggtataccaagcgtttagtcatcagatatgcagtggataaatgtctccataatttttcttatttacgatcaggaatttttttaaatcttcaatttgggagtgcagtgtctcgtagttatcatttctagttattttttcctacaccaagttcccctttttgtgcaacagagttgttttacattccacaatttttatttttgcagaggacagagaggtgatggtaaacttaaaatatcccaaatcaccatgcaactgtttcacaaaatgtgaaggagggctttttatgaacacagtatttttgtaagcctcagagtaaatgtgtaaattctggctaactgaccagtaaagctatggtaggaccacttctgggggcaataatcatccgatgagagagcagctccctttactggagccaccgaaatagaaaatgagcaccaccttttgtcaaaaaggctcacaaatcttttcaagaccgagaagagctgaaatatacggcaacagaaaaataatttttttaaaaaaatcacactttgaaagcactaaatccaaagttcaaaccaggtctagaagtgaattagagataagtgataagggggatgtataggcttacaactggactttaaaatatgattttatttaaatgtcacggagcagcctggcgtggtgactcacacctgtaatcccagcactttgggaggcygaggcgggcagatcacctgaggtcaggagttcgagaccagcctggccaacatgacgaaaccccgtctctactaaaaatacaaaaattagccgggaatggtggtgcatgcctatagtcccagcttgagaggctaaggcaggagaattgcttgaacccgaaaggcagaggttgcagtgagctgagatcacaccactgaactccaacctgggcgacagaaatagactccatctaaataaataaatacataaatgtcaaggagcattatttatttaactatatagaagcctggaaagatatgttaaaaaaagaatgagcatacttcgattacttttatgttccacacacatatgatctatgctcaaacagggtctaaatgagatactagatgttaaacagtgcttctctctaacgagtggtatttgggaactgacatacaatcacctatggcttctgtgagactgctgggcccaagcactgtatgcattttagatcttaatacagactgccaatccacgttctcaaagttcacagcaattcacacttctacctctacacactttccgacactgtatattatcattatttaaaaattttggggccgggcgtggtggctcacgcctgtaatcccagcactttgggaggctgaggcaggcagatcacgaggtcaggagatcgagaccacggtgaaaccccgtctctactaaaaacacaaaaagttagccgagcgcggtggcaggcgcctgtagtcccagctacttgggaggctgaggcaggagaagggcatgaacccgagaggcggagcttgcagtgagccgagattgcccagtgcactccagcctgggcgacagagcgagactccatctcaaaaaaaaaaaaaaattttgtcactgtatattatcatatttaaaatttttgtaaattaatgggaaaaaaagtaaacttccttaatttacattcactgactactcagattgaacatctcttcccatttactgatttacttgcaaatcctctctgactagttgstctttgtccttttttcctattgcattatgttgttttcaataaactcatygtacctatattttaggaataataattgtttgtaagtcatccacatcgcactatttcttccaaactgttctttttcatttctaaaaccaaataagtcagtcctcccttttgattctaagttttgtatcttgcttagggaaatttcctcccagtgacatttaataaatattctcaggaattttctactgagtagaattcatttttttaacaaaccattaagtccttggtattgcaatgtaaagttaatgaagggaggggataaaagaagatgagaaagaaaagggtacagggttaagaaagagactggaaaagtcttatttcttaatgttgaagaaagagttttaggccaggtgcggtggctcatgtctataatcccaggactgtgggaggctgaggtgggaagatcggttgagcccagagtttgagaccagcctgggaaacatagtgacaccttgtgtttacagaatttttttttttttttttttttttgagatggartctcgctctgtcgcccaggctggagtatagttgcgccatctcagctcactgcaacctccacctcctgggttcaagcaattgtcctgccacagcctccacaagtagctgggactataggcatgtgccaccatacctggctaattttttttatttttagtagagacaggatttcactatgttggccaggctggtctccaactcctgacctcaggtgatccgtctgcctggactccacaaagtgctgggattacaggcataagccaccatgcccggcctacaaaaaatttttaaaaaattagttggcctctaacccccagcactttggggagctgagtgatgactactcgannnnnnnnnnnnnnnnnnnnttcaagaccgagaagagctgaaatatacggcaacagaaaaataatttttttaaaaaaatcacactttgaaagcactaaatccaaagttcaaaccaggtctagaagtgaattagagataagtgataagggggatgtataggcttacaactggactttaaaatatgattttatttaaatgtcacggagcagcctggcgtggtgactcacacctgtaatcccagcactttgggaggccgaggcgggcagatcacctgaggtcaggagttcgagaccagcctggacaacatggtgaaaccccatctctataaaaatacaaaaattagccaggcacaatggtgcataatcccagctactcgggaggctgaggcaggagaatctcttgaatctgggaggcagaggttgcagtgagccaagatcgtgccactgcactccagcctgggcaacagagcgagattctgtctcaaaaaaaaagaaaaaaaaaattagttggacatggtggtgcatgcctgtagtcccggctacttgtatggctgatgtgggagggttgcttgaacctgggaggctgaggctacagtaagccaagatcgtgcccttgcattctagcctgcgcaacaaaacaataccctatcttaaaaaacaaaaaaaggaataaaaagaagttttaaaagattctaaagtaacaatacatttctcatattgatatattatgacaggaaaaaaactcaagtattttggcttgaaaatataaactataaacatataggaaaaattttggtttaaaactaagcacaaattacrctggttttttttaagaaaaggaacaattatatttttcataatactaaaaatgaaataatgtaaagtgataaaaagcaattaattcctacttaggtaatatttcatctcagccttttccattaaaactttaacttttatgtgattatgaggttatttatacctaaagagaccatttatgtatatagagaattagtacaggcatttattyytccagggactgagataagaggaaaataaccaagggaagaatttgttcagcactakaggcaatatttcagatgcttaagtggaaatacgcatatgcttcctcaaaaatcacaaatagaactgttagattagaacttgtacctttytgaatactttatgaaaagcccttaaataatatttttttccaaagtgacttcttaagaattagctcaggccgggtgcggtggctcacgcctgtgatcccaacactttgggaggcggaggcgggcagatcacctgaggtcaggagtttgagaccagcctggccaacacggtgaaacccygtctctactaaaaatacaaaaattagccgggtgtggtggcatgcacctgtaatccccgctacctaggaggctgaggcaggagaatcactggagcctcggaggcaraggctgcagtgaactgagatcgcgccactgcactgcagcctggatgacasagcaagagtctgtctcaaaaaaaaaaaaaagaattagatcacagccccaataagatttctrgtaacatctaattagacaattgagttcccttgctggagcttgtctgctttgcttataaaaacatgtgcaaagtctaagacaaccacaactagaccctcaatatcctcctccttaatgcttattggggaaacggaaataaacagtgtgatctgccttcgttcacacttgtcacttccttgtaaatgttgagagctttccaaagcaaagagcctatgacagcaaggaaggtgtccaaagccagtgactcctggggaagaacaaaataagaagaattattccatcagctaccaagaacttatattaaaatggtaagagtaagacagtgtggcatttgcacaagaatagaccaacaaaccaatgtaacagaatagtccaaaaatagacccatgcatatataaaaacttgatttatcacaaaacasacattggaaattagtgcaggaaagatcaactgttcagtaacctgtggtaytgagatcactggctaattttattggggggtggggtggaatcatgggaaaaaatttaaattagatttctacctcacaccaaacacaaaamtcaattccagggagaattaaagatttaaatataaaagtcaaaccakaagatattcagaagacaatataggtgcatgtttttatgacttcatggaaaggatttcttaagaatagaaaaatacaacctagaaacacaaaasagtgataaatcaactaaattaaaattataaacttctcttcttcaaaggataccacagaaagagtaaaaagacaacccatggactaggaaaagatatttccaacatatctaaataactaaaaaggcttagtatacagaatatgagtataggtgtatactcttacaaatcaggaagaaaaatgtaaacaatccaatggtaaatgagcaaagacatgaaatgcatttcagtgcaggatagtcataaatgcctgtaaatactgaagaggcacgacctcataagcagccacaaaaatgcaaactagagccacaaggtatgaagtgatgacraggatgtggagccaaaggtgcctggtgcctgttccttgtatatttatatttttacaattttaatttctgcagggtctttttctttttttttaaacagagtctcactctgtcgcccaggctrgagtgcagtggcgtgatctgatctcggctcactgcaaccttcacctcccgggttcaagcaattctcctgcctcagcctcccaagtagctgggattacaggcttgcatcaccatgccaaactaatttttgtatttttagtagaaacaaggtttcactatgttggccaggctgatctcgaactcctggtatcaagtgatccacccrcctcggcctcccaaaatgctaagattacaggtgtgagccaccatacccggccagcaacttttttttttttaagaatactatctatggtgactatttctagcccrccatgatagcgagtgtcttcaaagagagctgcaggcatgaccaacctgcgttcactctcattctaatcttaagatttcatcctttctacacamactcggtgtgaacagtctgcaaaccgtggtgasagcccattggtggggtatgaagtctgagaagaggtatacaatttttcccaccacatccagttccccccacaatagttgtagggtcctctggagcccaaatctggggagattctaggctttatctcctatttcctctactctaagtggccggaaaactaatgctcagtattgaaccaatactgattcagcaaatgcattcaaggcaaaagtcagatttgatgcactgcttattttttttttttttttttgagatggagtcttgctctgttgcccaggctggagtgcagtgacacaatctcagctaactgcaaactccacctcctgggctcaagcgattctcccacctcaggctcccgagcagctgggactacaagtgtgtgccaccatgtctgcctaattttggcattttttttttttttagagacggggtcttgccatgttgccccggcaggtctcaaactcctgagctcaagtgatccacctgccttggcttcccaaagtgttgggattacaggctgagccactgcgcctagccaacacactgcttacttytaagagttcctgctttgattcagttttagcctctgagcatccttaccaagtagtcractcattcattccatttaagggctagttttttattgcactcagcatttttaattgttgctakcaggaaggttagtcagatgtcttagaccacaggaccactgtattgccagaatctaaagtcaaaaakccgctttaaaacataaagctaattatgtcactctcctgctttgaaactttcaatgcttttctcatgatatacagtgtaaatctgagctcctaagtgctcttgaccctgttcaagaggcataagggaaacttcccagaggagaaagaaaatggaggttaaacttgaaccagcaggaacagagagaaaagaggagagcasagaaacagccaatgaatcctaattaacaaatcaaatgggcaggagaatattcaagtctagtatggaaagagctcaacattcaagggtctgatcaaccattagaagctcagtcaagactgcagggcatcaggggctctcaaagccaagagtgaagaatcagaggggtctgtaagagatcagggacattgggagcagcatctatccaaccacgcagaaggacagtgggtgcccaaaccaaagggccaattaggcaacctggtcacartaggagttagactgaggagctgccwctccctaattcacaggagcccagaaggctcaaacagatttaaaayayacaaaggagggcatgggagcagcagatcctcccagaccccttgttagtcacaggtactcctggtctggctctcaaaagcaaggccttcccaactttgttacagtcagctatgctgaagccttggctggcagaaactgacaagccccrtaacacagctttccccatctggccccaaaccatctctccaggctcacctcccctctcaccccattccatctacctccctactgcaacaacacagacactgacaagcagcactctctccagccttccctcytctacaggctgtttcatcytcctgaatgactttgcccctcttctctccccggaaaatccctacttattcttcaaagccccctcaaatgttgcctgatcaggagattactctgattcaagctgagtttgctaccctccactcctatcgagcacagccaacacattattattttattattattactattattgtcaccatcacatccatcatttatcaagtgcttgtcatgtgtcaggtactgtattaaatccttcacatgcatttttccttaccacttatagttattatcattctccattttactgaggaggaaaccaacgttcacatcatttcaaatattggcctaaggtcacatagctgctaaagggatttcaaacacagtctgttcttaactcaaaaactcatattgtttccagtaaaatatcacaattcatttatctctgttgcctccaacaacaaataagtaacttaaaaataaagatcacgtcttcctaatttttgtatagcctgcataatacctggcatatagatgatgctctctaaagatttaataaataaatgaataacagacattcattccattttctcaggaacttgaatgacaactgtagcacagaaccagtaatacaatgttgagactgtctttatgtcccctttggctagggtctactggatagctcgcattatggagaataaaggacagagagcacaagacacttaggtaaagattcaggtacaaggaaccaggcaagtcagcgcagtgtcttttgagtaaatgggtttaacctaggcaaacaagtggttatttttaaaacaagtggtctactccaacctcttttcaaataactggctgtcttttttttttttcttttcagacggagtcttgctctgtcgcccaggatggagtgcagtggcgcaatctcggctcactgcaacctccatctcccaggttcaagcgattctcctggctcagcccccgggtagctgggattacaggcacctgccaccacgcctggcttattttttgtatttttaatagagatggggtttcaccatgttggccaggctggtcttgaactcctgacctcaggtgatccgcccgcctcagcctcccaaactgctgggattaccggcgtgcgccactgtgcccgaccacaactggctgtcttaataacttcatctttatttttttcccagcctaaatcagtgcaataccataaccatctattaaacacctgctatggtgggaaggaagagaatgccatatacctcatgggatactgagttaatgaaaacttcttttccctgaagggggtcttagtcgtgcttgaatgtatgcagaggttatctcaatgaaggaaaaagtgcagaacattgtgacttttctgctcaaagctctctgaaagtttcccatctcactcagagcaaaagccaaagtcctgataatctagaagctgctacatcatgtggccccctctggtctcacctactattcaccccctaactcagtcccctccagccacatggcctccttagcgtgtcttctcaatgaggctttctctgatcactctattgaaaatcataaccttcttccacttcacatgccatctccctattcccagggttttttccccccatagcattttggatgatctaacgtgctatctacttaactcattcattttgtttatcatctctcttcccccacaaaatgtaggctccgcaaatatggaccttctgttgtgtttgttctctgctgtattttcaacacccaaatctgacactgaatcattattgtaggaatgaatgaatgaaccattagttatgtttatacaatgacctatctgctcacagcattactttgaaatccatttttcaaatttctgaatcacactggcatcacaaatttaaatacatcttaagattttttcgcttggcattgattaatgatgactaaaatctcattggtctagagctttcttcgttgcttttttctgaaaagacttactgtgaccattatctaaaaatgtaattgttgttttgagaccctggtctaaattttagcaaataattgcttgtattgtctcaagcacttcaacatgatttacaaaaatatattacttattatgccacaatgaaaaatagcacctgattataaaacatgactggaaataactacagtaattaagatagaagacctgagaatgctcttaagaaagggttctacttctttttttgttatttgtttttttttttttgaaacggagtcttgctctgtcgcccaggctggactgcagtggcgcgatctcagctcactgcaagctccgcctcccaggttcacaccattctcctgcctcagcctcctgagtagctgggactacaggcgcccaccaccaagcccggctaattttttgtatttttcatagagacgggggtttcaccatgttagtcaggatggtctcgatctgtgttaggatggtctcgatctgtgttaggatggtctcgatctcctgacctcgtgatccacccacctcggcctcccaaagtgctgggattacaggtgtgagccagcgcgcccagccttaagaaagggttctacttctaaattattgtaaaatattaacaaactgaggctgggtacagtggtacacacctgtaatcccagcacctttggaggctgaggcaggtagatgtcttgagtccaacagtttgagacgagcctgcacaacattgtgaaaccccgtctctactaaagatacaaaaacttagccaggcatggtggcacacgcctgtaatcccagctactcgggaggctgaggcaggagaatcacttgaacccaggaggcggtggctgcagtgagctgagatcacgccactgcactccagcctgggcaatagggcgagactccgtctcaaaaaaaaaaaaaaaaaattctatggagccaacaattcaaaagctatttataatcagtttggagcacattatattttttccttttttttttctctctctctctctctctctaatggttgattttccttcctatattttcttgagatttggagcttaaagaatctaagcacaccaaccttagcagaaagaaagccagtttgtgatttaaaagacaaaaaaaaatggtcatgcgtgccaaagagataatctgcaagacaatagtatctccagctcaacaaaagaagtcatgtacaagattaaactcatgctgtttccatccagtaacctcacacaaggtcaacttcaagatatctcctaaaaccatctagcaagtagcaatcagtgaggcttatcaacagggcccatccttcttacaatataaacctctttcagtttcaaaaattgatgactaagagctcttcaatagtggtatttgattccacattactctgcagtatgcaagagaaaaacaaagacccatcattctgaaccttctatcacagacccacgccaaactgcaacagaacattcttaaggaaattgctactgttattgtacacatattgctattgctcccataaatataaacaggttctcattttcaattctatatttaaagatagaaacacagcagttaaatattacatttgagagtagtgctttttctccttaaaatgttggaaaacagtaaagatgtacaaccaaaagaacaactataagtcaccaagaagttagagatcaatccctcaaaaaaaattctttttaaatattctatttacaaatgtgtaaagttggcataaaaactgcaaacagaataaaataaatagacacaataagagagaacttttaaaagacactttaaacagtactcaagaatacaaaattaaatgcactcaaagttaacatatatctctgtctaatgcagttaagtttttgatattttctgttttcaggaaggatttaatattttcattttcagaaagtagaaacaacaaattttaaaagactgtgcaatgaaggtttatgtattagctcataacttcccagttttttgttttgttttgttttgttttgagacagagtcttgttctgtcgcccaagctggagtgaagtgtcacgatctcagctcactgcaacctccacctcctgggttcaagcaattctcatgcctcagtctcccgaatagctgggactacaggcgcatgccagcatgcccagctaattctgtatttttaatagagatggggtttcgccacgttggtcaggctggtctcaaactcctggcctcatatgatccatctgccttggtctccctaagtgctggcattacaggcatgagccactgcacccggaactagattttcttactaaacacttctacgcccatggggtcatttagtcctcaagttggaaatatagaagaggggttctttaccctggctgcatctctaagggaagtgggattcacatgctgaagccaggctccacttccaatgagtgatttaactctcccggagtggggtccaggcagcagtagttttataaatcacccaggtgattctaacatacagtctgtattgaaagtcactagttcctacccacctcttctcagagaagacctcagggagatatccaaggtctgctcaaacatttccaatgttgagacccaatacctcattagaaaaatccagtaggcaatacactgtgttacagaatggtcatatttcaaatatgaatggtcatttttacagagcatggtaacccatcccttcccctaacaactacaacagagttcgcagatcttggcacttgtcctcttcttaaaaatcacattccccagtctccacatgactggctccttgtcatcattcaggtctgggctcaagtctcacctcctggggaagactgcctgatcacgctttccccagccagtctgtctcttccctcatggcacctctcacaactgaaatatgtgtggatgttcgttgactctcttcccagtctgaaacataagctccacccaggcagccccattgggtctgtcttgttcaacgctgtatctccagcaagtggcaccatgcccgacacagtagccactcaatacaaatttttgaatgaataaatgaaacagatgaagaggtaatgggcaatctaaagcaaaaagaaaacatcagagtggtagataacgtaaatacagtcatccctcagtctgggtgagggtgtgggggttccaggaccccctgcagataccaaaatccacagatgctcaagtctctgagataaaatagtgtagtatttgcatgtaacctacacacatcctccagtatacattaaatcatctctagattacttataatacctaatacgatgtaaatgctatgtaaatagctgttatgctgaattattcagggaacaatgaccaaaaaaagcctgtatacgtttagtaccgatgcaattttttttccaaatattttcaatccaaggatgcagaatccaaggatgctgaacccacagattctggggcctgactagttgacaatgcagattataaaatattggactaggccaggctcggtggctcacacctgtaatcccagcactttgggaggccgaggcgggcggatcacaaggtcaagagatcgagaccatcctggctaacacggtgaaaccccatctgtactaaaaatacaaaaattggccaggcgtagtggcgggcacctgtagtcccagctacttgggaggctgagacaggagaatggcatgaacccagggaagcggagcttgcagtgagccgagttcgcgccactgcactccagcctgggcgacagagtgagactccatctcaaaaaaaataaataaaataaaataaaataaaataaaatattggactaagcgggccggtgcgatggctcacgcctgtaatcccagcactttgggaggccgaggcgagcagatcacctgaggtcaggagttcgcgaccagcctgaccaacatggagaaaccctgtctctactaaaaatacaaaattagctgggcatggtggtgcatgcctgtaatcccagctactcgggagcctgaggcaggagaattgcttgaaactgggaggtggaggttgcggtgagctgagatcatgccattgcactc

SEQ ID NO: 17935 - DNA, 13197 bp, Homo sapiens
ttcccccatgtggagtacctttctggtgaccagagatcttagagacactctttgttgtttccacataattttgttgtgtttgagaaggagtctcgctctgtcacctaggctggaatgcagtggcatgatctcagctcactgcaacctgcaattctcgggcctcagcctcccaagtagctgagattacaatcgcacaccaccatgcctgtattttttttttttttttttttgtagagacagggtttcgtgatgttggccaggctggtctcacactcctgacctcaagcaatctgccacaagggaggtagagatggagtttcaccatgttggccaggctggtcttgaactcctgccctcaacagaaaccaggggatagtatgaagtctcattttatagataagtatcatccacttcctgatgaatctctgctacaggaactaatttcgaggcagtatctttatttttaaatgctgcagcgtggaagaacatgcttgggttgacacagggcccacagctcactatggaacaatcacagatggctatatgtgatccagacacaaaggtgatgattcagtcagaaatgaattgaactgttttatccaatccttgagggaccagccagtctcaaggactggataaaagctactcgaagtctgtttaccttgagaagggagactgcccaattccccctataaattccaagtggaacaccccagatgaagaagctgatatgctctgcacaaaagccacgcaggactggctttatgataatcgggatattcacccgctgaatacatccgttacccagggcaaatgctgcggttagggaggctccttttatgtgggcactccatgtaactttactgcttcaaaatctaacattacgagaagccttattgaatttgctatctcagcttactctcatcttacagatgctaataaaaacattaataatgagtcaaaggactcaacccagcagggtggaaatttttaagtgtctattaagaaatagggtgaataaaacagaccttgatgggactgaaacaaaagtcttttttgagatggagtcttgccctgtctcccaggctgcagtacagtggcacgacctcggctcattgcaacttccacctcttgggttcaagcgattctcctgcctcagcctcccaagtagctgggattacaggggcacaccaccatgcctgcctaatttttgtattttcagtagagacagggtttccctatgttggccaggctggtctcaaactcctgaactcaggtgatctgcccacctcggccttccaaagcattgggattacagacatgagccacggcacccagcctgaaatgaaagtcttaatatagcactaccaaaggttgcatggactataaggaccctcagatggtttcccaaaattaaagggctcaaacaaatctgctctatttgccccagcacagagaaatttaaaatgtaagaagggaaagattacaattagaaacatgatctggaattgcttggggatatatagtaaggtaaattaatcaaaataaagactcacaaaagggccaagataccttgctgaacacccaaaacctaatgcacaggagtgggtcaaataatcaagggatggagaagtttctgggactcatttgagagccttatatgctgttgcaccaaaatcttctagtgaagtctttttaaaaaaaaaaagatagggtctcactgtgtcacacaggctggagtgcagtggcacaatctcaggttactgcaacctccacctcccaggctcaagcgatctcccacctcagcccctgtagtagatgagactacaggtgcacactaccatgcctagctaatttttgtattttagtagagatggggttttgctatgttgcccaggctggtctcaaactcctgggctcaagtgatcctcctgcctcaacctcccaaagtgttgggattacaggcaggagccattgcctcaacacagtggcttacagccttaacgcaggctacaattagaatgataatatattaaagtgttaaggttgataggattaaggaggaagtttgaatgaaattggaatgtttaaacacactttatctaaatgttttatgggagtggatcttaggtttgactgtttcaccccatttctcctacctagtacagtaaaacagagggcacagtgtcaatctacccttcaagcattattaattggacatgctaaatgggaatgaattagattgcctgagctcacgcagtgtagaaccgagaagctggagcactggtacagacaaattctctgtatgtggagtgtgggctagggcttatgtcgaaagcctgcgagtgcctcccagtgacaactatcagggtgctggactacagactttccatttcagaggcaactactaagtttgctattggatattgatttaaagtgcccctatgactgaaggacataaaacaatgctgaaacttgaaatatccacggtatctaaggcgattttggaaaaacactctaatgggagaggacagtgcccaaaagagttccctattgaaaaagaaatggtttatactggatcttgttaccagaggaatgcaaggaagagattctcacatatagggagcctctttttcccttggactgactttggaactgtaggagaaccttctgcatttaattgtcacttggacaatgccctataaatacctctcagttgaccagcaaagtactgtttggtttatggatggcagttccaaggagaactatgatgtccacttgagcatgcctagcaatttgtgatgagaaagctcccaactttttcaagaaaactttaagtagcttccaccttctgacaaggttaattcacatacaactcaaagaggaatgaaacgaacagagggatggcagacaagcactgcaaaggcacacaggcatgcagtgtggtgtgggtagtggtttatttccactatgaagaaccaaaggaggtaagcaaggcccaaaaatgtttcttagacttcaattattggtatcaaaagttagacaatggtgtttaaattccccttttattcttccactagttctttgaaaaaagaatcatactctgattttcatactgtgctgctccaggtatttcccagttgcagaacaaagtgcccatttctgatctggggtcctagaaaagagccttcacatcctgggtacattttctctacttagaatttctagctagttaccactgcaaagtgacagtgatatatgcatttcctaaataacagattgaattggtttaaatgggctgtggatcagaatttcaaatcagtctagaaggacattttcatcactgaaatccacctactttgattcactttgggttttcatggtaactcttcagcacacgcaatgtttttaaatttatggcatagctttatcagtgagtaagaaatgaagtatcacatgttattaaaacccccttaacacagttaagaagagtaaaggagggcacccaagtacaaatcaacataaggacacctatttcattcatttaactgaaatatttttctctaatagaagagacattgtcaatattaaaatctagatttacacagcgctttcattttatactctacaattacttcgcatgacacctttacaatagacccacagaatgagttaatcatttaaaaataaatattgagacagataaggagaggttaagtgcagtgcccaatacagttaacacagtggttaagcatctgaaaaaagactgatgaaacccaattcttagtagtactacattacttactagctgtatcatcttgggcagattacttagtttccccaagcctcaatctcctcctcaacaaaaaatgcacaacagcactaactcactgctgttgagaggattaaatgtagggaaaagatccaaaatatacaatgcctttttgtagcacaattcctaacatagagtgattttagtgaatggttataaatttactgtatggcaattttttggggtatgtcactttaaattttttaaaaatctagctctataatctcaggattcactctgttgttctcggcatacagattacaaaaaaatagagtataaaaccatatccataaatgcttattcttcttcatttgaaactgaaataaattggtagatattaatgagctaaaactcctgaacagactccacaaaccaaacaggacaagctaagcagtggctcacacctgtaaaccctacactttgggaagctgaggcaggacgatcgcttgagcccaggagtttcaaaccagcctgggcagtgtagtgagacttcatctccactaaaaataaaaaacattagtcaggtatggtaatgcatgcctgtagtcccagctactcaggaggctgaggggtgaaggttgcttgagccctggagtttgaggttgcagtgagctacgatcatgtcactgcattccagcctgggcaccagagtgacaccctgtctcaaaacaaacaaacaaaaaaagagcagaaataggagagctcaggacagaccacaaacggtgagacataacctgctacttaaaagaggaggtgtgggccgggtgcggtggcttacacctgtaatcccagcactttgggaggccaaggcaggcagatcacctagggtcaggagttcgagaccagcctagccagcatggcaaaacctcatctctactaaaaatacaaagaaattagccaggcatggtggtgcgcgcctgtagtcccagggacttgggaggctgaggcacgagaatcgcttgaacccaggaggtggaggttgcaatatgctgagattgcgccactgcactccagcctgggtgacagagcaagactccgtctcaataaaaaaaaataaaaataaaaaataaaagaggaagtgtgataatggaagcttttggagtttttttttgccttctaaaaaaagcatggtatacaatataaaagaacatttattaggttctcaactctggaataaactcttgactgtatcatttaaaaaggttttatgttaaatgtagtaatatgttgaaccttcacaacttagagataagtgtaatttatagaagattatatgggactaataaaactagtaattattataatagcatcagctatcatttagtcagtgtcaattataccctaagtattttatacacgttttcttatttaattgtcataatagatcagtgagaaaggagaaaaaaaaaaaacccaaactattatccctatagagatgtggcaactgtcacacaggaggattacctaactcgcccatgggtatagttaataaatgacagagtagacatttgaacccaggattgttatgacttcaaaaaccaatactctaaaccaggcatggtggtatgtgcctgcagtctcaactactcgggacgctgagatgggaggatggtgtgagctgaggagtttgaggctgcagtgtgctaagactgtgcctgtgaatacactgtactccattctgggcaacacagtgagaccccatctctaaaaattaaaggcaaaacaaaagaacccacccacccccaatattctttctaacccaaattgcttctctaggcagaacataaataaattgaacttcaagattcaagaaaatggcctttaagatttcttctaagtctagaatacaaagttctttttttcggccaggcacagtggctcacgccggtaatcccagcactttgggaggctgaggcgagtggatcatgaggtcaggagttcaagaccagcctgaccaacatggtgaaaaccctgtctctactaaaaatacaaaaatcagctgggtgtggtggtgcgcacccatagtcccagctactcgggaggctgaggcaggagaattgtttgaacccgggaggcggtggttgcagtgagccaagatcatgccactgcactccagcctgggcaacagggcgagactctgtcttaaaaaaaaaaaaaagttatttttttctaatgggctaaaacaccataaggtattaagctccaagcctctgccccttctagccattctctaatccctactccattcagggaaataaaaggaagaaaggaagagagaattacttaaggtaaaatttttcagatacaaaaaggtgatctgtaagtaataatggaagcagtgagtcctcagcttctgctggtsggaaggttcatgctgaatatttagcaggcgctctctctaaagagaacagccaccacacttatggcagggactttgctgtcagtagctcaagaggcaaaatgaactacagactgggacaaaaggtgtgaagtctctcgtttacatagattggattcatcacaaatttaccaggtcaagaattccatataaagsgtttcagccttcacttgcagatcatgaaaaatatgacggagatccacagaatcctcagaaactgcatattgttaccagaataaaaaagtacaaaaaggtgtccatattgggaaaaagacataataaagatgctcagattagaaaacacacatatccatcaagttcacaagcatattgcttcagtgaatgcaaaactgaaagtggtttaacagtcagtaagaatcaagcccctgaagttgccacaaggatttccaactgaggaggacatgtctaagctctgcctcaagagcactggggaattagtgcagtggcatctgaaatctgtggagcagaaagcaattaactcctaatgcccaaggagcttcagattaaaaaatggattttttttttatctaaagatgatgagaaagtgtttcactaaaatatattttaaatatatacatataaaaagaaagtgggtgaaagaagaaaggaaagaatttagattggtcattagagaataacttcctgacaacaaaaattgagacatgaaacacattatcaaagaacattatgttggataaactgaagaaaatacaaccttgtgaacggctgtcaacacacaaatagtgtcaacatacacacaagatggggaagtacaaatatagtctacttggctcagccccacttataatttaaaatagaaaaataaaaaaaggaaagtggtaaaataagcttgacggcaccagtcgggattgcactacaattctgccagcttaaatacaagttagcaaaatgctaaccccagttgggtgcaatgcttcatgcctgtaattccagcactttgggaggccacggcaggaggatcatttgagcctaggattttgagagtccagggcaagacagtgacagtccgtctctacaaaaaataaaaaattagctgatgcggtggcacattcctatagtaccagctactcaggagggtgaggtgggaagacagcttgagcacgggatgtcaaggttgcagtgacccatgattgcactactgcactccagcctgggtgacggagtgagaacttgtctaaaaaaaaaagtgaatccaaatatttgtgtaaccttttttgaagaatctatcagtgtacaggtactattttataatttccttcaattcactatccattaagacatagcatctctattttctctacacattcatattcagatgacaactagtatcctagtctaggctcagcattagtcttcacaaatgtactggtaaaataaaatccatagtttgttattttcttaatatgtgttggaagaactttgaatgaaagataccacaaagataacttccttctgagattaaaaaacataaacaaaaaaccacacacacacacacacaactctggcagaactgttagacctgggaaagtcatctgtctcatgcctgctcaccttttctctcactcagatgaaatgctcccacaggcaaagatccaaagttgattgcctcaggaagctgcagagtcaacaatttcatttatcccttttcaatgttcgctgagttttgatgtgaacctttactaatccataaagaatgggaagtctacacgtttctggtagtaacagagttctctcactctcattatgatgaagaaaaaatgttttcttaatgacgattatatattatcaggaaaaaagggctatttccattaataaataaatatacccaaatcagccaagttaacacttgtgttccttcctatttctctctgcagtcactgactgccacctcaaagagaaacagcagtctcatctcagccgctggtcccaccatacctgctccctttacacaaaacagaaaagactgtgatcattattcggttctaataatataccccatggaaacacagtagttgggagcaaaagtacttgtttttggaaaatgtaaaatccaaggaaaacctaccttgtgagtagagaaggatttgcatctctaaaagaacacaggtaaacacctgcaccaggttctctaatcccaggagctcaaatgcctcccgaagggggtaatcagagagggggagttcactgggcccaggcctctggcagatgacaggttcataaacaccataaaatttcagtgacctccctggaggtggaaggggtacttcataaagaatattgtggatatagctttcaagtggcaagggtggtggctgctgtgaggtaacagccttgtaaagctggataaggaatttcttgcaggcctgcatgaatggtaacggtgtgatcaagcatatactttttgaaacatacagggtgtctctgctaatatcataggagttgtatcgctggagtttcaaaagggaagttgtatctccttcatcaagactacttgccaatgagtccatactgcaggaagatgaagcatacacactgctgtaatgctcagcgttgtgcatctggtaaagtgtctgcattgctgtgcagatttgcttacttgtaacttcttcataaaaagtgagaacaaaaccataggtgcgagaaccatcttccctggtaattataaatgagtgaaactgggggtctttattgtccgtttgtgtcctgaaagatagccctttaggcatgcacaactgtgaaagaaagaaaaaaaaaaatcagaatgcagtacacaaataacttcaagccagaaataaatgttgtttttttaacataacaggattcaaaaagacaggttttatccagatttaatattcgcaatagccttaaattagaaatatattataaattcctcatacacatgtatataaaattattcttaaaaggagtatatacaagggaaaaacttttactgtgtgatgttacatgcaaggggctttactaagaacaagagaatcactgatttagtcccagagtaaacctctaaccaagcttgtggcctttagcaagccatataacttctgtgagcctcagttcctttatctacaatagttgctgtatcaacgacttgaagacagagtaggcaaaagcatttcacaaatattaaaaagcacttcacaaaaatagtactcaagtatttaatacagggaaataggaaaaggctcatttaggaagtggaaaaaagttaaacaaagaataataaaaacaacagtgtcatctttgctattttgaatagtatggtattttatccaagaaaaagaaactttggaaattgaaagctttttgatctactaaagcagaagcacagaaacaaggcattttagattacttctagtagagattatgctctagttcttgggaactacccaggattgaggaaacttgagaacaaaattacccagaggagctaaagatgctatatttaagacacttaaaatgcacagaaaattagaattgattctttaaaacattttaaataaaagaagtgaaattacagaaaagttgaaatatactaaggaaaacagaacttgtaattcaaccatcctaatactcattattcatatttagatatttctatttttgtattgcaatatgctttttacatagaaataatttaaccatatattattactatttttctatatttaataactgatgtggtacaaaatttagactgtctcccacatccccacattaccaagaaaatacaattcctttatttcttcattcaaaccgtcaaaaaacatttattaagtgccttttatgagaggggccctatgatacaatggtgggaaggacagacatggcccatggtcctatggtatttccagtcgagtaaggttaacaggtaagttttaaaaatcataaactataaagtaagggaagtgctatgatagggtaaataagggttgctatgggaaaaacatataatagtaggaagacacacattagaaaagaaggagctaccaggaaaaaatgaagcccaactgaaacctcaggacgagtataggtcttagtggataaagaagattccaggcagagaggacatgtgcaaaagcccagaagagtttgaggaactgaacaggtcagtgtgggtggggcagagaatgcaaggtgggaggacgtgagagaaagcaagagaaataatcaggggctagcccatgaagggccttggtaggccatgttagaactgtggggaggacaatgggaaacctctgaagggtttttaggagagggacagaattagacgtgcctcttagcacatccatcttggaacactaaggggagtggttttcaaaggggttccaaagaggcagcaggaatgtctcagggccttggaagggagtgagaggctagaggaagaagttgagagggccagtgtcccttcttcccctatgcacattccactttcatttattctgtagagtggaattctttcagtgttaagatttctgggttcccactgcttaaaaacaaaatcttgatggtgggataggattaatgcaacacaattgtcattaagcatgaaggcgggtgggtgtccaaactgctcctcacagccatttcagattgtggtcctttcctttaccctaaaaactattggctttgaagctcatgtcatgattgtgccacattttgggtttcttttctatccaagttcatttccagagcaacttcttccatgattttaaatatactctttcaactcccaaatctacaatctcatgaacctgactcttaactgagtaactacttgacaatcccatcaagatgtctaataggcaactcaaacttaccatgtcccaaactgaagttctgatttcttcctccaaatcagtttcttcttatatcagtcttttctgtaattccatccatctaatttgcccaggacaaaaaccttggagtcatctttaacttcttcctctctttctcacttaccccattatccaatccatcagcaaatattatcaattctatcttcaaaaatacatgcagaaactaattgctgttgcttctttttttttttcttttttagaggtgaggtcttgctctatcactcaggatgaagtgcagtggtacaatcacagtttactgcagcctcaaactcctgggtaaaagcaatcctcccgcctcagcctcctgagtcagaaagtaattgttttgatctttacgcttaccactctaatctaagtcaccctcttttcttgtctggatgtaacagcctgtttctgcccttgtcccccataatctatttcccttataagagccaaagcaatccttaaaaaatatgttagatcttgtcactcttgccaaaattctccaatggactcttatctcactaaaagctgatgtccttataatggcctgcagggaagccctgcatgactcagcccccaacaacctctctgccctcatcttatactctctaactcacccactctgctccagcaacaatggcacgttactgttctatgaacacaccccgcgtgctcccatcaaaatctgctcttcccttttccagcagctttcttccccttggtatccacatgactcattccttgtggcagatatagctccaataatatttctactttcacacactcttccaaaccttgacacttccccattaagaagtggagctcactctccttgaacctgggtgggctgctgagagtgcctataccaggatctgggaaactttttctataaagagacagataagtattttaggctctggaggccattacagtctttgtcacaactgctccactccacattgtattaggtgagtgcaaaagtaactgtggtttttgcattgttggaatttgccatttgacattggaatacactttttaaataaatgtggttatagtatacatcttttttttttttttccaagacggagtcttgctctgtcacccaggctggagtgcagtggcgcgatctcggctccctgcaacctctgcctcgcaagttcaagcaattctcctgcctcagcctcccaagtagctgggattacaggcgtctgccactgcacctggctaatttctgtatttttagtagagatgggtttcactatgttggccaggctggtctcaaactcctgacctcatgatccgcctgcttcgtcctctcaaagtgctgggattacaggcttgagccactgagcctggaccatcattttaatgggcatttctcgctttatgtttttttgctaatgacttattacttgctgtttattttagattttagactgaaaatgttagacaaaaaagcaaattagagcagttttcttttcttttctttttttttttttttttgagatagagtctcactctgtcactcaggctggagtgcggtggcgcaatcttggctcactgcaacctccgcctcccaggttcaagcctcagcctcccgagtagctgggactacaggcctgcaccaccatgcccagctaattttgtgtttttagtagagacggggtttcaccatttttggccaggctggtctcaaactcctgacctcaagtgatctgcccgccttggcctcccaaagtgctgggattacaggtgtaagctacccgacccggcctcgagcaattttcttattcaagttcaaaatgggtcgtaaagcagtggagacaaccacaacatcgacaatgcatttggcccagggactgctaactaacgcacagtgcagtggtggttcaagaagttttgaaaaggagatggcagccttggagatgagaagcatagtggctggccatcagaagttgacaatgatcaattgagagtaatcactgaagctgaccctcttcagcaacatgaaaagttgctgaagaactcaacgtcgaccattctatggccgtttgacatgtgaagcaaat

SEQ ID NO: 17936 - DNA, 27301 bp, Homo sapiens
cagactggtggctttctttctttccttttccttgtcttttttttttggcaatttcaaacttttatttttaaataattggctaattagctagtagaattgattaagagaaccttaaaaccttgaattaagtaaagaaggcattcttcccacaatttccctacattttaaacaagctggctaattcatttataaagtatatgaatccgaggaccttaaaaccttgaattgtatagcaaaaaaactcttcccaggatttgcttaagtcaattttttttaaaggaacttgtgagctcatcctgaaacccagctcaaatgtattcaggactatggctatcctttccctcttaaatcacttccagtctcatagaagggtctgaaattgcctgtgtctctctactaaaccaactcacatgcattcatgaagcccctactaaatacctggcgctctgttctgagctatctctttgccttatttgctgccgcccaactgctccctgctggccctggaatacagagccagccaagccagattggagttttacctttaacttctggctttgctataaatcactgcccttgactgctgaaacaaatgaaacccaggtaggagaaacacctcctccatcttcatgctccaaaagtctcactcacctttgcagaagacagggatgaagagaagaaaaaacaggagagtgcagggccaggtcctggtagccaggttcagctgagccttgtgccgctgaaatccaaggcaagccatggctttatgggagcggtgttcaggtcttcaggaagtagagcaaaacctttcaggatcctgaagctttgaaatgtgtttgaacccacacagaatcaaggactttatatagatagctttgatcccagatatgtattacacatgtgcacacacagaaggcacttgaatagaaagcctttttgttttggttttacgagaaaggaagccgtgggtttagctgttacgtcgaaaagacaacctcaagcactcaactgaacaaaacaagccaatccatggatggaaaatgtattcaatttgaaactgaagcttcatgttcactttgaggatctggataactaagtggagacttggagaatttcctggagtacaagggtcctcctaaatcccaattttattcaatcttctgggcatccttaaccatccagtccaattcatttcattgacatctccaaaactactaggctgctaactttctgagcccttgggctaatggcaggatttgtctaggcatcattaataaaaactgtattctatctgtgaagcaccatccttctaatggtcccttgacagctttacaaataagtttatttctcctaaatccatttagcatttggttaagagaaaaaaactaaaatcacaagaaataaactgaaaataggcggaaaagaagctgcctctggttttgcagaaggaaagaattcaggtgttcttaaaagccttaactcaacagagacaaaacagagttgaagaaggtccaaagaaaagccaacccaaatgattcaagagattagagccgtccataaaaggatagacttttttttctaatacaaatttttcaagcagaaaattcaaaagtgaagattaaatataaccagagtccttaaatttgtgacagctgtagacaggaccaatgatctaacaaaaagaatttgaaacattgaggaccttccttaaatctggagagttttcatacattttaataaagaaagaaacatttatggggaacctgtaatatgcccggaattctgtgcacttaggattgaatgatgacaaaacaaaaacatagttgataccttaaggggcttctagaaggctgacatgcaaacagacagttgtaacagggaatatgacatttgcctactccagtccgtccatggtttcccattgtccacacctcagcacagcagaggagactctgcagaatactcaccaaatgcctccctctttggcctgtaccccagcattccctcccattcccccttcctgcatttgtctttccttccacgtgcctctttcaggcctcatcacctttacccatgctgttcctactgccttttttctcctattatcttattttatactccttctcatcctccaggacttagctcagctgtcatctcctccaggaagcctcttcttttttttttttaaattttattattattatactttaagttttagggtacatgtgcacaacatgcagatttgttacatatgtatacatgtgccatgttggtgtgatgcacagaagccttttctgacctgcctgttttctatacactgctacacattatagaaaccttcaagccccagctcaagcgccaacaagcaataacaacctaatgggcacttcctaatgccagactgggcaacagaggttttttaaaaagtgaaaaacaaatgttcctgccctcaagaggaacacacagcagtggcagggacagacagctaaacccatgatcatgatagagtgagatcaatgctggaattgaagtattatgtagaggagcagaagccagtggttcagcctgtggaagtcagaaagggcttctcagaagacgaaaagcctgaacttattattgagaacagagaaaagggtggatattcagacaagaagaataacatgggctaaagttggaaacggcatgaagagttcattatggtcacaggacaaagcttgtctggggatgagcagaaggtgcaagcggatgctcttagcagcaagggccaatgaaacataaggagcaaactggtatgactgagttcacatttgggggaaattttagggatggggaggatgggttcagggagaaatgtaaccaggaagactgggaagaagactattggaatacgccaggcaccaggatttggaaagctttctgaagggggcaaaatagtaaatatgttatgatttgcaaacggtggggtctctgttgccactactcaactctgtcattttagaatgaaagaagccatatattatatgtaaacaaatgggtgtgtgtgcattccaataaaacttcatttacgaaaataggtgaagtctggatttggcctgtgggccatggtttgccaacccctggtctaaactaaggtaatgacagctgtgaagacgaggtccctatgggactagtccacaatcagtgagtggaaggagaagtttagaatgaatgacaccagaattatggtttgagaagtactgtggtgctgcagaaattattcaaatgtcaagttttctttcttttcttttttatttttttgagacagagtttcactcttgtttcccaggttggagtgcagtggcgcgatctcggctcactgcaacctctgcctcctgggttcaagtgattctcctgcctcagcctcccaagtagctgggattgcaggcacccaccaccacgcccagctaattttttgtattattttagtagagatggggtttcgccatgttgaccaggctagtctcaaattcctgacctcaggtgatctacccgcctcggcctcccaaagcgctgggattacaggcgtgagccaccgcgcccagcaagttttgtttctttcaagtccataacaaccctacaagacaagagttaccatttttcccattttataaagaaggaaatcaaggcattgaaagttaaggtgacttacccaatcacccgtaggaagtggcagagccaggatttgaagccagtgatacctttatcactatgctaaagcaaagattttgaagcccaagataactggatttgtatcctagcatggggacttgcttactgttgacctggggctcaaagcccaatgtcctccagataatggcatctaattctcaagattattgaaaagattaaatgagataatgcatgtaacatgtataaaaggcctattgtaacagatagccactcaataaataggcctttcttattatagggtcaatgagaagacagaggtgcaatttactggaataaataacaggaagagcaggtgagaaagtgaaatgacagctttcatctgagtatgttgagtttatggcatccatggaaaatagttgccaataggattctggagcacaggaagagacattagtttaggcaactatgaagccactgatgaaaatgtcacaggccaagccacaaaacgagcattctttaaacatttgttaaataggtaggtaaatgaatgaagacagtttaacataagaagagatgagggttgtaattagaactttcaaagacatcttaccagattccttaattatgctcttatgaaactaattctgtcatagcaagaaaattcaaatggttgtaaaaaaaatgctgggtaaaagaatcttggtgagaaaagatatattcacatataccaccccacagattacttgataattacaatagggaaaagataattgataaatctagcagatactgctttaaccaagtgatcccaactgaagattactgtgatggagtgttctgacatagggtacctccagatacaatacactgagaaggacacaacaactttgtgtagttattgccaaaattgttttaactgaatctaagcatgaagaaataatcagacaaatccatattctgcaaaataactggcctagattcttcaaaaatgttaacatcacaaaagattaaaaagggaaaagcctggaaaaccattctagattaaaggagaaaatagagacatgatgacagaatttaatgtgttattattgattgaaaaaaataatacaaagcagattactgagaaactgggggaaatttgagtatagcctatatttcataatagcattgccttaatgtttaatttcctgaatgtgatcatcgtactggggttatgtagagaaccatccttgtttatagataatacttaggtattcgaggtttaagtgtcagaatgtcagcaagtactctcagaaggttcagcaaaaatatgtgtctgtgttagcagagaaagataaaaagaattaaacagcagtgatggaattttaacaattggtgaatctaggtgaagaatatgtgtgtattcatggtactattcttacaaattctttgtaaatttgaggtttttcaaaaaaattcgaagtaaaaattataaggccaactatttatattattgataatatggtaggcaataaacgagggatgagcaaactgaaatttagagaggaaaagtgacttgccgaaggtgattctccatcccctttcctcagatccaagctccacctgggacagacccctgtagaaaatgtctcattagttccctgtcagggtggcttctgagggcttagcattggaagttcccagcacatcagaaagcacaaggtggaagtccaggtctttcttccctgccctctcccaggttcagggccatgtgtctggtagtaacagtacctctccacaagtacagctcttgtttggtggcccttgttctatgatgcccattcttactcttacctcccctagggtaagagtaagaatcttaccctagattcttaaagaatcttaaagaatcttaaaaaaagagtaagaatctttccatcctaggggtgctatcagcttccactgttgctagtgtctgggtgcattacgaacctccacccctaacccttcttaatatttctcaaagtagttctttcattgaatcttttatttgaaccccctgttgcctgttgagaccctcattgatctagtgctacatttggtatgtggcaaaaactagattgaaatcttcgtcttctcattctcattcagtacttatttttcccgttatcttatgtacagcaataacatgttgtatcatataggtttgtatttattatagtcaatcatgtgtaattctgtctgtcttcctccaaattctatttccacagcacttacaacctcaacacacacaaagcacctagtcaaggcctcctttgtacctagtagataatagagaatttctgcatttcagtttagatctcaagcatttttatttctctcgcatctcatttccagctctggggaaagtgctaatcactaaggacacaatcataggcctgataggtactaatgagcccagcagagtgattaaaagcatggctggagtcagacagacatgagttcaagtcctggctctgcagcttctggatatgtgatcttggatgacattttttaacttctctgatcctcagcttcctcatctgtaaaatatgggtaatttacaggaattatcttgtatcattattgcgatgattcaatgagcctataccaataagttattgaacactgtgcctatcatatactatgttctcaggaaaaattagtttacatattaaacacagagaacgctatggattttaaatttcagctgttatataaaccctctttcattatmatttctactgaatagatggtattttagattaaaatcagatactaattattctaatactcacatattgaatttctgccctgtcagtatttccatgagtgtctggaaccaaacggcttattattttttacctgattgagtctaaaaactcacaactctacacataatctaagaattatgtattataagctctcaattattcagtggctgaatattcaaatgtctaagggtaccacatccttggatattttcatttcaggttaggaaggggaaagtcaatttgctaattatttttaccactccaattataaaagaaaaaaaggtggggggttggtggtaaaggaaatgaaaataatcggctaaaattaggacttggggattcactgtgatttcatttatactcactatcttcttatatcctaatagcttgagtaaaccccagattggttttgtagtactcttagtggttactgggtttgaaagatctctcaagatttgcataattcatagtggtgcctatggtgaagtatcttcagaattccaaaagaggtagagtttaaagagtaactgggttgtttacttaattgtaaaattcctcagcttatatagctcattctgaactkaattcagcttttcagatttttgaactttttccctaaacctcctccaattatcctttacccaactagtataccaaaacaattttaaaaaaatcaaccttttattgaaagagttgcacctggcattgactgtggtacctactgcaaaacatcctttgcttgatggtttccgatgtaatgggaagaatgaaaagtctaatatttgcatagtgtgcagtttcaggacatcccattacgttgagcctataatcatgcctaattaaggttatatactctgtgtgtttgtgctaattagctcatcacacagagctcctttcaaaatcgacttcaaaggaaaaagaaaatcatctaccaaagtaagtgactgctgaagaagaatctatcaatcatctcacttcgaaagagaattaaagagaaaggaaatgatatgcaaagtgactggaaagaaattttagcttcattaccattaaagggtgaaaatatgggctgggcaagaacccagttaaataaatgtggtagattaatwttcagtccctaggaaactataagccaatcataaaatcaggtaaaaaatggatgcttctgagctgtggactttgtcagtcctttagtggggaaacagagtaggttcctcctggcttttcagtttacattgtgaacagggttgtcagggaagcaaagttgtatttgctgatttggatgacaatgaaatgcagagcctgcttcagttgaagggtaatctttgcctgtcacagatttaattatatagagatgaaaacaaatatttttgaatgaataaataataagtcggctgggcatggtggctcatgcctgtaatcccagcactttgggaggctgaggcgggcagatcacttgaggtccggagttcgagaccagcctggccaacatggtgaaacctcatcactactaaaaatagaaaaattagctgggcgtgggggcgcacacctgtagtcctagctactcgggaggctgaggcatgagaatsgcttgaacctgggaggcagaggttgcagtgagctgagatcacaccactgcactccagcctgggcaacagagcgagacgtctcaaaaataataataataataataataataagttaactgtggtcacaaagcgatttgtacagggaatctgtgttctaattgcctaagctctttatatgattacatcttttgaatatcttatctccacttatggataatgttctgttattatattttgaattttagacattatcatctctgattgtctgtcaatgtccttagcttctcactcctaaaagtaaaattaaagttggattttgycttttttcttaatccctcagccctgttgtaacacagccagccacaaataaatttaagtaagtggctttatcaaaagccaaaaatagatgctttcaaaataggtaagcttcttattttacagatcaggaaactgatattgagaaggyaattgacttgcccagggtctcatattcagatcttattctttcattgtcaaggagaaataaacagaaagggaagggtaaatagtcccatatttgacccacgacaccctccccacaatgtaccccacctgaatggtacattcaggagtgtacctgatttctatttagaacgagctgagattacccagtaccatttccattttacaaaagaagaaacttcacaaatcactaatattttcttgtcttagtgcaaggagaaggaaatcttggacatggactacaaatcatctttaatgctgaatgaaccacccacctacaccccaaaacttgctagctatctataaagagtaacattggaagtgccaaacatttgatggaacccatttcttccatgatatttgtggctgatataatctcagcctcgagcatttatttcagtttcttggttacagagacattgctttcatattttgagctgtgttattttgggccctgctgcgactgccacatttcaatgatgccaggccctgaccctcttcatacttccagttcagaggaaatggttaagcccaaaccttgagcacagaaaatatagaaaaagagtacctatactgtttacagtgtgagtgatagcagctgtgatgctggaaaagggtgtgttaggtgacaagaaatacagggtgtttgcacagtctgtggcaggcactgactcctagagctagaagaaatgttagtgagttctgctgtctcattttaaagagagaatatgaaggcccaggaaggtgaaatgatttacccaaatcacccacacagyctgctggtggcagaaccaagatgagagtccaagggcccttgactctaatgtgattttcttctcactgcctttaccatcattcaccatcttccccagaacctcttgaactggcatggcttctggctctagttttctgcccagtttgcaacttcaaacccagccccaccaaacttcctgctaggtcttgggtacccacaaacacaaatcagcaaatcatttaagtaaaaaaacatatacatatggtctcatagcagcattaatcacaacagccaaagtggaaacatcccaagtgtccatcaactgatgaatggataagcaaaatgtactctatctacaccacggaatattattyagccataaaaaggaatgaaggtgcatgctacaacatgggtaaactttgaaaacattatgctgagtgaaataagccagacacaaaaggacacgtattgtacgattccacttatatgaaatatctagaataagcaagtctgtagagccagaaagcagattattgattgctagggaatgtgagaggggaaaatggggaatgactgcttggcrgtatgagatttccttttcgggtaatgaaaacgctctggagcagcatagtggtaactgtcacatgatgctgtgaatatacgaaatgccactgaattgtacactttgaaacggttaaaatcgtcgattttatgttatatgcactttacaacacacacgcaaaaatacggtcatattgacagattctataggcattcaccgtctcagaaagcacaccattggtcttacagtattattggccatgttttactctcctctgaatgtaatctggccaaatctgaatccacgttccacttctttccaagtgtcaaaagaatgaactggtggacacatcctccatgggctgaggcaaggaagaaagattctggttatttctcataatctgcaattctgatcccacatyacactgaaccatcaccagccagaatctgagatatggatcactggctctgccctctgctgggcacaattttctaacaggttactcagctrtggactaactaaatgagatggagggaagccatgttagaaaactttggcccaatgaactgtattattccggtgtgctttaggagaatatgatttagaaggagctggttacattaagtagctttccttagtagacccatttcacagattatgttctaagaggaaaatctctggcccaacacttcagccrtaaggaagaaactaaataattgtatttacatggtcacgtcagaacctgttgagggtaataagagtaatgcactgtaattaaaaccgaagctctttggtttttgtctggcacamgcatagagctcagtttctgtatgcacctaataggaccatgtcatggcaatgacattgtctgcttagaaatccattgcttatatttttgttatttctcaacattatttagattcagtctgatcacataaagttcttgccacatgcaaagtttgaactttgtagttctggacatttctgttccatcggttaagaaatgctgacaagtagaaaacaccagaaacatgtgtttcctgtgctcttaaaatataagcaggtcaagaagcttccatcaaatgcatctcctgcatttcatcctttggataaaatagacaattgtgagcatgagaacaagtaagtttatttggaattttaagctcacaaaaaaaagctaaaggaagttatgatgtttaaaaattaaatgtttgccactggaatttattatcctgatttataggataaattcagtaagcaagtttatgatcatgttgccaaataaatgcaattctttttctcatcatttgtaatcactatttccgtttgagaaaataaatcacttccaaattatctgaatctccctccaaataaccaggcttttttttttagtttaacatcawaaaatgtctatgtaagtgaatgccatttgtataacctgattttactcactgatttcactatctcctgtagcaaagaaaaactgaaaaaaataagtgaaatccttaagatttttattttaagagaatgagagtaaagaagaaaatgagaagaataagagaaatgacaaacaaatgaaacaaaggaagaaagacaaaacagaaactttaaatgaaggataatttgcatgtattcaaagaagcatcgattctgacccatctgacagaattaatcagcaataagagaacattggtttttattgtgggtggaactttcctaaaattcccaaaacctcttgatatcacaaaaccccaaaaaagtgctctgctagatgtttttatacaaagaatgtacagataatgtcactctrgtactaaatttagcaaataaaattgattgattgataagattcattgaatctattttagagcctttaactcaaatttcttcagcataaatggttttttgaagtcgcaaacctaaaaggaaattcttacttagatttaatcatgtttctgttgacactgagtcagataacaactttttagaaatttatagcagtttgagatgttaccaagattcaatgcctcaaatcgtgtcgttcctgcagagagacctcaatttgaagctttaaagtttgaaaactcatcacaaaatgtacaaattatttctttaaaatattttcaataaattctgtgttaatcgatcctacccactgttttccagcaaacatttagccaagctaaaggacataagaggaagataagaatttctcatgctctctaattccaattaatcacactggatttagtcatagcatatgaaaagtaagaaaggacacctgtaaaatgcataaagtagttacccaagatttaggaggttttagttataggcctggctctgatgctgcctaaatgtgaattatttcagttatataattgcatcagagtttttctcacctgagagataagaaggcactattaggaaggrtctcttactttcaactctcaacaatttttaattaaaagtgtattttcccttcatgatatataaattttaaaatcagattagaaaatcatatttagagtatgatctgctttgtaaaattaaaccaaaaatatacgtagaattatatatagtaacatcttagtgatgcttacataatttttacataaaatttttattttcttattttacctatctgtattttccatttttatgaatgtmtatgtgttactttgtggttagaaaaaaagatattacaaacaacaaaaattaagtccttttaatgtttacataacactaagtatatgtcaggtcatcagaactttggcattccggtttttggagaagttgaaaggagataagagatggatttagcttcttctctttcatgcagagatttgaaatccaagattagtctatatgagaactctagtttctagaatatacatcaaagaagcaatttctctagcacaatgtattataccatcggcttctccactttttttactccatcatcatcacaataaccgtaaagcacttcttgtgttaactttcctgaaatgctataaaagatactgtacacattaagaaacacattcttttccccaaagataaattacattattggatatggtccatccgacatgcaaataagtggattatgtgacctatataagagtgacactttagtggagcaaaatttttttaagcttttgaaaccacaaccaaggtattaaagacatccatcataggtaaattttagaaagaggtaaatttgtttaatatttacctgagctatctgggcccaaactcattgagaccttgaatatgggaatcagaactttaaggttcatctcttactggttgtgaccctcaaaggcagagagctaagcctggctccacatcaactgctgactttgcattttctgagtgcatgtcctcagtttctaactttacagaaatcatacaagatacaccaagcatgtcaggcagactaccttcagtttacagtggacttcagatgtcaagggttaaaactgtcagaatcaggtatcagataattcccagaaattccacattcagtataataaattagacatgaccttgagcataccatggacagaaaattaagggaccaatcttatgcaattttagaataattctctggctgattcctctctgtcagaataatattcctacttaaagatacgtatagtccaaggctcccgaccatgccagcctcttctctggcagaaggaggcaaaagaaggaaaagaggctcatctttctttagcacgtggagcccttttatttacctaagtttaatacaatagtataatatttaaggagacatctccaccagtaacaaggagaatcccagggaaatgtaagcatggctggctccccacagctcatcatagcttcaagaaactctcagtaatgaaaggtcaattgtttcatctttacaggaaggtgaatataaaactgccagtccaagtgactgtaacccttcaaatatgtcagtttagaaggctataattttccagtgatgctgtccttgttcagaacatctctgggatacctcttggaattattctcacttttataggggagaaaaaatgcagtgtgttattactttgtgatcgtgtcttcgttttgctacaaagtggaaaacacctggtttggtcaccaactgtccttagttaatgagagaattgttgggggaaaaatcaaattcacattcaaacaataaataagcgctgcctttcaagatattgcaaagattgtgctacaggtctttgaataccagaaacattttcagttatggcagtgtaccactagaaaaagaaatgagctattacattttgagaattgaggagaaggcatgttcctgccttacaaccgtacaaggcaagtagagatggagaggaaggagatttcctccttacctaccacttgtgcaggactgcagccgagtatcaggcccccctgggggatcagagcaggtgtgatgacaaacttttaccaggcataattcgaataaccgcactagaacctaaagaaaagataacgcatacaggcaggcatatagagcacaagaaggaaaccaggcaggcagctggatacgtcttcattgggaaggtgggcccacagatgggtgagccccagctcccaggatagaaagataagagtttgggtcagggcttctggcctcagcgaaaagaactggtcagagcaaggcagccaagagagccaaagcagaaactcagtcctctcagatccaagcaaaagggaccgtggaaaagctgggccttacctgactatggaggcagtccagtggccatttccaagaccaggagccatgtgagagctcagcgatgtgaaatkcactgaatccaagtcttagataatgactagggctaaggctctttcaacgaagtactgagacgtaaaacctttataacttcaattaggactgaggtgaaacagagcccagagtgaggtgagacagatgggggagctgagatattaggaacacagatgaaagaaattgatcaagatagagataaaagacataaataaagtctgcttagatgcccaagcatctaaggagcatcagagggaggctcaaggtctctctccgaagagacaaaaactaatttaaattctgatacgattattttactctattggcaaacctcacatgaaaaattccatgtttcctttcctttctgagtttattgtccttcaaaagatgctattgtattccatggattgctgggatttgccagttactttttttctttttttaattcaactatccaaggttagtagggttgaaactagaccgtggttttcaaacagcagacgaattgagaccagactacattctaaactcccccaccttctggtttcattacgctcttgaaacccaagtcamttttataaaaagagttgataaaactggtcttaattcttagcaaacctgacccagttagaacttgaagctggagtgaattcagttttaatttggggtgcagtgctgacagtagaagtgaaactaaatttgtgcaaatgtgtaagaactgaagaggaggaaaaaattattattaaatgataaatatattaacccagatctctgagcagtgagtggacaactgttaaaaaaaaatatatatatatatatatatatatattccaaatctaaaaacccagaaattactctaagatcataattctaaaataatgtttctgattaagttcaaactttccaagaacattcacccttgatctgaaactgaaccttgagaaatttcaaactaaaagtcatcataaactcctggcatgagaattatgttttcatgatggaactatagcgtaatcattgtcagttactaattacmatcttgagacagagtcagtggggccaaaaaagaaagaaagggagaggagagagagagagaaagggggagagagagagaaagggggagagagagagaaagggcgagaaagagagagaggagggaagagggaggaagggagggagggggaggaaggaaggaaggaagkaaagaaggaaggaaggaaggagggaaggaaaagaaggaaagaaggaaaggcaagaattaagttcatgcattctcagagcaagttactttgacccttggaaataagacactattagtcttattctgaatgcttctcagaaacatcatttttcttggtgtgacatctgacatttggatcaatcccagagagctctgtcacaaaataatgggatcgatattgatatccaatgtccactgtcatcatttctctaagccaagattccctaacctcagaactgttgatattttggaccaaaattggattaaacaagcacgaattttgttagaggaatgtctctaaaaaaatatggggagggagatgagaaaatctggaagaaccatcagatcatgatgaaaatttgacccctaagtgaaggatagaaggaagagaagttgggtggaaggggtctagaacctagtgaaatctaaaaggttcctgacaagactgtcagggcatcttgatctgaggtgagcacctggaacaggcktgctttagcattcccgccctgctcagtcactggctggaagcagcttataggaagcaagacctcagcataaacagagcaccatagactgaatgtttctgtcccaccaaatttcagactttaaatcctaatcaattggatagtatttggaggtggaatctttgggtggtgactagatcatgagagcaaaactctcatgaatggaattagtgccttcataacagagaccccagagagttccctctctctttctcccaccatgtgaacacaaagagagaagatagctgttatgaaccaggaagttatcttctctcaccagacaccaaaatgaccattgccttgctcttgaacttcccaggctctagaaaaacaagaaatgaattgtagtttataaaccactccgtttatggtattgttatagcagcctgaatggactaagacacagggcaatggatgccagagtgaagcggcttgggcctttggtccattacactacttataggagagggtctgtaaggcttatcctcatggatgccatagtccgtcccttatgccatgctgatccgcttgtccacaaaagttcaggcagctcttctttagtgattcctgtgagcctttcttcttcagaaaaaaactcagaagagggagattaatgggatggacaactcccatcactgtgactgatcaaggccacaactggtcctcctctctccctcctccccaaaccattctaaatgcctttccctcattctcagctatcatctcggcaggtcttggtggtttacctggtcatgtgatccaagccttaatacctgaggagtgtgtgcccttaagaatcatacccttcactgtttggagttgttacacggttgttcacagttataatgggacaagaataccaggaaacacctaagtggatcacctgttttccacctgtattcctccctgtcaccattgtatagaaccagccttggtctccttgattgggacctattatccctgcctgtattttgactctgattcctgcctgttggtccttggaaacaggactccaaagtgtcctaccagcctctgtaatgtgtggttcagtgggacacttgggccttctagcaagaatgtgcacccttgggggaccaaagtagcaaaggcaggaagcacaaaatccccaaatgggttattggaagctatggtagatggacccactctgcttccacctcttcacttctgaactcaagttctcctcttactgaggatatggtattatataggagtctctgatttaataaatgcattgcatccttaaggataatagcccattctttctaagtgtttcctccatactaacattttagctgcaaattttgaaggccattgcagaatcctatgatgccagctgcctattgggtacacaatgtgatatgaccagtggatcccatgaacatgagtccatttcaaacctcctttgatgtaaagtgggtccattggtcagatgatattaagagtgaagttctatgtacatggaccaggcattcagtaagtcccaggataatagtgttgatatgatgccccaaaggcagaaaaagcaaatctaccctcaaaatagttatcattccctgtgaagatgaaccactggccctttcaaaattgaaaggtctcagtgtaatcaacctgtcacccaattgtgccatatgagaagcttggtgttgctaacaatttgtacactcattaaaataagtcactaaatctactttggtaagtgaaaattcatactactgagccaaaatgtcatttccatctcttctactctattcatatgtccagcatatcagttctggggtgaccagtaatgaaggctggctaatgtcaaatgaccaaatcactttgttcatttggttgttcagcgccttttccatggtggatgctttctggtgggcattaatgtaagatacaaaatctttgcactttgtgcccacttccatatgtctagccataagattccaaagacctccttttctctaaccttccttccaggttcttgaccagatggccaggccattggtcaccttccaggatctatattctcatttcaggccacttctccttccacacaaatggatgatcgggtacatggctcatgtctatgtccattgggaacacttttccacctgactgccttcagggccgcccctgaattaggctataatgcagctactgtcaatgttcagtttgtacccaagtaccaagccaagccacctgtaaacaaaactacggctttttcctcctctttcagttggtcagctgaaacaccaattataatcccaaatttggccatacgcgcaagctgagggaggggccctggtgcaattgtggtgggtgatgtgggagtctgggccacctgtttgtttagcttgctcatatcctctcattcttcttggatccatctcagatttagtatttccaccttatgatggactgtttctgggtccatatgactttatggcttggtgaagccaatagaacccagtttataatgagaagtcccagatgcacagtgacttggagtcctgtggtcaagggttctacctctatcatggtccagtaacaaatcaagagctttttctccaaggacatattattccctgttgaaaagggcctgactccagaatcccaaaggtcttcattatgattctcctgctggagcataccatatactccacactgcatcttttctaccactgatgcctttgacacaataggatctgccagattacatgacccaaatagcacagggtgctgcaccacagcctggacctgctgtggtgccctttcctgctctgaacagtactcaaagctggcagccttccatatcatctggagcatgggtggaagcaatatccctagatgtgggatgtgttgcctccagaactcaaagagtcctaccagatgttgttttatttgtgataggggatataagatgcagcaatttttcttttgctttggaggggatatcccagcatgcgcatgactactgaacctctaaaagtcttcactgaaacttcccaaccactagagcacatatgttttcccaagacaccacacactagtcacctcttgctcaacttgtccaatcatmgtgatgttgtcaatgtaatagatcagagtgatgttctgtggggtgttcaggcagtccagttccttcagactcaccatcacagagggtggcagaaacatagacctgagacaaaattgtaaatgaatattgttgtccctcccacatgaatgcaaactgtttctgatcgtcttttctaatgggaatgtaaaagaacatattcaccaaatcagtgtctgcataccgtgaacctgaggccttattaaaatgctctaggaatgataccacatctgggatagcaactgctctttgggctgatgcttgattaagtctatggcagtctagaggaccaccagaatctgttcagtttctacggaacgagattggtgaattaaatagagataaagtaggaaccaccacccctgcatcctctagacctttaatgatggcatttatcttcaccatcctctcactccaaaatatatgatattttggatttattatcttgaatgaagtgagaaagatgttggacaatttgaaaagtttcaatttagcctactttaatagctcatattctacagaccaggaaacctatgtggaggttactacaatttccaaatatatcaactccaattgtacatttagggactgggaaaacaaccacctctggatgggttcttaggattctatctattacatgacccccacaggctgtcattctaacaaggggtgccatgatgacactttaggtctccaagtactgatgtcagctcagaccctgtgtccattaatcccaaacatgagtggttgttcccctcttcctcatccgtgtaagggatcataagtcccttggggaaggactgagggaattatctcagtatattcttgccatagtgctgaagggtctttcctcctagtaccaggccacctcttcagtcaatgggttacaaatctgaaaattggctcaagttcaggaactgcacaaaggattgtggctttttattagagcagttgttctcagtctcctgatcctctgcttttacctgtattttttttttctttttacagtcagcctcctggcttcccagagctccatcatcctcatagatgtcaacaaactcaactctgtgactacctctcttgccataatcccttacctgcaaaggaggaaaccactgtggtgctcgtgcccctctcaccagcatattccttataaccctagtgaatgattttccctctggtccctgtcatggaacatcaacctcctcttggtgggtcttctggtctcacataatatatccattccagcgtctctacctcttcagtccctttattcgtctaccatctgccacggtaattcaggcacttccacttcatgagagttggctatttttttatccaggcttctaagagccacccagcaataagtttgccctatcacccaacaacttttctagggtgttaaatatcaggtctcaagaaagtgcccttaggtcaatgaattcttgcttatctagtcttacattttagcttctttgatcaagcaccctcaaaatcaaatcctaggagtattcccctggcttctgccaattaatgctggcaaactattgcaattccttaggcatagagtctctttcttaacttaccaggcccagcatgacctcaatcctagttattggcttggcaggcaagagaggaggtgggggcagattctgaagtggcacctcttacaggggtgagatttctatagcatcttccagcactgtagaacygctagcctttactatggaaggtgagccacatctgcaagcccagaggatctgagggggttgaagaatgaacatcctcagggtgccatccagatgtccccatcccatgttgcagtattctgcaacagggtcccaccaggtccctgacctttgcataatatacctgctttggttgagcattcaaacatctctgaagctctgtgactctaacaattgagtcttcattctgcccctcagctacatctatcctactgctggggatctgggccactttgagggtgatcacagaggttttctggctcacaaacttagcaataaactgcctccactccttagtctgccaacatccttttgtggggcattaaagcaactgtctctgtatgcattattccctccatattttttaatatcttggatcactgcaccttactcactactaccctccacctgaacattttcacaggccaccagtggtgaaacatttagcaatttgtgccagggacaatctgtagtcgcccgctagccaagactgtgtccttttcacctgctatttggtggaaaagccagtcccaaattcccagcttacagcctgtttcctctgaaaaacaagtgccaaaatgggattaaacatgcaaggattgtattaggggaaatgtctgtgagataaaatgaggagggagctggaaaaggctgggagagacatcagaccgttatgcaagaatcggcctgatcgagagacggaaggaaggctgggtggaaccacccccaactgccacgtagtagaggaaggttcagaaaagcctccagagaattatcatgctaaaaacagctatccacggagtcctgcatctcccaggaaggggctgcctcagtatccctgactcattcagtcattggctaggaacagcccatggcaagcttgaaagtttttaacccatcctggctaacatggtgaaaccccatctctactaaaaatacaaaaaatcagctgggcgtggtggcgggcgcctgtagtcccagctactcgggaggctgaggcaggagaatggcgtgaacccgggaggcggagcttgcagtgagccgagatggcgccactgcactccagcctgggcgacagagcaagactccgccttaaaaaaaaaaaaaaaagaaaagaaaagaaaagaaaagaaagtttttaactgcaccacgaatacagggatggacgtcagaacacagcatctggggactttggtcagttatgctccttgtagttggaggtctggaagcctggaagtttgtgacttttttactgtgagctcatcttactggagttgtttactgttgacattccaggacattcgggtatggagatgttcttatcaggcagtttctagtttgcttctgttggagcactatgtgttttaccagataaagactacttttttttcttttttttttttttttttttttgagacggagtctcgctctgtcgcccaggctggagtgcagtggcaccatctcggctcactgcaagctctgcctcctgggttcatgccattctcctgcctcagcctcccgagtagctaggactacaggcgcccgccaccacgcctgtttagttttttgtatttttagtagagacggggtttcaccgtgttagccaggatggtctcaatctcctgacctcgtgatccacccacctcagcttcccaaagtgctgggattacaggcgtgagccaccgtgcctggccaatagactacttttaatgtgatttccttggtttggcttacctactctgtgcagggagttctaattcaaaccccgtggacttttagtaggcttccttgcagcctccccaaacaagacagagtttttctaatcgctgcttcatgggtatgtaccacagtcattcatggttcctatgtgtatgcaagaaatgaaattccgtatttccaaataactaaaagtgaaactggaatgttccttaaaaaagaaatgataaattattgaggtgatgagtatcccaattactctgatttgatcattacatgttgtatgcttctatcaaaatatcacatgtacccctaactatgtaaaactagtatgtatccatcacaattaaaaattttaaaattttaaaaaagaaactggtcccaggttttatcttaatattaattttcaggccagccttggtggcttacgtctgtaatctcagtactttgggaggccgaggcgggaggattgcttgaggcctagagttcgagaccaggctgggcaacaaagtaagaccccggccaggagcagtagctcatacctgtaatcccagctcttcgggaggccgaggcatgcggatcacctgaggttgggagttcaagaccagcctgaccaacatggagaaaccccatctctactaaaaatacaaaattagctgggcgtggtggcacatacctttaatcccagctactcgggaagctgagccaggtgaatcacttgaacctgggaggcagagattgctgtgagtcgagatcgtgccattgcactccagcctgggcaacaagagtgaaactccgtctcaaaaacaaaacgaaacaaagcaagaccccgtttctactaaataaataaataaatatttaaaagattaatttccagcaacgggaccatgagtcaaagaatgttatggcttttgatatatatgtagaaagtattaggcaaaatgcatcagtttacatgcccatcagcagcctatagattttgcaacttttctaacatacctatcttttaaaaaaaaatctgctaattaaataaaggtgaaaattttctgattgttttattctgtttttattcattgattttgggtcataaaactgagcattaaatgaccaaagaacaacagtgacctgaggtgctgacctgaggactgtttaataatagtccacagaatggtcaggatgaagacccagtttctctggaggttgctgtccacctcttgaatcttccaccacttgcaccctgctctttggtcagaccaatcctgtgaacctacgaggctctctgaaactttgattttctccttctgcctgagctgccctgtttttcattaacctgatgaagatctactttttccatgcagtctttcccctcttccttttccctcatctccaccccggtagattaccaaccactcttctgccatgactggatcttatagttacttctgtcaacatcaacaacactccattgcccttgttaatttgcagatcttctccccatattctattccttaaagtcaggaaccaccttggttttattgttatgccatcaggattttgaacagtaagtgtgcacacagtagatataataaataaagtgttccagaattacctatgagaggggaaaaaaagtggcatagctttacattcatgtgttttttttttttttctttgtctgccctctttgcatttcttttctttggccaaccagcacactcaagtgtctacccatcttatgttagcttctataaggcaacaacaaaaccctcctaaaaggttaaacggtctaagcctaaaaggtttcctaaaagcctaaatagtctgagttcacatgttttggaggttccaggcaggtatcaaaaaatcacaatgaaaactcaaataatcaggcaccaaaatgtttttttaaatgcagatatacagtgttagattgaaaaacatatagatgccaaatcagaactttccattttaatctagacacacagccctacttttactaggatgctagcaggaatgctgctaagactcaaagctgctcttatgaatctgtaacttctaaattgtattagagttgacagcacttgctgagcctctgctgtgcattaagaggaggctttaaatggtttcctgatgtccatggaaaagagactttcaatgggattgaaattgattaaacaataatagaatgccatttttaagattcatatatcacagcctttttagctttaggtgaaagcaacctgaagtgaagttataactttcatgaacatatatacaaccccggccatctccagcagacagtgcagcaatgctctttctctctcattcccagagtaaaagtagcttaacaaagagcatggagtgtaaaagggaagtcccaaggagaaggccttcatcccttttaccacctctattctccacagttctaagctctaacactggtccagaagaaaactaagtcttgtcacgtacttgaatgtggaccattactttaaccctaaaaatgcatgaggaattggatctgcttggaggaaatcacataaaaacatttgtaagctgaaaatatgttaaaaacattttaaaacataataacctagagtttctgtggctttgctaagccaaaagaggggaaaaaaaaggaaagaaaacatacttctcatttctagatttgcatcatctggagtaactgaatatatgcccaagagacttccttgggtctcaggctccaataaagttgaatttaaaagaatttgcacctgctcatttttcctacaacttataaagttatgagggtgagtggaattacatctataaaacagaagagagtcttgaagcaaagtctggtcaggagagaaaaggaagccagaaaggctgcctaacaaaatccctgcttctctcctttcaccctacagcccctccgtcagcaagtacagttgagttcaaggcacctccttatttaagttacttgagtgacttgagttcctattcagttttgtttggtcctggaagatggactaatcagaatcgaacataaaatcacagggggtactcacagactctagacctacctaaaacaaactgataagtgttgtcattgactcctactttctttaccaggaattattactcacctgtgcaccatgtagtctgaactagaagaaagtaccataatggaagacattacccgtaatgtttacaagagaagacaacaagaaagatggttgtgaacaaaacttatgaaagcaggtatttatatgcccatacgtagtatatgggtaatgaattaaatgattttgattttcgttcacacaaagatagtggaataagactgatgctttggatgtagaaaagaaagattagatcatgatcaaaagaaaccagtgtaaaagaagatgagggcagaaaagcactctgttacaaagttatatacccgcaaggaatgtgactcataaaaccaaatggatccatgaggagagtatttatatccattttttgttatttttattacaaaatctatgcatgttaagtacagaaaatttttaagaaactcatataaacaagataattcctatacccataaataatgtgttagcaatggtatatgtatgcatactaaaccatgagcaaaggaccctagctgtcttgttcacagctgataactcagtggatattctttggatgaatgaatttaagatgttttttctatgcatatatacatataaaatggagttatcccatacacactattttgcacttgacagtatatgacagacatagttccatgtcgaattatctccatgtcagtatatttccatctaccgtatttgattgctgtgttttatgacatggaggtaccataatttacatgactgattccttttctgtctgagcccactggttggaggcatttcctcctttttatagttcatttatttgtccctccttttccgtgagctctaatagttaatctcacgctttcatgagcgttttggtttcctgaagaacttgttaaaaattcagactcctgagctccatccctggaaatctgaattcatttgactaaaggggatcatgggaaactgtattttttagaagatcctaagtgattcatccacaagagggtgggaagaccacactgtgagaatcaccatttggtcaagctacagaatactataggcatatttccactccttttcattatttgcaaccctccaccctctggaagccctgacccgattttgagagaaatatataaaaatctgcttccag

SEQ ID NO: 17937 - DNA, 13455 bp, Homo sapiens
gcacttatcaagtctggattcttctagataaggaaatgcagatacaatccctcttccaaaactcttgaggccagatgtatttgaaaattcagaatttttcagattttttgaaaggtaacatggtacatttttttgtatacagtagtctttcttatccacagtttcactttctgtgattccagttaactgaggcaaactgtagtctgaaaatattaaaaggaaaattccagaaataaacaattcataaattttaaactgcagcttgatcatatctgaagtgcaggacaatagttctgagaagcatgatgaaatctcatgctgtcccgctctgtcccacccagacatgaatcacccctgtgtccagcctgtagccatctcggttatcagatcaactgtcacacaatctcagcgtttgtgttcaagtaacccttattttacttaataatggccccaaagcacaagggtactgatgctggcaattgggatatgccaaagagaagccaaatatatgtagaaagaggctgggcacggtggctcatgcctgtaatcccagcactttgggaggctgaggcaggcggatcacctaaggtcaagagttcaagaccagcccagccaacatggtgaaaccccgcctctactaaaaatacaaaaaattatttggtgtgtggtggtggcagtgcctgtaatcccagctactagggaggctgaagcaggagaatcacttgaacctggaaggcagaggctccagtgggccgagattgtgccactgtactccagcctgggggatagagggagactctgtctccaaaaaacaccaaatatatgcccaaagagaaactgttactctcttactgtgtctaattcataaattaaacggtatcaccggtatatatgtatagaaaaaaacaaagtatctatagagtttggaactatctgtggtttgaggcatccactggtgggtcttggaatgtgtcctccacagataaggaggaactactgtattacgtaacacacgtaacacctgctgcagtgtagccagtggcctacagtcattaacatttgttgtgataaatgaaaactaaaatagcataagccttgccaccagatcagttcaaatcagtcagattttgtagacaaataagttatgacaaaggattgaggaccagcactcacttacaacttctttgagcattaagcctcctccctcaggaagacagaggtgagaaagccggaagtcgccttgagactcacctgctctgctgatgccatgcaggtgggtagcagcgggatgacaggaaacatatattccagtgggtagatcattgccacgaatgccatcacagacatggagagtgcattgtagtctcgggactgtagcaccacctgtcatgagccatccagtaagaatcactccaaaacataaaatatggtttacaagaaaacagcttccaacattacaacttggtttccacttcatcgagcctacagctccagctttgtctctcccactgccccctgccccaccatgcctgccacctcccaatccaggcacaatggtgatcctcagtcacctgagatatgcaaatcactcccttaccttcctagttcttgtactgcccatcccaggaccactcactgaaacagaactactgatatttccaaagaattaggtcagtacaattaaggataagccctaatgaatggtaaaccctctaaatacatcccacatgataccagtatcttaattcaacccacatctacggaacacctgctgtttaccaggcatcatgttacctcctgaagacaaaaaggtgaaaaatatgtagtccctgtcctctaagagctcgtggtctggccactggcatatttaagagtttctcccctagaaaggtctaggaagcttgcctctcaccttgtgctctaacagaatgcaggttagcacctggagacaggcgtccacacctagaagttccaagggaaggtgcagtgggaaatccactagggtgaatcgagatgggtctggaagagcaaaggtcagagctggctggagctcttggggtaggacctcgatgtctactcgcttctgcccagagacgggtactggggagcgcagcaatcgatagatccaggcctcaatctctcgaaggtcatgcagaagggcacttgacttctcctctaccagcagcgatccagtaaagatccgccacatggtgtccctgagaagcagacagcaggaatcagacacattagcatcagaagctgataccctactgcaactcagtatcaccacagaggctctaatgatgacaatgggaaacggagcatcattaagaaagcccagtctctgagctcagataggaccggaaagtatatacaatggcaaaagcaaatgtaaagatatatactgggtaagacttactgtcctaaccacagttaaaacaccaaattccagcattactccaaacacaattttggaaagaggtctaactctgcagcagtcttttgcttagtaaagattaactcttggctggggatgatgctcacgcctataatcccagcactttgggaggccaacgtgggtggaccacctgaggtgaggagtttgagaccagcctggccaacatggcgaaaccttgtctctacaaaaataccaaaattagctggtcatggtggcgtgcacctgtaatcccagctactcgggaggctgaggcagaaggatcacttgaacccaggaggcaggggttgcagtgagccgagatcgcaccactgtactccagcctgggcaacagagcgagactgtctccaaaagaaaaaagattaactctaaatactctaaatatgcttaataggtctgaaggaccttgagctgtagaggaaatttcctatgcccctcaaagaccaattacatggaatctctaaatgcttcccccattaggcatcagcagcaaactgtacctttgtacgcctcgagggatgcccagtttcttgcccagaaggcgctcactacagcagtccaccaggcgcttgagagtatacaaacactctcggaaggtggagaagaaagggtagtggctgagcacgcacagggacgtgagagtactgttgcgggagcggctccccgccttggcccggcgtttgccccgaggagactggttcacatcaggggtagagtcagcactgagaggctgcagggatgagccactctctgagctctcagtgccaccctcttctgaggcacaggtggcatgggttccttccttcccacgggaccctgccccaccttcccccttctccttagagattcgcttttggaaggagcggtagaagttaacacagatgccatatcgcgtgactccagtgtccttgtcagtgagggtgaagacaaaagaggtatcatcccgaaggctcatgcgccgctgccgcacgctcaggcagccctcgggctggcagaagaacactacatctgggggcaggggaaactcagtgtgatcctccaaggggtatcgccgtagcaattcaggagtctgggccacgctatcactgctcgggtgcctgaagaacataaagacaaattcagcagcctgaagggatggaatgggctatcaaattttaaccacagtcaacaaataaagctcaagatgctattttggataaagtaacctgactgtaacaccttggaaaatatgggtgctgcctgccgcatggagctggtaacctaagtgaagtctacactgtcatgaaggcatctattctgaaacgaaggggagattttgacaataaaattatcactggcaccttaagatgattaacatcttttaaagtgaattaactaataaattaccaaaaaagtatacatagaggagtagcttataatgtactttttctttttacaaaataagaaaactgaggtataaagagtatatttgctcgacatcaagaagatgttagttaagagcagggttttgctttcaatccacctgattttgttttttccctactggcttcgatgctcccatcagggtaaaataacaggagaagatgagctatgcaaagcaacatggaaatcggagaagggaacaactgcagattttatggctatcccagatattaagacaaaagtcaatctcttcttggttacctggcccctacgatcactagatagtcaagtaaccgaggacagaacttcttcttttgcaccatggttccaattcatcagtttatctcagagaagcatcagggcaccaagcaaggagtcagcattcccaggaggaattctgaaaatcgaagtctaataggaaaaaaagtactgataagatccactgctgtgcctaagggactcatccctctcaacttcttcccggccagaggcagaggtcagaaggtcttccactttcatactaatgataggagaacttgacgcttgcctagcctcgtgtctaggctcatgagctcacagaatcgaatgttaaaaaataggccaggcatggtggctcacgcctgtaatcccagaactctgggaggccgaggcggatcacctgaggtcaggagtttgagaccagctggccaacatggcaaaaccccatctctactaaaaatacaaaaaaattagccgggtgtggtggcacacatctgtaatcccagctactcgggagtctgaggcatgagaatcgcttgaacccaggaggtggaggctgtggtgagctgagatcgcaccactgcactcgagcctgggtgacagagtgagactccgtctcaagaaaaaaaaaaaatgtagataaataatggttcacctacctatccctaccaatgacttaatttccagcttaacgcctggggctctgtttctgaaaaacagacctaggccatctaatctggactcagtcattgtaacaaaaattgaagtcactctcaggatccctccagggtggatcaggatcaaaccagactcctcaactagctagcactaacctgcacttctaggtctagatggaaacttaattattctgtttcaacaatctacattcagcttgatgtaaaactaccacatagactgtctagttaaccatgctcagacaataacagctggctattctacctcatgtgatctcaaatgaaaatgtccatgccccaattgcctaatctgcaccacttttctccctccttcaggcaagaaaggagcccagaggccactgctactagctctgcccttggtgctgaatcataatctctcctctattttgatctcaggctcagaatcagtaatacaatacccacagatgagtccttgtcctactatacattacagaggctatgaattagaggcagaaataccaggatttctgcaaggacagggagaggtgctcagagaaatttctaaactatgtcctaaaattaggaaaagctttcatggtcttaattataatttatttcgtgttaagtgtctatacacttctctaaataaaacgtttcaccccgctgcacagctatttctggtagggctacttcttctatgagtagaagttcttttctcatatttctagtgttccaggattctacctctgtgctctacatgcggcctaagaccttgttcaatgcacacggagagaaacccattatcgtatacacacacacaccctctactccctcacctgctgctgcgggcactcccatatatacagacatacacactccctggatgcttaaggccctatttggtttaggtaatgagtagaagttttttctcccctacctaacaataaacaagacctatttgcaatacctctcaaatcctcaaaatactgctttctcctttcccttgctcccagtagaggacctgcaggtaataggattcagttttatctctatagcgactctggctcccagcactatttatagcagagccacagcccctcccctgcttggtgaccgcacagtgctagcagctgctactccagagtcagccaaggcccataacaattcactctcctcgaacctagagacacttctcccactgacagtacctgctaagaattaggttgtcttctccctcatctgtctgtagtttgtacttcgtcctaattctggcttttgatagtgatatctctagamcaccaccaggtttctgagcacgccatatattcatttctaggtatcaccactgcttaacgaacccaaatagtcccttggttctcccaactgcaatagagtcatgagcaaactgcaggaggtggggcactataacagagccgcactcagctcctcctgagcagaatccaagggggagagaaatagagaaatgaaatgggatatgagtaaaaagcataatttgttttaataaagaattatgtagttaacctgtcatgggattcgaaaaaaaaaaaagaattatgtagaaatgactagagtgagagccaaagtatcttaaagtaaaacagaatttatagaaccagagctctagactacaccttgcaatctatgtttacattgaaaacccggagccctctccaaccaaaatctcaaagatcaggcctgaagcacctcctactgagtacgcatcaggcctctctagccttggtgggatctcagtccctctccactgacaactatctgacgaaactcaagtcactcacaatcatttccttccagagccacaaggaccctgagatcttgttattattctagctacgggtggtaggataaatttttagccagagttcacatctgatcagcagccactgccttcagttattcagattgcaaagataactaagattttccttctcattctctcctctctcccctccccaaaaagactaacacctttaactcctctaaagactaaatcctctaacatcacccacaactcacactcttgtcttcacaaccaacgaggctccgactctgcctcttgcctcaaccatgtttactaacgtagagcctctggttcctatcttcctgtattccaaaagcatccagctcaaaatgcatatctatctgctgaagtccsacatcaccatcagctccacccagaggtagatttaggattcacaaacttttaagttatctatgccttttcagcagaaatagccatgctaaccaaccctttggattcgtccctcattttggacaggatctcacagtaaaaccacaggaaccagagagcgatatgacatctctgctgacgtgaacacaacaggaggctctcctcccctcctctacctccccaggcagtgaccttgcaagctcatcagcacagactggtccagcgtatgggagaactggagcaaggaggctggcagctggcagggttggggtagaggggagggcagggaaaggtggaagaaggtagatacacgaggatggggaggagagcgattgcagaaagatgaaatggtgttctctctccagcaagtcaattttgaaayatcaagttaaaaaaaaaatttcttgagaaccaaacgtgtttctccaaattctagccaaaaataaggcgcaagcacgcacacgcacaagcacacccgccaagcgctgtgcgggttcggccccagggctggccagctctgcccgccccctcacctgctggacagttctcccccgcccccgcccccgccccgaacctgaacccgagccgcccgctcggcaggaaccaagcccagtagcctgagccccctcctctgcccggggcgcccccatccccgtccccgcccctcctcggcagacccccgtccccacgccccttcacactcccccagggcctcctgagagaccccttcctccaagagccacggtgtcctctcagagcccgtctcccgctcggagtccccagacgctcgcccaggaccccaccggcccagactctcctacctcccaagctctgggggactggccaggcccagcccgacgtcccccggcagcggggcgtcagtcgctccccagcgcggcgccgctccgagcgggcgccagttccgcgtctgcactggggggcacgcaccactcgcgcggggtgcggagggggaggccggggccggggccgtaccattcagcccggggggccggggctgcaccgagccgagcgccgcggggcggggccgacctcgggagacagcggctgcgcacagacctagcctagcgcccgtgggcgcgggagggcgcgccaggccgacccagcgccgtcgcgtgccaagtgggggacccacagcagtaccttctgtttgggttgctcagagagactctcacccgacggggtcatagcgcccgtttcgacgacatggggattcctctgaaagtcacttcccaagataatcggcccctgagacttcctgacgggctccccatcccccagtccccaccccccactcacgcgctttggcggtgctcggcgtccgagcagggaagccggctgccgagcggtggagcctaccaatcctgggcagcgggggcagaggggggcgcgcggccgcggttacctccaccgggcgcgcgcggggagtgggggggcgtggccgcgccgcggcgcccgctgggagatggagtccagtcagtccgcgaggacagccccgccgcaggacatcctccccgcggccacacggctcttctcttcctgtcccaaagggcctggggaccgacactgggttctaggtctttcaggttgtgcctttttcagatgccaaaggaaaaaccaaggcatgctacacatgcacgtgaggtgcaccgccgacgccttagcgctgaaatccaacacttcctcctccaccgcagaaaggcaaccggatcctacccggatcccagcaggggaagggggcgcctaagcctcagcattccatttacccatatggcgcagtgggggttagtaagaagaggccccctctcacggccaaggctgtcatttgtgactctccctcctctgggcctggaggcggatcctaaagatcgcaggcttcctcctctattaccgtgtccccacccccaatccagaaattggtttctctcattttgtattcattttgatcttcctgttcaaacagtaccagacctatcagtgaggcggcgctgaggcatttatggccataccacagagtgacagtggagaatttttcttggggccctgtgggaaaaacaggaagtggtggaggcaggatgggcagggctctggagaaccctgtgcaaagtggcccccaggcccatccgtttgtggggtcagcatgatcttcagacacagcacagtgttagcgagggctccactgctcagtagccacaaaactcgcaaccctttgactctcttttaatgccacgggaggatctccttgcccagctcccaggaatgtttgcccttctcagtctgttccacttctaggaggcagccaccaggcctcagccatccggccaagaaaacagaaaatatggggacagaacagtcattcgtgcacatcccagatctcagagagcagcggtgggagctttttgtcctgcagacgcagtgcaaacacttgctctgagtggacgctgctcagggtccggaggctcaccagtttcattagcatccgtgggaacatcagtcggtcctggggaaaggagagagacaaacacagcttttgcctgtccccagggaagcggggcaagagtaggggagttgtgggagaggtgaattgtctgcacagcatgcagtcagagagaaattcttgaagggaaagtaggtatgtcagggaatgggcctgtgtgtgggaaggaggaaaaggaacaccatggggagactcacatggggatggtggatggagacgtaggcatgcagggcttccacatatgtgtgctgcagcctctctacctggagctggtcctgcacgttgggccggtctataggtcaccaagagagttgaggagcaggtctggccagggtccagttccataccccaaattgcaaccaaaatatagagacatgctccagccaagctctctcatcctaaaataacacagcaaatgcctccaccctcccaagccaccacccccctccccccaccgattcctgtgggacctgcagccctccttggtgtaagtctcttgctgtttcccattgcccctcctccacacctgcagagaagatgctgatagcaatgagcaaggcaaactcggcatcattgagttgcagctcattcatggccctggagaactcgaagatggggttgatgaattccacttgcagccctggggaggaagaagggaggctgacgcaagcagcaggagcagcaggaactttcttctctcctcaccttagggaactattaggaactcactaagaagtttactgaggccgggcacagtggctcacgcctgtaatcccagcactttcggaggctgaggcgggcggatcacctgaagtcaggagttcgagaagagcctggccaacatggcgaaaccccgtctgtactaaaaacacaaaaactagccgggcgtggtggcaggtgcctgtaatcccagctacttgggaggctgaggcaggagaattgcttgaacacgggaggcagaggttgcagtgacccaagattgcactactgcactccagcctgggcgatagagcgagattccgtcaaaaaaaaaaaaaaggtctacaaggctttgctgtgtaaccttgagcaaatgtcttaacccctctataagcctcatctgtgaaatgggaatcatatctgaacccttctcagaaaattgttggtatagttcaatgacaaagtatgcagggcacttagcgctgtgtctggcacacaagaggtgctgaattaaataataattctggtattcttgttttttttctttgagacagggtcttgttctatcacccagactggagtgcagtggcacaatcacagctcactgcagcctcgacctcccgggtgcaagccatcctcctacttcagcctccctagtagctgggactacaggtgcataccatcacaagtagctaattcttatattttcagttgtgacaggatttcaccatgttgcccaggctggtctcgaactcctggactcaagcaatccacccgcctcgccctcccaaagtgctgggattacaggcaccagacaccatcacctgccaattctgtcattaaaattcttgagggctccacatttctagaaatagaggcaactcttatttttgtttatcaagaatcgtttttcagcaaggcacggcggttcatgcctgtaatcccagtattttgggaggccgaggcagggggatcacctgagttcaggagtttgagaccagcctggccgacatggcaaaaccctgtctcactgaaaatacaaaaattagctgggcgtggtggtgcactcctgtaattccagctacttaggaggctgaggcaggagaattgcttgaatctgggaggcggaggttgcagtaagccgagatcacgccactgcactccagcctggatgacagagcgaaactccatctcaaaaaaaaaaaaagaaaaagaaaaaaggctggatgcggtggcttatccctataatcccagcactttaggaggccgaggcagacggattgcctgagctcaagagtttgagaccagcctgggcaacacagtgaaacccggtctctactaaaaatacaaaaattaactgggcatggtggcgcacctgtagtcccagctactcgggaggctgagcaggcgaattgcttgaacctgggaggtggaggttgcagtgagccgagattgttctacttgcactccagcctgggcgacagagcaagattctggctcaaaaaaaaaaaaaatcctttttcagcagggcacggtggttcacacctgtagtcccagctactcaaggaggatcacttgagcccagaaggtcgaggctgcattgagccatgattgatcacaccactgcattcagcctgggcgacagagcgagaccctgtttcaaagaaaaaaaaaagacttgtttttcactggcattggccttacttatttgaacactagagatacatttcatgtatcacatcctcgagggaatattgcagtatgggtgaggatgtggattttggtgccagactgcctcgggttgagtcctgcctctaccacttacaaggcagtgtgaccttgtgtaagttatttaacctctctgggctttggttttcccatctgtaaaatgggaataataatagtacctatctcataaatatgtggcatatatggtaactaccacataagtgtttgtaaaataaataaaaaaattttttttgagacaaagagtcttgctctgttgccagactagagtgcagttgcatgatctcggctcactgcaagctctgcctcccaggttcaagcaattctcctgcctcagcctcttgagtagctgggactactggtgcatgtcaccacgcccagctaatttttgtatttttagtagagacaggatttcaccatgttggccaggatggtctcgatctcttgacctcgtgatctgcctgcctcggcctcccaaagtactgggattacaggcatgagccaccgcgcctggtcaataaataatacatttttcttggaaacagtcttcctgctgagaagactaaaatgcaacaaaacatgagctaaagtaatgatacctagagaatgtctctcatacacattgtcaaagtctctgcaccctacagagttccccaggctttgtcagatttcttttagcaaccatctgctacacttttccattcaaggcttcttggtgagtcacttcctgtactttcaccctgatgtttatcaagtgttgtgtgttggtccatttaatgggcaggccccattttctttttcttttttctttttttgagatggagtcttgctctgtcacccaggctggagtgcagtggcgcgatctcagctcactgcaacctcagccttctggttcaagcaattctcctgcctcagcctcctgagtagctgggaccacaggtgtgcaccaccacgcccagctaatttttgtattttcagtagagatggggttttgccatatgggccaggctggtctcgaactcctgacctcaggtgatccgcctgcctcggcctcccaaagtgctgggatttcaggtgtaagccaccacgcccggcggcaagccccattttctaaagcatttcttggtgaggttttgagccccaaagtgtggcaaacagccccctttatagagaaattaagaggaggttctatagttagctaatgcacctctgagggtctgctgatgcccacggaatgaacacctcaaatgtgctcagtccatgtcaccagttatctactgcatgcagtaaatagtagcggatagggaggggaggagacttgacaagcagagctcctgttccttctccccaagacctcactcatgaaataagaaatgcaagcatgattacttcaaaactgcttgtataaataaatctatgaataggtgcagattcagatagcatgagtctacaa

SEQ ID NO: 17938 - DNA, 16626 bp, Homo sapiens
aagcacagaaggccacagccttacaatgaaagtgctgaaacatgtcccctgtgacagtaaacatgcgctggcccgagctcaccccagtgctcttccaggcttcctggaactgggagccagcaggaccccagatggcctccagcctgtcagtattttcaacttcatcatctggagtctgtaatggcaagagccagattgcaggtgactctgagctgtctcctccttctcgacagctgcaggcatcacccagacacactgcagggctcacctgtgccatggaggcttttaaagtagattttctgttgcttataacagaatacctaaaaccgggtaatttataaagaaaaggaatttctcacagttatgaaggctgagaagtccgaggttgaggtgttataggatggaaggtcctgactgagttgtccaggttcttggtgtattgaacaaagaagtgaacaaaactcacaaagtaacaaaagaatgaaacaatgacagacaaaacaggccagtcgcagtggctcacgcccgtaatcccagcactttgggaggccgaggtacctgagaccagccttgccaacatggtgaaaccccgtctctactaaaaatacaaaaaaattagctgggcgtggtggccggtacctgtaatcccagctacttgggaggcagaggcaggagaatcgcttgaacccaggaggcagagtttggagtgagcccagactgtgccattgcactctagcctgggcaatgagagtgaaactccactaaaaaaaaaaaaaaaaaaaaagacaaagcaacaagaaaacagcttaccaaaggcacagattgattgaagcgaacgtgcaacccaccgggtgggagcgggcccaagcaaacggctcaaggacctcccaattgcaatgcttctcagggtttttataaagaacaccccagatgccctttagaggcctccaattggttacaccctatgaaggattagcctgggaccaatcagaggctgaagtggaggattggcccagggtcaatcagaggttgaagtggaagctcctgacttgttatcacagcagtgaggatgtggcctgtgtgctccccaatcctgcctagaactggctgcacctgctgttctctggcttatgagaacgggctgcacctgctgttctctggcttatgtgaacgggctgtacctgctgttcctttgcttatgccccaacccttggcttccctaattccctctcctcctgcctcagagaggctgcagcaggtgaaggccttcttgctggtggggactctggtgtcccgagacggtactgggcatcacgtggtgaggatgctgagcctgctcacatgctagctcaagtctctcttcctcttacaaagccaccagttaccctcccatgataacccactaacccatgaatccatgaatggatgaatccatctacggggacagggcctcatgatccagtcacctcttaaaggcagcacctctcaatactgccacattggggattaaatttcagcatgagttttggcggggacaagcattcaaaccgaagcagagggatggcgggtgcagcccagaggtagaacacgcttggatccccacagcccatcccttctgacgtggcttggccatccagggatgtgattttctgaatgacagacatgactgtgctttctctcaacaagagacgggtgccagtcccaagggttgggaagaggcactggggtcccaggggtttctcccacagtgctggaggcgcctgagagctgactccacaggtagaaacacaataatccctgtgggtaccagtgtggccaaggaagggacacatcattgtatcctcgggcttccgttgcccaagagaacagggacagtcactgggagaggcccacattgccgggcagctccatctcactcagtctttgacagggagtcccctttttacaccagagaccccttgaccaacccaggaagcccagggtggccaaagtggtcacagccagccagggtgtcccctgcttctccaggggacagggttcgtcccggctcagctctgctgcatgaggccacaggacttgtcggccctgagccttatcctcccacctgtaggctggaggggcagagagagtggctagctggtccttgggtgcttctgccctccaccgcggagccccccaggcaaagttgctcaggattccagaattttctctcatctaagccccaccctgccccacagtgcctgtttagaaggtaggtgaggagtggggaagaagacccccaacgttgttccaagcactggctttggagtcagggacctgggttcaaatccttgctctgagtgaccttgggcacgtgatgccctgtcagggcctcattttcctctaaatatctataaacgtctaaaaggagggtgtacaccatacccacctcacaaggccatggtgaggtcaggctggtcaagtgctcagtgatgtgcctgggcttagacccagcagaggcaggagtactcctgactctgccttctgccctctgcccctgccccgtcaactctgccagagccattgggcaccccccagaggcccaccacccagcgcctactgcccagcaccctccccatcctctgcttccaaccttctggtgtgatgtgttattctttcttccacttgcatccggctggaggagcagaatccctttcttttcccaggcgggttccccagaccccagttagaacacagacttcactccctgcacccagaggatgtgggtgtggctgggatcccctagtccagaggcagccacagcctgccagaccccagctccctctctgactgcagctgccaccagcccctcccaccatctgggacagaatctagcccctgggagccagcagcctggttccattcagggaagggcaggctctggagtgacctgtgcctgactcccactcctgggcctgccaatcaacttccctgggcccacctcctccactcgaaagtgaggatggcaccatcaacgccccagagcctggggattgtgccaggtgatggggtcacaggttgggcccccacctggtgctgtaagggtaactgaggtccactccttcctgcagcttagccttgagagcaaagacgccagacaggggaatgaggttttattcaggaagagctcaagatgggaggggagcccctggggttgcaccctctcggcctcttgagaccaaggctgatgggacactagaaactaatgactgcagcatctgagcttcctcggagtcatctgtgggggacacaggggcggcctcagagtcacccgtagcggggatggggcagcctcagtgtcacccaaggtgggcacgggcctcagagtcacccgtagggggtacgggggagcctcagagtcacctgaggggggcacgggggcagcctcagagtcacttgtgaggggcacaggggcatcctgagagtcacccgttgcagggacgggggcagactcggagttgcctgtcgggggagacgggagtggcctcagagtcccctgtggagggcatggaactggcctcctggtcggtcactgtgggcagcgccagataggtgagggtccagtagcgcaggaagttggttctcaggctccgcttcatggagctgctgcccatcttcttggtgatctccaggtagccgctgttttccgtagtgtagggttcccagtgtgtgggcacagccgagtggcccatgttggggtccctgcagagtgagaagaggctgtgcaggggctggggactcccagggggctgaagccctgctctgcacctgcacgcctgagccatccccgccctctgagctggccctgggcaccatgcccctcactgcatactgggcactggctgtgcacgtgcacgggattggggctctgccagtaactctcatcctcaaacacacatggattccgatgcagggggaggttaagtgacttgcccaaagtccctccactggcaagtgagggaacaaggcctcgtggtgggaggcccttctcggctgtggccctccgccctgcactcaacccacgtcttaccctgttttggcaaagttggtccagtaggcggtcatggccttagagactgtcctgtcttggggccggtagcccggagtggggtggcaaagggctccccaaagatgtactggatctcatctctatggtcggcccccacccatttggggtagacgggcatccgagagggatgggaaaacaggtaggcgtaggtcttggcactcctggaggggagagaccacccaagtaggcagggtgctcactggggaccgatcagcccagagaccggacttggagggaggtcccgggcagtgggcagggaagtgtctggggaattcacatgaagagatggggcttcttacacccagggaagggaaagctgagaaccaaattcatggattcatgggttccacaatttcagctgaatttatacttcacctccacaaaacattgtgaggcaccttccttctagaattcagtatcaagaaatattttgctctccaagtgaatgtgcattcttcaattagattggacaaggtataggccctcaactgtttccctttttgccttgactgaaaggaggctcacagctaaatgtactgcttagttgctgcaaagctttcatcctagacttctaggtatacttttatcttcctatctttttcagattgctaatttatttttaatttttattatttatttatttacttatttattcgagacacagtctcactctgttgcccctgctggagtgcagtggcgtaatctctgctcactgcaacctccacctcctgggttcaactgattctgctgcctcagcctcctgagtagctgggatcacaggtgtgcaccaccatgcctggataatttttgtatttttagtagagatggggttttgccatgttggccagactagtctcagactcctgacctcaagtgatcctcccaccttgacctcccaatgtgctgggattacaagggcgagccactgcactcggccttatttttccttctaattggctattattacatgaaggtctttaatgaggccttgggctgaaattattttgtaaggtggcaaagttgaggcccatgagagtcagtggatagaaaccattgtccagtgttctctcagtgcacacagcatgggggatggaaggtagctcaagaactctccagtgggaaggaccatggggtgcagggctgagcagggcagaggatcatagggtttgtaaagccctgtaggctgggaggtaaaaagaggccctcaagtcttgccaggcctcagcaaagtggatcaggcaggcacaggtggggactcaagcaccactttcccagacaacccagacacctgagagccacccacagcgaggcctcggctggaaggtgcagcaccccaggaaggcccccaggagccacccgctgcccagatcctcacttggcattggctctgtgctgggctagggcaatctcggtgggcaccaggaagaggacatcggtctcaaagtccaccacagtcttcttcttattctcctgggatgggtcctgggcccaggactcggtgtagacatcaaaggtcgtcttggcgcctctgagccccttggtgattgtgaactcactgaccagcttgtagaagtcctccctgggggaatcaagtaggcactgacactcagcctgtgccaacaggaaggtgtgtgcatactcaccccgaccggtgctaacttcctcactcccagtcctccactcaatgccttcctcctccaggctggccccctcgccagtgctttcccggcggccctcccgcacgggtcgcccctgagtcctgtgccccctgcttactccgtgactttcttgttgcccttgttgatggcaggcatgtcgatgctggcgaagatgtggccgtccatgttgttggtgcctgctatatagtcgatgtcggcggcgttggcgtacaggttgatcgggtcagcggggatgaagtctccatcaatgacagggacgaagcccacatagtgcagcatggggtctgggtgggagagccagcaggttagcaggttcttgtacctcccagtttcccctgagccgccccttgcctctcagggctggaattggctatgtcctcccttctctgatctatggacacttggggcagggttgattctgcaccatcaggggcatcctgtgccctgtaggatgtttagagcatccccggcctcgacccacgaggtgccaggagcaccccctccccagctgtgacaatcacagatgtctccaggccctgccacacgtccccaggctgagagccactgtctagggccagatctgtcctcttcagcggcagcccctccctctcctctctctctttgctgggcctgaagcaggaaggaggaaacttagaagccactgagggaactgatggagaaggagctccctctctcagggctgggttccagtccatcagccaaaaatggtgsgaggtctgcattgtactccagasccctggacgggcccctagaggacccagtggctgctgaggcaggcggggcctggctgtcactgggcccagcacagcaggytttgcttctagcggggccgtgggggttgctttgtttgggcttgtccatcctgagggcctcagggtggggaaatggggaggggtcgtgatgacctgccgaaggcctctcagcaccccaagaagagctcgcccaagaagaaggtgacctstcctttgagtcaggagcccaggaccactgcccaaacctcccggtcccagggccagggagtgtggagagcaggcagcagaggtggagacaggagtccccagggcctgagacaccgcaggcggcagaacagcgtggttgggatctggggtcccctgtgtgactcctgctgggggcagggactgggccgggcaccgacaccggcttcctgtggggcttggggtttctgtggcttctccttcacaggcagagagggtagaatttatggatgcctcgagagagctcctgcctgccggctctctttctggagggacccggacccgggtgtggagtagctcggctttcagcttcctgcacaggaataggaggcagcagctgtgccatgctgggcaaactgcctgcctgcttctctccasccgtctgcctgctctccacactccctgcccctgggcccgtttccccttctgtaaaatgggaacaacagagaggttggtaggtggaatcaccaggattagcaaatgtaaattcaagaggcccagttacatttgaatttcaggtaaacagtgaattgttttttagtatgtttcatttttttctttttctattttttgagacagagtctcgccctgtcacccaggctggagtgcagtagcgtgatctcagctcaccgcaatctccacctcccagcttcaagcggttctcctgcctcagcctcccgagtagctgggattacaggcacccaccaccacgcccgattaatatttgtatttttagtagagacggggtttcaccatgttggccaggctggtctccaactcctgacctcaagtgatccacccacctcggcctcccaaactggtgggattgcaggtgtgagccactgcgcccggcccatagaaatttgtttcaaatattgcatgggacatacttacacagcagttcttggcagtttatctgaaattcaaatggaattgggcatcctgtgttctacctggcacctgtccccatagaaatgagcgtgagtgcccgggatctgctgcggggctgtgctgggctctttctcagcctggcccgaagtttccagatctgattgagcgagagagcagcaggacctgcccctctgctgggctcttaccttcgcrgcactcgccactgcccagcagcaggtgaggcccaacacaaccagttgcaggcgccccatggtgagcatcagcctctgggtggccctccccctgggcctcgggtatttatggagctggatccaaggtcacatgcttgttcatgagctctcaggcactccctcccctctacaccctcaggtgcagggagatccagttttcccmaaacccacagtgcacctgtgcaggttaccacttacctgggagcagaggcaggtggcaaggtggcgggtggtaagggggatggtggggccgggcagggtgcacagtgccctgccttctggtttgttcacrgggcttggtgtcactgtcagagaaaagggcatactttgtctccatgccctgcctgtcccctaggtccccaraggggcttcacaggggaccaagcacgtgacttctgggacagagagggtgacatgctgtgggccccccacccaagtggckkaccttatctgtacgagcttttcctggggccatggagcaagcagtccaagctgggtgcgggtcccagagcagcayaaagccgtctcattcaagggtggggagatgtcaccatccagcctgatgcatcctgggagggaggactagaggctcagggggtgtgggtgggggggtgcggaggcatctagcccaaacttgtggtcttccctgaggaaagaaaggacacagccaaggccctggggcatgcccaggcagagtgacaggagagaaaaggaggccagcgggagggaagggagaaggtcstgtgaggttgtggaggaagaggaggcsactcgtattttctgtgaacaggtattaatcctggagccaggaaaggctctgagaagtgaaagaacaccacgaacaaagtcttmagatggggcctktaagctcagccagygtgaggtcaccctcaccgagacgctcggtggcagctccagccaccgcacagccctctgcagtgatgggaacagggtgagggcagccagagccttcccacccaacagtcccccaggagacactggrgcctgtgcttcccacaccaaccacactcccgttctgccacccctgmggccggtgccagggaccgagtggacctgcagagccacgtctgtccctctgtctgtcgaccacagccggtgccagcaattcaggaggcctagtgggcgagggaggctggggaaaggmckggagggtgggaggaggagctcggccacaggaaataaggggcctgcaggtggctggggcgccccagggcaaaggcatttgcctcagacctttgcccggctactctagttctgagaacctgccctaaataaaggaggtaattctgaactgggagacatgccctytgtgctccaggatattcactgcagtgtcatttacagtggctaaggaggaaaggggarggcagaggggaggcagcagggagaggaaggaggtgggggagagggctggggcaggggagagggaaaggaaggccccactttttatatatatacatttttagagcagatttaggttcacagcaaaattagaagaaggttacagagakttyccgtatgtcctcgccccaacccagtctcccccattatcaacatsccccaccagggggtacagctgttatactttatgaacctacattgacatgtcataatcacccagagtccacagatttaggggtttttttgtttgttttgagacagggtctcactatcacccaggctagagggcagtggcacaataacagctcactgcagtcttgaactcctgggctcaagggatcctcctgctttagcctctcaagtagctgggattacaggcgcccgccatcacacccggctaatttttgtatttttagtagagagggagtttcgccatgttggccaggctggtctcgaactcctgagctcaagtgatctgcccgcctcagcctcccaaagtgctgggatgacagttgtgagccactgcgcccagcccctaacctagttttggccatgctctgagcccacattctttgtggaacctcaagatggtatctaagctctgtactctgttgagaagttgggtctccatttcaaaggctcccgtgtatacgcattaaacaaatatgtatgcttttctcctatgagacaatctgtcagtgatttttcagtggtccttcagagggagaaggggaaagctctcccttggtccccatagtatcatcctgaatagtttgaatgctctaaaacccccctgggctccattgattcattccttcctcactcaaatcccttgaagcggctacattgtctggtctacatacccggggtttgtygtcatgcaccaggaaaatttaggacagggacaaacacgaggactttaggagcggaggtttaatagatagaagagargaaaaagagaaacatctctctcttctccaagcataaaggactggtgggcagcagacacactgaattttatattcaggtttgtccttgcccagccctgccagccgactgcaggagcaggagaactaaggaagggaaaaggaagcagatgaaaggcttaagaaaaaggcggatctgttggcagcagcccttatagaaagagaaattagccatgtgagaggatgtggacgcagatgtggacgtggaagaggtcaagttagacaaggatttaagagctgaccaaggctagagagggatcaatgtgagagatgyaaaaaaaaaaaaaaaaaaaaaaaaaagggggcactggaaggatgaatgtccagaaggcaatgagggaaatggccaaggccgtgagacaaagaggccattggccaagggctgccataccttagaggaaccagatactaatctgattgggctggcaggagctgaaggatgtgaggactaggacagaccgggctccttctcactgggcctccaggagtctgtggtcacattagaagttgaaggcagcaggattctgccgtatctggattccagatttctcgctgatggctgagctattatatgaagttacaaaaagaggagaaaaggaacccctcctctgggaaacagaacaggagaaggagccatgccttgtgaaaacttccttatagacttaaacgaaatgccccgtgccagaagctatcggtatattctagtgtttatttgcatctttttcaggataggttgaagctttccccaccaggacagaaaaagcacgacaaatgactaaagtactgttaaaagatattatccccaggtttggactgcctctatctttacagtcagacaatgggccggcatttgtagctgaaatagtacgagatttaacaagactgttaaaaataaaatggaagttacacacagcctattggctgcatagttgaggaaaagtggaacgcatgaagtggacactcaagcagctactgaagaaatattgccaggaagctcatctgagataagttcaggttttgcctatggtcctcctccgagacaggtgcacccccaccaaacaaactgagtatttaccctatgaggttttgttcagttggccaaccccaaatcataggtcaaattaaaggtgatctccaggaactagaggaattaaccttaagaaagcaaatgcaggctttaggaatagccatgcaagaggtccatggctgggtacaagaaaggatgcctgtaagcctgatagaccagtgtgcccctttaaatctggagactctgtttgggttaaaaagtggaatccaacttctctaggacccatatggggtgggccctgtactgtcatcttgtccactcccgttgctgttaaagttgcaggtgttatgtcttggatccaccacagtcggctgaaaccggcagctcaggacgagtggaccagccagcaggacacagatcatccaacccagctgatcctgagaagacaacaagctgctgctgaggacgatcaccctgctctggtcactcgtgaggctgaccagtcaacgcacggctgaagcttaaggagacaagccccgctctagtcacacacccgaagctgactagtctacgcacggccgaagcttgaggactcgtcaagcaagtaaatgtggttagaaatcttaggactagtagtcttccttataatactaactgttttactattgttccgttgctgtgctcaatctcctcccccaggcaaggccctcttctgtccttgctggatatgaatacgctgtacattgttttgctgttatcaccccccttgaccatgttaaaataagtacccttagaaagtgtccccattgtacacacactacagggtcaggaaacagtataactaggactctattattctatacttattaggagtgtacagggactcacctaggaacttgtacttacaatcggatcacctattcaatttgtgacccaggaaatggccagccttatatatgctatgaccttctaagtctttacctaggacttggtttgaggttcatactgagtcaaagaaaggaagtcttataaatcaaagccaagcctctaccccccagggggggctatagccatatactttgatatttgtcagttaacatccgtgaacccaacctatctcacaatctctggtcctacagggtactgtacaaactgccagtacaaaattgtatgtgcataccctgtttgcccctccaaggccctagcaatagcttgctggaaccgcacaacacagttcactgaccgatcatcactgaggctaaagccaatcttgctcatcaaagcgccagcaaaaccggactgtaagacaagcacttgcaatcctgtaaatcttactatcttagagccggatctacctatatggactacaggttactccatggcattacaaagcagcagtcaaaaagctaaagtaaatttatatatcataaagaggactcaaaccaagaagtcatcccagcagcaattccgagtctttaagtcattctatgagcacataaatcaaaagttgccgagcctccccctttagccaaaaacctatttgctcagatggctgaaaacattgctggcagcctaggcatctcctcatgttatgtttgtggagggacaaacatgggagaccaatggccttgggaagcaaaagagttaatgcctcaaaataactttactctgactgacccttcctgcaaactgactcccacaagttcaagcgtctggctcttaaaaacttctattatcgggaaatactgtattgcttgctagggaaaaacttctacagacccagtaggggaattaacatgtttggaacagaaacatgttaaaaaattaggaaaaactttatggcgcggcaaagatagtcccaaaccacctcatccaaatccattctcccgtttctctgctctaaaccacacctggtatcagcttgaagctccaaatacctggcaagcaccctctggtctctatcggatctgtgggccacgggcctaccgacagctaccagccaaatggacaggggcctgtgtacttggaacaattaggccgtctttcttcttaatccctctaagacaaggagaagccttagagtatcctgtctatgatgagaagagagaaagatatagaaggagcgtaaagaaagacacagccataggggactggaaagatgatgaatggccccctgagagaataattcactactatgggccagctacctggtgggggacgatggctcatggggttactggtctcctatttacatgcttaactgcatcatgaggttatagatagtgcttgagatcatcactaattaaacagcaagggctttagatctattagcccagcaatctacaaaaatgaggaatgctatctatcaaaatagattagctttagactgcctcctcgcccaggaaggaggaggatgtggaaagttcaatcgaactaattgctgcctggaaattgatgacaatggaaaggcaattataggaataactgcaagaatgagaaaattcgcccatgttccagttcaaacttggaaagggtggtctccagattctctctttggagactggttttcatttttcagagggttcaagactttaatagcagtagttctggctgtactaggaagttgcctaatactcctttgtctcttacctctccttgctagaagcattcaatcagctatagaggcaatagtagctaggcaaactaccactcagctgacggctctgcataaatatcaacctttgcccaaagaagaaaacttgtctcttgacgcagaattaagtaatagtgaggccttctattaaacttcttttataaaaggacttgaagtggggaaaaatgtagtgagggttaaaaagaaaaagaaacaagttttcctctgcttagcagctcacttcgaggacagttataagataacgctgtccaaaaagccaaggccaaaggaatgagctccagacagccccccacctccagagcaaggctgaggaaaaaaagagagaaagacaaattcctttactgttactcctttccctggcctcttaagcatgactatgtcttgcaaatatttgtatttagccagttcttgtttttcttttgacacagctacaaggccaccagctaggcaagaccacaagttatacactctatgattgactgcctttgtttttcttttgtaagcctgcttataaaaaccccactctgtctttgttcaaggctcacctttttggatgtgaatccactgagctggtgcataccttaaaataaatatcctcctgtattcacctgtactggtctctctagtcctctgcgtcccgcaacattagacctgaaaaagattccattgtctggatgtattgtatccattcacctgctgaaggacttcttggttacctccaggttgtggcaatgatggataaagctactataaacatctgctatgttgaccaaaaaacccaaactgtaaaatatttgacgagatttatcctgagccaaatatgattgactgtaaccagaggcatggtgtcaagagttcctgagaacatgtgccccaggcagttgagttacagcttggttttatacatttcagggggacataagacataaatcagtaatgtgagagggtttgggatggcttaaaaatcacaggtgaattcaaagattttctaattagcaattggttgaaagagttattatcaaaaaccctggaatcaatacaaaggaggatcttggttaagttaaaaagttgtgaagaccaaggttctctttctttctttcttttcttttctttctctctttctctttcttttttttttttttttttttgagacagagtttcactcttgttgctcaggctggagtgcaatggcatgatctctgctcactgcaatctccacctcccaggttcaagcaattctcctacctccaccctctgaatagctgggattacaggcatgcgccaccacgcccagctaaatttttgtatttttagtagagtttgggtttctccatgttcgtcaggctggtctcaaactcccgacctcaggtgatctgcccacctcggcctcccaaagtgctgggattgcaggcatgagccaccgtgcctggtccaagatttttgttatgtagatgaaatctcatagatggcttcccttagagacaatagatggcaaatgtttcctctcagacctctaaagggtgctggactcttcagaaatgacctggtaagggaaggagattctctacagaatgcaaatttcctccacaagagacagctgtgcagggccattccaaaatacgtcaaagaaatacattttggggtaaaatatttcaatttgtttcatgacctgctatctgtcatgtgatgctatacttcagtcaggttggaattttatatcttatttctacagagtctgttctgtcagtcttaagatctctgttttaaagctggtcagctgtgcctgaattccaaagggaagagagtatgatgaggcatgtccgacccctactgcccatcatggcctgaaccttcaggtccctttgggtttccctggccaagagggcgttccattcagtcagctgccgggcttggagttttatctttggtttacagctataaacatctgtttgcaggttgagtaaatcttaaggaatcagagtgctggatcacatggaagaaataggcattatgttttgggaaactgccaaactgtcttccaaagtggctgtaccgtttgttattcccaacagcactgaatgagagttctggttgctccacgtcctcatcagcatttggtgtttggccaattttctggattttggccattcttacaggtatgcagtggtagctcactgtttaaatttgcgttttcctgacaacatatgatgtggatatctttttgaaaaaaatacagatggggtcttactatgctgtccaggctggtcttgaattaactagcctcaagagatcctcctgccttggccgccgcatgtgatgggattccaggtgtgagccactgcacccaacctaggttaacttttcagatgcttatttgccacctgtatagcttctctggtgaggtgtctgcctttgacccattgtggaatcaggttttttttttatttattgagtgttaaaagctctttgtatatttttggataacagtgctttatcggatgtcttttgctaatgttttcccagtctgtggcttgtctttgttttcctaacagtgtctttgcagagcagaaat

SEQ ID NO: 17939 - DNA, 24438 bp, Homo sapiens
gatatatgcctatatatttacatttatatgtatatacatatttttaaggaaaaaatacataaagagaatatgcctaaataggattttgtgggatgaataggagttttctggatgattagaggatatgagaaacacatttaagcttattttaggaaataatataagaggtcaaagatgtctgaagtgtattattctgagaactaaaggtgtttgagtctatctatgtgaagaatgaaagtagtaccacatgatttctcacattttgcaaacttagaattctggaatagtcttttgatacttctttttttcgtgctatttactgcatcaccaatttctatcactttttcattatattatctctcgcattttttctttccttcatcatttccacaaacattaaaatatttcaaaccagcaaggtatggacaccaaaccatcagaaaaggtatgagtgataattccactgaagcccttagctaagccaagcatggctcatttagactgggggcaaagtggtgggagtgggaggagctggttgtggaggagaggttctagggaagcagggaggggactctggggagctcagggaagtggctctttaccaaccggtacagaaatccttcaacatgtcaacaataatattgccatactggggtgtgagaaataccaagcatccttgaatgagaagctgaacctcttttttttttttttttttttgagacagagcctcgctcagtcgcccaggctggagtgcagtggctcgatctccgctcactgaaagctccgcgtcctgggttcacggcatgctcctgcctcggcctcccgagtagctgggactacaggcgcccgccaccacgcccggctaatttttttgtatttttttagtagagacggggtttcaccgtgttagccaggatggtcgcgatctcctgacctcgtgatctgcccgcctcggcctcccaaagtaccgggattacagggaagctgaacctcttaactagtttttataaagacactcccacatgcccctgacttttgccttcttttctggccacacctctgctcgacttaatatccaatacttcctaatccagagctgagccattttgcaggtctgtggtgtgaattgatctacttgtcatcagcttccctcttgaaatagcgtaggtttgcccccctctgatctgataaggcctttacaattactttacctcatttccattttaaatgagtctgctaatagcctttttcttcctctctcccttcttccttcctccctccttttcttctttctttctttattctggaaatctagagtgatttttaaaaaaagcaattaggattatttatttcactcccctaattgaaatacagttaatgactgcctatttctattgaaacaaataccagactcctttcttttgcctgcaacactgtatctgctctgcacctgtgaagctcgcccgcttcattttgcatcattctacacttcagccttctttattgcagacacagagggctttcattttcttggacaagccatgtgcttttctggctccgaagcctcccacaggttttcccttctgcccataacaatcttcgttcccatttgctaccacagttcccaacctgcctgcacctcattttccgagctgattcctcctcagcattcatctcttggcttaaatgaaactttctaatctcctagacaattccagtcttctacatattctttcataataggctgggtggactttaattctgcctagcagggtacacatcacagagagaaccctcaatatcatattttagaatgaatggatagaggctgaattaatttgattctcaggctttcagtaattaatttgatactcagtcttttaagcttttttcttaattgtgtgacctgacaaatatcagtacctctgtgtgcctcttcagtttactcatctgttacgagagctgtctttccattttgagaagtcagtgagctactacagccaacagtgctgagacctctcaggctcattaaactttgagctttatgcctttttgcaaatgttctagttcccaaaacaatattttccagctagttgaggctcagttctttttttatgagctaataacccaaacttggcacttcagagatttaaagcaattttaatattcagtgaaatattaaacggactaggagtaccagctcctgcaatttcaagctgcaagatcttacggaagctttaaattttctgcaagtctcagcatcttttaaaataatattctaaaactgtaatttaaaaattcaaggagtttgtactagatttcaagtctccagcctttgtttgcactttagagatcataacaaaagtctgctgatgcaaatttgcacacagttgctgataaaggtgaagtgagagaagcttttttctggagcacccccagcttgctactttattctcttttctttaaattttgggtggagatggatgaacaggccttgcttataccttgcatatcaaacacacctttcagaaaaccagacaagcactgggagactcttaatgcctttgtgtaactttgtttcactgaactaaataaatttagatgtaattcagcatttgcaaatatgaataaaaagttgtttattggtcttagaaaactgttttggaatgtggaacattaaattgctttatagcaagtttatctgtgactcctaaattctcttgaatatagctattagagtcatatgcttgtttactggtaacctgagtttactagtaaacatgtcaatagtattgctcagacaagaaaaggaggtaaatcacattcgtttataattaaatgaaatttagtttctatcctctaaactttacgattatattttcattttcctaggtgatttcaaaaggtgtaatcattcttcatgggcaacagaaaattgagatcaacgaaaatggtgaggcctctaattttagcatataatttaatacaaatagaatgctttaattgggatatattttacatttttctttaaaagtcacaatcctcccattttaggactgtttactgccccctaaactacccttggggaacatgtaaagacatgtgaataggcacaatgccaaatgaaaaaataattacttaattaatagtgcattaattatattccaaacactactataatgggaaagggtcattgtccttccctttcttttccaagaaagacaggtaagtacttttacattcaaacaagaagggatttttaaaaagaaacaaaagtagactgaagtttgacgtaataagaaatgttcaactatttctttcttttataatttatggaataggttatgaactcctcctagaaatgctttataaattaaatttggtgggtcggggcagtctctttggcagtgggtaggatggctagaaactcagtggagggtttctgcaagatgacagtcagctatctcaccaaagcactttttcggtttgaaattttcttttcacagggaggaagggcatattttccatttctatagacattaaccctgaattagcgccctcagtacatatgcttgtctatagcttgcatcctggaggagaaatggtcactgatagcacccaattccaattgagaaatgcttcgaaaatcaggtaggtgccaaaaatgattcttttttaatttgggggaaaactaaggagaacttaagagagtgttgggtttaaactcccaatttttcatagaattgcaaaatgaaaaataaaagaaagctatggagaagttaatatgttggatgattgaagagtagcaggattatagcattcactttggatgttgttccaaatccagttgttcctaataataatattattaggtgggtaaagcacagaaagcccttttaacttatgtgtgtttttaaaaaagttaagaatagtctaaaagatgattcttctcatatggcttgccatccttttgcccttttattttcattttcaggtcaacttaaatttttctaaagaaaaaagtttaccaggatccaatgtcgatcttcaagtctcggctgcttcaaactctctttatgctctttgggcggtagaccagagggtattgctactaaggaattatggtcagctgccagcacaaactgtgagtgattaaaaccatctttgtttaccacccacagtatagttttatgtctttacctttggataaaaacaggataccttaaataaactagaggagaaaaaaattgtccagagttccaggcataaaaaatattttaggttagaaatcatgtacaatgactctactccaattatactgattctcttatggaaaaaatgagcaacacttttaaaaataaataacaattgctaaaggtctactatttgacacttgctctactgagtattcccatatctattatttaattttattctcatattaatcaaccctatagaactaatgcagtattcccattttgattaatgtctaatcttaggctcagggagatttagtaaattaaccgagaacattctctaacaatgtccttgaatgagtcctcaaagagtattgagcagtgcctttatctggaatgtattaaaatccagttgagcctcatggactttttgttagttttaatgtgatttagccagcaattatttaactgattaaatagtatttcaaagtttttacagatctaagatcctatactttctcaatatgtgtttatttggtataggtatgatgacagttctacataggatattcataggattatataggttatttatatactgcttgtggggaaaaatgaattgttttctatgaaaaaatacagttgactctcttctaccatctaggtgtatagtcagctacattccagcgaactacatggctattatttcagaggacttaacttagaagatggccttaaagtgccgtgtcttgaagatggacatatcctttacaatggaatttattacacacctgcatgggctgactttggaaaagatggctatgaccttgtgaaggtaaggcaactaagtcttaaaatggtgaatatatgtgacaatatataaataaatagaaatattcatggtgtgggtttttaatctcagaattcttagagtacaaatttacaattagtactaatgtctgagaaataatatctcaaataatgttataatagcaaaaagacttaataaagttcttatagttataattatataatagttataatattataaagctataatagttattctatatagttacaataaattatagttataatatatttttaaaagttgtattaatataattttatttaaaagttataaagttataattataaagttataaggttattataatgttataataaggttaagttataaggttattagaacttcattataaaactataataatattttaaataactaataatattataatattaggaaaagaactaatatgtgagggaattatcagctttcctgacataatattatgtacattatatactggtgtctaatataaatccccattttgctcctacgtctaccctcgaatttgatttctactattttaaagtattctactatatttaaagtgtttataagtgagataatatccctagttcaacaaaaatgccaaattcaaagtagtgaaagtacagtggggtatgatatgagatgtctttttttgtcctctcttatttaaaggttttcatcaacagctcttaattaggaaaatagagcaaaagccattagaattagagaaactaaggaactcaaagacatggaatttaggaaatgtcagtgaagtatctctaaatatatgacaattagagatggagaaataaataagtggaaattgaaaatatacatagaacaaaaaaccagtccagactgctagtctatgttgttatgtgatctaaaattgattttatcttgaaaggcaacaggattaaagatttttaccaactctcacctccggaaaccagtattgtgcaaggattctaaccatcttgamtctactgattacatacccttaggtaagtcacagtataatgcgaagggcaggtgacaggttataatctcttaatgcttttaaactgattgggaaaagaggggagrtgattattttcttttgctttgtcttttaattcatttaatgtgcctgtcatgtcagatgytagaaatacagtgagaataatgcaggtaaatctttatattcrtgaagtttacattgaatttgggatgcagacaatatacaaatggctgcatattgtcatttgtatatttcttgtgttgctgtaaagaaatayttgaggctgggtaatttacaaagaaaataggggccaagtgcggtggctcacacctataatcccagcactttgggaggctgaggcaggcagatcacctgaggtcaggagtttgagacaagcccgggtaacatgttgaaaccctgtttctactaaaaatacaaaaaattagccaggcgtggtggtgcatgcctctaatcccagctactcgggaggctgaggcagaagaatcacttgaacccagraggcagaggttgcagtgagccaagattgtgccattgcactccagcttgggcaacaagagtgaaactccttttcaaaaaaaaaaaaaaggaagaaaataggttaaactggctcacggttttgcaggctgtgcagcaaacatggtgctggcatctgctcggtttctggggaggcctcagaaaacttacagtcatggtgaaagacaagggggagcaagtgtctcacgtggccagtatgggagcaagaagaggagaggcgtcacacacttttaaacaatcagatctcacaagaagtcactcaccattgcaagaacagcaccaagcaatgaagggtctgcccccatgacccaaacacttcctgccaagccccacctccagcactggggataacagttcaacctgagatttgaggggacaaatattcaaactatatcaatggcataatttcagatggtattaagtgctctgatagttaatctttcctgaattattgctacataccaagcaacattctaagcattttacaaatgtcaacccatttattcatcacagtctatagattggaagctattaactgcaacttatcaatgagaaaaatgaagcttaggcaggttaagtaacttgtccaatgcaacagatgctaaataacagagatgggattataatccagacgttctgatcccaaagaccatgtttctctatcgtgagttactatctctcaaagaactactgtaaggaaaataaaacaagataaaggaaaagagcagaacatcaggacgctattttattttatttttattttttttttattattattgtactttaagttttagggtacatgtgcacaatgtgcaggttagttacatatgtatacatgtgccatgctggtgcactgcacccactaactcgtcatctagcattaggtatatctcccaatgctatctctccccccgcccctgaccccacaacagtccccagagtgtgatgttccccttcctgtgtccatgtgttctcattgttcagttcccacctacgagtgagaatatgcagtgtttggttttttgttattgtgatagtttactgagaatgatgatttccaatttcatccatgtccctacaaaggacatgaactcatcattttttatggctgcatagtattccatggtgtatatgtgccacattttcttaatccagtctatcattgttggacatttggcttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtcccaccagcagtgtaaaagtattcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtcctttgcgcactttttgattgggttgtttgtttttttcttgtaaatttgtttgagttcattgtagattctggatattagccctttgtcagatgagtaggttgtgataattttctcccattttgtaggttgcctgttcactctgatggtagcttcttttgctgtgcagaagctctttagtttaattaggtcccctttgtcaattttggcttttgttgctattgcttttggtgttttagacatgaagtccttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttcctcattgcttgtttttctcaggtttgtcaaagatcagatagttgtaggtatgcggcgttatctctgagggctctgttctgttccattgatctacatctctgttttggtaccagtaccatgctgttttggttactgtagccttgtagtatagtttgaagtcaggtagtgtgatgcctccagctttgttcttttggctcaggattgacttggtgatgcaggctcttttttggatccatatgaactttaaagtagttttttccaattctgtgaagaaaggcattggtagcttgatggggatgtcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttctaagttggattcctaggtattttattctctttgaagcaattgtgaatgggagttcactcatgatttggctgtttgtctgttgttggtgtataagaatgcttgtgatttttgtacattgattttgtatcctgagactttgctgaagttgcttatcagcttaaggagattttgggctgagacaatggggttttctagataaacaatcatatcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgcatagatagctcttatgattttgagatacgtcccatcaatacctgatttattgagagtttttagcatgaagggttgttgaattttgtcaaaggccttttctgcatctattgagataatcatgtggtttttgtctttgattctgtttatatgctggattacatttattgatttgcatatattgaaccagccttgcatcccagggatgaagcccacttgatcatggtggataagctttttgatgtgctgctggattcggtttgccagtattttatagaggatttttgcatcaatgttcatcaaggatgttggtctaaaattcacttttttggttgtgtctctgcccggctttggtatcaggatgatgctggcctcataaaatgagttagggaggattccctctttttctattgattagaatagtttcagaagtaatggtaccagttcctccttgtacctctggtagaattcggctgtgaatccatctggtcctggactctttttcgttggtaagctattgattattgccacaatttcagctcctgttattggtctattcagagattcaacttcttcctggtttagtcttgggagagtgtatatgtcaaggaatttatccatttcttctagattttctagtttatttgcgtagaggtgtttgtagtattctctgatggtagtttgtatttctgtgggatcggtggtgatatcccctttatcattttttattgcgtctatttgattcttctctctttttttctttattagtcttgctagcggtctatcaattttgttgatcctttcaaaaaaccagctcctggattcgttaattttttgaagggttttttgtgtctctatttccttcagtgctgctctgattttagttatttcttgctttctgctagcttttgaatgtgtttgctcttgcttttctagttcttttaattgtgatgttagggtatcaattttggatctttcctgctttctcttgtgggcatttagtgctttaaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggttttgagtgaggttcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtccgtgcagagctgagttcaattcctgggtatccttgttgactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcctcttgttgaattgatccctttaccattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacgtgagatgggtttcctgaatacagcacactgatgggtcttgactctttatccaatttgccagtctgtgtcttttaattggaacatttagtccatttacatttaaagttaatattgttatgtgtgaatttgatcctgtcattatgatgttagctggttattttactcgttagttgatgcagtttcttcctagtcttgatggtctgtacattttggcatgattttgcagcggctggtaccagttgttcctttccatgtttagcgcttccttcaggagctcttttagggcaggcctggtggtgacaaaatctctcagcatttgcttgtctgtaaagtattttatttctcctttgcttatgaagcttagtttggctggatatgaaattctgggttgaatattcttgtctttaagaatgttgaatattggcccccactctcttctggcttgtagggtttctgccgagagatccgctgttagtctgctgggcttccctttgagggtaacccgacctttctctctggctgcccttaacattttttccttcatttcaactttggtgaatctgacaattatgtgtcttggagttgctcttcttgaggagtatctttgtggcattctctgtatttcctgaatctgaacattggcctgccttgctagattggggaagttctcctggataatatcctgcagagtgttttccaacttggttccattctccgcatcactttcaggtacaccaatcagacgtagatttggtcttttcacatagtcccatatttcttggaggctttgctcatttctttttattcttttttctctaaacttcccttctcacttcatttcattcatttcatcttccatctctgataccctgtcttccagttgatcgcatcggctcctgaggcttctgcgttcttcacatagatctcgagccttggttttcagctccatcagctcctttaagcacttctctgtattggttattctagttatgcattcttctaaattttcttcaaagttttcaacttctttgcctttggtttgaatgtcctcctgtagctcagagtaatttgatcgtctgaagccttcttctctcagttcgtcagagtcattctccatccagctttgttccgttgctggtgaggaactgcgttcctttggaggaggagaggcgctctgctttttagagtttccagtttttctgttctgtttttttccccatctttgtggttttatctacttttggtctttgatgatggtgatgtacagatgggtttttggtgtggatgtcctttctgtttgttagttttccttctaacagacaggaccctcagctgcaggtctgttggagtactgggacgtgtgaggtgtcagtgtgcccctgctggggggtgcctcccagttaagctgctcaagggtcaggggtcagggacccacttgaggaggcagtctgcccgttctcagatctccagctgcatgctgggagaaccactgctctcttcaaagctgtcagacagggacatttaagtctgcagaggttactgctgtctttttgtttgtctgtgccctgctcccagaggtggagcctacagaggcaggcaggcctccttgagctgtggtgggttccacccagttcgagcttcccggctgctttgtttacctaagcaagcctgggcaatggtgggcgcccctcccccagcctcgctgccgccttgcagtttgatctcagactgctgtgctagcaaccagcgagactccgtggggtaggaccctccaagccaggtgcgggatataatctcgtggtgcaccgttttttaagcccgtcggaaaagcccagtattcgggtgggagtgacccgattttccaggtgccctccgtcacccctttcttcgactcggaaagggaactccctgaccccttgcgcttcccaagtgaggcaatgcctcgccctgctttggctggcgcacggtgcgcgcacccactgacctgcgcccactgtctggcactccctagtgagatgaacccggtacctcagatggaaaggcagaaatcaccgtcttctgtgtcgctcaagctgggagctgtagaccagagctgttcctattcggccatcttggctcctcccctccacagtcagtaattttttaaaaaatccctcacaggtaaattatcagcctctatctaagcacatacaataatgaggcattttgattacagaactgctctgcaataaatgagagttttaacataaaaattgaaagtactcacttttcaatgtatatcttcaaccaaaaatttagagcaacctttctcaactgttatataagaaaattgctttattgtttaactccacagagaatgtttcgagagaccatttgatgcataaatagtaccattcaggatatataggagagaatggtactatttatgcatcaataaatgtaatattaattcattacattcagtagctgtattggagacttagagataattctgttacagaactccggatggtaagggctaatttaaagttcctagcttgtttttcttttctttaattttctcagaactcttagaagtaatcagcctggtatcgttctatagcagtggaaatttgtggtccccaaatgcttgctgtcaataggcactttgtcaatggtgaacaggagattatttgattatctttttcaccagtgcatgatagggagtgctgaattttcatgccttgatatttatataattttcactggagtccacttcagttaggcagacacccatccctaaggtctcacttctatctttctcaaagayattctgcctcattaccaaagcacatgagctcctggaaagataaatatctaaatattctataaaatactgaatattacctcactaataacatctgagatgagaggcaaagattatgactatcaggaataaccagaatttggggccaaattgtcttcattgtaggwctaacagagaccrgatccatcttctggttatttattcattttccaaatgtgtaggtataattgacaagtctagcaatgatcagaattcccactgtggctcctygtgtgtggaataaacacattggagtggatgtgaaaaggttctgcctatcttatcctmaatgaactagaagttgccattatactcacagttccctgaaaataaactcttccatggcctccccatttcactcccttctgattcccagtctcagaacagagcatctcaytggtcgagcctgtcatttacctgccccctggattcaaggtaatctgggaatggagtcttctaacttctttactggaagtgaaacgcatatgttgggaaattaccaaagtatatgacaagtctacaaatggcctgaggtaaagatgtacactcttttataagccttaacaaatgtgtggcaagatgatcagggatttagaacaagacacattaagggactaattccaaggaagttgaggaatgaaattatattaaagggcttgtttctgtctcttctagagatatgtctgggaaccaaggtacggattggtagtggcttttgcagaatacttgttttccatcctyargaataggagttgttttcatttagaccttttaggatccaggaaagaagtatattttcattaacatgcttaagaatagtttcactgaattggaagctgagagtattatctggccatttggagattcccacatccagkcstctgggataacacagccaaactgtcaagaaacartacatttactgatatactttggggacaggaggatgaatgcaactaaatggatctcatggagcccctccatgtcccacaatgcagtctttacatttcatggaargagaatgttaccctcccaccacgttcaagtggaaccatctatggatcagattcctcaatttgtgaaattaagaccacacaactggtaaagaatcttaaggatctacaggcttcactgcaagaaaaaaaaagaaaaggaataaaaacatcctagtaactttttartaaattcctttactcctcaagttagcaggagagacgtaatacatttcatctctcaacgtagatggctttgataatttacttcaagcaggatcagacatttttttttacttgtatcgattggtcttgtacagatttatagatttttatatttaaagaacaatatattctatgtaagtaacatggatttagatataaaaattctgcttggctcttctaagattatttctccgagcttctcacatacctaatctccarataagaaggatctaataaaaatgaatgtcaaaaatatgagggcccttcattgcatmacttttgtaacactcaataattcatccaatcaattttgattagggttgaagttctgatttcactctgataagaatggatttgcaattcacaattccagcagaaagaacaacctggagctaattatctctaagaatgacagtattacacaccaarccctgtgagtcttcaaggcctagctagttcacaaaacatctttaatttgtttactatacaagtactttattgatgtaccagcactcttcamtatcaaaatattgacgcaaaaggtagccctgtcttcatataaaatataattcattatggatcttccagaataaaaatctaycctaaaacagttgctaaatgaacttattatgacagcttgtgtgtgtttatttgtgtaaactcaatataacattttggcaaaatatatattgaactatccatcctaaacataatctaatagggctrttttcttcttgagattacttctgcaacaagttagcaaaactatagcagagatggccagttttattagtacatcaaaaaatagacctatcagaataaacttttggcctgaattcctcatgttatgtatttaaatatttagactaggactggtcacttctagatgtaattsttccaarggttcatattttttttgacttggcctgggaagagatagaattaaatatacaaggaaaatttaagtaagttttgttaacgtgtaattcaatttgattagaacaacaattattaagccaacactttacttagacatctataccctgattacagaatgtgaattgcagccataatgcaagaaaattatatgactataataacaaggagcacagtggcttaaaattttaagctaatatgggctgtgaacatgtcatatacatttttgtgccttgagcayttggatcagtccttggaacacatctgacactctacragtgttttaaaattttatttaatytgaaaagaatgaagaaggaatgagttctggtgttctattgcacagtaggmtgacaatagtttacagtaagatttagcaaattacaaaatagctagatgagaggtttttgaatgtcttcaccataaaaaaaaaagataaatgratgaagtactggtaacactgccccaatatgatcattatactamatatatagatatgtgtgtgtgtctgtgtgtgtgtgtgtgtattgaaacatcaaattgtacccccccacttttttttttatttttgagacaaagtctcactctgtcacccaggctggagtgcagtggtatgatctcggttcactgcaaccttcacctcccacgttgaagcgattctcctgcctcagcctcccaagtagctgggattacagaggcacacgccaccatacccaactaatttttgtatttttagtagagatggggtttcacaatattacccaagctgrtcttgaactcctkggctctagtgatctgcccaccttggcatcccaaagtgctaggattacaggtgtgagccactgtgccccgccaattgtatcctttaagtatgtacaattacaatactttaaaaaaagaaaaaagaataaaggcagtacaagtttktatgaccaaagcatagtgtataatcctctaagatttatagacattagggttcttaagccctcacaggctctaccaaaagctacttgtttgtttcataagagaaaatattggcctaaaataacccttgtgaaactatccgaaactatccgaaatatggcagcaaagggtaatactctcatacaaattctgattgtttatatttttttcattattttctaggatcctcaaaacaatyggatttttcaawggcaaaatgtgacttctttccgaaatattacccaactctcgttccaactgatttcagaaccaatgtttggagattactggattgttgtgaaaagaaactcaaggragacagtgacacaccaatttgctgttaaaagatatggtaaccagttgctatttgtagctgtcctrtgtagatgaagagtttaaaggatggaccaacacaacatttrtgttagacttaggcaggagtaggtgaagctagaactggttttctttgtctcccttccttgacctggttggcttygtcatcagcactttgctgctcctctctccttccccagtatccttattctgattcctgccttctttttcccctagaaaatatacattttttctagaatccccacagtcttctaggagagatctaagagattgcaatagaaagaaaatgtgaggccrggtgtggtggctcacgcctgtaatcccagcactttgagagactgaggygagtggatcatgaggtcaggagttsgagaccagcctcaccaacatggtgaaacccagtctctactaaaaatacaaaaattagcccagcgtggtcgtgcatgcctgtaatcccagctactcgggaggctgaggcaggagaatggcttgaacccygtaggcagaggttgcagtgagccaagattgcaccactgcactccagcctgggcaacagagtgaaactccgtctcaaacaaacaaacaaaaagaaacaaaatgtgaaattctgargatagggaaaagaaaagaaagaggaagaattaatcattagtgagacaccaccatgtagaatggtgccacacaatttggggcaaatgatacatagctcatacagatggagggtacaaggaatcatagtaarctatatgactgcaataaggtttgcttgcctgtgattgtgsaggctaacgtatatttctcttcgtttccagtgctgcccaagtttgaagttayggtcaatgcaccacaaacagtaactatttcagatgatgaattccaagtggatgtatgtgctaagtgagtatttattcagagatttaccttcacaagaaaacacaaagctcagagagaatgagaagtgagattaaccatgaaactttaattatttatatgcttacattaatgttattagagaagcaatgaatcctcactgtagaaaatttgaaaaatatagagaaaaacacaagacattacctattattaatttgaccaactgccattaacattgtaatgtcactaacattgtaagtttcctctaattttaatgaatattttccatgactgcaatcatacttttctatttataataattaagaaaacatgcctacgtattatgccaatcttttcatgaattccaattttctgctgcacatatttttatgtgactatacccaatttaattattttattatataatatgttggctgtttcattttgttttcctggtaattaataattttgcagtatatgtctttgtgtataacatataataggtagcttttgaatgaaaaattgtttacttaagaaagatttccagaaaaggaattaccaagacaaaatatgtaacattcttttagtcttctgattgccatactcctcactaaacatgttgtgccagtgtaggattctagcagctggtgtgaaattctcattgaatctttactatcatggcatattttcattaaaattagaatatgagctattgaaatggcaaagtgaagataaagcatcttatcaagttaatctgaattatttgaattctcttaatgtaaaaaaatctacacgatttcagaaatttgtattttgtttttggaaaattatttttaatttttttttcttttttactgccttttctcaaatttctaataataatttataaacaattggccaggcacggtggctcacacctgtaatgccagcattttgggaggccaaggtgggggagggatcatccgaggtcaggagatcgagaccagcctggccaacatagcgaaaccccgtctctactaaaaatacaaaaaattagacgggcatggtggcaggcaccagtaatctcagctactggggaggctgaggcaggagaattgcttgcacccaggaagtggaggttgcagtgagccaagatcatgccacctcactccagcctgggcgactgagtgaaactctgtctcagaaaaaaaataataaaataaaaaataaaataaatgttttttgaatgtcaactagtttgttaagctctgcatatatcattaccacagtgctatgagataggagctattgtcatctgtattttataaagaaagataataagacacagagaattaaaataacttatcaacagtaatggagcttgttgatggcagaactaggatttagacctaggtttttcagcttcaaagctactctcctaatcaataactgtcatatactttataaaaacagttaacaatattaatatttgccatatttgttaagcactttgtttaatttatgacatgaaaattacttgcctttgagtatttccagcagtctattaaagatacattgattaaagggctgtctaatgaacgtgcaagcgtggttcttaagatgcctttgatgccccagagaatcttgcaaaccagttttcagccttcttttttttttttcagtagcatttcaaatcttcttttgactttaggaaatgattataaatttttttctaagttttaatgaagagtagttgaaaataccagaatttaatatacgtaatagatgagagactgtgtagatcactgatgttaaaaatgatgaggtgataaattcaagttggaagaaatccagaatactaaacaggtttcactagaaaagccaaacgcaaagccagagctttcagtggcattaacatctcatttatttatctgcacgatagtatgctaaaaacaaaacccacaacacattggaagaacaaaaatgtttctcaaacatggcctttggaaaatacttgcaaacctcatgctaacatggaactggtagttccttagcagtatgtcaggttacaatccatgatcctgatttcttgaaatttctttgatgttgtattttggatagagttatattaaggagtaaatcagtatcagcaataataatatcctgccaggaggccaggcagctagactggagctgtgcttgctacaaagttatttctgggcagattgtgagagcactgtttctagaaggttcacgtcagttgtatactgtgtctcaaattgtatgatactgtgtctgtgtttctttagccttttctgggatttagcttggaatggctagagaaaacaagaaaaaaattggattattttagcaaacaaagtcagagatgacttaggcttttaagagggaagaaaatttacctacagacgaagagattttaatacactgcattagcattcactgaaagcttttcaaatcacgaagggattattctgtcctgtttttaaaatttaagctacatgtcttataggcatatgttagcttacagataatacaataagacttttattttataaataaaaaacattaagtagaaataagaagaaatgttcaggtataatatgtgtggccagatctaagtctggcctttatataatcatgaaacctgacacatgattttattggtatgaattgactcagaatctcaaaagtgttaggaatttttaaatagaaagagaaaaaggtgagtggaaagaaaagggcacaggctatggagtgaggcagatctgagttcgaattttagtttcatcaattacaatgtggagaagttacttgacctcattttacaaatcagggtcactgggaaaaataaatgatatatatcagtgtccaacagttagaaaaaagtaatataatctgtgaaaataatattcacttttattatatgctagttttacatttggttgtctattaacaaaacaaaaaactccaattgactggatttgcctttggttgaacctttacaaatcttgtgttgtagttttgtgttttaggagaaaatgagatactcaaactggttatatttttggtcaaagcataaccagttcatgccagccccatagcctttatatttagtgagtggtaaataaaaattcgtgtttaaaatgttgatctggaaatgtttcaggatcctgaatcatccaagttttatatacatatatatttttctgataaaagggaaagtgctgcaatgttatgatgtttctatcagattaaaatatatttttaaaaaactcaatttaagcattaaatcatattcaatgagattttagattattttagattctgccttaccctgaattcaattttttaaaggcagccaaatcctcctgagatgaaatgcccagtttaacctgaattctgtggggaacctaaaccctcaccaatagggagaattcctaattcaatttggttagactgggttactcacagtttagagacttcctatataatttctgaagaagatcataaaatattgctatgatattgcttatctgtaatcataactacaccttcccccattaggtacacctttggccaacctgtgcaaggggaaacccaaatccgggtgtgcagagagtatttttcttcaagcaattgtgagaaaaatgacaatgaaatatgtgagcaatttattgcacaggtacagaccatgatctttactccaaaaaaagttctcactcatttttcattcttattctttctttgatttcatttataaggggaacttaacaatactattttcattttattgataatggagtttgcagctaaataaagtgaagaaagagaagaaaatacagtgcttaaagcagttttttattccatagaccatgtaaattgttctccacctatagattcatgggatttttagaatatgaaaggtatcgtgggctttgttgttttgtatatcgcctaggtggccttcctgatttttctttggagaatcgttaatcatcctttaaatgagtctgtgatattactctccatgccacctggatttttttttagtggaaacagcttacttgcaatcaactgcaattcagagtacccccactatattactttagacttgcagttcatatgtgaagtcatcatttgctctatctgcagcatcctaaccttaagtgaacaactcttcctatctctttgaaattgtcttttgactccccaaagtgaagcttgtgtacgccacatagttcatattttaagtccaattgtcctaaagttactcatcaaatttagtgaacatcctctaggtaaatatcaataattgacaaagacaagcagaatcctacctttacataggaaatgcaggcaaagaaaactagggtggaatttctccatgtcagcagtacattctgatagagttcagtcaactgttttacacaatgatgggtgttccctcagcaaatggtttatttttttcccccatgtgaaaaaaatacccataaacaatctggtagaggctaggagcagtggctcacacctctaatctgagcatgttggaaggccgaggcgggaggatcatttgactccaggagatcgaaaccagcctgggcaacatagtgagccccttctctacaaaaattagccaggcacagtggtgcacatctgtggttccagctacagggaggctgaggcaagagaatcactggagcccaggaggtcaaggctgcagtgaattgtgttcgcaccactgtactcaaggctgggcaacagagcaagacctgcctcagaaaaagaaaaaaaaaaaaaatctgtccggtggaactatctttatatatgagaggctttatttacttgaaataaatttcttagagtgagtttcctgagtcaaaggaaatatagataatgttcatagacagataattttaattttaataaatattagcatattgctctcctaaaagtttttaggcattcaaattcctgtcagaagtacatgagaatactatattttccaaattactttcagcaatatatttagaagttttaaaagtttttgtcattttgatagacacaaatttagcttgttttaacttgtgctatctaatttctatttagtttgagcaacttttcatatttttgttatcaatttggatttgagaactcttaattacccatgtttttctgttcatgtgaaatggaaactttcagtgtaagtactgccttccatcctacaagcattttttttcaagcctgttatttaaataggcaactcatttactttgtcatatttttgacatacccaccttccttatgttcctgggtttccagccttagaaaaaaaatctcactggcccctgtgttgtacatgtggctatctaagtatgctcttaagattgtttacaattttctaatagacataaagttcacttccaatgatgttctaaaatgggaatttttcttccagatgtgggctgtgttgtgttagcacctatctcacaattttgttctctctcactctttgtcctaaatcatgcccacgaaagtttcgtctattttattggttcttatttttactattttctttcttttattattttgtgttcctaaataatttattttctctttcatcttattaattcttttttctaatatttgtagttgattttgttggggtttaaaaaatatattagctgtttcttttagtaataagcacattcactgttttacatttcttctgaactgcagctgaataccattgactttgatgcgaagtattttttcattactctaatatctggattcttattggtttactttatgtattctctttgtttcaaggattcctgaaaaaaggcttttctcttattttcgaaataattaaggttcttctgatcactttctatgatttcattttaatttgactatattatcattagacaaaataaaattgcttttgttgttgatgtaatggctgttaatttaagatagagaag

SEQ ID NO: 17940 - DNA, 18430 bp, Homo sapiens
  misc_feature (1)...(18430): n = A,T,C or G, or insertion/deletion polymorphism (see Tables 1-2)
tcccaacagagtgcattcggtcctaaccacactctgcctgagagactacctctgcttccactagtaagaagctctggaaatgtttataacttgttgtaacggctttaatgccaaataaaacaagtttacacaccctgattatgttcagtagtggtaactcagaggagagcactgtgagcctgccctcatgacacagccccaccacagatacttatgcttgtgggtcttcacacaaagagaggccttaagggagagaacagatgagcattgcttaccattggttggtatgaaccagctgcctactgaggctctggacaaagggcttctcaagaacaggttttgcagagggaatgacgggttcccatttgtcccatgactcatggtaagttcctggcaaatttccctaaacccttcatcaattggctacgaagaaacactgcatgctttgcaaagtgatcacagccaaaagttgcaaaatgatttgaattatttccagaagctttgtattttcttaatatcaaaaatgatcaatactacctaaagattcatactttaaagaaagtgaagcaagaaaggtggtgaaaacacaggagagaagttatattctgaaaatgactttggaagagtgaatagatcttcactaagcttggaagcataatttattctttttcttatttttctttttacttttcatgagtatatattaatttttattttttaatagtatatattacctataaacttcagttactttgcattgtagggaaaggcatcttgaatataaaatgttttcttatattaaatatatgaatattcactgccataaaagcagacaatgtttattaataacattattccaaagtattcacaatatactcagacttggacttatgtcttacttgtgttttattttgacaattactgaactcatttttttaatttcataaaataaattgctgctgttaaaaaattataataaaaggcatcccagatgcatttttttaaaacattagagcaatgatcttaaagttagaagcattgatttagattttgtttagaatccttttttgtagtaatggtaaggaggctttagcccagcattgcacttttatagttgtaatgaaacacatctctgctttacaggatgaggaagtgaacattggaatgtatgtgaataaagagggatttttttcatatgctggaaacggcattcccagtttgcctaacagacaacccacaccatcatttttcccactctctccacacccttaactttatgaatgagatccttcttgtctagtaaatgatgaaatcttttcccacagtagaaggggatttcccatgcgtagactgagaattagaaacaactgctctgtatcctgtatgcaaataacattgttattgtactgtaaaaaacttacgtatgtctgtgttcatgtgtatatgtgttctgttattcttactgtttcccatttaaacagttagaagacttttaccaaatttagaaggtgtattagggaggtctatatttatatctatctctcaatttggataatgtttatgtacaaagttcacttttgagatctgggggaaaatctaaaaaaatgaacaatcataccttaagtcagatgtaacttagagagttggaggcaagtataaataatattaatagaattactccatatgtattataattccatggaataagaaaataaatcataattctaaacatgagtcccagatagaaggttagggcatttactccaaattttaggtgctaactggcaatctagaaaattctcatatgtgcaagtcagtgtagtatgctcatatatttatttatcagaggggtattattcaaatatttaatagttatgatttcttcaatcaaatcagatagatgagattgtatgtgtgtttataaagatgaatttaattctccttataaaagataagtgcactgcaagatccaccttctactcaacaaattcaaacatttgtactaatttgtcttttggaaatttcttatattaactttcctgttatcgatgttagatttggatttctaaattgtaatgggttaataaagtctgagaaagcatttgatctccagatgtgccctactattggtatgatttatattttgcattttaattagtaaagatgctctatatgtaagtacatgcctgactgtgttcctcaaatagtaagtgatcattttagattcacactttggaatgagtgttgtagcaaggggtaacgaaaccccaaggaatcagtaacaggcaaacataaagagaggtaggtttgggtgttgcttttcacaaagaacaacacaagtagtcactaatctgagactgttagccaactgggatataaagaggaaggagtagattgaaagcataaagtccattgtcttagtcaaatgattaagggcaattgtctttagatttggccaaaatttcataggtaaagaagtgcatgataacaggctttttagaaagggttatgtgaaaatagagtaacaataaaataaaagctaatgtctcattaagttgaccataccctaaatacagatactggctttaatcttttctagttctctgtaatatatagcagtgggaaaccagcagaagacattattagtcagaaagatgcgtctgcttctcactgcattacaaaacctgtgtaaaacctctggatagaaagctagcaccccaataatgggtttgctttaaaagtctgggagtcaagagtgcttacttcaaatgcagcataggatgggttgaatggaaagaagtgaatggaaagaagctctcctcctgggagggttaatattctcctattttgctccccaagaatatggttagttgtacacagacacaagattctatggaaaacctgagactgactaaaagtcatgattgactcaagaagtgcttgcattcatataccacccattggaaattcaacaatgaataaaacatgcaggctgtatctctgagattcccacagccaagtggcatgtattacataaaaactaaatatttgtagtgtgacatgacatcctgtaatagagatgagtacctgtgttatgggagctaaaagcagcaacaactaacttcagcttgggaattatgaaagtttgaaccgaatcacaaaagaacaaggaggatatatgtacctggtagacaggaagtcatataaagagaggttctagacagaagactgagcccacaaatacacatgtagagatgaaagggtgtggcacattgctggtgttttcagggaagaaagcagaacgtctgtgggcaagcagtgggggctataggtagataagagccttaagaaacttttttttctaaagagtttggaatttatcttgtaggtaatagtggaccattaaggatttttaaagaggatatgatataattaacttgaattttaggaaaaaacagttggtaaatagatttcctgctgttttcagtaaaagggcaatgtcagaggctgagcccaatgaaaccactttgtgatacttgataaagtcacagcaatcgtgcgattgtcttctaagagcatcttatttagtcaaaactctaaagacaaagaaacacaaaatacctggcaataattttggtaaaggaaaagaagaaaatgaaatgcaaaaaaagaaaaagtaatgcttcaataaactttcctaccaggatacttttatataaaaatatgtcgtatggaaaatacaacatcaacaattagtaataaaaaagacatggtaatatttaattttttttcaattagagcttccttaagcctttgttatttttacattgcttccattgtaataactatacagagcattgccaaccagaaattggtactgagttctcaaaatagatttagctctcaaccaagaaataatagtgagatacaaattaatttacaatgattgaatttactgaaatgggatttaatttgttcttgaaattttcactcataggcattgtaaattatgtctaggaaatgctgatgcaagactgttttgtaaattagataacacacctaatgacatgtaacacactgggagatggctaaaatttaaacatgacttaaactttaagaatgactcaggaaatactggcaaaatctcctgcatggatatatagtcccatactcggcttccctgactagtgagaacgtctgggctcctagaacactgacctgtatgtggatctagcagacacggcatattgactttttcttcatctcattggatcatgatgtggaagataatacatctgggtgtttttctctttcatctgtctctttctcagtctccaaacttgtcagtgattacacagtttattatttcacatggaaggcaaatagagcttggtattaaaaattcaggctgggcacagtggcttacgcctgcaatcccagcactttgggaggctgagatgggcggatcacctgaggtcaggagttcaagaccagcctggccaacatagtgaaatgaaaccccatctttactaaaaatacaaaaattagccgggtgtggtagcatgagcctgtaatcccagctactctggagtctgagactggagaatcgcttaaacctgggaggcggaggttgcagtgaggcaagatcgtgccactgggcactccagcctgggcgacagagggagactctgtctagaaaaaaaaaaataaataataataataataataattaaacattacatttttattgcagtgatttgattttaaataattttatcattttacaatataacccaaaatatgctcatgggactagtaaatttcaaatttggttggcatcatcatctctgcctcgtagatatccagaatgctgagtaagagctgtaacagtgctatatttatgttgaggaagaggtgtctgacagctgctggggaaggaactggacaaacagtaggcaaatataaaacagaatgtgctgtgtcagtttgggggcaaaagcattgtacaagaacactgatgatgttaacctttatagaactaatgacaaattacctgctgatttttaattgggatttcctttttgacttttaaaaatttaattcatatgccaacatctttctgtttcatacagatttagccatttgatgtatttctaacatttaaaaataacatacttctcttaaactcaaaaattcttcaattaacacaataattgctaagtaactaatcacacattcaattgtaatggtcttgcttgaattttgtaggcagtatgttctgctgattccttctgttctacaagaaggctctttggataaagcttgtgcccagctttttaatctcactgaatctgttgttttgacggtctccctcaactatggtgaggtccagaccaaaatatttgaagaaaatgttactggagaaaatttcttcaaatgcatcagctttgaggtaaatacttctttctgcttaatatagaaaagaatattacaggtgcatgaacaccacccacataactgattttttagggacagagatcaggctatttgactgtatgtgtaaagttattttaatttttaaaagaataatatagtcctcagtatgagatgatgttaagtacagtcataaatggtaacaagggcaagagccaaaacatttgattttatgatagaaaattgttgaagggaataagacatatagaaagaatgactcttgtgcagaaaagggaagttttaagaaaggcaaaagaatccatttaaatggtgagataaggaagtgacaaagcaagagaaataaacaaggttggttattgaagaaatagatatgacaaattatgaattaaaacttttagtgataccaacacacagtgatagagatttcttaacaaaaaatcagtttcatggagtatttatttgttccctaggttcctcaggccagatctgacccactggcatttattacattttctgctaaaggagccactctcaacctggaagagaggagatctgtggcaatcagatccagagagartgtggtctttgtacagactgataaacccacctacaagcctggacagaaaggtgagtgtacctaaatcaggttaccctcaactaatgtcacttatatgatatttgaattgatggtacacaatacaagctcagaaattttattgtattaaagtttattagagaacctgcttaaaaatacaaaataaaaatatagattacatagcctaaatgttagagatttcatttccatgagtctggggkggggagcctcagaaagtgyatttttaaagagcaccttattctattctaataatatccatattattctaataatattctaataatatccgtattattctaataacattctaatcacatatttggggattttgaatttaatttacacaaacttacaagcttatggttgaaatagaaacaaaagagcaacaaagtatgtcatgaacatgtaatgagatacccctagtgactagagaattgcccaagtaatagaatgatcagcatgatgttgaattaagctgaaaagcctcctctctcctcctgggtacagaaggagttgatgaatacagattacagcagtcagaagatagacatttctgatgagatgaatggtacataaaaaagcactgaggtagaattaatttaaaaaccatgccgtaaaatgagaagtagatagacttatttggagtaaagaaacccaaatgtccatcaatgatagattgaatgaagaaaatgtggcacatatacaccatggaatactatgcagccataaaaaaggatgaattcatgtcctttgcagggacatggatgaagctggaaaccgtcattctgagaaaactattgcaaggacagaaaaccaaacaccacatgttctcacttataggtgggaattgaacaatgagaacacttggacacagggtggggaacatcacacaacaaggcctgtcgtgcagtggggagagggggagggatagcactaggagaaatacctaatgtaaatgacgagttaatgggtgcagcacagmaacatggcacatgtatacatatgtaacaaacctgcacgttgtgcacaagtaccctagaacttaaagtataataattaaaaataaaataaaatgtgatataataaaagaaaaaaaaaggaaggaaaagaagctgcagtgaatagaagagttaaaggaaatccctgaatatagaactaaagaggcattttcatgtagttaagtaacacccatgaggagtcactacagatgtggggatcatggcttgaggaggcagtcgtggatgaactgggaatcacagtaatcagagcctgcttaggcaccaacacactgtgatcccagaacaacacaagcagagggaggtgagggatatgtgctggagatggaggaatgcactgcatgcattgtgctatccccagccttccactcctcttcccctgaccctttgcctccctccctcacttcacaaaagagggcattcaggtcagtatttaggcaccagagaaagaaggactagacaagaaagacagggcatggctgtacagtttgggctggcaccaacaacggtggaacaaacattacgagagcatgcatgctggcgtgggaggtgcttatgagggggaagagtatatgtgcttgacacaagaggatgtccaaggaaggcttctaggattcttgctaaggagagctatagaaggcagaggtggggaaggtggctgctacttcaaagagcacagaaacattaaaccttaatttaaaattgcttttttaaaatttcttatccatccacagtctagtaaagagtctaatgcacagaggaaaggttataacatagcaaagaaattgagccaggagtcttacacaattgagagatattcagttttcaaaaaattgatcattacaatctgagattataatgctacaaatattcataatctacycagcatcatgcttctttttgaataaaaatatggtgtgatattaactatgattgctaaaacctcattgcacagtttattgttgcttcatatttataatgcartatattaactactatatagtggcatgaacaaaatatgaaaaagcatagtaaacagataaaatagaaagtgagaccagactaayatggtgatggtagtctaagacagtatttcagcagaagactacaatctagctagcgacaatctgagaaccaaggcgatcaacagtgaaaactgtcaaaagacaacgaatyatgacctggacttcagtctttacaacaggatacctgacaaatttcatttcatgtagtttagaaacctgttagaactaagcattcttttgtggtctctcagatcaatctatcaactgagcgcagttacgaagaagcttctgaagcttacagaagctgtgcagatggtttctctgttagtgccttttcctccctccaaattgtacttcatccttaagacatcgtcacttttaatccacctcctttccccatcttctatagttatgctacattcactagactgttgcttaattttaatttccagagcaggaatctaatttttagtgctccaaagaccttgtagtaatctaaatccgaaatcacttcngtaagatagcatgtggttcctgttctccttggttcatggttgaagcttctatttctaagaatgcaactcctctatttaaccaangcagtgagaatttctactgcaatcctttgacaatcatccttgattggaagcaccatggggaagtaaaggncttcttgaaaatcaaagcagctgcagcattatcataactcccttattagttctcaccccccgaatgttgacttattattgtcaattaggccaaatatgattanccaactccctgctttagtaataactacatttgcataagaacaggattaatggactgttccctcaaatatgggtcatagataagaagatcrtttgtaccaaatgtttatggcaaggagtttccatggcacaacaaactgcatgtgcttatgtatagagatggaaattgatgtagcatttccaaaaatgatggcagctaagagattatgtggttttatctttgcaagccagtgtttctaattgctggacattatctggttcagtattccatttagataaatagattcaatgcatggctggcctatgagatttgggyattcataataaatttgactacataataaaaatatagtaatgatgcaactgggctcattatcaaatgagccaagatatrgagcatatacctagtttcttctgcccaaatcytacatcggtcttttctttcattttctgcaatttcattgctgatggtgcctttcttttcctttaagtcagtgttttgtagartattcaaacatactttttccagaaagtttcatttgcatcaagaagtttcagatctttctttaaacttatcttaagacctggaactactagtcctctaaaaagaggccctgtgtatggacagggagagatagtatgaaccagaaggggacatgaaggagttgttgtattggttcttggctggtttatacaagatttagtgcagacagtcattagtgactasagcagaatcagcctcattttaataattgtttttagagaaaaatcaagcagcttagaacaatgaaaatgtgattttactaggttcttgttcactagttttttgaaatagaccaagctgagtttaaaaaaaaatctaaaaaaaaargacaaattaagtaataaaaactaaatttgttgaacacagttgaagccatctgcattggaagtattacaaatagcaaacaaaaagggatagtactctaggttcatttctcattattagaatctcatccaaatggttaacgtcttcccatggcacctttgggtaatatawtcattttcttcctatgaggaaatctcatgagaagctctacctctcttaatgcttgagttaatgttgcagcagtagctttcttcaataccatctcaatatttcatcaagattcaattccatgaatttagaataacaagtaggcccttaattcaactgttatatttctcagttccaagaattctggacaaggtttatgaatcctgttcytatctccagacacattacgttttattagtgaatgaatgctgcaattagtgggaaggagcacttagcaacttggggagtgggcaaaggaccctatgtactcatttttaaaattctcatcagcctattcacatgagggcttctggcctaggagtctttaatttcaacttgttagttttaaggtcctgagagaaaacactaagagatgaaagtcaaactgttgactataggtttagagggggcaagagtggtaaacatggagagaactgagaggagatacagagaggtggaaggagaaggaagaaggagaggaaactctgcaagggaaacttgggcaaatgtctacrtttatttacttgtctgataaggaaatggtggagtataggaatggccaataatctaagacaaaaamaattagtgctagatacagaaatcaaaattgaagcatttcaaaaagaggcaaccagcagtgtaaaacattgcaactgtcagagtgaagactgaccacgaatttgttgataaggaagttatkattcatctaagagggcatttttattatgttggagagacccaagggcaggrttgcttactgagactgcagggtgtatgttgtgaaagagagagaagtaaatgaaaattcttgaaaactaggcagatgagtttcaatataatcaatagatattcaaactttcagtcagaaatcagtatttgtttgggttgtcctaaatgtgtttatgtttctttgcttmataatagatttataattaacctcttcactcatctagaaaaaaaaccttgagttcatatattaacattatttttatttttatttcagtatccagtgatcacccttcaggtaagataactaatagttgaagaattgttttctcattttttgaacatctctcyaaacctcaaaatcaaaaggcagctcacagggaagattgtctatttaaattgtygcagaattattaatttcatgyagacagccycaagaggacagaaataggtttccacccccaccaccatgtgattcatattagcatgcacccattaatacagacaataataatatagacaacgggcaagtatgattgtatttaatttaatgtttagttgttgaatgtatataaatgtacacttaatgttttatgcactggggataaaatatggctcgcctttaagaaatcagagattgacacagaaaataaatgtaaaaaaatcacagctagctctaaaatatactaagtrctgtaatatgcatctatgtgacctcagataggagagtaaccaattctccttgggtgatgtgaggacgcactcatgttttgaatcctaagtaagttggaaacctaagtaggaaacaccttgctgaaactttataatgaataaaaacatccagcatgcaaaaatacgctttcttattctcaggatccagaaggcartcgaatacaacagtgggtgaatgaggagtctgtgggagggattctacaactctccttccagttaatctcagagcccatcctcggatggtatgaaatcaccrtggagatgctcaatgagaagaaaacatatcactccttctctgtggaagaatatggtaaataatagcaatgaaaatattacctatyaataaaaaaattataaaatmtttccaattttgcaagggcargattattaaataatgaattttcaagtgagtatctcttcctttcctctttccttgtcctctgttactattttagggttctccatctactgtgatttttatctcctagttcagcccataatcttcctgcaattctctgttaacctaggctatctatcttccttttgtagtatctggattctattttatatgatagtttctgggatgtaaagcacttcttatgagaagaatggaattaacattagtcatatgttagccattagtcccttcatattttctcctaaaatcttcataaaatttctattgtagtatctttattactattttaaagatgaagatattgagaaacactttcccaagttcaacacctgaraagtgatgaatttggaattcaaaatatgcatttttctatccaattccaaaatccagtcttaggcacttcarcgtcctcctcacactgtttattaatggcaaacataagcaaaggttgatggtttgtaaaggagaaacaattgttttgtatgaatgtatttatgttaatatgtatttatgttaataatatataatatacacattataatataatatatattttttttttactggcagtgttacccaaatttcaaatgactgtggatgcaccagaaaatatcttagttgtggactctgaattcaaagtgaatgtctgtgccttgtaagttgaaattgtacacaatagaataatgtattcatagaaagatattagaatgggatagatggctaaaaagaagtaaaatataaatgtgtagaaggtaagggaaaaagaaggtgttaaattattttgctgattttatgaattcttccatgcatctataattcttttaatgcatgttatgacacgtggttttatgtaacagtttaagacaactgactactgtctttcttacatcataagataacatattgttttgcaccagccaatacagtagccgtgaccacatgtggttatttaagttttaattaaaactaaatattcagttgcgttagccacatttcaagctgtcacatgtgactagtggccactgaattggagagcatagacataaaacatagaacattccatctcccagaaatttccattggacaatatcttctgtttatgatgatttctcaattcaatctttatgtattacatgattataaaagaaagctgaagctcaagatgtatcacagagaaaactgctgtaagagttacaagtggctctagggtaatggcggggcacagtgtggaggatactaagggcagacagggacttaggggcaaatagtgaggattaacgtgtggcaggagtagcagtgaagcaggtcaggttgttttcccctcttgtcactaagttaagcaacattcacagagtttatataaccagcaaagagagccagggtgcaaacattaaaactttgtctcctcagacctgatgtgtactacttttccctgactcatgtgtactacttttccttttaattttgcataattaaaaataaaaaagtgacctggaaatttctagttattaggagagcttcactacagtaatctaaaattccatgccaaactttaaggtgaaagctttgcctgtcctccttcctgtgtctactttaggctggaagtctttaagagtcaagaagaagcatggctaactttttgatgtcactaccttgtgcttcacctccagagttggaagaatacagaaaaggcagagactgaaaagtctcattgtagttgggtcataaaggcagggaattgccagcattgctggaaaatcccctgagtaacagaaatccccaaagcccaaatgtctaggtacttccctatcacagtggctgtgtgttggctcctgtgtcatttttactggagaagtattgcataagcaaaataaagcactctaggacaagccagctgggaatcccaaaacataagcatgaatcactaaatggttgaagattctaatgacttgaaatcaaggtattatataaacaaaaaaaagagcaatatatacctgagaaaactgttgaacatcaatcagaaaaaaatttagaaataagtaaaatgtgtatactcagatatgagtcaatagtgtaactttaaaaataattaaagaccttggaagtaggcatattattaatttaaaaatatatgtgtagaaaggctgactagaaggatcgatgatgcttaagagagaattagtaatttggaagatgaaattgagaaattgtcataaaacgtagcccagaggaatctactgttattccttacaagcaattttgttctttgctctttctacctatttaaaattttttaaattatactttaagttctagggtacatgtgcacaacatgcaggtttgttacaaatgtatacatgtgccacgttgctgtgctgcacccattaacttgtcatttacattaggtatatctcctaatgctatccctccccactgcccccaccccacgacaggccccagtgtgggatgttccccacccggtgtccaagtgttctcattgttcagttcccacctatgagtgagaacatgcggtgttcggttttctgtccttgcgatagtttgctcagaatgttggtatccagcttcatccatgtccctacaaaggacatgaactcatccattttcatggctgcatagtattccatggtgtatatgtccatctatcattgatggacatttgggttggttccaagtctttgctattgtgaatagtgccgcaataaacataagtgtgcatgtgtctttatagcagcatgatttataatcctttgggtatatacccagtaatgagatagctgggtcaaatggtatttctagttctagatccttgaggagtcaccacactgtcttccacaatggttgaactaatttacagtcccaccaacagtgtaaaaatgttcctatttctccacatcctctccagcacctgttgtttcctgactttttaatgattgccattctaactggtgtgagatggtatctcactgtggttttgattttcatttctctaatggccagtgatgatgagcattgtttcatgtgtctgttggctgcttaaatgttttcttttgagaagtgtctgttcatatccttcgcccactttctgatggggttgtttgattttttcttgtaaatttgtttaagttctttgtagattctggatattagccctttgtcagatgggtagattgtaaacattttctcccattctgtcagttgcctgttcactctgatggtagtttcttttgctgtgcagaagctctttagtttaattagatcccatttgtcaattttggcttgtgttgccattgcttttggtgttttagacatgaagtccttgcctatgcctatgtcctgaatggtattgcctaggttttcttctagggtttttatggctttaggtctaacatttaagtctttaataatctgtcttgaattaatttttgtataaggtgtaaggaagggatccagtttcagctttctacatatggctagccagttttcccagcaccatttattaaatagggaatcctttccgcatttcttgtttttgtcaggtttgtcaaaggtcagatggttgtagatgtgtggtattatttctgagggctctgttctgttccattggtctatatctctgttttggtaccagtaccatgctgttttggttactgtagccttgtagtatagtttgaatcaggtagagtgatgcctccagctttgttcttttggcttaggattgtcttggcaatgcgggcttttttttggttccatatgaactttaaagtagctttttccaattctgtgaagaaagtcaatgttagtttgatgggaatagcattgtatctataagttactttgggcagcatggccactttcacgatgttgattcttcctatccatgagcatggattgtctttccatttgtttgtgtcctctcttatttccttgagcagtggtttgtagttctccttgaagaggtccttcacatcccttggaagttggattcctgacttcaaactataccacaaggctatggtaaccaaaacagcatggtactggtacaaaaacagatatatagaccaatggaacagagcagtggcctcagaaatagcaccacacatctacaaccatttgacctatgacaaacctgatgaaaacaagcaatggggaaaggattccctatttaataaacggtgttgggaaaactggctagccatatgcagaaaactgaaactggaccccttccttacaccttatacaaaaattaactcaagatggattaaagatttaaatgttagacctaaaaccataaaaaccctggaacaaaacctaggcaataccatttaggacataggcatgggcaaatactttatgactaaaacgccaaaagcaattgcaccaaaagccaatattgacaaatgggatctaattaaactaaagagcttctgcatagcaaaagaaactataatcagagtgaacaggcaacatacagaatgggagaaaaattttgcaatctatccatctgagaaagggctaatatccagaatctataaggaacttaaataaatttacaagaaaaagcaaacaaccccatcaaaaagtgggtgaaggatatgaacagacactgcttaaaagaagacatttatgcagccaacaaacatatgaaaaaaagctcatcatcactggtcattagagaaatccaaatcaaaaccacagtgagataccatctcatgccagttaaaatggcgatcattaaaaagtcagtaaacaacaggtgctggagaggatgtggagaaataggaacgcttttacactgttgttgggagtgtaaattagttcaaccactgtggaagacacagtggccattcctcaaagatctagaaccagaaataccatttgaccagcaattgcattagtgggtatatacccaaaggattataaatcattctactataaagacacctgcacacgtacgtttattgcagcactattcacaataacaaagacttggaaccaatccaaatgcccatcaatgttagactgggtaaagaaaatggggcacatacacaccatggaatactatgcagccataaaaaagaatgagttcatgtcctttgcagggacatggatgaaactggaaaccatcattatctgcaaactatcacaggaacagaaaaccaaacaccacatgttctcactcagaagtaggagttgaacaatgagaacatatgggcacagggaggggaacatcacacaccggggcctgtcgggggttgggggcaaggggagggatagcattaagagaaatacttaatgtagatgatgggttgatgggtgcagcaaaccaccataacacatgtatacctatgtaacaaacctgcaccttctgcacatatatcccagaacttaaaatataataataaaaaataatgaacagttttacttctttccaaaacaaacaaaaagaaattaccccaaaatctgatgacttaaaatgacatttataaaaaataaataaataaatataatttacattttaaaagtaaaaaccataaaatatgctcataatagcagtttaaaaacaaaaaaactaaaagaagcaaaatgttattttatttcattttttgtttttcaatactccattgctatcagtatgcaaaaaatattatttttaatgaaataatgactgatgtatttttttgtttttttgtttacattgtattttagtgacttagatatataacgtctacatgcctatttcaacctttttaattaaaatatatttttgcctaaagcattcaactcaattttagtccataccattgttttagatttcctccagaaaataaaatttatggtaactagctatttaaatgttgttacagtgctggtttcagctactaaataaaggtttcaaaaccctatacagattaaaaacgaccttgacctctgtaattgtgttattgttatattcttctattagatatacctatggtgaacctgtggacgggaaggtccaacttagtgtgtgcagagaatctacggcttatcattcatgtgctcatcttatcagttcactctgtaaaaattttaccattcaggtaagaggtatatcagcaaaattataaataggtttgcgttaactttttatcctcaccttccatttaccttcctttcttcttgttttcctctttacagttaaaatatatacttttattctatatttctattcctatttgtaaattttatattcctcttttgtcatgctaagtttcattttctattgactgacaaaaagcaaattatagtatcagaaactgagtagtaaatttcgattcttaattaaaaatacatttggtttcatatcaaaatctacaccctatcaatttactgggaacatatgtcctgttctttattttatactttgtgaatttagtcagggagatgtgatgtttctgcatattcaagagtattagatgtataattattttcctctcaacctattctcactggaaataagtgtatataggagctccagatgggaaccctatcagtcaggttcttaaccactaaagagaagaatcaacttttccaaact

SEQ ID NO: 17941 - DNA, 19858 bp, Homo sapiens
ttggtgagaggagagtggtattttcctctgggtgtatatggcaatatgtctggtgattagcctggctcagcttgcctcgtctccatcaccaaagagctaaagaaagaaaagaaaagaaaagaaaagaaaagaaaagaaaagagctaaagaaagaaaaggccctgctcccaaggtcatactgaaaagcaattcagcttctccccatgtattaaatgttatatttttcctagtttcctggaacaaagagatctgtagtatcatccatgcaaaacccaagaccgcatgcagagaggttcttaatgctttcaatgatgatttgttgattgatttgcatattgaaattatgaaatttttatccaaaatatataataactcatggattgcttacccatggctattgacagctttgctaatattatgtgggtgagtacttcacaacagaagagaagcatatctggggtttaacttctggttttctcagttcctcagatcttttgggttggcctttggagaatacactcctgctaaaatctgtctctgttctatgattggtgacaaaagcaaagattatttagaaaatggccataataatgatgtctttttgacccctccatagttaatctggacttctcccctccacaggtagtacctagtgctggtcccatcacacctctacactggagttcctgaaaagacctgtgtcatccttaatcacctgaatgagatggtggcactgaaagtaactctgatgtacaaaatgcagaagagatccctcctcacagacctggtgacgaagaggaactatttctactgcagttccttcatggtcagtactgatccttgaaataagggagctggatagagaaagagcacattagctgatacctttggttctaatcctttgaaaataaaaaatgcataatgaaagaaaaataagaagtacagagtgaatctcaatttagattttaagaatggaagttctactgaatatgctcacagcttacatgatatttacaaacagagtgccatgcataaaatttaacagtagttatagaaaggatttaatctgatcttaaacttctgaggtaaataatattcataccattacagatagaaacactgagatttataaagtcaaataacttatctaagatctcaccaatggttgatagtggatgtattgtccttttaatcttttactacttaaggtattaattgtttaatcatatgtagttaccacaaataataacataaaattttttttgagacagggtctctttctggcacccaggctggagtgcagtggtgccatcacggctcactgcagccttgacctcccaggctcaggtgatcctcccacctcagcctcctgagtaactgggactatagataggcaccaccatgcctggatgattttttgattttctgtagaggtgggggtctcactatggttcccaggctggtcttgaactcctgggctcaagcaatctgcccaccttggcctcccgaagtgctgggactataggcatgagccaccgtgcctggccagataatatataatgttgttgacctttgaaaaataaaatttaataattattttaatatcaccattttgctgtgaaaatgcaagcatcccatttcagtcataactggcttgaagaattagctcattttattgcaatattttctccttcaatcatgttactgtcatgttacaacatcataataatctacttttaagacaaggagcattatccttgactttgtcccttactaattctcagggactaaccaggaagacagaaactcctaatggctgagaaattcagaagtaagtctgggcagattcttcagctcatttctgttttacagattccagaattaccatcttcctgggtggtcattgctgtggaggtagagggggcaactctgcatttcacaaagagcaaatcaatatatataactacagcagagaacctagtctttgtccagacagacaaacccatatacaaaccaggacaaacaggtatgaggaatcaaatgagcaaggggaactttgggagaggggaggagcttctttattactttattctgcaatcctgggaattcaggcatgctattactaccccaggctccacggggtgatttcacaggaaaatacctctgtttcagtgaaattccgtgttgtctctacggatgtcaatttccaccctttggatgaaatggtgagtctcgtaatgatgggtgatggctgagggaaaaaggaaggcctattcttttgggaaacttgagaccagttaaagaggtattttaagcccaccacatgaagatctcataagggtatctctgctagaagaataagggatgtcagaatcaaggcactccataaactgcattcttaaaatgaattcagtatgcagttgaagctgtcctcttaaagattccagttactttcattgaataaatgtgtgaatttgatttccctcttaaacaaatataatctgtgaaataataataaacttattattcggacctttttatctaaataggtttcctcaattgtatgttatttaacaataggaaagtcatgacttcgtgaaagatgtatgtcccaaactaaacatacaaagtgctgtgaaccaaatggggtatttcctcatttggaatatagagacttactttctctggcccatatactctgtcagtgctggtgtcatggttttctccttctatattctaccatgtgctcatactatctttttttcttttcagtttccggtggtttatattgaggtaagtggtatgttgtacattacaactggaatgaggactctctacaagttacattaaattgcctctctcccttccctcaccatttcaccaaagctaaacaaatactgtttttctgtccactttaaattctaagtggataacatgtaaatgcaggaacatttcttgagatgatgcaatttagtgactcatccaatatttctgaccaaaataaatatacataataccaaaaagaggcatcagtacgaaatgttatctgtaatatctcatagctagtaaacttattgcccttatctcaggttggaattcctataaaactttgctaatacctttgggccaatttaccaaccatctgtgatacagctgcctatgtcgttcttacccgcaaagctgcccttctactcaaaggtatatatttcaattgtttctatgaactcataatatttttacctataggaccccaggaagaaccaaattttccaaaggcaaagtctcaaattgcaagggggactcaaccaactctctttcccgctatcagtggagcccattctgggttcccacaagatcatgctgcagagagagtcagggaagaaaatacagcactcatttgagatgaatgaatatggtaagaatgctctatgtgtaaggcatttataacgtcagagtatttaagattagataatttttacatataggtaagaatcaaaggtctagcatacaatagttgaaaattagcaagcttttaaatttacccatatatttgctaagtgctttttatgtactacctcatttaattctcacaatgcccctctgggacagatactattattattcccattttgcaaatgagcatatcagtactggaaaagttagtaacttaaaaaaatcacagagtcattaaggggtaggaaagatttgaattgatactcaaacataaattgttatccaatacattgtgtcagctacatacactatgtatgttttttatattttataactgaaagtatttccagggattattttatggttgtctataacctacacctatactactctaatcaactatgattcctaaaccatataatttagtaatcaactaaactatagttcaactaagtatggtagtcaactaaactttaacacaattgatctagtcagtactcaaccatagttgattactaagtcagacattgaagccatcttattagttatcagttatgtggattttgtaatgtaaattaaatattttatgccatggctgagaagtcctatcacaaaacatggttcccaaaactcgtcagaactgccatcaaaatcacagaatagtattatattgtaggaataacaccttacaaaactgtgagagaagctagaaaagtaagaggccatcaggaggagttgacaggtgagagaaaattactagccagttctgaagcatgattaggggtgtataaatgtgagcttgcaaaggtctgggaagcgagggaccctcagctgcccaagtgcaccaaccatgcagaggagctgacagaagaatctgtggaagattattacctctgcactctgcatagctaccactttagtaggcttatagccaggtgtcagatgatgggcctcagacctctgttagtcagcagggctggcatttgggaagaagagctgggcctagggagggaaagaataagaatacattgaaacctattggtccctctttaccacatctaactgtgatgatcttcagggactaatcatgctgccttccctctatctgggaaatctggcacaaattcagagaaagagagtctagggaatgtattatcaagttaaccaagtgaacatagtacaaactgctcatggtaatgaatggcttctccttctcagtattgtccctgggctccctgttgtagctgaagtcatttcatgtgaccacatgttaaaggttctgtcatagcatctactaccaatacttgtaagatctctggcccactctcacctttttttttcttttttatcaaaacagttttgcctaaatttgaggtccaagtaaaaatgcccaaggttattggttttctagatgaagaatttgtgataacaacctgtgccttgtgagttgcatttttttcatctcatttctatttctgtactctatctgaggggaggtattgtaaataacagttactgaagttggaagtgttttaattaggagaggaatacctctctttgtagcttgcctaagctcacagtagggagcaggtacagtagcagatgacacacatctgctaatcataaaatcatttactggacatttaaaatgggccagacaatgttctaattggcttgtgtgtactaatatttttattctgtaagtaatcctataaaaaggagaagcttggggaactgaccctacaccttatctgccccatcatttgggctaaagcaataggtttcaaacgtcagtgttcaacagaatctatggggtggggagtgtgcttacttcaaatgcagattctctggccccatgtccaaagattccaatcatacatctgaggaaagtctcagaaatctgcatgtcaacatgtatcccagatcgtttcaatgctggtggtccacaaaacacgttttgagagacaacaaattagttatggctttgtgtcatttccttctatcatattaggcagagtcaaactgagtcatgatacaacatttttgttttatagctactacttttccatctaacttcacatttattttcttaaagtacctataaatcaaggagaactcagaaatacactctctacatagtcttaatatgttgccctaagacaatgtaggaggtgttgtcaaagctggaatcatgacctagataatctgacagcagagaaagagggaaataggaccatcttatagtaaaaccgcaactaagagggaagaaagatctgagaaaaactaaattggtaattttccatttggagctgtttcaaaaagattcttccagtactttttctgagagttatggacaattaagacacggcctttcagaagaagggtttataaaatggaaataatatggaaggtaatacaacagcttaaggtggatgtatgaaaggatcaagtcagttgaagaaacatcagtattatttccattaagtagcttttcgcatggccaccttattgttataggtacacatatggagagcctgtccctggtctggtgacacttagtgtatgcagaagatattcactatgccgttccgactgccacaacacacattcacaaagtatctgtgaagaattcaatcaacagktatgtggaaaccactctsctcaggacactaataccaaggttttctcttctcatggattacaatagtgaatacaatacaacagagaatagtgtttgaaatacccatcaagcaaaatggtggagtgggggaaaattgtaagatggtctggcagtgttgggggctcacttgagggttgggctcgtgggtatctagtggtatttatctggttagtttggtaatgtccttccaacggcaatccaaatgccagatataagggcataaaaggatgtggaaggatccagagttgtcttttatcaaacagaaaacagaaaaatgtgtgtggcaggtgttaagaatttggctagtgggagaatcaaatggaatgtcgtggaaagtaaactgcgctggaggaatgttaaaccrgtataaggctgaaggaaggaagrcttccaaggacaatggattagatgcccaaaacacgtcaaggaagaagtggaataagaataattaaggggaacagctgaaagtagaatgtgatgtattaaaaaataaaaggcaaaaattactgattccagaggcagagtatgtaaaaagtccagggtgtggcagtatgagcagaccctgtaagggtgacgcagggcaggtaagctccsaaatggggttttagcccaagagggttcttttcttcacccaggaaagaattcaagggcaagccagaggtgttagagacagcaacgtttattgaagcagcagcgtacagcagcagcagaggtactgttccttgcagagcagggctaccccataagcagtgtgcccayagtagcagctcaaagggagtactgcagtcatatttacacccattttagttacatggaaattaagaggcagattatgcagaaatttccaggaaaaagtggtaacttctgggttgtcaggccattgccatgraaagaggcattaacttcgggtgtcgccacrgcaatggtaaactgacatggcacactggtaggcacgtctaatggaaagcagccaccctgcatccctgttttagtaagttctcaatttggyccggtgtctgagacctgcttccaaagttgagtcccacctcttacctcaagggtatggaaaagaaagttatcaaagctgcagagagcaaatgaatgagaggccagagtaacgaatataataatgaacaccaaggcagacactgacaagcaagatactataagaggaatctagctgcccaaatctgtaatgtatcagggagactagtattaacttctgttttcaagtgagtcatgacatacatctatataaaaataaattaatatgattaaatttattatgcaataaagattttcttataaataaatttaaaatgaaaacaaatctttattaaaacatgtaccccaacatttagtttgaaaacttggttatggtgaggattcatctatttaataaatgtatatattcctattaatatcctagatattgagaatatacagttaagaacataacaatcctggctgggtgcagtggcttacacctgtaatcccagcactttgagaggctgaggtgagaaaatcgcttgagcccaggagtttgagaccaacctgtgcaatatagtgagacccctgcccctataaaaaataaaatatcagccaggtgtggtggcacatacctgtcgtcccaaccactcgggaggctgaggtaggaggatcacttgagcccaggaggttgaggctgcagtgagccatgatcatggccactgcactctagcctgggtgacagagtgagactctgactcaaaaaaagaaaaaaaacaaaacaaaacatagcaatccttagtcaatatttataggaatgaaagccttctcagaatatgttatgtctgagttaagttttgaggagcctaactgttggctacggtaagaatgggaaaaagagaattatcatttgaggaacaacacatgcatagagatagaattatgaaataccatggcacgtttggaaactctagaaagttgaatatggcagaaatggaatcagttttcagaagagaggggagaagccaaaggttgataatgaataaatcaatgatgaacgaagaaactttatgtcattcttgggcttgggaaaagataagcaccaaaagratggtcagaacatttgttacatttatttttatggccagtaaaaaaattctcataaattgacagctgactttttaagtagcaaattggaagacctgagaattctctttctttctcttcaggcagacactgaaggatgtttcacacaacttgtaaacactaaaatatttcagctgagacaaaaagagtatgacatgacgatacatgtcaaagcgaaggtcaaagaggagggaaccggtttgtattatttttaaatatttattaatgtgatacatatttatcaaacttccattccatgtaaaacactttatagtttctggagattatgaaaataacacggtccctgccctcaaggaattaggcacctaaaaatagaaattaagtgtgtgtgtgcacatagccataataaaatttctgcaagaaatacaaaaaagggccaagtgagtatgaagagaggtaattaattctagtataccttctagagcccaaagaaaaccttattgctaaaatagcatttcaactgatttatatagggtaggtaatactttgaaagattaatgatggaaagggaaaacgtgataagcatcaaaaactatgatctcagaagaatctgaaaatggaggctggtgctaagctgtggagaaaagtaaatcatacactaaagagtttaaatttattctgaaaagcttggatatctttcaatatatttgagaagaatcgtctaaataaattgatattcttaaaaggtaagtctagcagacctgaagaggataggctagatgaaaaaatgtgctaccatgtggtacgtcagacgattagtcaaaggtgaccccaaagattccaaatttggggcctgggaaatggaaataccattaaccaagataatgagtcaatgaaaaagaactgttatgatgagatgtgttaaaaataattttttttttttgagatggagtttcgctccttgcccaggctagagtgtaataactcgatgtcggctcactgcaacctccacctcccaggttcaagtgattctcctgcctcagcctcctgagtagctgggattacaggcatgcgccaccacgcccggctaattttgtacttttagtagagacagggtttctccatgttggtcaggctggtctcaaactcccgacctcaagtgatccgcccgccttggccttccaaagtgctgggattacaggtgtgagccaccgcgccaggccaatgttaaagataactacagcttggaatatcaaaacggaagtggatgtatttagctgataattttaaaacagagccagagttaaattaggaccagaaatgtaaatctaaatccattctcgttgtgtctatgtcctcttaagagtgagtgcggccgggcgcggtggctcacgcctgtaatcccagcactttgggaggccaaggcggacggatcacgaggtcaggagatcgagaccatcctggcaaaacacggtgaaaccccgtctctactaaaaatacaacaaaattagccgggcgtgttggcgggcgcttgtagtcccagctactcgggaggctgaggcaggagaatggcgtgaacccgggaggcggagcttgcagtgagcggagatcgcgccactgcactccagcctgggcgacagagtgagactccgtcccaaaaaaaaaaaaaaaaaaatagtgagtgcaaatgctctgaaagtgagctcatttagcactgctaaatttaggatagagacaggacaaagaggcgtccaaggacagaaacaactgcatttaggagatagacagtaacaaataaatcagcataattaaataagaagccagagagctggggcaaaaacaacgaggataattttttagaagcccctggaaggaagagtttcagtggtacttagtgtggagtactaccgagagttcatgtacaatgaagtctgagatgagaattcgatatggagggcaagtagggaatcttttaagaatttgatagcactgtgtttttgataagaacaagatacagrgtacacatcattgaatggaaaagcaccaggtgttcactatcctttggatagctcacgcagggaaacgacaggtctttctggaaataaagtttgtattagaaattcaagcatattttgggccagtgtgattgtgaagaatccaaccatgtacagaaagttgtggagggagagcagggatgtgagagagggaaaaacaaagatggagcaagatcacagaggagttgagaaaataaagaacataggtggaaaaccagaggaatgagggaygatggataccaataatgtttcatgtgaaggtgaagctaatgtccagttgctggtcaaatagcttgtaaatgtgggaaactggcaagaataaagaaaagagaatgtggatggtattttgttatgatgaagtgaggctgaggaggaagtaggaggtgagtttttaatacatagaatggttcaacttcatttatttttcaggattggaattaactgggcatggatcatatgaaatcacagataccttaaggatactgagatttactaaagtagattcacattacagaagtggactcccctggtatggacaggtaaaaaaaatgtttttaacataatcacaatttggggcatgaggtttttaagaaaatgaagttttaaatcacaaaatcaaaatttatttaaaaaaataatatttcaaataggaaaaaagtacagcagattataatttaaaaagcaaatataatcacaaaatccagaaaaacaaagcatgttttattaacttcctaacacacctctgtaatacatttgtgtagttcagctgcatactctttgattgtctctttataaacaatgattttgtaacataatttttataggaagaattcaaacacattctttcatctagatgattgaattttttattactggtagtttttaaagttgttttccatttcaaagtttcatatagataccaatattgatacattttagagccaataatttagtaaactatccattttctttcatataagagatgcaagatttctaggtattttaaattatattttgtagtaaataatctttgaattaacagttcatgggcaaatgcttcaagctgtattttgaattttatatttgatattttatacttgaattttacattttcttcatttatcctagtatttcatattaaattatcaagaaattaataactatatagatatagtttcatatggccatttcaggtagagagaagatcatgagaaaaactgatgacttgaaaggtgagtatgacatggtcagaaatgtaagataaaagggagaatgtctaaggctctgggtatgaaacagtttttcaagagcaaagaactaaaaagcagccagtgtgatgacagctaaggttaaagacatgaccgaattcactgaataattgcaggcaagcaagaacagttattaaggtcttttaagatatggtaagaattttggattgagaagtgactaatggttttaagaaagagagtaacatgatcaggttagctcaggmtgtatagaatggtttagacaagaatgaagcagcaaggaaatgcagaagattaaatagctactggaaaccagatgggaaaaaatgtgattttaactagaatggtagcagcagatttggagagaagcagatagaatcaatatatatttgatgggagatggggagaggagatagcacttgacaatgagtttgagataagcagtgaaagaaaatgactcattaaaaaaaacccaattcctcagtattcctgcgtcagttayctgatagatggaagacccatatactgaaagagagaacagtggaagtggagaaagtttgggaaggtagtgtgatgatcccacttttggatgttctcaatttgagkccccatgagatatccaaatagaactattcaagattttgagatgtattgcataacaggataattatagtcagtaataatatattgtacatttcaaaataataaattataaatgtctcatctgaaaaagtggtaagtgacgtgatatatatgttagtatatttaatcattccacgttgtatacatatatcaaaacatcacattgtacccaggaaatgtatataattatgatttgtgaatttagaataataatggaaaataaactgccatttagctttcaaaataatttttaaaaagaagtattaaaaagaaaaatcatagtttagagctcagaaaacaagtctcgttttcagattctaagatcttcagtaaatgacagggagtgacctggcggtaaatgtgacggagtggaagatgttattgccatatgacaatttaaccagctatgacttttatatctctaggttcttctagtcaatgaaaaccatcagccaatcaccaacaaaactgtagatgttcatgtgaatactagatactatttcagtgcaactactgatgagcatggtttggtgaacatttccatggacaccaccaactacatatcaccttttctcacartttcagtaagtggaaaggggcatctgggaccaaaaatagagaaattactgtggccagagataatttaaagatatttgagaggcatgtgaactctaggaattaaaaaaaaagtgataaagagtaaaatgtaggccgggcgcagtggctcatgcctgtaatccaagcactttgggaggccgaggtgggtggatcacgaggtcaggagatggagaccatcctggctaatgcggtgaaacccgtctctactaaaaatacaaaaaaattagccgggcgtggtggcgggcgcctgtagtcccagctactccagaggctgaggtaggagaatggcgtgaacccgggaggtggagcttgcagtgagccgagatcgcgccactgcactccagcctgggagacagagcaagactccatctcaaaaaataaaataaaataaaataaaagagtaaaatgtaaattaagcaatatggagacctaaattataaaaagagaaaagtctgccagaaatcttttacttgtaggtaaactctgttgacaatatgatttaggttcaagagacattgaatagatcatcttgatattcctttgaaaaattgaatatttttatgattctaatacaagtaagatcttgcttggtttctttggcatactactattttgttttgtgttgaatattcaaatgttcttatgcaatttgcagccatagcgtgttaagagaaagtaattgaccttgtttgtgaatgaataacatctactaaatcagtacagcataagcttaaatgatctcgaggggaakcagtttacagattctgctatatttaagaaagcagccttcttatatggctttattatattgctttatgtatatatatacaaacatatataatatgcatatttttatatatttttgcaatyatatatatattatatataaaacagcttatttattcttccattaggtcaaatacaaagagagtaacaattgttctgataactggtggcttgatgaatttcatacgcaaacatctcatactgcaaagcattttttttccccaagcaagagttatattcacctcaaacctattattggtactttgacctgtggacaaacccaggagattcaagcacactacattctgaataaacagattctcagggatgaaaaagaattaaccttctactatttggtaagaataagacccactgtagctccttctgattgtgtagactccaaaattgctgggttcctgtctaagtaatgccatttataagataacaataatatattttgtattgtttttgtgctagaagagaagttacttcctaacaaatattaatgctttaatttctcatttatgctctattcaccactgaaacttttagaatttttccttgcagagttccaatggcaacttattgagcaggagaggaaagagcctaggataaaatgtttttagtcaaagagaaaatgttttcttagaactcagtagataaagaagcaaaagctaagaaccatgaactcattcaaaaggaaataaaacttataaacaatcttctggaaaaatattcaattctaattattttacaaagctcatgactggtgtgattgcaaggaaaaggtatattaacaggcagactataaattggagtgatacttttgaggccaatattcccacgaatgcccccaaattgaaaatgtccaaggctcatagttactcaaataagtcattttaagaagaaaaagttaaatatagggaattctgtataagagcattaactataaataacattttcttaattccataaaaaaatagaaaaattaacaataaatttgaatttcctagatttattgcttcctagatacatgaccttggataacttacctaatttcatctggaaagagaaatgtcaatcatctcactttagtcctggagataatattaatacctacttcatgaaattatagtgtaaattaacagtaaattacttagttcagttcctggcatatagagaatgctcaatacatttagtttttttaaaatagaggcaatattagagaatacttatttatactttatatctgccttcactatatattgctttgcataaggtagatgtttgaaatgtttgttgaaaaaatacataaattctgtttacatatttacatatatttattagaagtgataaatattaaataaaataataaaacgttatacaattatatattttttatttaaagtatgtaaagacacatatatgaagatattgaaaaggaagtttagtgatcaaaataacttctaggttggggtaataagattatggttcacaaatatatcatgaatgttttaaagttaggttaaaatgtattcttttaaacaataatgaatatatttccttctgccttcagatcaaagcaagaggaaaaatctcccaatcaggaatccatgtgttatccattgaacaaggaaacagtaaatgttttcaagatttcctttttctttcctctttcatcttgtcaaattctgaacaatttagcaatttggagctattctcacattagaagaaacagtcaccaacctcttcatccaaagatgaagaagctgatgtaataggatgacatactgggtttgctttagcccagttaaaattttttcttcttttatagcattcctacattttaaattttattcctaaactaatacatattcattttatgtctttaatgtcttcaaaaggcagaaaataactgaaaaaatatggaaaataaccacagaaaaattttactttgtgtgcttgtgtatgcattgcctattactactgtaacagattatcacaaatttatgggcttaaaacaatacttctagttcttcgttttagtgccttaaaacaccacttgtatcttctagttctggaggtcagaagtctcactaggctaaactcaaggtgtcaggactgcattcctgctggagcttgaggggagactctttccttgccttttccagcttctagagacctcttgcattctttgcttgcggttcctttctctatcttcaaattcagccacataccatcttcaaatctctctcatcttcctgtcttcctcctagaaagacccttgtgattacattgggcccacttggataatccagaataaacttcacacctcaagatccttaatttaatcatttctgcaaaggcccttttgccatataaagtaacatatgcagaagttttggaaattgagtatcttcaggggccattattctatttaccacaatcttcccattggccccagagattcatattcatccctcatgcaaagtgcattcactctatccatcataacattaacataagattaaaagctcacagtctcattagctcaaaagttccaaatctcatcatctcagtcatctaaattaggtgttaatgaggtcctggacataatccatcctagggcaaaaagagtctttagtcccaagaagtgctgatatctggctaggaaaacagcatagttttaacacctgggaataatcctctttaattcatttctctattgtctgggctcaaggatccactcatgaaatcatttgccctttttcatgaaggatgtgtttgcagctgaattgttttatcagatctcgtttcctgcttgcatgatttgagaggtctgatattcttcttttattctatactctctctgtcccttttagttgaagctgacaatgtttctattagtataaacttttcaagaaccatgtaggtctcctgtgtgtcacagagattcattccgttaaacaaaaagccttttcattgacatttgatggataattctatctccaattttggcttttgttgtgatgggtaagggtatctaagagtcatgcacttaatattttcgaagagccctttttttgtggctaaattactctgacattttaatttttctgcaaatcaagtctttagcaaaaagttgtccagtcacatcatagctttttttctagagcacaatttcctgacagcgaatgtcttaattttaccgatttttgcaatttagataagctgagaaatttccgaattatcaagtcctagttcatttttgatgactacttcctcattcaatttatttttctcctctccagttttgttataagcaggaagaaggaagcacttttctataaaagctttaacacttttctgtaaaagctcctccctaaatatctgaattcattaatatttggtatttctttttcttaaatattttgttgaatttaccagtgatctggacatagaattttctttgtgagaagattttaaatacaaatttattttctttaatgaagtgcaaggtaagtttgctactactttagttaattttttggttgtgtatgtcatttaaaatcttgtctatttttctaaactgtctaatttattgacataaaatagtccataatattgttttaaaatatctgtaatttctatagtgatagaagctctttcattcaagatacttataatttatgtcttcttttgatcagtttggctagaagtttctcaattgtactgatcatttcaaacaactggtttttggtttaattgatttttcttgtttttttttttatttttatgtcattggtatccactgatctttatcaattaaagattgattttaatttagtcttctttttatactttcttcatgaggatgttggggtcattgattgagacctttcttctttactaatacaagtgtttattgttacacattttcctgttaataatgctttagttgcatcgtttaatatttacatgtgaaactttcattttgaatcagttcaagatattttctactttcttttttgatttcttctttgaaccatgagttattcagaagtgtgttatttagtttctaaatgggagatattttagagatctttctgttactgatttctaatttaatgacattatgattgtatgactttaattcttttaaatttatggagacattttatagctcagaaaatatggtctatcttgataaatgttagaatgtgtattctgctgctattaagtggagtgttctctgaacgtcattgaggtcaactgggttaatagagtttctctatcttagatcacacttttcttctttatttctttgaatcataaatatctttatttatttatttatttatttatttatttatttatgtattttgagacggagtcttgctctgtcacccaggctggagtgcagtggcgcgatctcggctcactgcaagctccgcctcccgggtccacgccattctcctccctctgcctcccaagtccctgggaccacaggcacccgccaccacgcccagctaattttttgtattgttagtagagatggggtttcaccgtgtcagccaggatggtctccatctcctgacttcgtgatccgcccgcctcggcctcccaaagtgctgggattacaggcatgagccaccgtgcccggtgcataaatatctgttaatttctgttatcctaggaagaatgtttaacatatcataaaaagataagtaaaaatatattttttttacaaaagataagtacagctggcctatttacttgttacctcttgtccccaagttgaatctcataaggaaaaaatagacttctttttgtttgtttgtttcaaattttgaaacaaaattgaatatttatgagctatcattgactgaaggaacttttattaacagagctcaaataaattttcaaataaaaattgatttttaattagtcatctaactcaactatttacaacttttcctttaaataatcatgtaaagtttgattaaaaaacttttttttttttttcgagatggagtctcactctgtcacccaggctggagtgcagtggtgtgatctcagctcactgcaagctctgcctcccgggttcatgccattctcctgtctcagcctcccgagtagctgggactacaggcgcccgccaacacgccggattaattttttttgtatttttagtagagacagcgtttcaccgtgttagccaagatggtctcgatctcctgacctcgtgatccacccgcctcggcctcccaaagtgctgggattacaggcgtgagccaccgcgcccagcctaagatacctttttaattaatcacgaatttaagtttgatttcaaaatattaatgtttgtttgtaattttttgagttccagattagcctcttaataaatttcctgtaactctacttctagatgaaaacctttttttcatagactttctcccagtctttttgagccagaaagaggcttctaaggtcatgataaggatgcagtacccacactctaaaacgccactcaccataggttcttcttcggtctgtaacatctcttaggtctatataatctcttactgattgttttctttctgcttgaaataaagcacaaaatttgaatacgttcattcaaatatgaaacattgactctaaatttccatttaatccctgattttatgttattggacattgtattgatttttttagagcaggtaaggttgtctctaataacatatgaaaaagtcactgcctcacaaagcagtatcttcaaagtttgtttctgcagtagagtttaaatcctgtatggattgggtcctaaggtggtgggatgggaagaagaagtgtccctctctttaagaaaaaatatacttcattttatttaatgacagctatgtaaatgattgttttgactttgtctttgacatttcggaaactcagtgaaaaacttaagtactctagtgtaataaccatttcattgcagcttcctaataaaattaactcctatgtttaaccctgcttcagaattccacattcatttggctttcgtcttactgtttcaaattattttgactctgctgtttctctgtattttcatgaaagctgccctcaaatcttttatagatacaggaagggtacaatttttaaagaataattttatgctacaaagatcaaacttagaacatttatgaaaataatcaagtggaatgttacataagctctatgtagttcacacagaggacaaccactgagatgaacacacagaattctattataaa

SEQ ID NO: 17942 - DNA, 58038 bp, Homo sapiens
tggggagtcgaggtgggagcagccctcaagtgtctcctggggtcccctctcccaggaggcctcccaggctcatctgttctcttgttccttcctgctctggtcgtgaggggctttgctgtcacgcaggtcaccttgcaccctcatgtctcagtgtccagcgctggctggggaagggctggctgcctctcctgaccctgggctggggtgataggtggggaccccttggggtgacgtgggaacctcaccactgttgaaggccacagcttccccttcccaagccccacatgggcttccccttccagatctcaatgtgttcctgaaggtcacgtggctggcagggggtggtggtgggggtggggggtgacaggagagggggtgttttggagggaggcgggtggggcacgctgttgtgtacaaacacccacctcccacggcacaggggccggaagtggccccagaatagaatgtgctgctttcaagttccaaattgggctctgggggtgagagcaggcgactctggatgtaaaaatagaaaagccagtgcgtgcgtgggtcctgggtcctccacccacaggcctggtattacaaaatagagcttcctaatgggacctgcctgacactctcgttttatgtagaaaattgactcaagcaaacctcagaggacagagccagcagctgacctgggctagaggtgtggcagccaggcaggcagggcaggccctcctggggagtgctggtggcctgggggcgctggctggcccttgacctggcgtgaactctggctctatttccctcactctgccctctagcgctgtgcccctgccaggagagtcctcccaggttgtgggagcccagctcagtcctactgtccccaaagagccttcgccgacttcgtcagcctttaccagctctcaggctggccaggaagccaggcctgtcccaggcacgaggggcagtgggcaagctggctgtgggccccaccctccacaggctcactgagggcagctggccagaagcccacaggctggggccacccactgaggatgttttctgagcagggccccgtgttggaccatcctggggaccagagccactggaagagccctgacctcaaggcgccccagcctagggggtgggatggggtggtgaggaaggctagttctgggcagtgtggtgggatgtaggtgcacatctgggcatgactgtgggggtctggggaggtcccctggggtaatgctactgagctggctttcccgggatgacgctggagggcagtggaggcagaggggaggccagtgtgcagggcactctggcgtggggtctggctgagacctgagcgggcctccatgcttccacccctcaaccagcacacacgtcctaccatcccacccaacctccactgctccccctccagccccaggctgctcctttccccttcattcggtaaaggagaaaatattccccatcccacccagggcaaggcgtgaggcagccaggcctggcctgggatgcagagatggcccagagcctgggaggggccactcctgtccagcctgccctccctgccagagtgcctgccaccagcccagcctcctgggagagatgccagcccccagccctgtcctcagagccagactgatgcctgcgtgtgaggcccagcctgcctcctcaaactcctcttcccatgagccacaatcctcccccacaccccctctgcccctccctccagtgctgggctgtgtggccaggggactggactgtgtggcaggatgactccacacagcctcccccagggagtggggattgggggaggtagggtgggaacctgtcccctcctatccccagggaagcaggtgggaagcctgtggccttggccctactcaggaattgcctctcctagcgaggcggcctggtgaggtggtacactgtatcactgtggggccactcctggggacagggacaggtgggagggcagggtccatgcttccaaggtcctctggacacgggacccaggtggcagctccaaaacctggctaggatgggcgcagtggctcatgccagtaatcccagcactttgggagctgaggtgggtggatcgtttgagcccagtagttcgagaccagtctgggcaacatggtgagacgctatttctacaaaaaaataaaaaatataaataaataaaaattagttgggtgtggtggcacatgcctatagtcccagctgaggtgggaggctcacctgagcccaggaggttgaggctgcagtgccactgcactccagcctgggcaacagagtgagaccctatctcaaaacaaaagaacaaaaacaaaacctacctagccccttccttggggctgccccttgaggcctttgtctgttcattcaccaatcatgcactgggagtctattttgtaactcaggtgccctggaagcagagcccagaccaagggaagcgaggggtccaggcacacccgccaagggtgatctaggggcaggaatggcaagtgcaaaggccctgaggtgggaatgtgtctgcggtgctggaggagacaggaggccagtgtggccaatgctaagcggggctatggagagagaactcagggagcaggcaggtggcacaggctcggtctgggccctgcccatgcaaggatagaaggcatttgccttgggggaggtgggatctacagaaagttctgagtgaagaagtgacatgacctgactcacactgtgactgcacccctctggtgtgatgatggacactgccaggcaagcgcaggagagggaggatgaggcaggcaggggctgagaaaggcaggattccaggtgtgctttgccaacagaaccttcagggcggacgggatgtggggcgagcagagaggcatcagtgcggacgactccagggttgctggcccagggaaggaaaaagagacttggcaggcgcatgaagccccctgctgggacgcctgtgacacgtagaccagcggcagatcttgccctcgccatcctaaccgtcagcctcaccctcagcaggtcctgccctaccccccagacagcagctgcctctgcctgttctgggtcctgccaaatcagtggcatggccgatggcacacgggggatgggtgtggcgggggaccggcccccttctctttggccttattctgtgggtgtgattggggcatcaccatgggcttctaccccggatgtgccctgtggaggtctgctccccagctccctgccggccaggggtcctcgccttacctctgctcacctgccctgcataccctcccagcaggcgaggtcatcctcctcacccatccctgctctgtcagcctcagcggaacccctgggtgcccagaggctctggccacagcctccagcagcttcttgctcggaggggctgctgggagctgccctgaggccccaactaggagttccttcctcccacgccctggggttggactggtaaggggggagaaggggaggaatatgaggtgtgggattctccccacggtggaggctgcaccctgttccccctgtttggctgaggtgccctgcacagaggtgctttgcatttctgggtgatcattctctaggcgcctggtccgtccacactgtctgcagtgaccctgctccgtcaactctgagcttggcatctgaggccagccctgtacaccctgccctgtagtcaggccctggcggggccgcaccgacgtttggctttgctccactcccctcccggtctctgcccctttccccagctggtcccctgggaacaggacacttgctgtgacccaatggcatctgctcatttgtccatttgctcctctcgtgagccacaagggtagggacttccttgtatcatcttgggtccccggggtctggtgtggggccaggcatttatttagctgaactggacatcagggacatcaagatgtacagccccaaggtcatgagtgttttgtcaggagccttagaccagtctggcccagcctggagctccctccgcatgtggcctctgacaggagtgacgcagccccatgcggtgctaacagtggcagcactgaacgtcggatggggctgagcccagccacttccacaatggctgtagttcctatctcttcctccctgctaggaaaatgtgaaatagcccagagtggggggtgggcagaagagttgcaggctacccaaggctgggatgagcagagttgagacctggggagccaggcccaggacacttacaggtggggatgtgagcaggcaccccagagagtgagcaccccagccagccagcacccatctactccctcactggggtctaagttcagccccgagagctaggctgtaggtgggtagagtcacagccccagcgccggtgtgaggggtggccctgggccaggtagggtgagtatctgcctgctgtcatgccccatccacttctgccgcctccccagtagaggaccccctccatttcacagatggggaaaaggggccctgttgtctgaagactctcccatatcctcccctgcctctgccatcccctgctttgtcccttcccttccagaggccctgccttggtcctggtcacttcctggtaggcactggctcttcctctatgcctgggctcagggcctggccacctagttttctgactcctcccacttactcccctccccagttaacctctctgatcccaagtgtgtctctccagcagggaggagggctattgcagccagggatcccctttctgaggcttgggacccattattgggcagctctgggacaggtggacggtgacttggcccacactcggtccagctgcaaccctgagaacccgcttggtttggctgtgtctcctggaggccctcaggtatttcaacctgtaggacccaaacccagtccttcacctgctgcagggccagccctggacacccctgcccctgcctgatttggagcagccaattcagcccctgtcattggactctggcctcttgtgctcagtacagagggtcagaccttggccgcctgcctggacagggccaggtcaccaccacccacccccagctcccttgggttcccagcaagatcctgtccttcctctactcacagcttcctgggctctgggacctggggtccagtccccactcctcatggggaggagtccccccacgccccaagcagttgactcccgcactggtggggggtccgctcgccctcaagctctgcaggcccagcttggtctccccagcctcttcactttctccacggctccctccacctacctggccctgagagctccccagggaagccatttcctcccaggaagcccctcctcttctcgcccctgcccttacaccaaggcatctgggcctactcttagggagagggtgatggtggaggaaagggagcctcagaggaggccaagtgtaaagcacccggtctcctgtgcctcccagccccaagacgacctctgggccaccggagtccagacctggtccaagaggcgaggtccccctgggaagtgcctgaaaagtaccctggaggacatttggaaacaaagacaaggttccctggtgcccagcaagccctcccccacctcccctgctcctgtcttggccagggcctaagtcgcactcacggggcaggggtggggccgcccaggatcaggaccacggggctgggggggtggacagcgccctttccacctgggtcgctgggcactggggtgtcactgggagggacacgcaggagggacagacacgctacctcactcacgggcgagaactaagcacctactgtggacccggcgtctaggcccgcgacaacgccagtcttcgccccccaggggcctcgtcccggggccgcggaggccacgtgcagttccccgcccaccctgaggtaccggccccgccccacgcccagctcggacctccaggattgcgggacccgccggggaggggcggggccggggcggggccaggaggagggcggactgggcgggcgcgggcgggacggagctgcggcggcggcgggtcccgcgggcgggagcgcctggcggccgagtcaagccgccgcctcgacccagggcccgcgggccaggagagcgctcggcgggtaagcctcggcggcgggtctcggcgggtctcgggggtctcgcgggggggcggtctccgcgtctggaaggggctcggcgggccttggckgtctgggggytctcggcgggtctcgggggtctcgggggagtctcggggtcccgacaggtctcggcgggtctcgggggtctcgggggagtctccggggagtctcaggggtcccggcaggtcttggcaggtctcgggggagtctcagggtcccggcaggtatgggcgggtgtcgggggtctcgggtgcgcagcagcctcccccgggccccggggcctccgtgtccttgccaaaggacrcacggggcctgggcacggcgggcagtgcccgagggagcgcggcttcggggcgggggccgggtgtcccttgccgggggctcaggggtgggaggcggtgcgacgcgtctgtttcgcacccctcgcgcccctctggccccgcggcggggcccctttacgcgaccctccccacaagactcaaaggctgcggcgggcactcgctctccgcccttcccggaatccaaacttccctctgcagcggccgcgcttcacggagggcaagaaaagccgcccactggcgctgattcacactgaagtgtgagtgactgatagccgggcgtctgagactctcatgggcaacagggaatctcaggggtggcagagggactggaggagttagggggcggggacagccccttccacctgtacgctggcctccctgcagcccagcactttcccgctgctctgggcctcggctccctgggggyattgagggcctgagccctgctgtggggagccttctgctggtgctcctttccgtgagcacctcctatcccctctctgtgcctcagtttgctcatctgttgacactggggacagctgtgcctcctggtctagtggccacacttaagtccttcgaattggctgtggccaggggcgggtactccgtgtgggctgctggggtggacagcctgcctggatgacatgtgtgtggccttgcaggtgacatgggccggtgatgcaatgtgtagaattgtttccacaaccgcctgaaggcagggcccacagcctcctccttgccgaagcaagcctctgggttcaggtcagccctgcaccaactccatgagcctggacaagctcctgccctcactggctcaggccctgtgggaccagaggaggggctgggctccaccccctcctggttcttcscactctgtccactgtctcctctacgtagacaccgtcgaagggccctcttggagcccaacctcagggccccactccaggcactccactcctggcaggacaggaggcctgggacgagggctgcaagggagtgaggattctgtctatcccctctccctgccacccgccaggctccctttgcctggctctgtgccctgcgttaggcacaccctggagggggcaggcagaaggaagacagataggcagccgtgtctaggaactgccagccagggccatctggtgagaggggtgctgacaggggacctggcctttcagggagtccccaggcctccaggatcatgggggagcccaccaaggaggctggcctgaagaggcagacagagggaggacaggctctgggcctgccttggccctttctgcccacatggacagaggaagcagggtgctgagtcagctggagctccccaccccccagggatgcacgcacacaagcaggcccacagacgggaagtccaggggcccagagagacgagatggccagccttggttcctgaggggcagggaggaagggygcaaactcagccaggatcttgggtgtgaactcagatgccaccagtttccagctgtgtgatcatggccaggaggcttccccctgccacccctccgttttctcatccatgacctgagggctgtgaagcactttgtacctggtgggtggctatgagtgtccgtaggggggatggtggtggtggtgacatgtgcttggtattcagtgacagtgggtcgctgagggtgctctccctggtcctcagggccgctgtatgtcctgttttgggtgggggcagggactggcctggagaggcctgggtaaaggccraggctcccaggttcctgcccacattggactaaggcctgagtccatcaggagtggccagtgttgggcagcccctgggtcttcctgcgttctgtcctcaaaagctcccttgtggggacaccccaggtcagtgactatgtgtggcaggctctgccctcctcactctctgtcctctcttgacctcatgatctgcccacctcccaaagtgctgggattacaggcgtgagcccccacgcctggcagagtatatagttctttaataaccgggtggcttggccatcactgtgcagcctgggtgggtgaggagaagggcaggctggcggggaaaagacggggaatttgccacaaggtgagagctgtcctaccccagacgcagtggagcggctcccacccctcgggccaatgaatacagggtgggccgtcaggaggagggatctgagccgggcgggcagccatgcaggtacagacagactaagccaaaggcgggcggtagggagggtgggagaccagtttgaygggagtggcctttgcatgccaggtgtggtgagggtatggaggggcctgggaggcaaggagaaggggccgtgcagaccctggaatccttcctccaggataggcggctcctccccagaaggcctctgcattcttctggtggccctgtctggacaccgaggggctggagacagtcccacgtgtgggctgcctaagtcccagagggggtggtagggagcatttcaggctcactggctggcccccttccctggggcactggaccctcctcaccaccccttggcctgtgcacgggagggtagacaggatggtgccaagagcaagggactggccctcagccacgggccaggagacctgagccttgtaggcgaattgcacttcctgaccctcagtttcctgwtctgcaaaacgggatgacagaagtccctggctctggaccacgctgctggatttgggttccgtgccgggcccctgactacactcatccttcaagggtgacgcgagagaagcacgtgcccaggttcggggcgggtggagacctgggtcagacaggagttcgaggtggtgcaggctcccaggaggggagaaaggtgccctcccccaaccttctctcttctccccaggctctgtaacttccaaggccatgagagtggtcaggccctgcttggtttcccggcccccgatcacagatcrtgctggaactgctggccccaacgccctgaggtgactggccctttcttcatggattccggtcacatctggtccatctttgtcagctggcctctgggaagaatgtgggctcggccacctggagcagttgcctggggagatcagaggagccctgaggggttggcagagcgccctcgtggtatccatacccccatccctgtagctgagctgattccaagaagtgccctctgcttccttgtgaatcagatgtttactgcgctcctgctgagcctgctccaggcagctgggtggggcgtagggtgcctgtctgctcaagcctgcagagggaggccagctccccrccccagggtcagccaggctggcaggcaacagcctcaagaaggcagtgtgcgtgccatggcacacggggctgaggycgcgaggcaggggccgagggaagcggcacagagcttctctcaggcaccagaggggagctgagttctgggctcagagcaggcttcgtctgagggcttcagcgtcctccttgtgaaatggggtgaaagtaggtctaactcatgggaggccagatccccaggcccgagctagggcctccctgcccttgacactgtgtgaatgggcagctccgtttgggggagttccttcagcctcgatccaggggtgttgtaatctagtgatgctcttctgtggcatttgagggtcctgggtccccatgccctgcagccctgtccactgtcctgagctaggcataggggtgggcccttgctgctggctgcccctggacaaggtgggaagggatcaggggtcattctgggagcctggaatgctgggcggtccttggctttttctcagccttgggartctggggcagtggtgcgcctttaccacccaccctggtttctgcctctggggcagtggtggacctccttcagaaggctgctgcccagccccgggccccactcatgcaacactgggtgcctgtgtactgggccctgggctaggcatgcactgcaagagcagacaggccacaggtcagagggcaggaccgctggcaggtgcccatgggtagcagctcacctgcctggcccaccttgccactctctcccttagaagcaatttcagctgaagacataagtgtctgtcctgcttggtgctcagggtaccctccctggccacccccaactccaccctgagctgggtgccttcctgagcccccagcctggtctatggccaccatgcatgttgacccatccatggtgacctgtccgcctgcccctcctgcttgggaactcaggaaggtcagggtcgcgtctgagagcccatgccctggtggtgcccacgtgggcctgtcccagaggaagggtgaggggagtgccggctctcccagcctcccactcctgggcagggaagtggcgcgggcaacgggcgggctgtgccaagctctttgaaggtggcttgtcactccccccacctgtgtttaactctactgagcatcagagcctaatgtgccagtcagcctggcagctgccgcccagttggtggagtttccaatcagataatatcagactgttgtgctttggtctcccacgaaactcttcaggtttccatcacagcctcctcccttccccctgcgggctgcgctgtgacagccaccgctgcctgccacccggcagcagggacccagctgcttctgggcctggtctcggtggccctggcagcggtagatagggaggaccaaagcctggtgaggaagagccgccgagckgagtcggtgtcccctgtcctctccctgaacgaaagtgctttctttctctgtagctgctcttcctaaacgtgtgttggcttgagattggagttagcctggcctacctgtgccaccagggctttgggtcccaaagagctggcacctgaggcaagtccaagcaaaaggccggatttctcaccattaggagggcaatggggaaagatccagaaaagctggcctgggagccctgagtggcaggtgggggtacacagccctgcatggagaccaggctcagagccagaggaggcaggccaggaaactcggcactcatctcctctctcggaaacrcccctccctgaccccagctgcttcctctcctcctactcgaggccagaaagggaagcccctttccagtggggtgagtggctggcgctgcccgaggcggtccgctgatggctgggcagatagtgctggggcctggcctggcaggcagatcagtggtcagcagagtgagtttgaccagggcagaggggaagatgacgggggtgcatcccccgagctgggggaagtgacttcccgttgccatcacctcttgtggcctcaggcgttcccaggctgagwcctctaggaacacaggtgctgggtggctcaggtggctccaccaggccaggccgtgtgacctgggcatcctccgccttctctgggcagggcagggacaggaagtgcagcctcatgggatgcgtgarggtgagggtgtgcccatccagctgctggggcggggtgtgtgggagtggccccccaggagctgcacgcagcacggggcctgggaaactccaaagccggcgtcaggtcatcgaggcctccgggctgattaggactaatggcgctcaggggtgcagcctcagcctccacccgccacccgtacccgccctgcctcaggacttcgttcctgctgtacccctgctggctgcctgtccccacaggtggctccttcctccccaccggaggagctgctcccaggcgggaccctgggggtggaatctctgaaatgccttcccctcgggaccctcaccgcgactggacttcgctcagcttcagaccctgggctgcagctgcctaatgaggtgggatggggccctgggtgtgtaaagtggagggaggggcagtggccacctctgagccctgagccatcctggggtcctgggtgctggcttcaggaaggtttgctacttggggcaggggctctctgagatcaaccttcccattttcttgaggatgtgaccaggagggtgatgttttgtggtcggggtggctgtgcctgcctctggggcaggaagttgctggggaaggaagaagattgagaaaggacccccaacccccacctctgcagaggatctagcgggccttgccccatgccagggttcctgccggctggcatcaaggggacagctrttccagggctggkgtcctgagaagcaggggggacccacttgggacccaggccccctcgaagacctacccagagccacccttgcggcaggcagggtcctggcccttccagtacgaagctgggaaaaggcagcaccaaagatgccaggggygcctcacggatccccccgggggggcctccttgagggggagcaggaggaggggccaggctgagggctcaggctgtgtgaaagacaccctggttttgaaaagggagaggggctagagaggtggggcccgagggcctggtggggcttccagcaggggctggcttatgttttcaagcttactctggggtctggagaccactgccgaacatacgccctccaagcagtggccacaagaagaccatgaggagctcgggcggggtctggggaaagggtgggggctgccacagacagaagtgggttcgtcgaggctgcagaaggctgggtgggagtggaggaggtgaygtgaccaggatggggtcggtgacccctgcacaggggctacaggggatgaaaggggagggagcagcagactgctgagattggggtggcattggccctggtgggactgactgtccccggctcagtctccctcctccttggctggcttttctggcagacagtggcatggtccagagctgcctccctggggagggaaagggcatccccaagtcactcctgaggctgtgtccccagagtgtccaccgggctgtgccacctccctgtctgrtgcagcctgcccctgcctgagctgcccgagcctgccccgtggctgcttcccagccaggaggaggccctaggggcagacaccggcgggcttgcttacaggccctgctgactccagagtcttactgccacccgagcagtacgtggaggtgcttgtcctgtgaccgccccccccccgggctgatgacgggccaggtggcacttcacctgggggctctggggaggctgtctcgggctcccgtgccaggggtgggtgcagggaggctgggcaggcaggagagctcaggcctcggctcccacgggtctggggctgtggtggttggggaccctaactagagccattcacccctctgaggaaggacctggcctggagcgccatccccagggagcagtaagggcattgggggtgtcttggggtgacctggccgggggcagaaggccaggcgggagtttgcaggtggggaacggctggaggaactcgtggaacagcctgagaggtgtccggcgaggtagggcatgggtggccttgagccctgaggctgagcggagctgtctttgagagccacctctgctgaggctgcagcagaaaggctgtgacaggctggctccgagggaggaaggagctgggctgtgggcggcctggccttgggaagggggctggacagttgcatggttgggggcggagaggaggagaccctgatccagactccacccctgcctgtcttgaccgcggaggaccggggcccagactgcaggggtgcagagagsctgcggcagaggctgggggctgggctcctttcccggcaggccgggcccaccgccagacccttgtcctcactgggcctctctgaacagtggagcgttgtgaggggcctgggaacgttcaggtcacccaggccccctctgggccacgctgagggtgaggacaggagccagcgggcatgagtcatcctgtcccctgcccgggccccgaggctctggggttcccaggctgaggaggaacacacagctctcggttccccaacccggggtctggcccactccttsttccttctttttgcctctctgtcagcacctcttcctgttgcctccctcttgctcctgggcctgcctgcatctcccttcccctgtccggccagagaccccggcctgggagtggctgtggcctgctctcccaccccgatgcctgctgcagccccagcagaggggctggcctgtcgccttgagcccacctgtgcyggcctgtgagtggccccaggaggaagccagcgcaaggacaagacccagcctagacaggaaacctcctgaggccaacctaaaatttactaaggaataaaaaatgacaagaagcagaaggcaagggaatagaataataaacccagagagtaaaaacgaacaacatccgggaaaaaaacccatgttagaaaacagtttaaaaatattagccaggcgtggtggctcatgcctgtaatcccagcactttgggaggccaaggcgggtggattagttgaggtcaggagttcaagaccagcctgaccaccgtggtgaaaccccggctctactaaaaatacaaaaataagccaggcatgttggcgcatgcttgtaatcccagctactcgggaggctgagacgtgagaattgcttgaaactgggaggcagaggttggagtgagcaaagattgtgccactgcactccagcctgggtgacagagagacctgatctcaaaaaaaaaggggccgggcgcagtggctcacacttgtaatcccagcactttgggaggccgaggccggcagatcacctgaggtcaggagttcaagaccagcctggccaacatagtgaaaccctgtctctactaaaaatacaaattagctgggtgtggtggtatgacctgtaatcccagctataggaggctgaggcaggagaagtgcttgaaccaaggagacagaggttgcaatgagccaagatcgtgccactgcattctagcctgggcaccaaagtgagactctgtctcaaaaaaatatatgtgtgtgtgtgtgtgtgtgtgtgtgtgtgtgtgtgtgtgtgtatgtatatatgtgtgtgtatatatgtgtatgtgtatatatatgtgtatatgtatatatatgtttgtatatatgtgtatatatatatgtatgtgtgtgtgtatatatatgtgtatatatgtatatatgtgtatatgtatatatatgtttgtatatatgtgtatatatgtgtatatatgtgtatgtatgtggtgtgtgtatatatatatgtatatgtgtgtgtgtgtgtgtatatatatatgtatatatgtatgtatgtatatctatatacacacacacacgtaacgttagggaaaaaggatcacggcgaatgcattaaggcagcagaaagacctaaccctcaagtgctgaaatgagtggacagagggaagggaccctgttgtgctgactcagccttggtgggtcccagcctgtggcacccgctgacagatggtgacagggttcctgggtaagcgaggggcccaaggaccctcagtggtgcacagaggagccatgatgggggccacgcctgggccccagcgtcctttgccctgacccaggagcttgtccagataaaacgccgtaaagtgcctgggctgagcccgaggtgtgtgcaggagctgcatggttttgtgcggtccaagggaggccgccaagaccgccacggtacgaaaagtaccacggtgatgagtgaaagggacaggcggcgcagggctctcaggccacttactgctatacggtcccaaggcccaccctgtagggcttacacagctgcctacacagggtgcccatcgtggtggctcctgacctctsccgttggctctgggtgggagcaryggggctgggtttctctgactggcgcccctactgcatgccaccccagcaggagccccagggcctcggcatctccactctgttcccttgttatctcgccctggtgctgggatccgggataagcagggtgctgtccacttccagggcctagggacccagtgctgggccaagtgcctatggcagagtgcttgggagctgtctggtttggtcctcagagtcctgttgctaataagcgtggagggggaggacggagcaaggctcagggagtgaagtgacttgcccctagtctccagcttaagggaccaaggctgggactggagcccaggcgtgaatggtgcccaggagctcatcccagggaaggtctgagatgctgtctgcctcacctgggcatgtggcctggactggcagttctaactaagacccacctctgtctctcatgtcagaaggtgggtgccttctcttacctgcaaccccagggcctttgcacaagctatgctctgtctgactctatgtaatcccatgcttggctaactcatgtggaagattgctcccaggacgctggcggatgtgtcaacgtgtctgggtggaacagatgtcacaaggatgtgagtcagaggtggctgcctccctaacagattgggagcccagacagagggtgacagtagcttggatcccgggtgcagggtgtggcgtttgcctgtaggtgctgtgcctgagtgcctcccctgtgcccgataccatgagacttcaggccgagtggagtgacactgtgcaagagagacagggtccggctgaccagcctcaccatgactccagccgagcccactgaataggtgggctaccttccaccattccctggcctcggtttcctgctctcggtttcctcagctgcctggtgggttccactgcaactctctgggggtctccttctgtcccggcaccgcctgctcctgttcctcatccgagtctctgcggatgcgtggaccccgccctctgtgcagcctcagcactaagtcctgggtccagcagctccgggactgccccagttactcctggggaaactgaggactggagctctgcttctttgcccgagttttctctagggtgagcaccagaccactctttcttcaagggaaccagcagcattgagcgggacccaaaagggggctgtggcctgggagagcttcccaaccagcctccccaggggctcttgggatcagtttaaaacagaagcagctcctaactcctcaagggtgggctggagcccctgcttccccaggccttcctgtcctgctgagctgggccctgcggtagcttcctccctgtaccccacatggcgtggcccaccctgtgtcccctggcctyctacccagagccctgccccctccacagaggccagggcccacccccactgtccttaaggttggtgggcttccttctgagagtgggcctggggtttctcctctccttcttacccaccccagagccaggctcagcaggaaatgcctggtaggggccctgccagggccataaggctttcagggcaccctcaggttgtgttgtaggggtgggccaggtggccccaggctctgggtgacactagccacgctggctgggtagccaagcgttgcagctcactcagcctcgaggtcctaatcgggagaacaaaacgagcagttggcgatggagcgggcacagagctggcgcactcagaacacagtggacatttccttgggggctcccygcccctcccttggtccagcagcctagccctcctatcacaagaggtgactgtgggcagggaagcacccccaaccttcacacccactgtgcccgtggcccaggcgtcccacgcatcccaggagggtctggttggcgggagcsctctgcttctgcttcctctagatgaggaaggtgcccggcagrtttcctacctaagcacaccccctgggcccggagggtcagcagccaggctggtgtgggcgtggggtgtcccggccacagctgatctgctcagtgactgctgctgcccttgcctatcgatgaggatgctggggccgggaggtcaccctggaggcccaggctgcgcttggtgggtgcagagcccctggagtgcccccctcctgcagccaggggtcccccgagatggaagaagtggggtgcctggggctggccagatggtgtaattcagcacatgagcccatgagctaggccccacggagagtaggggttccagccagctggggtgtggacgaggtctgttcatgctgcaggaggcacctggtgccagtgtcacactgggcactgttcaggcaccaaggacatgggggacggacatgcagagatctctccccacagaactggtgtcaggggaggggcagatagccaacagacatgctgaaaatgccacagcgtcggggggtgccgggtgggggctgcctctctgaggagtgggggccctgccgtggactgagcctgtgtgggagaaggcccagggcctgcggattggggtccagcccaggggagtgtggtctagatgaggggccaaggggcaagggcggggcagaggaggtggagagggtggcgttccaggtggagggcactgctgctgccaaggtgcagagagggaaggggtgtggcactgggaatgtggctctgtctgtgccaagggccgcggggagacgcctgttctggaggccaggcccgcaggcaggaaggaaaagcacggccggacgctgagctgggcggttcctcccttcccttgacactagagcaagcccagcagccagctgccccacccccactgctcaagtgaggaaactgaggctcagagtgggccacaggccaggaggaggggattgagccaggcttgttcccaccaaagcctgcacgctgaccacggctctattctgcctgccaaggtcacatgcatagagcggccctctctggtgggagccactgggtggggcaggactgccgcccctctcgggaccctgcggggctggggcatagggtgcccaggctggctgcggtgagggacagtgaaacccttcaggccaggagaggcgaggcagggtggggaggaggtgggccccagccttgggtgggagccaggaacttggggtggtggacccggcccaccccacacatcaggactctggagaattttttctcaagtgattaaaaggtagaaactcgtcagtgtttgtgaagaactgaagtgtgaatcctgagccgcctctgctgcttgtggtttgagactggagagtggctccaggcgagcagcagtgccagccgtggcttcccccagacccacctcgccttgcctcacttcactgtctccagccccacctcacygtctccagccccacctcaccctcaccaccctcggcctggaagcccgccctggcctcctccctccagccagtgtacggcccctgcctggccaggccagagctccgcctagggcaaccctcttccaggtgtggaggcccccgggcagtcccgactcccatgcccatctcaagaacctttcctggggacagagacaccaggcctgagagaggaaggcccagtggggcatccggagatgtgagaacattgcagcttccctctgaggacagagcttgagggccaagcatccaccaacagcttggccttgctctctgaagcccaggtgccatgcaggcagctgtgcctacagggcccttgtctgcatttttcttaattccctttgtccgttgcacacagcagtggcctgaccgtctctgcctccaccctgcaccgctctgtgaagcccctggggcctctgagccccgaacacactgcgtcttctgggaacactgctgtctccagtgcaccagcctttctctgttttgcagcgagcagcctcacgtgcgtgcccagggctggccgscggcttgtctcactgggcagaggtccaggggtgtggaagggcctcagctgcggccgtgctgcactccagttctttgaaaacctctctcattgagagtccaattagcgctaagtcacaattttttcactctgagctctgaaggatgtactggttacaacctcgctggggtctggcctcatgtatggacatgacagtgaactcatctgtttgtctgtctgtcyttctcttgggtcctgccatgggcctggtgcccatctgggccttggagattcagtgggacttggacccgtggggagtgccagggacacatggggtaatgctggtggcagaactgtgccattgacttggagatttcagagaagagggcaaggttctagatggttccatcctcaaaggatgagggagcgtttggtttccatgtggaggtgactgcaggtaccaggatggggcaagtgcatgacaggtccagtgtcgggggcccagggcaggaagggaaagcaggcgccgcaccccatccacgtggacagggaaccaacctcgctgctgcgccgtggtgaatgtggcctgagacaaggaagggcaggccaaaggggtgaacgcgaggccaggaggtggggtcagcaagcctggcgggtgtgggtcaggcatggcaggtgaggctggtggaccctgtgtgcaggagggtgggaggtggagagcccagccttcgggaggctgtgggcacctgcggaggcaagctcagcagtgcccgcccaggttggtcacagccttgtggagcctgtctctccctgacaggcacgcccacactcgggatcagactaagtggagcctgcagttcatcctggggaaggactcaggtgagtccccgtgtggattcatttcctggggctgccctaagaaagttccacacacgaggggcctgaaaacaacagaaatttactctctcatgattctggaggccagaagtccaaagctgaggggtctacagggctgtgttgccccggtggctctggggaagccccttcctcccctcccagcttctgctggtggccggcgatcctcggtgcccttggtgtgtggccacatccctccagcctcttttccatccttacatggtcctttccaggcatcttctcctactccatctcttacaggacagttgccttggatttagggcccacttggtcaatccaggatgtgctgcttaacttagttacatcgaagaccctttttccaaataaggtcgtgttcacaggttctggggattaggatgtggacaaagcttttgggggccacctttcagcccactacaacatgtggccccaggcagggtccttctttctagggttccctctccctctatcccagttgggtagtgcccagtccgagttcccgggaatcctcccagtcctgcatcatgggacagcaatcagaatggggcatagagggaaggggcttctggctggggagagcctgggagggtcccagggatggctgtggagcggacccaggccccatgggaggggctcatgcaaaacatcttattttgagagcttgagattttccctgggggtgcccgccttcccccaggctctgtgcccacccaccctcctagggctcagtgcccrccttcccccaggctctgtgcccacccaccctcctagggctcagtgcccaccttcccccaggctctgtgcccacccaccctcctagggctcagtgcccaccttcccccaagctctgtgcccacccacccttctagggctcagtgcccgccttcccccaggctctgtgcccacccaccctcctagggctcagtgcccgccttcccccaggctctgtgcccacccaccctccccgggctcagtgcccgccttcccccaggctctgtgcccacccaccctcctagggctcagtgcccaccttcccccaggctctgtgcccacccaccctcctagggctcagtgcccgccttcccccaggctctgtgcccacccactctcctagggctcagtgcccaccttctcccagggttagtgccctccctccctccctgggctcattacccaccttcccccaggttcagtgccctccctccctcctctgggctcagtgtccaccttcccacaggctcaatgccctccctctctcccctggactcagtgccctccctgagctctgcagaccctccttggcatgttcagcacctgagcctctcctgaaggtggcaagcaggtaccaggctgggtacagggtccctgggtgccagtccccatgccactgatccctagcttcctctctgaaccccagagatgcagatggcaacaggactgtcctcttgggctgtgagccttgagatgaggcaggtgccgtgaggcaggaggtgccagggcagggtcagctccgtggtggctgcagacaccacccactgtgctgggtgtttgccttactcctgagcgggctgaaggctcccagaacccagtgaaagctccctccctcttctttttcaggctgacccttggccctctgcctgccctgctggctggctcccactcatcctggtaagtgccctgtgtctggcatggtgggaagtccccaagcctggcagtttgaggcaccagctcaggggcaggggagcagctgcaacttgggaaggatggagagggacaccagggctgcccattgaggcggccccggccatgccccgctgcacacaccccctgcttggatgcaggcgtggggtcatctccatggttaccggcacagggtaaatgtcaaggagtggccatggctgaggaggggagaatggcctgtgtttaggaatatgaacggcagtgtcatatgcygcagggatgaagaggaattgagagagcaattggagaagctaaggcccagagaggaggggtctgcagaggtcacccagcagcccaggactcccagctccagcttccctctgggaagatagggttggggaaggggctggtgtggatttgtcccccacccccagggtcccctcacctggcctgctcctctcctmtgggctggactccccctgtagcatcacagcattggaccagggctgtggggggaatgggcctgggccagggtcaggtgggtcttctgcttgcttctgcctctgccgagtctatgagtgtggggcttttggcggagcaagggcaggggcgagcctggctcctgcttccagctcaggccttgtccgctcttgcatttgcctgcccagtaaggggtggcgtgttcctgagagcgccggctgcctctgggttcttatcttcatgggttgtcatccctgaagctgtgcgttggccacctcattgcctgtggattcctcccaaccctggggtgtgctcaccccaagccccttcctcccgtggctccctcaccccagctccttccagcaaacttcctcctctatcaaagctgggcccctcctctgggaggcgttccccagtccagaacccacagggcctggtccctcctctggaccctgcagccccaactgtcagaactgcctgcctcatcgtccaggctgggcagtggcccaggggttcctcacctgctgtttgatctcaaccctcctgcaaggaggaaagagaatgggaagaggccccactctgtccgtgccctcctcgctgccctctgtctgtctgcctgctgtggccagccttctgctgaaggtgtggtctgcccttggccacctgaggggactgaggctggcacaggctggggacgccagggtgtctgtgcccatgctaargaggccccagacctaaaagcccaagctcctcaccctctaggagacagtggggtgtctgcagcccaaacgggcccygagggggaccttggcagcagggctggggctgcagacacagctggggagacggagctccttagcctgggagctgccttttttgagtgacccgacacctaggctatgggacagcttgggacctgcacagccggttacggggctggggtccagggtttgttgggaggctgatttcggggggccgtgccctaggaagcctggcgggcaagatgagacccctgcagctttgtggcctgtgctctgtggcctctgtcaccctcaaatcctgctgtgagggtggccccaggccccagaaagcccctttctccagctgcctctgcccaggggtcctgtcctccctgggcaagttctgggaggagagggagggcgctcagcagccagtggctagaatccccattccctgcttccgggctctgggcctgggcagggcactgggcttggtgggggcagagcagccctgggaggggccgaattctgagcgggccttggggcaggggccggtgagtacgggagcgtgctttgccactcagccataatgtactttctagcaaaccagatgttagcagagctggtgtggttgcggggacgtgaaaaggctggggatagagtaggaatcgaggaatgccagagcccaggcctagtccctcagtcccttggtgtsaaagggcacagagatggccaccttgaaattcatagaaccgggtgcaagacataacagccctctgtgtggcctcagatggcagagcagggtggcagcagctgccctggcaggaagagcatgctggtaaggtgacaccatccctgtgtgtgttgtaaatgctgctctgtgctgggcctgacacccagggtgcaggttgtttcatggtttgctagggagaagccgagtattcagaggtggccctgcggggaggcagcagggagcttcctcccagggatgcagctgaccttgcgctggagccagagagccctggcctctgaccacaggatgggagggcaggagcagtggaaggtaggagttaaaacccggatggtggatgaggggcagccctgggccccaggcagctttcaggacctcacagggtagaaggcaggaagtgccggctacttggtgctgcccagggagcagggaacaggaagtcccgggtggggaggaagcaccggcggccacaggcctcagaagcagcaggagtgagctgtgggcacagctgtggggcagccaggcgcgtcaggcctcacatgtctgggagatgtaggctgcctgggctggtggcccctgagccgcatggcctccctgggccccaggacaccggccccgagcaggtcacgaggacggagggccatgtgttgggtcagcaccatcaggtcagtggggcggccccaggactggggctcgggaggcggcactggtctagcacctgaagaaccagtaagggggccccacgtgggagccacagccttcctcggggctggccgtgggagcccacaggaggtggccctgagcctgcaaaaggcaacaggctctgaggagagtggcctctgtctgccttgagaggcccccgagctggcaggcacagggggaggccagagagggaatgtgatacttagaaccccccccacccccccatcacatgcggccgacagggaggcgggggccagcctgctggggtggggcccaggtccgggaacttctcatgatacagcctgcagggtggccttggtgtttgggtcctaagtacacacatgttgtgtatgtragtgtgtgtttctgttgtgrgggggtaacggagagagctgtacaaggtccctgctgcccacctggggagtgccatgctctgaaacctgcaatgtggaggaccckcagggacctcagggactgccgggctggggctgtgctcgcagagcccaggctgggccaccctgccyctggccagcagtgcttctctggcatagctggttactgggcctttacgggagamttttggttttgattatgttaacagagaaagattctgggaacaggaaggaaacaagggaaaccgaaaaggaagagcagacagctgtggggaggcagggcagccagggctccaaggtggaagccgccccatctgcacatcccacgcccaccaccggccacccactgtgcgccaagctgggccgtggctgtgctgggccgggggtggtgcgtgagccaccatttactggctgtgtgactttggccaagtttcttcgtcagtgacttggggaggactctggtttgaagctcaaggtgttggatgatggggcgatcactgagaagcacagagcttggcccacagggagtgcccagtgcgctcggcacaaggcctgatcctctcccagcctctatacccaagtctgtaaaatagaagtaaagtattgagctcaggtggaccctggkcgatttagtgagctgtgaggtacagcttggcactgggccctggcagggctgggagtggtggtgatgattctgtgctcaggcttcaggacacggagacacagaagaccgcacttgacaggtcttgttggtcgttggaggctgtgtgtgtgtgaatgagtgcttgcatatgcatgagtgagtgtgatgaatgtgtatatcagtatacatatgggtgtgagtgtgcacgtatgagtagacatgagtgcatgagtgtgtatgagaacatgagagcgagtgggcatgcgggagaatgagtgtgtatatatgtgttagtgtggatggtgtgagtgttaactgtacatgcatgagtgtgacaggatgcgcatatatgagcgtrtgaataaagtgcacagggtgacctggtatcttctccctttgggctggatccccagccccaacttgccctgtggctcccacaaatggggccaacctgatcaccactaacagtaagtccttgaccctgtggtcacatgaggtgctggctcccttaccacagccaggatgatcctgyaggagcccagcctcccagagcccccaccctgctcctatgcaggggctcacgcctgtgtgcatgcgagctgtgcagctcatgtgcacgtcctgtgtgagtgcaccacctgtgacattaactgggtgtgcagagacacagcgcacatgagggcctgcacaggccatgaccacacacgccacagrgctcatggggccccagggtggtgggagccacagagcctgcattaaatggaacccgatggggtgtctctgtgggamtgagcacttttcacctgactgctctgccccccaccgcagcagcctcaggccttggggtcacctgaaccaattgcaactttgagagaaggtagggagatgagcacagaaacagagacctggagagtgtatcccaggtgccccgtcttccctaatgtgcatgtgcacacacacacacacacgcacacacgcacaagtgtacaggctcaaatgcaaatctccacgtgtgcacacatgcaragatcacatactttctggaagggctcatggagcccagcagccaccaccagctttggccrcccaacgctggcccatgtgtctccagagccctgccccagagagcagctgcagaggtgtcaggggactctgagagtggactcctccatacccactttacactggaggaggtgggggctcaggggaaggaggggccccaggaaggatgtgaacccagatcttcagcactctccctcacagctcctgcccatgttaactcagccgacaccgcagcagcatggtgacaggtccccccagggtgtctgcctctacagaggaagggactgaagcacccagagagctggcaggtaggcctgtggagtcccctggaatgaatgaatggaatttaaccatcaggtccctggaagaggggctgggcactgagaagcacagccagggaggcctggccagctaggagtgtgggtgctccttggggatgccccctggttttcccgagcacaagtggggccagattctgtgagctgggctgaacttccccaagagcagcatggtcaccacggcctccatggcccatcatcaccctcagcctcagccgacctttcccctttctgctctcagcctggcctggcactgggctcctggccaggtatcaccccctggcacagggcagggccaggtggggcagaggatagtaaggtggcaggggtgggtttccccttgaatggcccctcctctggagaggggctgtgggtgtcagcgtctgtccctgaagcgaggaattcccaggggaggtgagggtgccacatgacctgcccttgtcatgacctgtccccctgcccagggtcagctgatgatcacctaagagccttcatcctgcccacagcgggacagcagccaggcaggaacgagcccctcacaggcctgcccctatctggccactgagctggacccatgtaggactgtaacctgtccctgtaactcttcctgctgagccttgtccaggtgtggagccaggaggaggtggtgggttccatctgtcctcacagtggctcctcccactttgacacacaggccaggtcttatagcttttgggtggcgggggcacagtggggtgtgatgccccagggtaggggctctgtttcagcttcctgtgccttccaggcaacttgcagtccctgtcacccacagggtgaacattccatccttcttttggggctacctgggtgtcccccctgggctgggtctgagctggtgaggatgggagacaatgaccaactagtgtggtcagtgttaggggcagagaaggctatgctagccccaagggagggacacaggactccagagaggttatgggagactgcctggaaaagggaacgcttgaactaactcttcctttcatttttggattgttgctagtatatagaaatagaattgatttttgtatgttgatcttatatcctgccaccttgctgctcatttattctaataattttttttttttgagatgaagtctcattcttgttccccaggctggagtgcaatggcgcaatctcggctcactgctacctccacctcccgggttcaagcgattctcctgcctcagcctcccaaatagctgggattacaggtgcctgccacctggtatttttagtagaaatgggggtttcaccatgttggccacgctggtctcgaactcctgacctcaggtgatctgcccgcctcagcctcccaaagtgctgggattacaggcgtgagccactgcgcatggctattctaataatttttaagtggattccttgggattttctgtatgtaaaataatctaatcagtgaataattgttctttctttccattctggataccttttatttctttttattgcctaattactctggtgagaatctccagtactatgctgaatagaagtagagcagacatcctttccttgttcctgttcttgggggaaaaactttcagtcttttaccactaggtatgttagctgtgggtttttcatagaaccctttatcagattgaggaacttcccttctattcctggtttgttgactsttcttatcatggaggagtgttgaattttgtcaaacacttgttcttcgtctatcaaaatcatgtggttgtcctttattctattgatatggtgtattacattaattgttttgaatattaarccatccttgtattcctgggataaatcccacatggtcttggtgtagaatcccttttatatgttgcaggattcagttggccagtattttgttgaggatgtttawgtctatacccataagggatattggtttgtagttttattgtgatgtctttgtctggttttggtrttgggataatgctgctctcatagaatgagttccctcctcttctattttctggaagtttgtgaaggatccatgttcttttgagccaactcttgatggctgggttagttcagtttcaactttaggctgtggcaacagcaggggctgaggcctgcaagtgggtgcttgctcgattcaggtaactggagccatagggtctggctggcgtaagagcacagaaggtagagggcaggagtggctgaatcaggaagggccaggttggcatgaggaggccctagaggtttagcactgagcagtgatgggaatggtgtgcgtgttgattctgtgctgggtggagggggctggaggcagaggaagcctgaggagaggaagtggagggggttgccaagaggcaatggagaggggcctggcagggcrgctggaaggaggtgggatccttgaggcaggccagacaagggcactgagaacagaggcacagagatgggacagagcctcgaaggctgggtgcagtgggaagaagtccagatagcgggcctgaggtggggccttgaaaccagggtgggtgcccaggatggacagctaggtagggtcaggcccaggctgttagagccacacctgcatctggcccatcttggtggcagcttgtttgcaggtggaagatggaggaggcaggatgcctgggaggccagcaagggcctctgccggcctttggccaccccaggggactctcctgggtgaggtgcctgcgtttgggcaagcaggtgggaggtgccaaggaccagacccctggctccttggagaatccggggctggaggcccatggagtcccgcaggaaagtggagaaggtgagggcggggcacgtgcccgatcccttgccccgttgccgccctccatgcaggtgccgttttgcagaggccactttcccgagggagctggttgcaagggcccggcgggatgggacctgggcggggcctcagagccgaggctcccgcgccggccgtggatttccaaccaagctgtgtggactggcaggtgttgggggagtggagcgggaggcctcgtttgcatcgaaggcttcttgattccaggctgcaccaacagatgtgggcctcctgtcccaagcgcccaccaacctccttgcagcgtggggaaactgaggcccgcagggggctcacgtgcctcccgcgcacggtgacgcggcagggggcggggccgggaggggcgcgccgggatcctcacctgcccgcccagtcccccgccgagaggggaggagccggcggctgccaggccagggccggcgggcatggcgggctccgggccgcgccgcggagctggggccggcgggaggcgggcgcccgggacgaggcggcggcggccgggggacgcggcccggggccgtgccggtgctcgcaggggaggcgggcgtggatcgccccggggaagccggccatgcccgccgcgtggacgccgtgagtaccgagccccggcccccgagccccgggacccgggccgcgagcttccggctctggaccccgcaccccgagcccctggaccaggccgcgagccccgggcgctgctggtcgcccacgcgcttcttgggggaacaaaggcgggcgtggaccgtcccggcgggcggatgggggactcaggccggcacggggcttgtcgatctgcgggcagctccccgcgggcggactgggcacggggctccctcctccatccccactgcggggctccytcgggccgggcgcggtwgggcgggcggcggggtgtggcggcgcctttgttccaaaccttggcctgtggttgggggtcctgcggctgggacccgcccctgacccctccctgcccagaggggctgtctttgggtgcagaaggagctggtggggtccagccgggtgacccaggccgaggccggcagaagacagcctgatgccttgaagacttcctcttgcacttttgttggagggtgctggtttgctaaaagcagagagtatttttctttttatttattttgtttttaattttttaattttagctccagctcagttgcccagactggagagcagtggccaatcatagcttactgcctcctggaactcctggctcaatcgatcctcctggataagcctcctccgggtactataggtgtgcaccaccaagctcagctaattattttttagagatggttgtctctatatgttgcccaggcaggccttgaacgcctgagctcaagtgatccgcctgccttggcctcccaaagtgctgggattacaggcgtgagccactgcgtccggctattttatttatttatagagacagtgtctcactttgttgcccaggctggagtgcagtggtacgatcatagaccactgcagcctcaaactcctgggctcaagtgatcctcctgcctcagcctcctagagcagctgggactacagatgcaccccaccatgcctgactaattaaaaaaaaawttttttttagagatagggtcttgctatgttgccctggcttagttttctttatgtatgttttttggggttggagctgtagtggaaccagtcccagccccactgggcatctgggtctgaccttagctgctccactaagggcttaacaggacactggccacaggcctgctcccatccaactccactggggccacaggagkgaccctacccaggatggagtgagggcaggcacagaccaaacagtgcagggtcggggggtactgttcactgggacaagagatgaggaagatgctggatttaagtgggcaatgagggtgcctagcagaagaggggactcttaacctgggtcttgatggatgagtagaagttctctgcatgggaaggggtggaggtcatttcaggcagaggaggaagcattaaacagcatggtgtatctcaaggagagcagctggagcatgagtaaggggggctggagtagggggcagggcatgatgttgggtcctgtgggcctgggttagccccaaggcagtcactggtcctccactgactgtgtggtcctcgcttgggctcagagggaaggggagtgatatcctgggctggtggggtggatagcagccaacccaccaaatggtggtcacgaccactgctgacaacagtgtgctgtgtgctgggctgggtgtccactctgtcctccagcatctgaggcttgggatctcccagaaagtcacaccaggatgggagcccaggtcgtttgagctgggtgctcttggctgctcacttgccttcttcctgtctaggccccttataggttcacctggcactgggacttgaagtagttatggcctgaggtctcacttacctgggctggcagttttctgagttcgttcatctctacccagcccccgtggggccttgcgctcagtggctgtgtgcagaatgaaccagtggagagaaagggctgcacgtagcgctcaggatcctggggttgggtttgtggctgagtggaccaggggctgactgagtggagcccgtggctctrtctctccctggggtcccacctggaagcccaaggccctcagaaaaggggtttccttgcctgtyatggccctaccctccaagctgtgtcctggatcttggcagtgtccccctgagcgccctggctcagmcatctcctgcctgaccgyagctgagccacgtgcctttgtcctttattgcagcttcatggcggctgaagagatgcattggcctgtccctatgaaggccattggtgcccagaacctgctaaccatgcctgggggcgtggccaaggctggctacctgcacaagaagggcggtacccagctkcagctgctgaaatgtgagtccctggggtggtagggtgcacagtaggagggcatgggggcagggctagccatgtaagtaagcatcctctccaagcctctgcttcctcacatggtgtgccctctggattttcccattccctctctggtggctggcacccctggagaagcagaggttgacttccctagcccccaggactgtagcagggtcyggggtggtgcacagtgctggccagctggcaaggggagctgcagcctgcagccaggacctggggaccacaggtggccaggtaggtctggcctctggtgctgccctcactgaatccgtgaatgttcagtgagttagttggtcacttcgcccacagtgaacctatgtgtcaagtcctggctgggtgctggacctctggagctgcacaagacccaggctctggcccccaggacagctggctgggaggaagaagcagccctcaggcttgagagatacccaaatgctgagatactgaaggccaagagcatcagggcctgagcagcaggtgctccatgcctttgcagtagcagtgccctctgccagggactccctggtcctgggccgcctggttgagatgtccaggctggactgattggttcctgtacgggcactggttgagctgttctcctctttgcacagacagcctccttggaggagctgtaactggcttgtcccccagcctgggacagggctggggcagtggagctagggtggtttcagtgtaactttccacctaggggtggccccacaccagtggctctcactggcaaactctccgggctcctgagtctccctcttttattttattttttcgagacagggtcttgctctgttgcccaagctggagtgtagtggcgtgatcatggctcactgcagcctcaacctcccaggctcaggtgatcccctcagctgggactacaggcatgccactatgccctgttaatttttttttaaatttcttgtagagatggaatttcattatgttgcccaggctggcctggagctcctgagctcaagcgatccatccgccttggtctcccaaagtgctgggattacaggtgtgagccaccgcatccagcctattttttatttatttttgttttttatttatttatttttttgagatggagtcttgctctgttgcccaggctggagtgcagtgacttgatctcagctcactgtaacgtccacctcctgggttccagcaattctcctgcctcagcctcctgagtagctgggattacaggagtgtgccaccacgcccagctaatttttgtatttttagtagagacagcgtttcaccatgttggtcagcctggtctcgaactcctgacttcaagtgatcctgtcttggcctcctaaagttctgggattacaggcatgagccaccgcrcctggcctatttattatttttatgtctcactctgtcacccagactgcagtgcagtggtgcgaacacagctcactgcagcctcgacctcctgggctcaaatgatcctcccacctcagcctcccaagtagctggaactacagatgtatgccaccgtgtccggctaagttttgtattttttgtagagatggggtttcacatgttgctcaggctcaccccatcttttattttyagagacagtctcactcttgtcacccaggctggagtgcagtagcacgatcttggctcactgcaacctctgactccygggttcaagcaattctcctgcttcagcctcctgagtagctgggatcgcaggcgtgagccactgcacccggccttagtccccctcttttagctctggggtagtgggagcctccaacagccctgcagcacccagcaagtcagctgtggcctccctgggcctctggtcctggctctgccttgcctcatgctggctccacacagccccccaaatctacctcttctttgtgggcagccaggcctgccctcgggtggcactctggggctagccagtgtgcctacaattttttccgtatttggccccagagtgggctcctggggagggggcagcatgccagccttgctccctgctcttccatttggtaaggcttagaggcaggaggcctggccccaagttgtcctgtggagggtcctcacagtgggtcttggcagctgcccctccaggctcaccttcctgcccttgccacctcccacagggcccctgcgctttgtcatcatccacaaacgctgcgtctactacttcaagagtagcacctctgcctccccgcagggcgccttctccctgagtggctataaccggtaagtgcccgacctgcctgctgacctcgggcccccacagccagcgggtccctcccagcagagccccagctgggcctgcccctwattcccgcccaaggaaagtgctttcccgaagcagccttcgtgcccatcccctgtcctccccgcccagcctccacagtgcctcgccctctccgcgtgtcctgccctcaggcgcaggaccttgggggtgccagggtcttcctgtggctttgtgcacaagtcccagaggcctggacagcctgctctccagagtctccactcggccaccacccagtgacttctgcatctctcctccctccccaccttgccccttcacccaccatgacctctttccaggcagcccagaccccagccagcccaggccctgtcccaaacagaggctgggccctaggattccctgctccagggtcctcccaggccgggatcagtttccagcttcacgcatgtcctgggctgggctctatccagtgatgggccatgagctgccctggagggccttctgcactaacaggcaggtgggcggtggccaggtggcatgtgggtgggggagtgcactggcacagcccatggcctggggcccacacaaagggttaatgctggcacccagctctggttctggttgctatcccatcggagccctgcaccccacagcatttatctatgcctcttaccaccccttaagggcccagcccctcctgcctatgaggaaccaagggtcacatggtatcagtagtggaactgggacctttggagtgactctaggccccggcctgcaccctggccacaggcctggtagggcagccttgccagagcacccagcctggtgccaggcccccatgctggcacagagctccggggtcccctggggaaggtcgttccctttctgcagacagacacagcgccttccggcctccagcatgtgccagccatgccatgaaccctgggcccagtggcagatgcaatcatgccccagggaattgtctagcccatcagggaatgctgggcctgaggagttttggccaggctcttatgggccgtataagtgcacctgccccggtgcctggctggcagggctccccacgtgataaactcagcgcaaaccccacatcctggctgtgtgagtgggccgcagagcaggcacgagtcattccctgaaatgcactcagggctgctgctgggcctcaggggcacggagccctgtggggtaccccagggaggccaagcaggcctgggcaaatggggccagaggtgggagggtggcgtccatgtaaagtggcattggcgggcatcgaggcaggtttgtccttgtctcctgtgcactgctgctcccacgaagcccacccagcacccctcttccatgcccctccatgcccccttacgcctgcctgggcatgaagctcactactgggagcatcagcagccagggcccacccagatctgccctcttccgttggggcgtggtgctggtgccgagacgtgttcacaggggggtgctgtgggaaggccatccctatagctgtgaaccaggccgtgacccctggcgctgtgcccccagggtgatgcgggcggctgaggagaccacgtccaacaacgttttccccttcaagatcatccayatcagcaagaagcaccgcacgtggttcttctcggcctcctccgaggaggagcgcaaggtgactgggggtcckaggacgagtgcaaggtgactgggggtgtgggcctgcaggcaccaggctggacctgccttgggggctcgctggtcctggggcgctggcctctcagccccgggcaaagagaaggtgtggctgggacacaggcagctgggtgggtgctgccccagctccatccccatgcccagagcctggtgccagcgcccacacaaggaayatgctgtcctgggaggtgcccctgtgggctgaggggagccacacagccatgttgtatccagccgggtcgcctcctctgaccttgggagtcacagcagagcaggcagggcagtgaaggtggaggggtgcggtggggyccaccctggtggcaccgtgcccaccacagccccgctgacctgcagagctggatggccttgctgcgcagggagattggccacttccacgaaaagaaagacctgccsttggacaccaggtgagcccgggcccagggcataccgggcagtgagggtccctggggcgcctgggcctgacccgggtgtccrcctyccagccccgggcttggcatagaattccgtccttaaaggtttcctggaggtgccagctgggctgcgtctctctgctcctgtctacagataaacacagatacaggacaagcacagatgttcacacacagacgagcgacacgcggacacgcacacacaaacacaagcaacacgcggacatgcacacacacagagcaacacgtggacatgcacacacacacagagcaacacgtggacatgcacacacacacagcaacacgtggacatgcacacacacacagcaacacgcagacatgcacacacaaacacagagcaacacacagacatgcacacacacacagagcatgcacaggtgtgcatgcatctctctgctcctgtctacctccagccccatctgtcacatctgtttctgtgttgccgccatgggtagttcctgttaggggatcatgtgtgtttatacgcctgccaccagggaggcctggcatggcagcagctgggcactttgggttcccagccccctacgcccaccctggctcactcagagtgagaccagaatgattctcctggcggggcgccactgggcagtctgagccttggcagcctcccccgtgagctggcccgacgtgcagcagatactctctggattgggactycctggcccgagacgatgtggagggaacaaaccttcctgtcctttcacaggtggggacaggaggcccagggagggctgggcacagccaaggctgccctgcaggtccctgcctgactccgggctcccgtcccctggtccaagctgttcagcctcgggcccagcccagagtcgcccaagccctcttgaggcaggagcaggtggagacgtgggcacagtcagggcggccatccttgtgggccagaaggggcacctagtggaggcaccacagcctccagttcttctgtctgtccttgtaactgtgtgtgcatgtccgcgtgttgctctgtgtgtgtgcatgtccgcgtgttgctctgtgtgtgtgtgtgtgcatgtccacgtgttgctctgtgtttgtgtgtgcatgtctgcgtgttgctctgtgtttgtgtgtgcatgtccgcgtgttgctctgtgtgtgtgcatgtccacgtgttgctctgtgtttgtgtgtgcatgtccgcgtgttgctctgtgtgtgtgcatgtccgcgtgttgctgtttgtgtgtgcatgtctgcgtgttgctctgtgtgtgtgtgcatgtccgcgtgttgctctgtgtgtgtgtgtgtgcatgtctgcatgttgctctgtgtgtgtgtgcatgtctgtgtgttgctctgtgtttgtgtgtgcatgtctgcgtgttgctctgtgtgtgtgtgcatgtccacgtgttgctctgtgtgtgtgcatgtcctcatgttgctctgtgtgtgtgtgcatgtccgcatgttgctctgtgtgtgtgcatgtccgcgtgttgcttgtgtttgtgtgtgcgtgtccgtgtgtcgctcgtctgtgtgtgaacatgtgtgcttgtcctgtatctgtgtttatctgtatacttccatgtctgtgtgacagagtccttgtgtctgtgtgtctacatgtctgcgcgtgtccctgtgtctttktgtatatatatccatgcctgtgtgcctgtgttcctgcgtgtgcttgtgtgtgcacgtgtgcatttgtgtgtttgtcagagtatgtrtgcatgtgtgtgtctgtcagcgtatccatgtgtgcatgtgtgtgtctgtcagcgkatccgtgtgtgcatgtgtgtgtctgtcagcttaaccatgtgtgcatgtgtttgtcagtgtatcygtgtgtgcatctgtgtatctgtccatgtatcygcgtgtgcctgtgtgtacctttgtgtgagcatcaagggacctcccaggcctggtgctcaccgtccgccccaacgcaccctgcattgcagcgactccagctcggacacagacagcttctacggcgyagttgagcggcctgtggatatcagcctttccccgtaccccacggacaatgaaggtgaggtctttctccgcatccactgcccgttygcctctccccacctggcctcctcttggccgctgtggaggagagggaggtgtgttcggctgtgctccttgctctggccctttggcagtgcgcagtagcatccctgggctctggccttcagcggcagggtctggactcacagtcctcccagcaggtgcttgccccttgcctcctggactcagccccatgcatggagcattgctcggagactgggcctgggccggtttggctctcaccacmcccctctccccatgcagactatgagcacgacgatgaggatgactcctacctggagcctgactccccggagcccggaaggcttgagggtaggtgrggcgggtgggcccggggagctctgggtgtgtaggaagcaggggctgggaccgggagcagagcccctccsaggctggggatgctggcccaggtaccgctctgggtggcttccgcttccctgctgtgtcccaagtattatgaggattggagcagaagaggtgtagctgctgccacctctgctcatttcctcctcccacctcccaggaggagggacaggcacatggcgataagtggcaggtggagccggggtggccctgggggttaagcatggggaaggaaggacgctgaggagcgcgcaggctcagggcaggtccatgtccccatggctgccagcttgtgtggacactgctgcaggccaggtcgttgtcccaccccaccccatcccatcccagtgtccacctacctcctgcagcacatggcctagtcaaagagacaggctgatacaggtggtcacacgtggatgacggaagcacgagctgggtggggaggacgtgtctctgtcctcctctgtcscctccctcccttcctccctccctattgtctctccagccccctcatcttgtcaatttcctcatgtctggggctgatccttgatccttccattttccctgcgtccgccctgcctccttgttttccagcctcctgttctcactgacttggcctctgctgaccccagcccctgaccccgtatcctctctgcctcccatcccctcccaccttcaggctcccgggtccagcccctcttctcctgccgctccctccctccttccctctggggtcccagtgccaacagtccttcagcccacsagggtctgcgggccgcttgcctcagtttccttccatgcagagctcttgtctcacagtgttcaccatgcctgtcccttcgcccacacactactgccttccgtcttagcctggctggccaagccttggtgaactcagactccgtctgcccagccctgagctgcagcccagtgaggctagagatgggcctggggagccaccagtgctcctgcatgctactgctccactcaccctccctctgtacccccttcatcctctccccgagacatttctcgtccaggacgcctgtggcctccccattcccagttccagcgctcagtcctgagccacaccagcctggcgcctgccctgttccttgccagcccgtcctccaggcgccccgtgctcccagggtcctctttctcctcagctcctgtgctggccccatgagggatacccgggactcagacctcactcctctcccgaattccctgggtgacagcctgggtcatctgcaggctgcccgctccgagtcatgtccagcctggatttttgaactctgcacacattccctgaccccgcatcccctggcatctcccagctttctggatatgttctgagcaaacacgggccttcaccttcctcccagctgctcccctcccctgtccttgggaattccgtcctccctctcgctccagccgagccctgagatccttcttgacttctcttcctttctcttccttccacctctgggaacctgatgggctcctcaggtgtcctctaggcttcaggaagcgtccacaggctgccatagggaggatgaatggggaaggctgggggtggtgggtggtctgggaccctggggaaggcaggatgggagtgctgggtgctgggctgctgggtgggcaggctgtggggtgggcctaccatgggttgcactcctggttggcctggctgaccactgccagcagaggatagtgttggcccagtctctgtcagggtccaacccgggtctctttgctctgcagatgccctgatgcacccaccggcttacccaccacccccagtgcccacgcccaggaagccagccttctctgacatgccccgggcccactcctttacctccaagggccccggtcccctactgccacccccgccccctaagcacggcctcccagatgttggcctggckgctgaggactccaagagggacccactgtgcccgaggcgggctgagccttgccccagggtacctgctaccccccgaaggatgagcgatccccctctgagcaccatgcccaccgcacccggcctccggaaacccccttgcttccgggagagtgccagccccagcccggagccctggacccctggccacggggcctgctccacttccagtgctgccatcatggccactgccacctccagaaactgtgacaaactcaagtccttccacctgtccccccgaggaccacccacatctgagcccccacctgtgccagccaacaagcccaagttcctgaagatagctgaagaggaccccccaagggaggcagccatgcccggactctttgtgccccccgtggctccccggcctcctgcgctgaagctgccagtgcctgaggccatggcgcggcccgcagtcctgcccaggccagagaagccgcagctcccgcacctccagtgagtttgtgtggcggctgcaagccctgcctccagctasagggaccctggcctggcctctgacgggcactctgcccacctcgctcccctggcactcttagcccacgacggggtaccaggtgcaagggtaggaaggttcccggttgcctccagtccgccttggtggaacgtggagcatgtccatgactcagccctgaagcttgctggaaatgctttgtttttttttctttttgagacagggtctcacgctggcaaccaagctggagtgcagtggtgcgatctcagctcactgcaacctccacctccggggttcaggtgattctcctgcctcagcctcccaagtagctgggactacaggcacctgccaacacgcccggctaatttttgtatttttagtagagacaggggtttcactatgttggccaggttggtcttgaactcctggtctcaagtgatccgcctgcctcggcctctcaaagtgtagagattacgggcgtgagccaccgcgtcctgctgaaatgctttctgctttatttctgggaagtgccaggagaccagtttgtcccccactcccacagagttacgccaatggctgtggtcaaaggcatctgggaccccaggtgggcttcctgccttgcctggcaggcaaagggtccaggaactggaggggcaggtttcgcatgggtgtgctggccggcacgcgcacccccgaatgcccttgcccacggtgcccttctcccagggctctgcgaacacctctgagatgcctgctgcctgtgtggaagtgcctctgagcagcccttgtcacactcgtggttctagttcaccaagggctgcagagatgcagatgttyggaagtcacgtttttccatgactgtggggatagcggttccagggctcagcctcacccacaggctggcctcccatgctggcgtggcccgttaatcctccctagagcctttgaggctttgctgagcaggaccggctagccacacagggaggcgtgcagggacgccatgggcgtcctttggggtcacactgcattgttcatccagttcacgtccactcccctgtggctctgagtgggctgtgatttggccatgaccggacctcccctccccacgagcatccagagcacttgttgacggtgtgatgacactgagcttgggaaccctggactcccttgccagcatccatggcagccctgacccctgactccggtgtcgggcgattcctgctgtcccagggcagtcagcacgagccctacccggatctctgttgtcctgagctttttagggtcacaggggccatagcaggcagcttgccgtcctcacacagagggtggagtgggsaggggagcagagggtggccgccccgtgtctgacagtgaaatggtcctgccttcctctccctgcccctccaggcgatcaccccccgatgggcagagtttcaggagcttctcctttgaaaagccccggcaaccctcacaggctgacactggcggggacgactcrgacgaggactatgagaaggcaaggctgagcggcaagcctgggtcccagtggccagtaggtggacaggtggtgggaaagccataggccagggcggcccctcacagaccgtccygagcaaggaccccccgagaaccygggagcctagggggacacagcaccatgtaaagccccggatcccggcaccgggtggccaccgtcyggggagtggtggtgcgggtggatcactccgacgttggcactgacaccgtcagcctcttgcaggtgccactgcccaactcggtcttcgtcaacaccacggagtcctgcgaagtggaaaggtcagcacaaagccctgtgtgtgctgggtcctccgccatgcccggcttcctgcttctgtgtccctctcactagcttccgtgttggggagttgctggcacaagttcatggccctgcgtgcagcagaaaccagaggagtggacctccctgctctgtcccatgcccagctggcaccctggctggccagggctctgctgggctgcttctgtcagcctcacggcagcccgacgtgctcagctcctgagacctacaacagcgagagracagaaagccaggcttgggagcggggcgggaaggtccgtgtgaaagctgcccgaggaggactcacccgctaatatgactgwcttattttaggttgttcaaggctacaagcccccggggagagccccaggatggactctactgcatccggaactcctctaccaagtcggggaaggtaggcgccaggggaagatgccccagggcccctctggctctccacacacccaggctgtgggtgggcccaggactccacagttcctaaaccrctccccttgtggactcttacttggtgtctcagctgaattctcttcccagcagcaccccccaatctattccctaatagatctccatctgcaaattgggggccatgatggccacctcccagtgggggccaggactcgggtggggtagggctcatgctctggggtggcggaggccacatggggcaggggaacgccaggtctgcccgtgtccctccgagcgtgaagttgtgacctcactgagccatgctctcccgggtgtgtcggagtggttattggtggttatgagctgttgctcatcagaggctctctgagggctgccagtgtcgyccccgctgtccttgtgcaggtggtctggagtccctccccgccccccgagggccacaggacccagccttgatggttctgcccccctatccccagcccatggtctcccgaggctggtcccgctgtttctcagggagccgtcagcctcccgcttccgtcctgtaggtcctggttgtgtgggacgaaacctctaacaaagtgaggaactatcgcatttttgagaaggtgagagggctctgagtgggacggggaccctggccgcatggcctggcaaggggcagggcagaatctccctgatgaggcataggcagcgggtagactgagactggcacctccaggataccgccctccccttcccctccaccatcgctcaccccccacccctcctgctcagcctccctcctctcgtggcctacctttgtcctccactgaccctagtggggatgggcggtcagccatagaccctgggttgcttgtcttgtctttttctttttgcggggacaggggtctcactgtctttctcaggctggtttcaaattctggggctcaagcaatcctcccacctcggcctcccacagtgctgggattacaggcgtgrgccaccgtgcctggcctaggttcatttcctgaccttgtctgaagtgctctgggtgcaggctcctggacatggaggacggaggggaagtgaggtgggaacatggagagcacaggcctgatgcggaggccaccttgggggcaccaccgacagccaggggccagcctggtgatgccgctgttgatgctgctgccttgttttacagacggggagactgaggcctagagccgcagagtggcctggccctgctgacgctcccccttctcttcccccacaggactctaagttctacctggagggcgaggtcctgtttgtgagtgtgggcagcatggtggagcactaccacacccacgtgctgcccagccaccagagcctgctgctgcggcacccctacggctacactgggcctaggtgatggcagtccatgtggctgccaggccaaggcagtcacaggggycctgaccccaggccacacagacggacatgggcccacatgggagggtgagcaggagcaaggctgtgcttgcctagggcctctgtgatggacatctcgtaggacccagccagtctcatccagcaggttgggttctagggctgaaccaggcgccaggctccagaggacgaagggactctgttgccccacactaacttgccctgtcccaatcccagaaacccaggaccaagctgtgcctgggctccaaggacaggaacactggtccccccatcacactcacccctaagtgggctgggagccaggcagggccagggcagctgggtgggggccggggctggccctgggacccccaggaacgctaagacacaggctccagtaggggctgttgcctccaataaagcagcagtgagctttgccttggtggctggggcttgattgggaaggaggggattaccagcttactgggtgcccatgctgatgtctaagtggtgaccgcagcagtacccgggaaccccaacagttggttgtcttgtcttccagggtgcaggtcactgagtgacttccccagggtgcacagcgagtaacagatcaggacccaaacttgggcagtctgggctgggagcccacaccccactcaccagttctgctgcctcaggtcaggccagggcagtgctgctgcagagctagaaggccctgcagctacagctgcttcattccctgcattagtgcctggttactgggtacctcctgagtggctgtccccgttccagaacttgcatacactgagcgggctacagagctagaaggccctgcagctacagctgcttcattccctgcattagcgagcagttattgggtacctcctgcatgcctggtcccattccagacaggggcctctggcctggctgagttcacagcccagtctggggacagctgggtatgaggtgcttacggcacagtgtccagggcagctgggtgtgcagggactgggggctcccggaagattttttggaggaagtaacagctaygatgggatgggaacagtggaccctaagcaggccaagggtgcgtagggacggtggtacccagatgcccaagtcttccaggcaatacctggctcaggcccagccccaatccatccccttactttctgccatggagttccagcaggtcactctccctggcacaccttccaggctggatttttaatgaaacagactcagggaggtaggggctggcagggaccctagaatccttgtgatttttcttagcaccttatgtcagggaaacctaaactgaggtcagcacttgggcccactgacagtgactgactgggggagaaggtcctgcagcccccttcccctgggtgtgttctggggacctgtggtttgctggcggaaacaagtgatgaggctggttagcggatgtgggaggctgtgaccccagggggccatagggtgcggtggaactgcaggccctgcagatgacggcagccagctgcttccaggaaccaggtgtccaaggccacctctgcaggggtttcctcttcagcctgcctggggtgagaggtcagtgcaccacagccgaggctggagcacagggagcttctgttgttctgatctatctctrgaaaaccagccattcctcctccctgcagtcagaattctttgccctgtctgacctgaacttgcttagggagtcatgccactccccactgtggccatagtttctcttcctgtaaaattttattattttagttttttgtttttgagatgtagtctcaccctgtcgcccaggctggagtgcaatgccgtgatctccgctcactgccacctccgcctctctagttcaagcgattttcctgcctcagcctcccgagtagctgggattccaggcgcccgccaccacgcctggctaattttttgtatttttagtagagacgggattttatcatgttggccaggctggtctcgaactcctgacctcaggtgatctgcccaccttggcctcccaaagtgctgggattacaggcatgagccactgtgcctggccccttcctgtaaaatttttaaatggagaattgggtgcgagatgtggtttccagcctggtgcctggggtgctgwgctagtgagtggtgcagtccaggacacctttgctttatstcacttacacggtcacctggagccggctcaagtggctaaagcatcctggggcccagagccaggtgataggtccctctggccaactggacagttgaggcctgtggttacccgaagcccagctggggccctggtccagcctcgcctcccagactctgcacctgctagcacagctgtccacgtctgtgtgagctgctctaggccgagggcctcagtttcaagagtgtgttggggtgggatggggcaggccgtggtcctccagcatgaagaaggagccatgaggagttcccatgacctcccgagacttgccataagtgttctagtccacatataagggtagggttgggattaccatttactgaccacatctgtgaggtgccgagctgggtgcttgacatcatttgcttggagaagcagctgctagtagacccattttacaggtgagagaaccaagtctcacagaggcctgggttcaagtcccacctctgccactaactggcatgtgaccctatctatccttcactgctctgagcctagaccctggcccctgcctggctccctgccaggctccctgccacccctcacgacctctgatggtcgttgtgggggtctcttgcctggctcccagggctagggttagggctctggaggtgctttcactcaaccaagggggccacagcactggggagtgaaactgccccgcctcaccctgygttgccctctgggtctgtgagggtgggctggcaggaggcctaggccttgccctaggggcagtcctgcttcctcattttatagatagggaaactgaggctttgggaggactcactgacatacctaccttcaagatgagttcaggtgggctcagttctggggcttgggaaaagggccccagtggctttgggaagcacccccagcccagggtgaaacatgcttcttctcttcctgtggttccatccgaaggattgtggtgagccccgtgccttcagttaataaagatttgtattgtgaaaagattttttcttttttttttgggacacagtctcactctgtcgcccaggctagagtggattggcgtgatctcggctcaatgcaaatctccagggttcaatcgattctcctgcctcaccctcccatgtagctgggattacagctgcctgccaaatttttgtatttttagtggaaccggggtttcaccatgttggccaggctggtcttgaactcctgacctcaactgatccgcccaccttggcctcccaagtgctgggattacaggcgcgagccacggcgcccagccttgaaaagatgtttttagaaccagaagaaacctcggttcccactgatccttctgggccacgttgtgcggagctcccctgctggttggggctcagcgcagccccagggaggtgcttcctgcacctcaggatgggcgagggtgggcattgggggagagggggacctgggacctgcggcttagttccctgaggcaggcagggcttattggggccatttcatagaaaggcagattgaagctcagcagggaagaggcttttgagggtgatccaggcgctggagggatggcctaggacaccagggtcacaccaggaacatgggagggccgtgcttgtctctagacgaggggaatgggggaagggccacaacctctgtttctgtgacccascagcatcaagcccctcgctgggcacctcgcacacaccccctgccttatctctgcctgcacgccctgttccctccacctagactgcctgctgagggggcagtgccaggaggttgcctgtccttggggaagaggggcagtgaccctgtgaagatgcttgacagacaacccccaccacctcagaagtgtgtgtgagtggtgaacccttttaagccatcttccarccattctcactggagggagatttgatgggtacagagcagacccctacctgtctaccctccttcggacccctaggaagcttcgcaggccttccaggctgccagacagctgccctggcgttgccgtctgcttcttccctggccccactctgaggggctcagagctgaggcagaatccctttttcattcatttcctgcagaataaaacaacatacagaaaagtgaataaaacataaatgcacaacctaacacactgttaggaagtgaacgatctgcaaccaccatcaggaaatagttttgccagcacccaagtgccctcccctcacagtgtcacttccggcctctctgccctggcttatgtgagtcttgtgttcttgtttttctaaaaagtcttcagcacccaattatgcaggcattgcagtattttcctgtttctgtgctttatccccttgaatcatacagatgcaaattctggcagctggcttctttggctcgttattatgtctgtgagatttattcatgttgctgtgcgtagtatagtttgtgcatgttcattgctaaaaacttccattgtttggctgtatcgtagttcacagattcatttcactgtcagtcaagcttgtccaatgcatgcagcccaggatgcctttgaatgtggcccaacacaaatttgtaaactttcttaaaacattataaagatttttgtttgcgatttttttttttagctcatcagctatagttagtggtagtgtattttatgcgtgacccgagacagttcttccggtatggtccatggaagccaaaagattggacatgcctgctgtagatggacagttggtttgtttctagtttggggtaactacacacaatgctgctagcaacagttttgtccatgtctctgatgcacgtgtgttttttgcaaatggtgcacaaatttttctagggtttgtactcaggagtctgactcctgggttctagggtatgaagatctttctaaatattgttctagtttacgtgcccaccagcagtaaaacagaattcccttgccttcccatccttggcagacatttcacttttgccagtctggtggggtgtatagttatggccttaatttgcatttagctaattaccaaggagattgagcatatttttatgtttttattaaccattttgattttgtctcctgtgaagtgtctatcatcttttgcccattttttaacttgttgtctttttctttttcttttctttttttttttttctgagacagggtctcactctgttgccctggctggagtgcagtggtgcaatctcagctcactgcagccttgagtcaggctcaggtgattctctcacctcagcctcccaagtagctgggaccacaggcccacaccaccaagcccagctaattttttgtatttttaagtagagacgggtttcatcatgttatgcaggctgctctcaaactcttgagctcaagcgatctgctggcctcagcctcccaaagttgggattataggcgtgagctaccagattttttcttattaatctaataattctttgtatagtcttgatattatccataatgtgtattgcaaatatcttctctaactctggcttgactgtttatggtgtcctttttttttggggggggttttttgagacaaggtcttgctctgtcacccaggctggagtgttatggcacaatcttggcttattgcagcctcaattcctaggcttaaacagtcctcccacctcagcctcctgagtagccggaactacagtcacgcacttccatgtccagataattttttttttttttttagagataggatcttactatgccccagctggtctcaaactcctagactcaatgagcctcccatcttgacctcccaaagtgctgggagtacaggcatgagccactgtgcatgccagttcttatttttaatgcagttgaattgatcagtgttttcattttggttagtgctttttgtggcttaagaaattctttccaggctgggtacagtggctcacacctgtaatgccagcactttgggggcagaggcaggaggattacttgagctcaggagtttgagaccaacctggacaacatggcgaaacaccatctctacaaaaaatacaaaaattagctggacatggtggtgcgtgcctgtagtcccagctactcaggtggctggggtgagaggattgcttgagcccagaaggtcaaggctgcagtgagctgtgattgtgccactgcacttcagcctgtgagacagagtgagaccctatctcaaaaaaaaccaaaaaaaaaaaaaaaaaaaagaaaaccactgaaattatttccactccaaggtcatgaagatagtctcttagattatattctgaaatccttataaatgtaaatttcatatttaggcctttaattcacctagatttggttttttgcatatggtgtgaggtaaggattcactttcatttttttctctccatagggttacacacctgtcctatcattgtttgtaatctaactttctgcgcccatctgcaatgccacctctgtcatatgtccacatatgacatatgtagatctgttgttggattctttcctctgttccattagtctgtctgttcttgtgccaatatcaagctgtcttcattattatcaattatgtattgagatctgataaagtaagtcttttccaccttatttttcttctttgagagtgtcttgactattctggctctttgtattttcatgtaaggtttttctcccatataagttttaaaatcagcttgtcaattccaacaacaatgatgcacttgatagtttgggaatttattatagctatcaatcagttttgggaaaattgacgtctttacaatattgagttttctgattcatgaacatggtttacctctctttccatttgggtcttctttaaggtttaccaataggattttatatttttgtccattgtggtcttgcttatcttaagtttgatttgtaaatattttatgtttcttttagtctattgtaaattgtgtatttttaatttcatttttttttttgttaatagcatataaaacacaccttgtcttttaactggagcattttgtccattgtgtatttaatgtaattaaatctaccatcttattttatgctacatattgtctcacttgtgtttgtgttttcttcctcccttttctctccttttccccttctttgagattgagcaacttaaaacaaatcatttcatttccccccttctcctagttagaaagttaaacactctctattcttactgaagtctagagttaactaataaatacttttatcctcctcctggacaacataaggacctcaggtgactttcattggtctccctcattacttgatattattgttgtatatatctaattctaactcaatgtattttaaaactctcacctaagaccgtatttgtttttttgtttttttttttttggaggcagagtctctgtcacccaggctggagtgcagtggcgccatcttggctcattgcaacctccatctcctgggttcaagcaattcttgtgcctcagcctcctgagtagctggaattacaggtgcctgccaccagacccagctaatttcttgtatttttagtagagacagtgttctgccatgttgtccatgttgatctcttaactcctgagctcaggcaatcctcccgccttggcctcccaaattgctaggattacaggcaagagccaccacgcctggacctttttacttttttgtagttggaaaaggaaggaatattttaatagctttaaaattgttttattatgataaaattttcatattataaagtttatcattttaattattttaaagtgtacagttctgtggctttgcgaatattcatattattgttcagtcatcaccaccatccatctccagaactttttcatcaccccaagcttaaactctgtacccattaaacactaaatccccattcctccagccctttgcaaccaccattctacctcctgtctctctgaatttgactactctagacacctcatacaagtggaatcatacatttatctttttgtgattgggttatttcacatagcatgtcttcagtgttcatccatgttgtagcatgcgtcagaatttcctttcttttggccaggcatcgtggtttatgggtttatgcctgtaatcccagcactttgggaggctgagtttggatttgggaagattgcttgagcctaggagtttgagaccagccctggcaacatagtgagatcccgtctctacaaaaaataacaaaaattagccaggcatgttggcacgtgctggtagtcccagctacttgggaggctgaggcaggaggatcccttgagcctaggaggtcaaggctgcagtgagccatggttgcaacactgcactgcagcctgggcgacagagaccctgactccaaaaaaaaaaaaaaaaaaaaaaaaaaggcacaaaaccccaataaatagaatttccttctctgcataatgctgctatgaacatggtacaaatagctgttttcatttctttggggtatatatccagaagtggaattgctggattatgtggtaattatgtttaattttttgaggaaccactctacggttttccacagcagccacaccattttacattcccgtcagcgatgcacaaagggttccaatttctccgcatctttgccaacacttattttctttttttcctcttcttcctccttctccccccttgaaactttttgttttcttctcgtttttgtagagaacagggtctccttatgttgtccagtcaagtctgccaactcctgggctcaggctatcctcctgtttctgcctccctaagtgctgggattttaggctgaagccactgcgcccaactccctgcttcttcaactgccatcctaatgaatgttaagtggtatcccacagtggttttgatttgcgtttccctagtgattaactatgggaagcagaagtgaatgagacagaattgtgatcttgtcagaaaaatcgtcttggaaaagccaacgtccaacagaaatggttagaacaggggtcgctggcttccatccagacagtatccctgacccttgttggggcaatgtcacagaggctcctgctgagcagggaggtctggattccacactcttctgccactgcccagctctggacctaagctttctatgggtgtcaagaggacaagcagccgtgcccatttgtctcgctgcttgtttttttgggtgtcagatgcgccagcaggagggacagtgtgcgggaaggtgctggtctgaggctggtcctgccaaagccccgcaggctcactccctggtcgtgcggaggtggctggtgctcgctggtctcctcagcacccgcaggccgggcccgggggccaggcagttgtcctctgtggagccttatcggggcccacaggccctgctgccttgaccccacccgggccccaaaactcggcctggggactgcacaaggcggggctacgcggggcagggcccgtctgctgggggagtgcgctgggcggcggcgggagggcagggtccctgggctccgacagcccctccggcggaggtcaatcacaatgaaaccgtgtccagcggacccggcaggggctcgccgcagtctacctggccaccgtgaagccatgacctggcgcccgaagctgccggccggggtgtactccgcgcgggaccctgggcctccgcaggccccggcggggtcgccccgaggcgggcctggcgagtccaatcgccctgcccgcaggggacccgcccctcatgggtcccgccaatcgcagggtacgttgctcggcagtgctgcgcggcttggcctatgggacggcgcgttgttgggctgcagcgccgcaggccgcacccaggtcgggcggtgggggcgagcggaggggctgaggggcggagaggcctggcgggccgctgctgcgggccaggggacgggggcggagccggagccggagccgacgggcggtggccgcactgggaccccggaatcccgcgcgctgcccacgattcgcttctgaggtgaggctagctagcgggggcggcgggggcccggttcgggctgaggcggcggcgggggcgcggggaactgggccgcggttgcggcgggcgggggccgcggggcctgcggcggcccgggcagcctcgggggcggggaggccgctgcggcgccgagggcgtcttggaggggtccccgcggggccttcggcctgggccgagccggggagcgagggcgccgcagatctttcatcgggataggaccccggggactaggcttttcccgggccgctcgttcctggccggcttgtgggctgcaggggtgggggcggaggaggacgaccctggctggacgctggtcagcatcctgcttgtgagaccggttccgcggtccgcagcgctggtggctgcaaggtttgtgtacggacgcatctgtcggctctcgtatttaaaaacgacggcttctgccaaaagagaaaagccatatctgccgacggacgctcgagagataatcgtggaactttatcagcgatggggctgttggtcacctttgccctccctctcttttcttttttcttaatcttttattttcgttttttgggagatgtcagagggcctttccctgttaggatgacttttatctttgctcttgtaatggctcaagatagttgggaggtaatttgcattcactttatgcatacccaccttgaaaaacgtattttggttcgcctgaaactgttgttggtttgagcataatttatgtttagaaagacaaaaagcaattgtcatatctccaaagaccaaagacatagctgatagctgtatgcattactggtaagttaaagaaagattttttgtgtgaaaaattgactgagatcttaatggggataggaaatagaatgctgataggtcgactgtgtctatgagtagaggcgcctagtgaaaacaagcttggagtggatgagtaggagttcaacaggcaccagagagaggagggcatttcaggcagagggtgtgaattgtatgaaagtgagtttgtaaactttggagccttgaatggacaaaggcccgcgatgataccttttttttttgagacggagtctcgctctgtcgccaggctggagtacagtggcgcgatctccagtcactgcaatctccgcctcccaggttcaagcaattctcctac

SEQ ID NO: 17943 - DNA, 16896 bp, Homo sapiens
aatatgaagggaagtaaaatcataagagtgggcagtgacggtgagcagtgctgggctggagtaaagcagatgctgcatctcaggcggcagctgggaactgtcgccttgtgtgcttcctccaagaggccgcacggagggtgcaccagcgcccaggggtcagcccctgccaggcctggacagtcagctctgagccgcgctctgcagtcccgatgggttttccaaggatggtctcactatcctgcacaaggtgacaggaagccccaagggacagtctcagctggacccaagaacaagtctttgatggcacatcctgtcctctacaggctgctccaaattcacctatggcctacccgcctccctgcctttcaccctgaccctgacaggctgtaccctgcatccacttcctgcttgacatggctgtggcttgtgcctttcatcctgccccaaccctgccccttattggcccgcaccagcccaggatgctgctggagccgaaggcatcagtgccatctccgcagctacccccacaggaccgtcccgcaccaccagcacagccctggcagccttgcctcgtgccttcccctcatgcgctccggcctcctcgcaggcctggcttcgtctctggagtagttctctgcacctggaactccccacagccatgctgctcgcgcccacacccttgggaagccaggccttccctggcccacactgtgccgtgctccctgcgttttgtctgtggtgctgacccccgggcacgttacaccgtccttgtctctgccccactaggatgagagttccatgaggacagcaactcggctcgttccggccaggtccctggagcatagagcagataagctagctatcacagactccgtcgcctggtcaaaggctgatgaggatgagatgtgagccctgccccttatcctgtatccacttcctgctggtgtggctgtggcttgtgccttttatttaaaagaatttgggttggcctggccgaggggcacagcaggtctcatggtctcggtagactgggccagtcaggcccttgagtttggtctccatggagacgaggcattccggcactcgaaggttacatccacatgggcccaggagtggctgtatctgtgggtgcagccagggttccaggacacacctgtgcaggagaaagcgggtaggaccaacctcagtgaactgcctttcgggagattcctcagaagccaccagccaactcttctggaagccaaggtcttggtgaaaatgggtcttaaccatctggttctgttggcttgaaaataaggtcaaactgccaagactggtggaaaccctgccccgcctagcacccagcgtcagtttgcacactgggctctagcatgcacacggccccccgcggcagaaaggggttctcctgtgagccttctcacgaagcaagtggctcacggcctttcgtgccaagtttgtctgggaaagaggggttctgttgacgtttctggctgtgaggagcacaggctatggtgacctccaactccccaagtcccctcctttcagagagtgctctcaggggccagcccacggccctccctcttcaagaagacagtggctttacttcgttccggctgtgccaggacttgagcagccacagccttggcttacccccccgcccaccggtaggcgcacagcaagggcaccatcctgctgcagggagctcgcagcactgtcctcacgctgccttgacaccacagaacccgtgcgtggagctcagggcacgcagcaggtgagtcatcgcagagtcggggatttcgtgtttttcaggagctgtgtcagagcacactgaccgaaatggaaagccagaagcagctctgccggccgctgacctgtgagaagagcaagcctgtcccactgaagcttttcacaccccggctggtcaaagtgtgggtgctggcagcatctccctgggaggccagggctgtgggctcagtgggagctgacggggggcgtctgccagttctgcagttgagcagatgactacggagtgaagccacactcccaagcaggctctggctgagaggtggggacagactcttgcttccttaacagtggctttctggttgtagcctcgagtttggaagaaaacaaggcagtagtaaggaggaacaggaaaggaagaggctgatccacaaacacaagcgtgaatttaaaggggccgttcgagaaatccgcaaggacaatcagttcctggcgaggatgcaactctcagaaatcatggaacggtgagggggacgtgtgtgtgcgacacgattgtggtgtcactcagctttggtgctgtgtggccctgggcagagcaccgggcacctggcatcccacagccttggctctggctgggggttggagccaggcaggttcacttccccctgtttgaactgaacgtggccacggtggctaatgtggttctgatgtgggagagagagggcaagatgctctccaagaactaatccaaaaatgggcatttgccttttgtttcttttagggatgcggaaagaaagcggaaagtaaagcagctttttaacagcctggctacacaggaaggcgaatggaaggctctgaagaggaaaaagttcaaaaaataaattacattttataaataaggcaaggaactggacattacctcacatctgcaattccaaccctctgggaggccaaggcaggaagattgcttcagcccaggagttcgagaccagcctgggcaacacaggaagaccccgtctctaccaaaaaaacataaaaattagccaagtgtggtggcacgcacctgtagtcccaactactcgggaggctgaagcaggaggactgcttgagctgagtccaaggttacagtgagccgtgattgagccactgcactccagcctcggccacagtgcaagactgtgtcgcttaaaaaaaaatttttttttttgagacggagttttgctcttgttgcccaggctggagtgcaatggcacaacctccacctcctgggttcaagcgattctcctgcctcagcctcccgagtagctgggattacagacatgtgccaccacgcccagctaattttgtatttttagtagagacggggtttctccatgttggtcaggctggtctcgaattcccgacctcaggtaatccacctgccttggccccccaattataggtgtgagccacagcacccagccaaaaaagtaattttttttagagtaataatgctataatgttggtgtgattccaacctccagctccccccacccgctgcctgcggttttgtttctgttaaaacgtcacctgatgaaatagaatgaatcctgaaatgcacctctgggatcgggaatggtctgtgtgttatcagctgcgactggttcactgcgtctggacaagcctcatggggactggggattctggccagtgtaatttctgtcaaccacggacgtttgccttcatgtgtagaatttactgttgttatgcaaattatattttcaattataaatgaaacaagtttgcagatattttagaaatcagagaagggaaacatcacccacagtccctctgctggaacagccacagttggccttgtcctacttacgtccttcagtggatgcttctgggtgctggggttctccattcaggacactgcactctcggaggtgggaggagactgggttgcgtctgtgccgacctgggatgcagtttcaggtcagaatcagaagatgtgcaagttacgcatgacacagctttttaaagtgcttttcccctgcactaatcaagagggaggtcagccctcaggtgtgctggacccgggagggactgtgagctgtaagaagtaacgagccccttgaacttcacaagctggccagggagccatatcccgaatgccactgccacttcctcgtggtgcaaggcttgttgggacctgccaccttgctgagggaggtgctgaagtaggtggtttccctgttccaatgcggtatgcggtcttgcaggccgaggcattccccaggggatgacggagcccccgctgggctacaagccagggcaaacactgaacttgtgtccttagccggcatcccaggaaagaaggccggggtcaagttcacacctcatgagatcacagtgaccagccctgcccaggctgccctagtacgtgcctgaagcatcgcggaggtcacatctagccacggtgaccgtggtgagatgtaaggattaaccagactacgactggggaggtgaggaaggtgacaaggacccagttccagcttctaacggggtgtgggatctttgagcaaggaagaagatgctagggagaatgagtctggctttgttcttgttgggaggtgttcaagccatggctggaccagagcatgagccatcctcagtgtgagaggcagttactgccgcggttgggctgcctggtaggcctggagctcaaaatgagtcagtctctctctggaaagcgcaagacagagacagcgctggtggcagctgggctgaagccagcagcttggagatgaggctcaggccctgacgggggaaatcttacccagcctccccagatggctcagagacaggtctggcaggtgcacggatccacaaatctagaagagtctggggttgtcacatccaccaactaggctggctgtctatatacactttgtcactgtgtaggcccaggatttcacccatctacaaattttctctgccacacggctactgccactttaattcaccaagccaagcccttgcactcaggaccctggcccaaccctctttggccaagcaaagaggaaacgagaacaggacagaaaaaaaagtgggaccggaccaggcacctggctgtccattgaggccttgctatgcgatccaggacggaaggtgccggcagcaagctcatacactctagctgcgtgtcatgtcattgaagagggcgcgtgatccagctggaagggtggataaaagtgtaactgcccagtgggttcaccttccctgttacctagacagccaatttatcaagaaagggcatttgcaacagagaaaaggtaattcacgcagagctagctgtgtgggagactggagttttattattactcggtctccctgagcatctggggtttggagtttttaaagataagctggtgggtggggggcagccagtgagtcagaagtacccattggtcaggtcagagatgaaatcacagggagtcgaagctgttttcgcactgagtcagttcctgggtgccacaacatcagatgagcctgggtggtgccaggtgacccaccaagtgctgatcttaggctttacgatggtgatgttatcgccaggagcagtttggggagggtcagaatcctgtagcctcccgctgcgtgactcttcaaccgtagtttctaatcttgtggctaatctgttggtcccacaaaagcaggctaatccccaggaaaggtttcctttgggaaagggctgttatcatctttgttttaaactaagttcctcccacagttcaacctgcgtgcagcagtaaacaaggagggcatggaggttagaagcaaaatggagctggttatctcactgtcggcaaattttgcaatggcagtttcatagagatgcctgtcctctgggaaaaaagctaataacaggttgtctttttggctgcaggtggaaaactgcatctattaggcagaggtggggctttgttcttacccacaattggaagttctctatggagtaaaggcggtatgtgtgccacctgattcctttccccatgtgtatctggttagggtcggccacgtgagatccgcaagcattttagaaggtgggaggggaggtgggagctggctacaggccaggcgttggcgtggttccgtgagtgtgctccagccaggcccaaagcttctcctgcccagagggaccgtttcctccagcgtgggtcgggtgcttctgcgcccggaaagagcgccagctcctccttcgggtgacccagggagcggggctgcaggcaaaggcgcaggcggccaaaaaggtgccaaccgggtcctgtggctttcagttgtctctgcccacccaattcacaccatctttccccctcagccgcctgtcctgggacttcaggctcagcaccaaacgcagcaaaagtaggtgcacagagagcggggtcagctcacgcagcccgagcagaatggctgtgctgccgccccaggcccgcggccaccgctgtgtgtgtggcaggagtcagccccccagcgtggggccccgaagcccgcggtccttccacggggagggccaggcccgcagggcgcagacgatgggggacaggctgcgccagcgctcgcctgaggccccgcacacaaacctcaggcccatgggtccgctccgcggggcaggcgtcgtgggcccaaggaggccaggccaggagtctcggcctcggggttacgcggcggcgggcagctcttccgctccgctcagggtgctgctaacccacagccgagcagcgacccgcaggaccggcgagaaccccgccactgcctccggccggaagagaacgtgcagagatgtacgtcacttccggggcgtggcgtggccgggcgtggccgtcccgcccctggcggcgtgcctggtgccctgttccgcgtctgtgcgaccgtccgtcccgagcgcgcagccgcggcaggtgcggggcgggaccgggggcgcccggggtggggggcgtagggggcgctcgggttgggggtgggacaggggacgcgcggggtgggggaggagacgggacccggggtacgcgggggtggggcgggtgagaggtgcgcagggtaggggagtagggggcgcgcggggtgtggggctggaccaggggcgcgcggggtgggggcggtgggaggcgcgcggcgtgggggttagagggcgcgcagggtgggggacgggaccggggacgcgcagggtggggggcgggaccgggggcgcgcggggtgggggcggggaccgggacgcacgcgggatggcggagtgggaggcgcgcggggttgggggtgctcctgcgtccggtgtgcaccccatggcccccgccagggagaccgagtccgggccaggggccggaatcgcggggcgcgggccggggctggggttggggttgggatcgggatcgggatcgggatcgggatccgggttccccgcggcttcaagttttctctcgctgttacgagggcgtgggaggcgcggccgtggggtggggtggggccaggtccgcgatgtgctcaccctggtctctcaggaccgttgcctttgcggctattttttgtgcaatccccgaagcctgcgtttcctgctgcctgggttcggggcgggggcatcgcgcaggccagaacggcccctgcgtccgtaggccagagcccctgccatcagcccctttagggtgctcgccggctgtcgggtgtgggggtatgccaggccccggaggactcggcttccccgctaacccgacccgccgcaccccacccaggccaggtcagagcagcccaccatgggatggggagggggtggaggctgcaccccgcgcccacccatccaccagcagccgccggagcgccgcgtggtcaccgttgtctttctcggcctcctgctggacctcctggccttcacgctgctgctgcccctgctgcccgggctgttggagagccacggccgtgcccacgtgagtccttgccctgcggcccacagtgccccctgccccccaggcccatcagacctccccagcccttatcgtgattcctcatcccctaggaccccctctatggctcctggcagggcggggtggactggtttgccaccgccatcgggatgccagtggagaagaggtacaacagtgtcctgttcggaggtatggctggctctgtgcccttggcgggctctctacggtcctwtgtttggtggacgtggtccagcccaggcccctccccaattctcggtccttgccttcccactccctgggctggcatgtctggtgcccttgcccacatgtcctggcttctgggcatgatcccttgcctccgcgtgtcacgttcagatccttcctcatctctccattggggccccctcggctcaagggccatggcctgtgagtgtagggcccagcatgactggaccctcaggacggggctggacattggccttgagggccccaagaccacagctcatggtgccaggcagccccatgatggtgacatctgtctctcaggtctcattggctcggcmttctctgtcctgcagtttctgtgtgcgccactcactggggccacctctgactgcttggggaggcgcccggtgatgctgctgtgcctggtatgttcctgggcctgggtgcccatggggaagcctcctcccacccagccagtagccccatggggttaggtggggagagggaggtggctgtgggcccctcatggccactggttggccctcatcgcatcctggagggggttctcgggggaccagtggctcctgttccagagccaggctttcaaggagctgctcctggcccctaggaaggcactgagaacgcaagtggccctcagatgcttcgaaatagggcagggttgaggggtgttgtctgggttgccaagccctactctgagccactcctggccttaagcgaccgcccctgcctcttggcccctgcccctgggcagatgggtgtggccacctcatatgcagtctgggccacctctcggagctttgcggccttcctggcctccaggctgattgggggcatcagcaaagggaacgtcagcctctccacggccatcgttgctgacctgggctcgcctctggcccgcagtcaaggcatggtaagtgcacaggctgggyctttggggtcctggtggtgacttctgggcctgggtctccctgtgcagctcgggtggtcttttccctaggcggtcattggggtggccttctcactgggcttcaccctgggccctatgctcggagcctccctgcccctggaaatggcaccctggtttgccctgctcttcgcagcctccgacctgctgttcatcttctgcttcctgccagagacgctgcccctggagaaacgggtagggctgtrgtctgggacccacaggcctaggggctggaggcttgattccatagcgatgtaaagtgccccygtgtgccagccccagatgccagggaggctgggccgctctcttggtgttgggacccttgaggccacagtccgtgggttgccaggccagcagccgctcctgcaggctctccaatgccatccccacaggcgccctctatcgccctggggttccgtgatgcggctgatctgctcagccccctggccctgctgcgcttctcggctgtcgctcgtggccaggacccaccctctggagacagtaaggactcgaccaacccaagcgtggagcctgctctcccctgggcttccccgggcggcgcccttccctgctgtggtcgcyttctcagcacgcgccacctctccccagggctcagcagcctgcgccgcctgggcctagtctacttcctctacctcttcctgttctcgggcctggagtacacgctgagcttcctcacacaccagcgcttccagttcagtaggtgggtccccatctggcgacggcctgctgtctccctgaaataacgcccctgcttcagggaagcaacccccatccccaggaagccttggcagccactctcgccctggccctgccctgggtggccctgccccgggtgccctgcactaacacacccrctcccagcctacagcaggggaagatgtttttcctcatcggcctcaccatggccaccatccagggtgcctatgcccggcggatccaccctggcggggaagttgctgccgtgaagcgggtagggggctycctccaaagcgggtggcaggcagtcccctgagtcctgcagggcacgggctgtgctgaggctgccgtgcccacctgcaggccctcctgctgctggtgcccgccttcctcctcatcggctggggacgttctctgcccgtgctgggcctggggctgctgctctactcctttggtgagtggccctgccctggcaggggatccgatgggcagcaggggctgggtgatgcaccctcccctgggctracgggcacctcctcgatgtctcccaccagccgccgccgttgtggtgccctgcctgtcctccgtggtcgctggctatggtgagcccccttccctcrgccgaagccacctgagcgggagaagggcagtggtgcctgactgtgcctcttcccacaggctcaccagggcagaagggcacggtcatgggtacactgcgcagcctaggtgctctggccagggccgcggggcccctggtggccgcttcaggtragggcgcgggatggtgctggggcaggctgggggccaagcacctgccctcgcctcccaagtgccagccccctcggggactgggtgacgccaccgtctctccgcagtgtactggctggccggggcccaggcctgcttcaccacgtggtccgggctctttttgctccccttcttcctcctgcagaagctgagttacccrgcacagacgctcaaggctgagtagctgagccactgtgcccaggctgtgggcaccaggcagagtgggagcctaggtcaggcccctgcccactgcctgacccccaccccccgccagtccagggagaccctgtgggtgggggccggcccctaagcaggaagctcaggcagctcctccagacttacttactccttcagtgactccgagctgcagcactccaaggctgtcagggcttctgtttgttttttaaactatgcaccaggtttctgatgatgaaataaagcacctgtttgttttataccaagtgcctttcgccatatatagccgtgcttctacccacaccaggaaaggcagctggagctgaatgaatggctccactgaccggaagggtccaaggctctttgagaccctcagtttccccctctgcacagtggcagcctggggactcactcaggcaggctcctccaaggctggggtcagccctggccaggtggtatctggcagtgtgccccgcaccctggcaggatgtccccagcacagagccctccccatcaaacatgagcacacagtgacagtgagactgggaccatggggacaaggacaggccagcagttccctggacaccctgagttcccgtggagagggacaccaggagtgctgggtggcacgtcctgccgcacgcgtggctgcaggtgacattttatcaagacatgaacattaggaggtctcttttcagcacgagacaaacatgggaacaaagaaattaaaatataaaactgcttcccagatttagacaaggaacttgctgaaagaattttatttgtgagtaaaacatgttacactggagaaaggacattcaggacctgtcctcccaagtcggtgtccatatatgcaactatatttcatgttgtaatacaaaggattaaactacaaaagtgaaaattaaaagtcattgcatatgtggggtaaaggaggggataaaggaagagtccacggttaaggacttttcattctgccttggcaacaaaacgacacagaagagaggcagcacgcttgcccgcgtagcaggccctgcggctcagaggaagctggaagcggcggtcagtgccatgcagcagcctggttctcgctcggctggccaatcagtgggatccgaggtggctcggcccatcatgcccaggatctgagcccacatctggcaccagctctaccaagggcctgttgggcccacacaagcttgcctgtacctagtcaggctggtaccggcacctcctgaaatgggtcaccctccggttcctgctcagcagctctgagcccttttccagcctcttggagggaagtaacaacaacagcatctgccgaggagcacacggttcaggctccatcaatgacggtgatgtcgaggggccccagggctaccctccacctcgagttacctttgatcacaactagggcatctttctggctgagttaaggtgagaacagtcccctgaagcctcccccaaataagtgaaaagtgctctactgtggggtctggaaagaagaaagcaaaaagcagcctattcacgttcacagtcgaaaaatgtaagctaaattgtaaacctgctcaaagaaaattctagaaaggcctcttcccctcctgatataccttccctatgacaggaatccagagacccaagtgaaaaagaaactgagctcctgaatctgattctggtcgagggatcgtcggtcagacatgcatagcatcacgttgggtgcacacaggcccatctgccgctggggtttcctgcccagcatctggcccagacctgcctcttcaaggccgctggtgggcacacgagtgttttcacgggaccaaggctttgtatatagatttaagtgagatcactgagcagagagaatgccacatgaagccaggagtctgagtccgtcacctgagactttagggtggaggggaagccaagcagagacagaatgtggtgatttcacaacaggagggacggcaggaaaggtgaggctcaggagggtgacgtgcagccaaagctgcagaagccttcagtaccttccagccaggaccatgacttagtgcctcccccctgtggggagagcatgtctcccccagaagctgaggctctgagaggacaaggggcagggtggggtggggctgctgagcacacactgggtcagcccggggctacacggggctggtcacgtgaggggacctctaggcggagggcttggcttttttgcattccattacacaaggacagagcacagacgtggccggggacgctggcagagccagggtcgctccggacaggacagtgttagcgcagggctttcaggagtcactcttcttcttgctcttcttcagaaaggacggggtacggaacttcttcttctttttggacggggacttgcctggagacccatcgctgccagggtccgcggcggccccctcctcgacagctgagggggcagcctcttcagccaccggggctgggtctggggctggctcggggctggcctcagtaggggcctcagtggggcttgggggtctatgggcttcctcctccttctctaacattgggaagccgagtgcttctgaaggttcatcaggggacagatcggggagagttggcttaaaggtggcagcatcactgtcatctccagtagtcggctccggcacaaggtctagtgggtgaggtgagagatgggattaagggttcctgcccagatctcaaagggcagcttgagatgggggagccccacacacgaaactgccattttattttactctacagatttttaccaagacaagaaacttaaaatatggtctactctactgtacggctggatggagctaatatcataaaatacagactcagtctcggggtagtttttagctccttctggtgggcagtgtgctgacaacaccagactccgtcccaggcctgggtccccccgccggaaagacagactgcagcacaagctgaggacgactaaaggagcgacgtcccgctttcattatgtgacgagaagtctgccctgtcaccctaagggcatgtactagtagtactgaaattaagtctaaatttgggtctacaacacctggtctcccccaaaacagccagtagaaaatcgtgcataactcccacagcacgttgtgtgacgtcaacatccaaaagaacaaagccgtttaggctggaagttaattaaaaggaaagagatggcctgtaaggcaaggagtgggggcaaaaactccacccagcatcaggagtggccatctgtgaaggagcacagcggccctgaggacacagcctgggggcgccttccttgcacttacccgggcacccgctctgtccattcgtaaacggcctacaaagttaccagcaactgacaggttaggcaccacaagctgtttagtgtttaaaaatcaagccacacatcagggccaggggagtcagctgagtggttaggagcagcacaggaggcccaggccccaaactctcagtgctttacctttgggaagctggaagcacccccaccctgccagctgccccaggctgattccaggccacgcttcatgagaaccgggaaagggctatgggcacacaggcgccgctccccctgaggagatggggcccgctctgctgggcatggtgtggctgatgctaggacggaggctgccccagggcactcgctctggagagctgccatcatctgagtgaacatcacactgctttacgagggtccaatatccgctcctctgcccacctcctttggaccagcttcagcaaaggtccaaggcaatctgaccccacacggcaggtggcagaaccccaccctgtctgaaccgaggctgcacttacatctgatccagtgtggcaaaaccctcccaccaagcaatccaaagagaccctcaaaggctggaggtaggaactcctgaggcccagagtgctccatggcacctaggtgcgtggaggtacccgctgccgctgaaggcagcacagcactcaggtgactgaaccacttccaggaaggcctccaagggactgggtacaaaaaaggggggcttctgtttttattttaaataaacagaaaacaaaacttaataaacaacaaagaagcaggagaatgaggcaaagcgcagggcaccggtggagagcggaggcagcgcggtacttactagggtaacaggtactctctagcgcatccgtctcctgcttgtgacgcagccacagggagaaaaaagcacaaggagagaatctatgcattcagtcacagccatcaggttacagaagaagaaaggcagggccacgggcttcacgagagacatggatgtacgagaccgagggacagacacccgggatcacacaccacagacacacggtggctgagaggcagccggcgtgtggctcacacagcggagggcacctccgaaggtggcatctgcatgacaacacagcacgaggagtgtgcgagcaatgggcaacgtggacaccagcaaccatggtgggttccgacccccgaggccggccttcctacctggtcacagctcacatacaaatctgttttgcctggagttacccaggacagaagcaatataggaggagaaaggtgtcacgtcctggcgctgatgcaagcacacacttccgtgttgctgttaacacgactcccgccacattccgccacagcgcgcacgagccgtgcaccctcccacagtggcggccgctgccacccagagctcaccttcctccagcttgatgggagtgctgggaggcgggtgggggaccgcaggctggtctggaggactcttttctttctgttctctagcctcgtccagattctctgcagagaagcaagaaggatatggtaggagctgtggacgccacgccatgagcctgtacctgcctccatggcagatggggcagcccgctcggccgccctctgagaaggcagggctctctcaaccctttccctgatcctctccaagagaggataaaggaagctgtgacctgggtgttgactgatgcgaatttcagagaaacttaaccaacttcagatacaaaacttatttctattcttattccaaagagagtctgccagagccacttctgtgatggactcgaatggtatgccctggcctgtcccccgctgtcctgtgcgagtagggacccctccctccctgccttctccctgctgagcaggtggctgagggtcctgaacccactcaccaccttaagggacatcacatgagcattattttggttttaattctgtggtagggcattttatcccaataatttaaacttggcaactgtaatacgtatttttactttttaaagtgaaaaatgctaataagaaccagaggaaaaaatgcaggaactaggatcctggatatagaaaaggattccaagtctacttctcatttcggggaaaatatggaccagcactattctaactccttccatctctgtctttatttcagaagtttaagattaatagcttaggatcagcaggtccgtattttgaaccagcagctatcatcatccttctgagctcccagggcctctgctcccaccctaacagctggctcgcctccccaagtaccacgttggcagctaccttccagaagccaggtgtccataaaaaggccgccataccacctagctgagtgagcatacagcctcaaccgggaaaaggtgctgacctctggcagccagcctgcattttacctgtggcacattctcccctcagcccatgccaagggccagatcagacctcctgtgggttctcctgctgacagctctgtgatcacagagcacggccagagcctgtccccatccactcagctgccatcacagccctgctgaaggagcctcacacatcggggggaaactccacatatcttgtttgacttgtttttaaaaacaatccaggttactcagatcccaggagactccaaagggcagacacatgtctgtgtacatgtgcacagaaactaggaggaggccacatgacccacagctcaagctgactacctccagttctcgctctaaggcaggtaattacagcaatggctcagacaaagcttcactggagggagacaaccagcagcagggcctggtgtgtgtggcggcctgaatagtaaatagcggtgtgacactgaaaaacaattcagcaactcaaatttcagtcacaactacgtaatgcagtggctggtctagaacgagacaaaaaccggtgaagaggtcctcttaggaggagtgcctagctcccaggatgacgacggcccaggagag

SEQ ID NO: 17944 - DNA, 23606 bp, Homo sapiens
atcgcttgaacctgggaggcagagattgcagtgagctgagatcatgccactgcactccagcctgggcgacagagtgagactgtgtctcaacaaaataatataataaaaacctggtgcggtggctcacacctgtaatcccagcactttgggagactgaggtgggtggatcacttgaggtcaggagtttgagaccagcctgaccatggtgacattcagtctctactaaaaatacaaaattagcccggcatgcctgtaatcccagctagggaggctgaggcaagagaattgcttgaacctgggaggcagaggttgtagtgagccgagattgcaccactgcactccagcctgggcaacaagagcggggctctgtctcaaaaaataaataaataaaaatttttaaaattaataataattagcaaagcatggtagctcacacgtttactcccagctactcaggaggcagaggagccgggaggatcacttgagcccaggagttcaaggctgtggtgagctatgattgcgccactgtactccagtgtgggtgacagagtgggaccctgtctcaaaaaataaaatagtgagagtagtagtgctacctcaaagggtcgctctgagggttaaaatggggtcaatgtggtaagccctctgtgcactgcctggcatgcaggcattttgttggtgaggttatatggctacctgctgcctttccaacagtgcctgccaggatgccctcccggggaaccccctgcctccgtcctgctccttctggtgggctctggtttcacccccaacgaggccttcccaggtccccattgacaatcacagccacctgcacaccctcccaccgccctccttcccccttcctgctttacttttccttccatagcactttgggccttccaacagatggtggaattgacttgttttacttgtcttctggtttatttttctttgttggtgtctcccacctctaacacatcagcttcaggagacccagaagtcttcccctctccttttcttactttatctccagtgccggtttcagagttggattgggctccagcgtgctggccctgtggcttggcgactgtcgcagtctccctgagcggcactctccccactggtccagtgagcaccgtctcatttacctgccttggggggtcgctgtgggtattcactgagagagggacacaagccaggctctggatggaaccggtttccctggcaggagctggtcaagtgtgtttgaggagcagggaggaggaggccagtagggctacagtagggtgagcgggcgacagatgagaggaggagaggcgccgggccagccaggaccctgtggtcacggtgagtgacaactcggactttgactctgggtaagccaaggtctctgagcagcggagggacaggcgctgatttaggcgctaatgggcgccctctggcggctgcctggggacagactgctgggggcgagggcagaagtaggggcacagggaggaggtgagtggatctcacccaagtcgggggcggtggagaatgctggatttaacttagcggtgaagctgacagatttggctaatgggccagatgtggggacagactaaaggatgctggcccgagcagctgcagggcgacatcttaagttccccgagatggggaaggtgtggggatgggggcgatgggggtggggagcaggactggaggtggtccggtctacagtaagatcagaactcatagcacatgttgaggggaatggatataagtgttgggctcagcaaagaagctcgtttattttattttattttaatttttcagatggagtctcactctattgcccagactggagtgcagtggcacgaccttggctcactgcaacctccacctcctgggttcaagcgattccctgcctcagcctcctgagtagctggggttacaggcgcacaccaccatgtccggctaattttgtagttttagcagagacggggttttgccctgttggccaggctggtctcgaactcttggcctcaagtgatccacccacctcggcctcccaaagtgctggaattacaggctgagctaccacgcctggacaatttcttaaaaaatttttttaaagtaggattgatagcagatgagttttctcggtgggccaggtcctctgctagggatttcaatggaatgatcccatttaaacccactacaacctcatggggctcttattgtcctcgtcttgtgggggcagagaggaaaagtccccagcatgcagagtgttggaatctggatttgtacacaaagccacgactctgaattgttcaaatcccaagactctcttccccatctctgactctgtcccccaactcttcactctctctggatctctgtctaatcccactccagtgtcctgaccctcctcgagctcaacctttcctcctcctgctaggaccctgccccctcatccctgtgcccttctgtctgggtctctgtccccttgtctgggtgtctgtcaccctccgctctctggttcctcgccttcccgtctctaatctcacagggctgatgtggacgctgctgtatggggggaacacctgccctgctcacagggctctgccacttttcccttccaggagggcatcctggctgtttcacccgtggacttgaacttgccattggactgagctctttctcagaagctgctacaagatgacacctcatgtccctgccctcttcgtgtgcttttccaagtcttcctattccactcagggctgtggggtggtggttgccctacctgtttttgccaaaaataaattgtttaaaacttttcttattaaaaacgttacaaagtattcaattgtctgttcttacacttgggaactaaagttttaaggagaggagatttggttcagagatttctgtggcttacgcaaattgaggaaagaaccagttcattcattctagaaatatttatttgcagcacctacaagagcctgtctcctggacatgtaacatatttgagagaatacctgtaaatattccagcaacttgcatttttttttcctattgcacgatctggttattctagctaatgctgtatgatggtcatggagtctttccagtgaattccacagaaaggtacagtctaacttcacctgtgtctaggacaccaccctcttcttgtttttctcctcccattgctcctttcaagtctctcttgctggtttctcatctacctacagaccagtggtttgtctcacacacaccccccactctccctttttttttggagatagggtcttgctctgttgcctatacttgcactgttatatagatacagtggcactatcatggctcactgcagcctcaacctcctgggctcaagtgatcctcccacttcagcctctctagtagctggaactaaaggcatgcgacacgacgcctagctaatttttaaaaaagaatttttatgggaggccaaggcaggtggatcacttgaggtcaggagttcaagaccagccaggccaacatggtgaaaccccatctctactaaaaatacaaaaattagccgggcatggtggtgggtgcctgtaatcccagctacttgggtggctgaggcacgagactcgcttgaacccgggaggcaagaggttgcagtgagttgagatcacgccactgcactccagcctgggcaacagagcgagactccgtctcaaaaaaaaaaaaattgtagaaatggggtctcccttatgttgcccaggctggtctccacctcctgggctcaagtgatcctcctaccttggcatcccaaagtcctgggatcacaggcatgagtcactgtgcctgggcggtttgtctcctttatagggccatatcccccttcacagagtaatgtttgtaaattaataagtgaaatgtacaggattacaaaccgaaccaattacagttgatcctcagtatttgtagattatttgcaaatttgcatccttgctacaatgtattcataccccaaaaattaaggcagtgcttttgtggtgttttggagggcaatgcttatgcacagagctgcaacaagctaaagacctgatgtgcatatttgcagctgggctcctcttgcttcagctcaaacactggaaacaaatgtccttttcttggtttgtttagtgccatgcttttcaatttttttttttttttttaaagttagagtctcggtctgtcgctcgagctggagtgcaatggcttcatcctggctcactgcaacctccacctcctgagctcaagcgattctcctgcctcagcctcccaagtagctgggattacaggcgtgtgccaccagtcctggctaatttttttatttttatttttatttattttattattttttgagatggagtctcgctgtgtcgcctaggctggagtgcagtggcaccatctcagctcactgcaacctctgcctcccgggttcacgtgattctcctgcctcagcctctggagcagctgggactacaggcgcccaccaccacacccggctaatttttgtttttttagtagagacgggggtttcaccatattggctaggctggtctcgaactcctgagcttgtgatccgcccacctcagccttccaaaatgctgggattacaggcgtgagtcaccgcgcccggccaaattttttttttttttttttttgagacaagagtctcgctctgtcacccaggctggagtgcagtggcgcgatctcagctcactgcaagctccgcctcccgggttcacgccatcctcctgcctaagcctccacgcccggctaattttttgtatttttagtagagacgggggtttcaccatgttagccaggatggtctcgacctcctgaccttgtgatccgcccgcctcggtctcccaaaatgctgggattacaggcgtgagccaccgcgcccggccgcctggcgtaatttttgtatttttaatagaaatgggggtttcaccatgttgcccagactggtctcgaactcctgatgtcaagtgatccgcctgcctccgcctcctaaagtgctggaattacacccgtgagccatcgcgcccgaaccctattgtaaattttaagtctcaggcgtttgccagcggcacgccagagagtatagcctgcgcggaggcccagaaaccaaagagcgagctcattccgggattggagagaagtgtgagcagagggaagtagagggatcggggagaggaggggcaggacccacgcattcggccctttgcattcagcttcattcaactaggaactttttctgcaaatcaaggaaagcttcccggaggaagtggtgcctaagctgtgctctgattcacgtttagaagctgaccagacaaagagaggtgggcgttcctggcagggggagggacttggcaaaaaccaagtggcttgagaggggttgatggttttaaaaaacttggaatgattatgtcaagggctagggatttaatgtgttgacgacggactcctattcctcacttgcttcgggaccccagctatgcccttcctctctctgggcctctcaccgattccgtttttcccccaggtaatgagcacaagctccctttttcctccagactccccccgggttgggaggatccaccgagtggacgaggagtgataattcctttgagccaatcgttggtgcctgaagccccgccttcttccctacccgtgggccaattgccgtgttctccttgaggccggccgcttggcgagggtgggccaaaggctgcgtgacgtcgcttccggataaaccaatggcagcgattaggaggcgggtcgttttggtgatggacaggtgtttcaagacgcccctttagcgcggggctccccgggaagctttgaggcggtgctgggtgtaaaggggagggcattcctggtggattttgcccaatcaccagtcgcgcttcttgcaatagacgggcagttttccccatcccgggtcgacttgagggggcgggattctggacgccagagttggcaaacccctgacctatgatggacgtattctctagccaattactagacggtattctcagacgggccgcctccattgccaatgaaatcttccagcggggtcgcggtaggcgggccgtggaccctctggtataaggcggtcccgggggagtgaggagaaagggggggtcttggcggccggaggaggagtaggtgcgggtgaagatggcggcagccgaggccgcgaactgcatcatggaggtgagcgcttggagcgccgccgtgggcgggaggcggctttgggtcggtgtttcacgcctctgtggtggggaaagggctctaagttggcgatatggggttggaggtcccccgccgcacacgggggcgccgcacgttccacatccggggatatcgtttgaggtgacggctccctagcttccaagggccttcggcatccggcctagcggagggtcttatcccccctcccacgtggaggagggctgggggcgcttccggccaggcccccacgtggccgctgcgcggtgggtggggagggggtgtgccgagtccagtggcccggcggctccacgtgcgggacaaaggccccgcccccggccgggaaggggcgcccaggggggcggggagggggtccgaccctcctgacgcccccagccctcctccccggggacctgggcacacgccgtggggtgtgatcgacctggggccctccacgatgtggggagtctcttgggaggagcagtgcttctcagccctttaccaacctccttccgagctccgggggcatctgttgggatatcggacccggttttgtgcgttctgggttagggactggaggaaaaccaagaatggggtcccccgccgaccccgtttcccctcccagaattctccccctcgcccagggctttaggagttgggggatggggcatgcccctgtgacctccctctgggtggtggtggggcatctagatagagattttcccattaataggcgccgtgcacccccttgtggccatttctgggtgtgtgggagggacatctttttcatggggcgtgtcctgaagcccacctcccctcggatttcttcctggcgggcggagggaggagggtatgtccgctgggaaggagttgtgggaaatatgtaggctgagagctttaccctactggagccgtttatctcccccgggtctttgtgagggtgcgagatgacctccttcttcctgaagccctgtgcagggtcctgagccctggggtcctgagagtgggtgcctgaaatggtttcgagtgaggtttggttctcgtgcagccatgtgggggaggtttcagtcttgcgtttcaagccctctggggctggggttgtctggcggtagttttcagtggtattgagaaataggcccgagtgggaaaccccctcagcacctttcttcttataggcatccccgctagcttgggagagctggagggagggtgcttggagcctagtaggtcatggcctgtgacgtggcccttcttggagacttggatagtggtcacatctggaagagatgtaatctgatggggcctctgtccttccaccccttacctatggcattggctggaggggcaggtcagctctcagctgtcaggatgcagctcccaggggtcactgtaatgacttcccaccctcttggctgtctcctgcacctggggctctatggatggaggaaataactttcccagaggtggcctcaggcttggccgcacctggaagtcttcagggcctgggatgggtgtctgaatgggggcgatggcctgactccccaagccactttttttttttttttttttgagacggagtcttactctgtcacccaggctggagtgcaatggcttgatctcggctcattgcaacctccgcctcccgggttcaagcgattctcctgcttcagcctcctgagtagctgggattacaggcacccgccaccaggcccagctaatttttgtatttttagtagagatagggtttcaccatgttggtcaggctggtctcaaactcctgacctcaggtgacccacctgcctcggcctcccaaagtgccgggattgcaggtgtgagccaccgtgcccccaagccactttctggagtcctctcattcttagagggtccaggagctgcccatcttccctgggaccctaccttcgtgggcagagggtcataagggagggggttggttccagctggttttgtttggggctcctgagtccaaggcaggagctggggtctggggtactagctctggggaagtacccgtgtgccacacctctattctggaatcctctcagacatgagactggtttgcagaggtggcagatgccctgtgggcatatcctgccagccccgctcccttctgctattcatggcaccctaggataggggtgtgtgtgtcaggaagtgtcacctaatctggaggagattaggtgatgagagggagcgacagctggcggtggtgggtgccaattcccctggcctggatgggggaggtgtgtggtcagctgcctggccagagaggggcagcgtgggggtgggccaccatctctccagccacagctgggataggagacccccctttcttctcccctcacttttcccaccctttcttaaacaccccacctcattacttgcccccttcgccaccactccccaccaagaaggagaattgctggaaacccaccccccggccagagcccaggttccgccacccagccctcccacagccactcccagtagctaatcctttttccctgttactctctcctagaattttgtagccaccttggctaatgggatgagcctccagccgcctcttgaagaagtaaatatccttttgtgagacccctccccaccctgacctccacatcaatatatcttgccacacatctggccctttcttgaggtctaaccatacccctcttgcttcaaaccagtttaccccaggcccccagacacttagtagcaacccctccaggttcacagcccccgctggcctcccccagtatcgccgctacttccttaactccacctccaacccccctttgcccttccctgtgtctgcccccattttccttcccctcccctcccyagctgtgggctgagctagagacggggtcagagagactggagagatggtaggcgtggctgaggtatcggggtgctcccctggatggtgctctgggggggtcctggaagtggaaaatggggttgttaggttttggggttcctgggggggcaagatggcaggcgggggctgtagggttgtcatggtatgattttgggggttctatactactcttcagggaaaagtagggcgctggaggtttaagaggctgtggggagcccccagatctgacccatgatcccatcggccccctcccaggtgtcctgtggccaggcggaaagcagtgagaagcccaacgctgaggacatgacatccaaagattactactttgactcctacgcacactttggcatccacgaggtcagtggggacagtccccaaggccccaatcttaggggggcttaaatgttggggaaggggtggaacctgttttcccacgcatgcgcactgcttcccctggccgcaggccgcccccctgcccctctgctgcgcacyccctagggtcgcctcgccaagccgttgccttggagaccgaggttagcctgaatctctgcaggggcctcgcgccgaaggctggggtgggagagcgcatgcgtgcctggggccttagccagaggtcgggcagggcccactggtctctgccgccctctagtgaccggcggtgggactgcgccccggctgctcccgccctaacagcttctgcacacttcagatctgactgaagacactgaaatcccagaacgaagctggggtggcattctaaggaattttcttttccccctgaggcctttttcataaaattgtggcaaaatatgcataaaattgccattttttatttttagagacggtctcgctctgtcgcccaggctagagtgcattggtgcaatcatggctcactgcagcctcgacctccccggctcaggtgatccccccacttccactttcggagtagctgggaccacaggcgcgcgccaccacgcccagctgatgttcttatttttctgtagagataatcttgccttgttgcccaggctggtctcaaactcttgggatcaagtgatcctccgctttggcctcctgaggtgctgggattacaggcgtgagccaccgctcccagcctgaggacttttaaaagccagggttcactggttcttaggtagcagtggtgaagtccggccaagattggagtttagaccatctaatctgattttttaaaaagggaaactggctgggcgcagtggttcacgcctgtaatcccagcactttagggggctgaggtgggtggatcacctgaggtcaggagttgaagaccaacctgggcaatatggtgaaaccccatctgtatgaaaaatacaaaaattagccgggcatggtggtgtgcacctataatctcagctacttgggaggctgaggcaggagaatcacttgaacccaggaggcggaggttgcagtgagctgagattgcaccattgcactccagcctgggcaacagagtgagattccatctcaaaaaataaaataaaataaaaataaataaatgaataaatataaaagggaaactgaggtgcatggaagaaagcgagagggccgagctctggccctccgagctctcaggacacgctgttctccagctggggatatggggcccctcacggcgtctctgtgccattcttgccctaggagatgctgaaggacgaggtgcgcaccctcacttaccgcaactccatgtttcataaccggcacctcttcawggacaaggtggtgctggacgtcggctcgggcaccggcatcctctgcatgtttgctgccaaggccggggcccrcaaggtcatcggggtgagtctccagggtggccaggcggggccgggcctgagggatggaggggagcccatcagggctcagggattggatggaggtgatgggggcaggggatgggtctcaccctcccttcttcctgggccctcagatcgagtgttccagtatctctgattatgcggtgaagatcgtcaaagccaacaagttagaccacggtgagcccagaaagaggatgggtttgtgggagtggagggggtgatgccctgcttccccagggccctctgaagagcagtggggtctacagatgaccacagattcagcagctcccaacccatggtcttttgggctgccggccgcctgagaatctgagtgtcaaaatcacaggcttagcaccgcagtcttaaaattagggcaagaagcactctctagtttcttgaatgagtaatagagtcacgtggttggccacggaaggcccacagtgagaagccttccctgtttcccagctgccctcctctgagtttaaccaacactaacttccagagaagtctggacctacaaacacatacatacgtaaatgcatttacattctcgtgcataattttcacgccagtagcatttcataccagcctcttgcccttggcttcttacacctgcttgtcatgtcgtttaacactttccaggatgttgcggcatccgctcttttgcatgaccaccatcataggtacatccccagcatttttttttttttttttttttttttgagatggagtctcactcttttgccaggctggagggcagtggcacgatctcagctcactgcaagctccgcctcctgggttcaagtgattctcctgcctcagcctcccaattagctgggattacaggcgccagccaccacgcccggctaatttttttgtttttttagtagagacggggtttcaccgtgttagccaggatggtctcgatctcctgacctcgtgatctgcctgcttgccttggcctcccaaagtgctgggattacaggtgtgaactttttttttttttgtatttttttagttgagacatggtttcaccatgttggccaggctggtcttgaactcctgacctcaggtgatccatccactttggcctcccaaagtgctgagattacaggcgtgagccaccgtgccatcctgaagtgatttttaaaaagagattattataatgaacgcacgagtccatttgaagcaaattcccactgtgatgtaattttcccggtaaatgcgtctgcttgtgtcttatctaatagataaaggctgttttgagaatgtgatcatgctgttacttattatatcaaaaccacccagttaaaaacaaaatcgcggccgggcacagtggctcacgcctgtaatcccaacattttgggaggccgaggcgggcggatcgtgaggtcaggagatcaagaccatcctggccaacacggtgacaccctgtctctactaaaaatacaaaaaattagccggacttggtggctggcacctgtagtcccagctactcgggaggctgaagcaggagaatggcgtgaacccgggaggcggaggttgcagtgagctgagatcacgccactgcactccagcctgggtgacagagcaagactccgtctcaaaaaaaaaaaaaaaaaaaaagtaacatcacctgatacccagtccacataaaatttctgctcctgcctcaaaaatgtccagaacgatgtatgaattttaaaactgttagaagggttcatggcttctgctcacgcrgttctctgaactgaagtggggtccccaggctstagcccccgggggaggtgaggtgaggggcaggcctcccgggggctgacgtggccacccttgtccgcccgcagtggtgaccatcatcaaggggaaggtggaggaggtggagctcccagtggagaaggtggacatcatcatcagcgagtggatgggctactgcctcttctacgagtccatgctcaacaccgtgctctatgcccgggacaagtggctggtgaggccccagcgggacgggtgcagctcgcgtgggctggggtccaggtagaagacgaaaaccacgctcaatttttcccacagacgggacttactgtgggggcttagctgcaaggtgttagaaagccacagcccaagccaggtgtgacagaccctggagggagatggtgcgatgtgggggaggtcgtaggaacaggaaatccgtagcggcgcaatagcccaggtccttaggccccagcaggcctccccgggagaggtgaggtgacggagaggtggatgaagcatacggaggggcagccagggcaggtgtgcccttgctgcgtgtggaacagcagggaggcccgtgtggaaggagggtctagaacggcagcaggaggaggagtggaggtgaggggtgacagggcgtgtgcagattttgtggaggcttatgggaccccgtgcttttcctctcagagcagctagggagggtctgaggatccccagaacctccaagggccgggagctgactggggtgcccctgggtgccctctggcggccgtgtgggaaatagaccagggggcgaggggtgagtgccgctgcgacatgagggtggcccagaccagggcaggaggccacatcttggaggcaagactcagggtagtgttgccaggccccacccttcatgcctcgccctgcccctctgtaggcgcccgatggcctcatcttcccagaccgggccacgctgtatgtgacggccatcgaggaccggcagtacaaagactacaagatccactgtgagcgcggcccgggagctggcgggcggggcctcgggtgggctgctgcgggctcaccccctccctgcctgcctccccagggtgggagaacgtgtatggcttcgacatgtcttgcatcaaagatgtggccattaaggagcccctagtggatgtcgtggaccccaaacagctggtcaccaacgcctgcctcataaaggtgagggggtgggcatggccaggtgccccctgggttgaaaccaaagagaggccatcacctggccctggcatgggactttggggcccagaatgttggcctgaggtctcagagcctgatctgccagccagaggtggtgctagaggcccasgaaagacacttcgtcctttaaatatctttgtgagcgctgctgtgtgagaaccatgcttggcacttggcttctggcggaggaaacacccaaagctggcagctaaagcccacagcccatgcacggaaaggcaggaccccagggcgatgagcggatgcacatgcacgcgggccactgcagaagagcacggggccaggctgggctccgagatgtgcctgaggtcccagctactcgggaggatcacttgggcctgggagttcaaggctgcagtgagctgtgatcacatcactgcactccagctttggtgacaatgttttgttttgttttttccttttgtttttttttacttctgagaccctgtttaaaaaaaaaaaatacggcgatgagtatttgttgagctgggatgtgtgagccgggtgaagctgggtggctgaccgggggatcctgtcggggaggagtaagttgttgagtgggggaggagaggagactacaggggcagggaccccactcgggccaccctcctgagagccaggggaactggcgcagggtttaggttggcatttgtgttgccgtttgaagccatcatgttgttggacttgtcaaggggttggggagacagtggagtggggcgcctgcattctaggaggtctggacagagttagggtggcactgccaggtttgggtgttggagaggagggagcaaggaatctgggctcraacccacatggtttattgggagccggataggcaggatgcagagtgaaggaggagccgaggctgggtgccagtgagggagggctagcaggaaggggacagcgaggtcacaggccctctgggagcttaagggagggaggaggggatgaagcgaggtggggacgcatcccggagctcgccctctcatgtcctgcaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagtgaggcggggcccacagggctgggggccgttccygagccagggcggaggcgcacccacgtagtggagggggtgacagaaacgggcagaaggaaccatggggacacgcgtgttccagtgtgagctctgccatgtagcagtcacgtggccttgggcaagtgacctgagtgtgcagtgcctcagtttcctcatccacaaaaggctgacacggtccctgtctccaaagctcaatgacagggaggtgactcgcggatagcagtcccatcagctgtcatgggggtgggcattccgacagagggaacgcaagggtggggttggggggggcagcaggccgaggccggctgacccgcccgcgcccccaggccccgagtccccgtacacgcactggaagcagacggtgttctacatggaggactacctgaccgtgaagacgggcgaggagatcttcggcaccatcggcatgcggcccaacgccaagaacaacgtgaggctccgggcagctgggtgggagggtggcagctagggcggggagtgtagattggggggggagtggtgggggaggaatggtggcagcgggggtaggggatgggggcagccggggtgggggatgggggcagctggcgggggcgagcacctctgcctattcccgggtccccaagcccctcagccccatgcctgtctacacagcaggattgcttgagcattcaccggaagttatgggcctggggacccaggctgaaaccctgccctcctggtgcttccactctagacaagggggtcagtgacatggtgatgccagttggaggtgacctctgtcaggctgggagcagggcagacaggtgttggtgtaggtgggctccagggcaagaggcagcccccagtagagtgcacggggttttctagcccagctgggaggcatgagaggagaaaggcagctttttgttttctgctcccctttctttttcctcctgagcacttggcaggagctgccatcacctgagatcagggggcttccgggggagctgggggrgcttctcggagacagggtctgggcagagatccagtgtggtgggtctgagcaggcaggaggatggaaggcttggagcctggagtcgccgggagtggtctgggttggaaaagtgggtcccggccgatgggtgcgagggtgggtggcactcagggtagtcatggaatgtggaccctgggacacccacgagcctgtgacagcagcagttgtcaactgggcagttttactgccccctccgctccccgcccccccccaggacgtttgccaccgtctgtggaaacatttgtggttgtcactccggagaaggggtggtcctggcatctggtaggtaggggccagggggctggtaaatgtcctgcagccacaggaccaccccctacaaagactcatgcagcccccgggaccacggcactagctgggaaacggatactggagagggaggaggagtcctcgggcgttggtgactttgtctcatcttcatgtgctggagggtatggggggaggagaggaagtggagacagcaggctggaccattgtgtttcactggaacgtttgcctgaggaggaagtgggcttgggagaggttttcttttttatgaaagaagcaatcactgcattgctgatgggaatcatcctgatggagaaatccaagggcaagggacagcagctgggctctactcctgagtgagtctagtgggcttgggggtgtccatgtggtgctgtcccttggcagggtcagggcagctgctagggtgggaccagcagttggggtctgcagcgtggagatgggcaggaagctggagcccggctcatcgtcgcatagcctgcctgcacccgccccccgccaccacctcctggtgggttccgccctcatgccccacctctccctgcagcgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggggtctggctttgtttcctgggggcaaaggaggtttggggttcctttcgcaggtactgcagtgccagcctcagcagtggggggaccggccttggcacctgctggtggctgccattctgtggatctgcgtctcccgtcccccgtctctaggcctcttgctccccttccttggttccttctcggggtccctgtcctccacagctgtctctcagggtctttgtccaactcttttcatccctctcctgggtctgcgcccctcccctctgcggtacccgtgtcctgcctagtaggggatgggggtggctttccagcacagccagccctcaagtttcccagaacagtctccccacctccccccaacactcgacattgttcctctctggctgttttttcctgttcgggtcccttcaaggcccaactgtgcccagccctctgcagctggggacactgagtgggttgggggtgtatgtttgcaaggatagaatttctcatgggggagtggccctgcttcctcccctagaatggcttggggcttagggctggggacttgccctccatggaggtcagtgggagttgcagctgtaaggtggcagggcctacccatcttacagaggtgaagacgaggtccctctgcctctgctgcagacatggcgtctgcacccacccttccaccctcagggcctggccacggggtcctgggtcccccacaatactgtgcactcgacctggttgacccaggacaccctcctcgttgaacagccctggctacacctgcttcagtgcaactggagccctcaccggcgagtgcctgacacctcggccttttctcttccggaggggcgctcctcagtgtgtttggggtctccctcgctccacgccctccagggggccgcatgtgcacttgccctgcattgcctggcccccgaggttccagggtctcaactgtctactaaccggcttcccgacagggtgagggtgaggtcgcatctacaaccagagccagcgcttccccgccgccaccccttttcttggaatcccgctgcttagctacctgcgggtgtcattggccccgccccatttccccacgctttgaagggggcgagtctccacagacctcctagggggatagacagcagctggtgtgaccccacacacccagtgaggtctctggagccgcggtgcgggaagcggggacccgggtttgaatcctgcccctctggtgtggtgcggcctcttcccacagacttttggcctcagtgttccccgcctgggaagtggggactggccctggtacctggctccagagctgcacccagaggcgatcagcccggtgcgggaacggggcggggtggccgcaactacgggccacggatcctgacccgccctgcccacgatgactatccacatcctcatcctgctgttgctcctcgccttctccgcccaaggggacctggacactgcagccaggtgagaaacccgggtggcagcagggacagggcgggagggagaccgtaaagggcgagcgccctctcccggccgcggaacgggcaggtgatctgtaagcctccccgctggtcttggagtgcttgggtgcccacctccatcacgctccatctctcaattcggtttgaacccggttttctcccacgctccctctccaggcgaggccagcaccaggtcccccagcaccgcgggcacgtctgctacctgggcgtatgccggacccaccgcctggcggagatcatatactggattcgctgtctccaccaaggagccctcggggaaggccagccacgagccccaggacccctacagctatgggcgccgccggtggcgcgaggcggaagcccggctcggttcccaggattccggcctgcagcgagggggctagcgcagtgcccagctcgctgggtgacctcgggcacggctcgtcccctcctcggcttcagtttgcctatctgtatgttggagcttctactccacatttcttctcccctaactccagcccctgaaaccgtcttccccagtccctccccgggctgcgactaggttggacctagaagcacacgggaccaggctgggcgaagaacactgacgcccagagccgaataaacaagagttccgtgtttcagtctctgcttctctgtacctatttcgacctctcagtcgaggctgggtctctaatatacctttctctattagccatgctgcttctccctcacggaagtcccactgtctaccttgaatccaacccgctgtggcgcctttcttgccaactcaatccatgcaccttccgtgggtggttttggcgggccgtcctgacccccaaacatccctcctccctccctggcgtgaaagggctgagatttgctccggcaccctacgcgcctgacgttataatgcacctggggtgggctgcgacctcccagctgagccttgttcctcgaagagacaggagactaagagacaatgagctgagtgaggagcccaggaacccgggttccgaacagctgcgtagaatgcgagcggccaaatggtggagaatctggccgggtaaaaggagacggaggactggggatcgaacggatgtaggggattggacgccgtggctcgaagggggcggggatagaacgcggggattggaaggaggcggggataaaacccgggacctgaatacccggctagggacacgagagagaggaatcggggtttctgggtgacggtgatctcggggtgggcaggactccaaaggcccgtcgacccggtggtggactccttgcactgggattggacatatgcaagcgggagatttggggccggcgctcaaaatcggggggcgggggtggactcgggtttggaccccaggatccgatcagcggacccttgattcaacgtggtaagtactggaccccaggggctcgggctccggcggggcctggagtcctgtgtctagggttgggcgtgcaagcctctccatcacttgtcctcgacgctcgcctccgctcacagcctcagcatcccaggctgcgaggcatgcgcagtgggtgcttccttccccattccctccagcacgggcggggggaggggacgctgagcggatgaatttatagacaccatccccctcgccttggcatgaaaagcggcaatggggtggacagcgtcaatgtctaacaggtgtttgtttcatatgggtctaaaactaatgcttttctcaagaccccgcaactcagcctggaccagtttccctcctccacccacccccgaatcttgagaatcctgtactggggggagggcactgcccccgcaccatgttcttgggagagcaggtaaaggggttaacgcgagctatccctctggcctctctatgcgttcccagaggtcccgaattgacgtccttccctcaaaacctccgggtctacaaaccaggaccctcaagacccttcaggtgcttagagaaggatgagctaggttatgtagtcctgggtcggcgcaaaaaggcagctgaaagcgtgagatcccgggtctgagggaggaggggctggggcctgggcttctgggtctgagggaggaggggctgggggcctggactcctggatctgagagaggaggggctggggcctgggcttctgggtctgagggaggaggggctgggggcctggactcctggatctgagagaggagggactggggcctggactcctgggtatgaaggaggaggaggggctgggggcctggactcctgagtctgagggcggaggggctggggtcctgaagtatgactctgcccgactcagggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctgggtgaggagcggtgctggtcggtttccttccggggatccaggtttctgcttccgggatgtctgaggctcacttccggcatttcagctggttcatttctgggagactatcacccctttttccgagaattttgatgtctgctcccaggacccctttagcaatttctccgtggctcacttctgggatccacagccccacctgctgagaacctctgctcacttctttcacccaagaggggaactgggccccccaaaaactacccacttccagtttctagaactccatatccttcccttatggtgaaattatcatttcttcctttcatctccagcttcttttgtagttgttgtttctgagacacagtctcactctgtcgcccaggctggagtgcagtggcgggatctcagctcactgcaacctccgcctcctgggttcaagcaattccctgcctcagcctcccaggtagccgggattattggcgcacgccaccatgcctggcttatttatttatttatttatgagacagagtctcactctgttgcccagactggaatgcagtggggtgatcttggctcactgcaaccacctcccaggttcaagcgattctcctgcctcagcctcccgagtagctgggattacaggcatggattatacgcccagctaatttttgtatttttagtagagacggggtttcaacatgttggccaggctaatctcgatctcctgacctcaagtgatctgcctcccaaagcgcttgggttacaggaatgagccaccgcgcccggcccaaactcctgctctgtccctgttctggaatgcgcatgcccaatgtgtaaccagcacccatgtctgtcccagggtttctggttctagaactcttgcactgtctccatacagggactccctgcttgtcacatcctctgtgtgtgaactggggtctggaacacctgtggggtcatgattgagtttgaatcctgactccaccgcttagtagctgtgtcatcttgggcaagcacctctcttggagtcgcagtttcccctcgtggaaaacatgggtgttgacagcacctccctcacaggatagccttgaagactaaattaattcttctatgtcctggcccatggcgaggtctgagtgttagcttctgatattgttcttcattcattcaccatatatttatggggcatccggtaagggcctggccctctttagcatggagaacacagcagatatcaacagacagaatcacgcctgggcactgcgggctcacggctttaatcccagcactttgggaggctgaggcaggaggatcacttgagcccaggacttggacaccagcctgggcaacatagggagaccccatctctattaaaaaaataaagacaggtcgggcacggtggctcatgcctgtaatcccaacactttgggaggctgagacggacggatcatgaggtcaggagatcgagacccttctggctaacacggtgaaaccccgtttctactaaaaatacacacacacacaaattagcctggtgtggtagtgggtgcctgtagttccaattactcaggaggctgaggcaggagaatggcgtgaatccgggaggcggagcttgcagtgagccaagatggcgccactgcactccagcctgggcgacagagcgagactccgtctcaaaaaaaaataaaataaaataaataaataaataaataaataaataaataaataaataataaagacagaatcctgcttttatggagttctcattcgagttgggggagaaggcaataaaacagatgagcaaaacagaaggcaataaaacagatgagcaaaatatagggtatggtgacattctatagtgtcatctgatattgatggtgacacatgctatggtgaatgataaatcgggtagagaagagtgatgtgggggtgttgcagttaaataagggggtggcaggccaggtgcggtggctcacgcctgtaatcccagcactttgggaagccaaggcagacagatcacgaagtcaggagttcaagaccagcctggccaatatagtgaaaccccatctctactaaaaatacaaaaattagccgggtgtggtggcaggcacctgtaatcacagctacctgggaggctgaggcagaagaatcacttgaatccaggaggcagagattgcagtgagccaagattgcgccactgcactccagcctgggtgacagagcaagactccgtttcaaaaaaaaaaaaaaaaaagggggtgggagccggcggccaggaggatctcctgaagc

SEQ ID NO: 17945 - DNA, 16963 bp, Homo sapiens
tgtctctgtctccttctctcggcctctgccccgttccttctctccctcttgggtctctctggctcatccccatctcgcccgccccatcccagcccttctccccgcctcccactgtgcgacaccctcccgccctctcggccgcagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgcgcggccgcctggtgcagtaccgcggcgaggtgcaggccatgctcggccagagcaccgaggagctgcgggtgcgcctcgcctcccacctgcgcaagctgcgtaagcggctcctccgcgatgccgatgacctgcagaagcgcctggcagtgtaccaggccggggcccgcgagggcgccgagcgcggcctcagcgccatccgcgagcgcctggggcccctggtggaacagggccgcgtgcgggccgccactgtgggctccctggccggccagccgctacaggagcgggcccaggcctggggcgagcggctgcgcgcgcggatggaggagatgggcagccggacccgcgaccgcctggacgaggtgaaggagcaggtggcggaggtgcgcgccaagctggaggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcatctgctggcctccccctgtgatttcctctaagccccagcctcagtttctctttctgcccacatactggccacacaattctcagccccctcctctccatctgtgtctgtgtgtatctttctctctgcccttttttttttttttagacggagtctggctctgtcacccaggctagagtgcagtggcacgatcttggctcactgcaacctctgcctcttgggttcaagcgattctgctgcctcagtagctgggattacaggctcacaccaccacacccggctaatttttgtatttttagtagagacgagctttcaccatgttggccaggcaggtctcaaactcctgaccaagtgatccacccgccggcctcccaaagtgctgagattacaggcctgagccaccatgcccggcctctgcccctctttcttttttagggggcagggaaaggtctcaccctgtcacccgccatcacagctcactgcagcctccacctcctggactcaagtgataagtgatcctcccgcctcagcctttccagtagctgagactacaggcgcataccactaggattaatttggggggggggtggtgtgtgtggagatggggtctggctttgttggccaggctgatgtggaattcctgggctcaagcgatactcccaccttggcctcctgagtagctgagactactggctagcaccaccacacccagctttttattattatttgtagagacaaggtctcaatatgttgcccaggctagtctcaaacccctgggctcaagagatcctccgccatcggcctcccaaagtgctgggattccaggcatggggctccgagcccggcctgcccaacttaataatacttgttcctcagagttgcaactccaaatgacctgagattggtgcctttattctaagctattttcattttttttctgctgtcattattctcccccttctctcctccagtcttatctgatatctgcctccttcccacccaccctgcaccccatcccacccctctgtctctccctgttctcctcaggagactctggcttcctgttttcctccacttctatcttttatctctccctcctacggtttcttttctttctccccggcctgcttgtttctcccccaacccccttcatctggatttcttcttctgccattcagtttggtttgagctctctgcttctccggttccctctgagctagctgtcccttcacccactgtgaactgggtttccctgcccaaccctcattctctttctttctttctttttttttttttttttttttttttttgagacagagtcttgctctgttgcccagcctggagtgcagtggtgcaatcttggttcactgcaacctccacttcccagattcaagcaattctcctgcctcagcctccagagtagctgggattacaggcgtgtcccaccacacccgactaatttttgtatttttggtagagacaaggcttcggcattgttggccaggcaggtctcgaactcctgacctcaagtaatctgcctgcctcaccctcccaaagtgctgggattacaggcatgagccacctcacccggaccatccctcattctccatcctttcctccagttgtgatgtctacccctcatgtttcccaacaagcctactgggtgctgaatccaggctgggaagagaagggagcggctcttctgtcggagtctgcaccaggcccatgctgagacgagagctggcgctcagagaggggaagcttggatggaagcccaggagccgccggcactctcttctcctcccaccccctcagttctcagagacggggaggagggttcccaccaacgggggacaggctgagacttgagcttgtatctcctgggccagctgcaacatctgcttgtccctctgcccatcttggctcctgcacaccctgaacttggtgctttccctggcactgctctgatcacccacgtggaggcagcacccctcccctggagatgactcaccagggctgagtgaggaggggaagggtcagtgtgctcacaggcagggggcctggtctgctgggcctgctgctgattcaccgtatgtccaggagctggagcagcaccctctcagagcctcagtttccccagatgtcaatgagagaatcagcatcagccacatctcccacctgaagaatcgaaccttgagttctcacctttaagaatttttttttttttttgagacagtgccttgctcagtcgaccacgctggagtgcagtagcacgatcatcaatcactgcagcctccaactcaagcaaccctcctgcctcaacctcctgagtagctggggccacaggcacccaccaccatgcctggctaattctttcttttttgagatggagtctcactctgtcgcccaggctggagtgcagtggcaccatcttggctcaccgcaacctctgccccccgggttcaagcaattctcctgcctcagcctcctgagtagctagaattacaggcgcacaccaccacaccaggctaatttttgtatttttagtagaaacgaggtttcaccacggtggtcaggttggtctcaaactcctgacatcaggtgatccacccgcctcggcctcccaaagcactgggattacaggagtgagccaccatgcctggccatattttaaacttttttgtagagatggggtcttactatgttgcccaggctgatctcaaactcttgggctcaagcagatcctcctgccaaagcttcccaaagtagttggattacaggtgtgagccaccacgccccaccaacctatgaagatgtctaagcagacagggtgccctatctcaccacatccccagtcagatccagaggtgggacaaggatgggaaggaggttccagaacaaaggctggcagggagtcgtatgggacaggagctgacccagcaaccatccacagagacatcctggagcctgggaaggagaaggacaaagagcccccttttttaaattttttttatgtttttgagacggagtctcactctgtcacccaagctggagtgcagtggcacaatcttggctcactgcaacctccacctcatgggttcaaacgactctcctgcctcagcctcctgagtagctgggaccacaggtgcacaccaccatgcctggataatttttgaatttttggtagagacggagtttcaccatgttggccaggcaggtctcgaactcctgacctcaagtgctccgcccaccttggcctcccaaagttctgggaatacaggcgtgagccactgcaaccagccagtagcccccatctttgcccctcgctgagccctactggatgttcttggttatgcgacagtttccccatctattaaagagaaacccctatagcagaggggaggatgaggttggaaaagcaggagcattgttatgctattcttgtggggtctgggaagcagacatctgggtggatgtttggggggtgctgggcttagttggggaagtaggggggcccctggggcttacagggactggaagctctgagctggccagagggatgttgcaatcctgccagggtcttgtctatgctgtccttttcacaaccatccccctactgccaggctgacacgtggttgcgggggcacaaggccagccaacctagagtctgaggctaggcggaggacaccctccccaccagctgccagggtcactggcggtcaaaggcagctggtggggaaggcattggactccagccttgggggacggatgtagtgatggtgggaagcaggcttggtgccaggaggggcgtcagagggtgaataaaagcagatagagtgtttgggggaggtagccagccaaagggggtgaggcccggtggaagggaagaagggacatacacgcagagctttgcagctgagggttttaattttttgagatggggtctctgtcccaccaggctggagtgcagtggcacaatcacagctcactgcagcctcgaactcctgggctcaagcaatcttcctacctcagcctcttgagtagctgggactacaggcatgcgccaccacgctcggctaatttttgaacttttttgtagagatgaggtctccctatattgcccaggctggtctcgaactcccaggctcaagtgatcctccctcttcagcttcccaaagtgctgggattacaggcatgagccaccatgcctggctaatgcaggtgaggtttttgcagtgtcatccagctaaggcgacccgttcccctcccaaaaaagggagactgagaaccatgaagttaagagcccagagaatatcacggtggtctggggtgcttcaagggctggtctggaataaattggaggtggcacgcagggtaggagcgccgggccaactgggagacccagcaacataaaggaaaagttgttggggctgaggaggcttgctgagagaggggaagtgagggaaagaggtgatctagggacacggtgtgaatgagggggggatgagatcacagggttattactgggagacccctgagggaagatggccacagggacaggacaaggctgtcttcttaagggaggagaccacccctcatattgtcttatgcccaatttctgcctccaaagaaagaaaaagtaaaaactaaaaggcagaaatgaaatccacaagcagacagcccgcgccacaccctgggcctggtggttaaagattgacccctgacctaatccgttaggttatctatagattacagacattgtatagaaaagcactgtgaaaatccctattctgttttgttccgatctaattaccggtgcatgcagcccccagtcacgcatcccctgcttgttcaatcgatcacgaccctctcacgtgcacccacttagagttgtgagcccttaaaaggaacagggattgctcactcggggagctcggctcttgagacaggaatcttgcccattccccgaacgaataaaccccttccttaactcagcgtctgaggaattttgtctgcggctcctcctgctacattctgagtggggaaagggactaaggtggtctgaggaccccacagagtcaggaagattgagaggtgagagtgctgaacggggaggggctttggggctaagggaagtgcccgggaccccacctgaccccaacgctcacgggacaggggcagaggagaaaaacgtgggtggacagagggaggcaggcggtcaggggaaggctcaggaggagggagatcaacatcaacctgccccgccccctccccagcctgataaaggtcctgcgggcaggacaggacctcccaaccaagccctccagcaaggattcaggttggtgctgagtgcctgggagggacacccgcctacactctgcaagaaactcaaaaagggagatgaggggatcgtgggagggaggtagggagggaggagggtgccactgatcccctgaacccctgcctctgcctccagagtgcccctccggcctcgccatgaggctcttcctgtcgctcccggtcctggtggtggttctgtcgatcgtcttggaaggtaaaagtgggatgggagaattgcggagttrgagatttggaagartgaaggtggctacaggcctggggtcccggcttagaggacctctgagagctccggggccccttctgggtcgtggttgcctcatcgtggtcgggtgggtctccaggttctcccaggctcagtcccgcaggcgccaaatctgcgcaggagagcactagcaaccgatgacgtattgaggcccacacctctgggattggytgtcctgcttcgacagccttgaaagtgggtaagctgggtggggggctctgggagaggtcagtgctgagtaaggcaattcccagcagcttgagccccaccaggtcactccagtattcctccccattctttttttttttttttttttttctcttgagacggagtctcgctctgtcgccgaggctggagtgcagtggcgcgatctcggctcactgcaagctccgcctccctggttcacgccattctcctgcctcagcaggactacaggcgcccgccaccgcgcccggctaattttttgtattttcagtagagacagggtttcaccgtggtctcgatctcctgactttgtgatccgcctgcctcgacctcccaaagtgctgggattacaggcgtgagccacygcgtccggccattcctccccattctaaccacatgatccccaaggatctctatccatcccggtatcccaacctaagggggttccaataacaaatttttggccgggcagggtggctcaygcctgtaatcccagcactttgggaggccgaggcgggcagatcacttgaggtcaggagttcgaaaccagcctggccaacatggtgaaacttcgtctctactaaaaatacaaaaaaattagccaggtgtggaggcacgcgcctgtagkcccagctactcgggaggctgaggcaggagaatcacttgaacccgggaggcggaggttgcagtgagccgagatcataccactgcactccagcctggctgacacagcaagactccgtctcaaaacaaaacaaaacaaaaatagctgggtgtggtggtgcacacctgtaatcccagctacttgggaggctgaggcaggagaactgcttgaacccgggaggtggtggttgcagtaggccgagatcatgccactgcactccagcttgggctacagagcaagactccatctccaaaaaaaaaaaaaaaaaaacaaattttgaacccctgcccatcttcctggcaggcccagccccagcccaggggaccccagacgtctccagtgccttggataagctgaaggagtttggaaacacactggaggacaaggctcgggaactcatcagccgcatcaaacagagtgaactttctgccaagatgcggttagaacccttcccagggcacgggagagctggggtgtgtttttgggtggagccctggcagatggtccaagatgaacagattgaaaaaaaaacaagtcctggagaggctgacaacatccctctggtcacacagctagatctcaaggtgctcagacttcaaggacagtttccctgactcccatccaggccatattttaaaagatggtcttgggctgggcacggtggctcatgcttgcaatcccagcacttagggaggccgaggtgggctgattgcctgaggtcaggagttcgagaccagtctgaccaacatggtgaaaccttgtctctactaaaaatacaaaaaaattaggcaggcatggtggcgtgcacctgtaatcccagctagtcgggaggctgaggcaggggaattgcttgaaccaggaaggtgggagttacagtgagccaacattgtgccagcctgggtgacagaaggagactctgtctcaaaaaaaaaaaaaaaaaaaaaaaaaacaagatggtcttgcccaggtatggtggctcacacctgtaattccagcactatgggaggctgagatgggaggattgcttgagcccaggagttcgagaccagcctgaccaacatggcgagatcctgtctccatttaaaaaaaaaaaaaaaaagatggttttgtgaggtaatgaaaatgaaggccccaagcttggccagacctgggtccccaggctggagtagcaccccttcctgtgtgatcttgacagaggggcattactgtgagcctcagtttcctctcctataaactggtggttctacagggaagtaaaggagcaggcctacagggtgtctggtacatgtagatgctcagtatatcatgaaacccacccttgccccctttggcaagttagagagtcattcgttctttcaaaaatatttactgagcatctgctaagtgctggaaactgtttcaatgtggggaataaaacagtgaagaacgtgccgagcacggtggctcacacctgtaaccccaccactttggaaggccgaggtgggtggatcacttgaggtcaggagtgcgagaaccccgtccctaatagaaatgcaaaaaaaattagctgggcatggtggcccatgcctgtagtcccagctccttgggaggctgaggcgagaggattgcttgagcccaggagatctaggctgcagtgcgccatgtttgtgccactgcattccagcctgggtaacagaatgagaccctgtctcaacaaaaaaagaaaagaaaagagaagaaaagagaaaagaaagacagggagggagggaggaaggaagggagggagggagggaaaatagagccaggcataaacttagaaagatcgtttggaggccaggcacaatggctcacacctgtaatcccagcactttgggaggccaaggcaagcagatcaactgaggtcaggagttcgagaccagcctaacatggagaaaacccctgtctctactaaaaaaaaatacaaaaaaattagccggggcgtggtgcattcctgtagtcctagctactcgggagcctgaggcaggagaatcacttgaacccgggaggcggaggttgcagtgagccgagatcatgccactgcactccagcctgggcgacaaggcgagactccatgccaaaaaagaaaaaaaactcctggcgcggtggctcacgccagtaatcccagcactgtgggaggctgagcaggcggatcacgaggtcaggagttcgagactagcctgctcaacataatgaaaccctctctgtactaaaaatacaaaaattagctgggtgtggtggcaggcacctgtagtcccagctactcgggaggctgaggcaggagaatggcttgaacctgggaggcagaggttgcagtgagccgagacagtgccattgcactccagtccaggtgacagagcgaaactccatctcaaaaaaaaaaggaaggcattggtagcaagagatggcaggccttgaaagccaggccagggtgaagtgtttctttttttttttttttttttttctttttaaatttttttttttgagacggagtctcgctctgtcacccaggctggattgcagtggcctgatctcggctcactgcaagttccgcctcccgggttcatgccattctcctgcctcaccctcccgagtagctgggactacaggcacctgccaccacgccagctaattttttgtattcttagtagaatgtagaatttacttagtagaattttttgtattcttagccagcatggtctcgatctcctgacctggtgatccacccgcctcggcctcccaaagtgctgggattacaggcgtgagccacggcgcccggccttattttttctttttgagatgtacccagactggagtacagtggtgcgatctcggcttactggaacctccacctcccgggttcaggcaattctcctgcctcagcctcatgagtacttggaactacaggtgtgtgacaccacacatggtattttttgtatttttagtgaagatgacatttcaccatgttgcccaggttggtctcgaactcctgacctcaagtgatcagcctacctcggcctcccaaagtgttgggattacaggcgtgagccaaatgcccagccaagggtaaagtgtttagacttcaacgtgctttggtccatctgggaaactgaggcacagaagttggcccacccagcccagcggtcctcctaatcccacagacagtggggatggagattctgcaaggggaagaggtgggagtcaggtagcaggcagaatttggacagcctgggaggtagctgcacacagtgacccccttccttattcctccccacagggagtggttttcagagacatttcagaaagtgaaggagaaactcaagattgactcatgaggacctgaagggtgacatcccaggaggggcctctgaaatttcccacaccccagcgcctgtgctgaggactccckccatgtggccccaggtgccaccaatraaaatcctacagaaaattctctcctgagtgcttctttactctggggaaggggctgcgggagagggtaggggcttccagagagggcagggtctgcaggagagggcaggggctaaaccttaggtactcctcacaagccctccaatgccctatctacttgccctgtgctgaggatgttttaactccatggtctcaaaagagtcttcctaagaaccctgcaaactgggccttattaatcccataagggcattgaggcccagagaggtgaagttacttgtataaggtcacacagccaggaagtagagaactggaactagattgaaccctcagcctagcaatgtcactatgctacacttttcctagtgtggtctacccgagatgaggggctgaggtttttttttgtttttgtttctgttttgaggcagactcactctctcccccaggatggagtacagtggtgcgatctcagctcactgcaacctccacctcccaggttcaagagattatcctgcctcagcctcccaagtagctgggatttacaggtgtgcgccaccacacccagctaatttttgtatttttagtagagacagggtttcatcatgttggccaggctggtctccaactcctgggcttaagcaatcctcctgccttggcctcccaaagtattagaattacaggcgtgagccactgtgcctggctcttatgtaaaattaaaccacatacacatgagaaacaaccctatgtaattaagatttctttctttttttttttttttttaagagatggagtcacccaggctggagtgcagttgcacaatctccattcactgcagccttgcaacctccaccacctgagttcaagggattctcctgcctcagcctcctgagtagctgggattataggcatgtgccaccacgcccagctaatttttttgtatttttagtagagacggaatttccccatgttggccaggctggtctcaaactcctggccttaaatgatccacccgtcctggcctcccaaagtgctgggattacaggtgtgagccaccgcacccagcttaagatttcataagaaaaatatttgtaagccacatatctaataaccggttaatattcaggctgggtgaagtggctcatgcctgtaatcccagcactttgggaagacaaggcgggcggattacctgaagtcaaaagtttgagacctgcctggccaacatggtgaaaccctgtctctactaaaaatacaaaaaaattagccgggtggggtggcacatgcctgtaatcccagctgcttgggaggctgaggcaagagaatcccttgaacccaggagtcgaaggttgcagtgagccaagatggcgccactgccctccagcctgggagacagagtgggactccatctcaaaaaaaaaaaaaattcaaaatgtataatatacaatcctagttgggacatcaaacactgcagccactgtggaaaacagtatggggtttcctcaaaacattaaagatagaactctcaaatgatccttcaatcccacttctgggtatttattcaaaagaattgaaatcaggaccttgaagagatacctgccctcccatgttcactgcaggtctgctcaatacccaagatatggaaacaacctaaatgtttatcaacagatgaatgggtcaaggaaatgtggtctctacatgtaatggaatgtaacgcatccttaaaaaggaaaccctaaggccgggctctgtggctcacacatgtttttttttttaaattttatttatttatttatttatttatttattttttattgatcattcttgggtgtttctcacagagggggatttggcagggtcataggacaatagtggagggaaggtcagcagataaacaagtgaacaaaggtctctggttttcctaggcagaggaccctgaggccttccgcagtgtttgtgtccctgggtacttgagattagggagtggtgacgactcttaacgagcatgctgccttcaagcatctgtttaacaaagcacatcttgcaccacccttaatccatttaaccctgagtggacacagcacatgtttcagagagcacagggttgggggtaagatcacagatcaacaggatcccaaggcagaagaatttttcttagtatagaacaaaatgaaaagtctcccatgtctacttctttctacacagacacggcaaccatccgatttctcaatcttttccccaacttttcccccctttctattccacaaagccgcgattgtcatcctggccggttctcaatgagctgttgggcacacctcccagacagggtggtggccgggcagaggggctcctcacttcccagtaggggcggccgggcagaggcgcccctcacctcccggacggggtggctgccgggcggagaggctcctcacttctcagacagggcggttgccaggcagagggtctcctcacttctcagacggggtggccgggcagagacgctcctcacctcccagacggggtcgcggccgggcagaggcgctcctcacatcccagacggggcggcggggcagaggcgctccccacatctcagacgatgggcggccgggaagaggcgctcctcacttcctagatgggatggcggccggacggagacgctcctcacttcccagactgggcagccaggcagaggggctcctcacatcccagacgatgtggctcacgcatgttatcccagcactttcggaggtcaaggcaggaggatcacttgaggccaggagttggagaccatcttggccaacatggtgaaaccccgtctctactaaaaatacaaaaaattagccaggcgtgcgcctgtaatcccagctactcagtaggctgaggcgtgagaatcgcttgaacccaggaggtggaggctgcagtgagccgagatcatgccactgcactccagccggggcatcagagcaagactcaatctcaaaacataaaaggaaatcctgaaactgggcacagtggcttatgcgtgtaatcccagcactttggaaggctgaggtgggaggatcacttgaggtcaggagttcgagaccagcctgggtaacatggtgagacaccatctctaccaaaaaaagaagaaagagaataaataaatgtataaatattactccctggggttaatgcatccccttctcccccaaatcaaccctccaaactcctatactctcctgtcttctcactcagcagcctgttagaactcaagtcagattttttgttttttgttttttgagacggagtctcactctattgcccagcctgtgcagtggcaccatctcagctcactgcaacctctgcctcccaggttgaaccgattttcctgctcagtctcccaagtagctgggactacaggcgtgtgtgtgccaccacacccagctaatttttgtatttgtagtagagacggggtttcaccatgttgcccaggttggtctcgaactcctgagctctagcaattagccctccttggcctcccaaagtgctggggttacaggcatgagccaccatggccggcctcaagtcagattatgctcttcctctgctcagaactctcctgattctctcagagtaaacccagaagcacttaccaaggcctacaaacgggacactatgccgtccacgatcgcctcctccctgtctctctctccatcactcacaagcaactctttgctattcctccaatgtactgggcaggttcccatctcagggcccttgcagttactgttcctcttgcctggaatgttcttccccaggggtccagatatctgcctggctccctcctcacttcctccagttctcttccaaaatcatcccctgccagacgtggtggcacacgcctgtaatcctaactctttgagatgccaaggtgggaggattgcttcagctcaggagttcaagatcagcctgggcaatagcaagaccccatccgttctaaaaataaaaataaataaaaaataaaaaataaaaattagctgagcatggtagtggacaccttggggttccagccacgtggcaggctgaggtaggaggatggctttgaatcagggaggttgaggctgcagtgagccatgttctgaattagatactggtgatgatcgtgcaaccttcccaatataggaaaaaccactgaacagtacattttcaaagggtaaatttagccggacacggtggctcatgtctgtaatcccagcacttttggagtccgaggcgggcagatcacctgaggctgggagttcaagaccagcctgaccaacatggagaaaccccgtctctactaaaaatacaaaaaattagccaggtatggtggcgcatgcctgtaatcccagctactccagaggttgaggcaggagaattgcttgaacccgggaggcagaggttgtggtgagccgacatcacaccatcgtactccagcctgggcaacaagagcgaaactccgtctcaaaaaaaaaaaaaataattaagaaattagccaggcgtggtggtgggtgcctgtagtctcagctacttgggaggctgaggcatgagaatcgcttaaacccggcgggtggaggctacagtgagcctagattccaccaccgcactccagcctgggcaactgagtgagactccacctcaaaaaaataaataaaagggtaaattttatggaatgtgaatcataattcaatttttcaacatgcgttaggagggacatttcaaactcttttttaccctagactttcctaccatcacccagagtatccagccaggaggggaggggctagagacaccagaagtttagcagggaggagggcgtagggattcggggaatgaagggatgggattcagactagggccaggacccagggatggagagaaagagatgagagtggtttgggggcttggtgacttagagaacagagctgcaggctcagaggcacacaggagtttctgggctcaccctgcccccttccaacccctcagttcccatcctccagcagctgtttgtgtgctgcctctgaagtccacactgaacaaacttcagcctactcatgtccctaaaatgggcaaacattgcaagcagcaaacagcaaacacacagccctccctgcctgctgaccttggagctggggcagaggtcagagacctctctgggcccatgccacctccaacatccactcgaccccttggaatttcggtggagaggagcagaggttgtcctggcgtggtttaggtagtgtgagagggtccgggttcaaaaccacttgctgggtggggagtcgtcagtaagtggctatgccccgaccccgaagcctgtttccccatctgtacaatggaaatgataaagacgcccatctgatagggtttttgtggcaaataaacatttggtttttttgttttgttttgttttgttttttgagatggaggtttgctctgtcgcccaggctggagtgcagtgacacaatctcatctcaccacaaccttcccctgcctcagcctcccaagtagctgggattacaagcatgtgccaccacacctggctaattttctatttttagtagagacgggtttctccatgttggtcagcctcagcctcccaagtaactgggattacaggcctgtgccaccacacccggctaattttttctatttttgacagggacggggtttcaccatgttggtcaggctggtctagaactcctgacctcaaatgatccacccacctaggcctcccaaagtgcacagattacaggcgtgggccaccgcacctggccaaatttttaatttttttctagagatagggtcttactgtgttgcccaggctggtgtcaaactcctgggctcaagcagatcctcctgcctcagcttcccaaagtggtgggattataggtgtgagccactgcgcccagtcagtagccccctctttgcccctcactgagccctactggatgttcttggttgtgtgacagtttccccatctattaaacagaaacccctatagcagaggg

SEQ ID NO: 17946 - DNA, 27032 bp, Homo sapiens
ttgagttcttgctctgcgcctggccatgccggctcacagtagtcaccaagacaacccagttccctggggttgccatttgggaatgatggcgcctttcatctggatttctccaacacaggtttcaaccgcagcggaggtggtggctatagccagaaccgctggggtaacaacaaccgggataacaacaactccaacaacagaggcagctacaaccgggctccccagcaacagccgccaccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacaggtgagagaatgagtgtgtgtttgtatgtagtgatcgcacgtgtgcttttgaacctgagcaagttaggtggaggcggatctggggaaatcaacacatgccccagctactggtcttcactctaacctctagcctgcccttctttctccctggccgtgatcttgactcagatggaccctacacattcccagatcccctccaaacccaggagtaaatgtagaccttcccagaacctgctcttctcccaccaccctcaaggggatgggctgtaagcactgatccctccagcaagtacattattcttggctagtgtcactaacctcactaaatccccaagaaagcacttgactggagtcaccccttgcccaggctggctgacctctttgtcttttggacataataaccagggcactaaggttgctgaggacttgccctctgcacagagagcttcaatcctgagcagctccaggctcagttcccgttcttggaaagccagtgccctggctctggtatgcacaggctcctgtaaaccagagaggttttcagttatcgcacagccatttcccaagcactttcctcatgccgggcctggaatcagctgccaggaaaccaatggatggttcccaggcccagctaactagaatatttcttagaacaagagttgggcaggcacagatccaaacccccagccccacaacatcctgtttctgtgagcttggacaaatagcttcccgtctctgggcctcattttcctcataaaggtgttagtagaagtcccttccaaggtttgttgtgaggaatgggtggcactatagctctgggactaggcagacctggggtcaagtcctttttccttggcccagaaatttcatcttgagcctcagtttctttctctttaaaatggggctagtgggacctacccctaggttctatatggagattaaatgatgtaatgatccaacctgtacttgggaagcacttagtcaattgccactactgtttctcagcagatcttccagtaacaactaccaccacctgttgagtacccagtggtttatacacacaagcttattggatacccagggcaagctaaaggagttgttcttgttctattgtgattctcattttataaaaaagaaaactgagatttcaagaagtgccgtgtaccttgctccctgggggtctcagagctggggttagagtccacatcacagccctggggcttgcccttcatcctgccctaccatggcatggagctggctctcctccttctcagcccacaaacaatgtccactaggcaagggaagggcccctgtgggccaaccacttaaaaaggccctttttccatcccagcatttcacatctgcagatttcctctatttcacagagctttggcttttttccctccactttccagccgagttacagccagccaccctacaaccagggaggttacagccagggctacacagccccaccgcctccacctccaccaccacctgcctacaactatgggagctacggcggttacaacccggccccctataccccaccgccaccccccaccgcacagacctaccctcagcccagctataaccagtatcagcaggtaggtgccagactgggggccaactggatggagagacttccatgggcccctcctgggtgtgtattcccagacttaagtccctgcttatccctaaaaagacagcctgctggcctcggcctggcgttcatctggtgcagccattccatttggtcaacacttctgcactggttgctaggtaattggtatcctagccccctccacagtctagcaagtgaaggggaagggctggcctaagtaccaggggcctcagagtcctctttcagcaccatagacagggggctccaaatcctgctgcaggttggtgcccaggcccccatacctgttactaaatcttttgactatgatatctagctatacccaaaaggcactgggttgacaagctgagacctgggcttcagtccctaactgcctacctgtgtggtgtcaggtctttccaaggtgccttgatttctctgtcaggggacctgtgttcaactgttgtcactgcagctgtctctgccctaggtgagggtggggctggtggggaggctaaatgtgtggtggatgcaggacaacttggtgttcttggtttctttccccagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgcgcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagtttctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaaacaacttaactgagggattcatgtgcctggccccgattttggtgctaaaaatgcacgcttaaacaagggtccctggtttaaaatccactagttcatttttaaagtgcttctcttgttctctacctctcacagtctaaaatccctccaggagtttttgagtaaaggacatggaacaggcctctaggtggagggatgggtgggactgatggggcagagaccagggctggtttgtttggcatcatcactgggcatccacagaccacctgcctcaggcctggcctgtgtgcagcacggaggacagttcctgcctgttctgtgtttggggctcatggggattccaggagcttcatgtttcagccagtgtgtgtgagccacctgctgtgttcttcagctgtcctggacagtgctggggacatagtatggccacggcagtcctggaccccgttctcacagagctcccactccagagagaacaaagacctgccagcaccaagtggtcagctgtgagagcctggggtggtgtgcagggagggcttcctggaggagtgagccagggtaaaagactccagattgcatccccatggcccatcttccccttccttagcaaccttatgtcttcgttccctcatacatgctgtgttcctggctccttgtgagagacaatgctgggccacaggagaagccaattcagccccaatcttccctggtgggagctcagagccttgtgaaggggagatgggcaacaaaaacaagggagggaaactgactagtctcagaatctcgggtagggcatcagaacgtgagaaggaaccaaggttggtggctaaaagggaccctagaatgcgccagagaggaggtggcagggcctttagtctggaaagtccccttcccttcatgtccatatgctgggctacagcgccctctgctggcctctcctggtaatgcctaggaatctgggttggtaaatagggacctccttggctttcttccacaactccagacctcaagggaatgcaaatggggaagctcttcctctgttctcagccagtttttctcacacgtctcatctccagtcccttgatgcccactcccttcagaataaaggaggtcaagccacttactatggcttatgaggccctgcatggcctagcacctggtaacatcgctggcgccctctctttctgctccccctttgaatatcaaatcagtgtttattttgttctgaggagccataagtcctttttggaacccacaaatgatgccatgaaccactgcattggagaatacagaggtacatggaattttgcataaaaattcatgaggttctcaaaacctccacagcccaatcatggctttcaagttagagctcctttcctatgccctgaccgtagtgaagtgcttgcagcaaccagaaccgtccgtacgtgccatcctcctcaagactcttccctaccttcctcttaacccagctcctactcgttcttcaggtcttagcttgagggtaccctcccagaaagaaggcttccttgaccctccagcctggggtggacagctccctcagccctctggatccatcaaagccctggccactgagtgacatgtctgtctactctgctggtaacacctaaatagagccccacccatcccatagggaaataaggaccagagttgtcttgtttcacacctgtagatttcctccaggtcctgggaacacaaaatgggaagttctatctcactatccatctcatgccagccagagacagggtatgatgacggaagtaagccaggctggtggctcacgcgcgtaatcccagcattttgagaggctgaagcgggaggattgcttgaggccaggagttggggactagcctgggcaacaaagtgggacccctggctctacaaaaaaattttaaaaattagccgggcgcggttgtgcgcgcctgtagtcccaagtactccaaaggctgaggcaggaggatcacttgagcacaggaatgtgaggttacttgaactgtgatcgcgccactgcattcgtctgggcgacaaagcgagaccctgtctcaaaaaaaaaaaaaaaaaaaaaaagagtcaaggcttagtaatattcctgaattcctgaaggagttaagaaaggaaaaggacaagcgggggtctaaacgagagcacgaaccctcagcgtatgacggctccaggctccgggggaaagtcctttagccatccatcccaaaattaagcacgctgggagctggagtcacagcagtgataaaacgaacaatgattctggttcctactgactgacaggagaggtttaagggtctctcactctccggggagcccctttccttcctggctgcggagggcggagcccgagagaggcacgcatgcgcaatgcaacgtctgccttaggcccggaacttcggtgcctgggcgcagcggtgcacccggacccggaacattctcaggcgaaagtgtctcttgygtgcgtgggccggaggttagtgtgcggggcccgccgggcggttgaaaagtycgagagaatcaggatggaggccgtggcgacggcgacggcggcgaaggaacccgataagggtgagatcttggtcacgcgcaggcggcgggtgggtgcggttgcggtgtctctaggaaatgattcccccaggaacgcgaagtaggactcgttttagggggacacccacccccctcagctttaccggtcctcttcactactttgcccagattattccctcccttgtcgcgggctgaccttcttttcctccattccttccccccgaaattaacctcttcccagttccagaccaatcctttccatgtccctaattcatttccttaccaggctaactctcaaattaacagaaacctctctaccccggcctaattcctgcattgcctcagaccagcccttctcaaattacctccttccctgtaccaagctgagccttcccttgctctctagacgaatcctcctacctttccaggctaaacttctacctgcctcatgcaaacttatcccaatctaacgattccttcatttcattgtaactcccgtttcccccaaagtccgaaatccagccaggctcctttcaaagtccttactcaatttctgtgctttcccacaaccttcaaagtaatccgacgtcgggtgaggtgtgattggaagcgtggctccaacaccactggccaagaattggtaattgtggaagccagatggagatgattggtatatggaggtagggggagaattgtcgttgtactttctacttttgtgtatgtttgaaattttctaaaaataaaaaatttaacctaaaaaaagtcttaaggccgggtgcagtggctcccgcttgtaatcccaacactttgggaggccaaggcaggagagttgcttgagcccaagagtttgagaccagcctgggcaagagagagaaacctgatctctataaacatttaaaaattagccaggcctggtggctagggagtagctaggacaagctactcaggagactaaggtgggagtgtcactcgaatcctttgagattgcagtgacctaagattattacaccactgcactccagcctctgcagcagagtgagacttgagcccaggagtttgagaccagcactggcaacatagccagaccccatctctacaaaaaatttaaaaattaaggccgggcccggtggcttacacctgtaatcgcagcactttggaaggcggaggcaggaagatcacctcaggtcaggagttggagaccagcctagccaacatagcgaaaccccatctctactaaaaatacaaatattagccaggcgtcgtggtatgtgcctgtaatcccagctactcgggaggctgaggcaccaactggaatcacttgaacccgggaggcggaggttgcagtgagcagagatcgcaccactgtactccagtctgggtaacagagcaaaactctgtctcaaaaaaaaaaaaattagccaggtttgatggtgcattcctgtggtcccggctactcaggagtctgaggcgggaggatcacttgagcccaggaggtcaaagctgcagtgagctgtgtttgcactattgcattgcagtctgagcaacagagcaagaccctgtttcaaaaaaaagaaaaaaaatttgtctcttggccccatctgtctccttcagagagtcatgtatacttggtcttcatttcctcgtctcctgctcacgactgtctgacttttctcctaagaaactgctctgattagggtctgcactgacttcccccatgttgttcaattcagtccccccattcaggtttttgtttgtttgtttgttttttgagagagtctcactctgttgcccaggctggagtgcagtggcatgatctcagctcactgcaacctccacctcccaggttcaagtgattcccgtgcctcagcctcccaagtagctgggatcacaggtgcccgccactatgcctgtctaattttgtatatttttagtagagatggggtttcaccatgttggccaggctggcctcgaacttctgacctcaagagatcctcctgcctcagcctcccatagtgctgggattacaggtgtgagccaccacacttggcccattcaggttttttttcttactagactggactagaattaaatgctgttgatccttccatcctttttgcatgttttcctttggcttcagcgacaccacagtgcctgatttcctgcctgtctctcaggctgctccttctcagcctgactttgtttcccaggggtgctgtaacaaagtactacaaactgcatggcttcaaacaacagaactttattctctcatagttctcaaggccagaaggctgaagtcagtgttgctgaactgaaatccaggtgtctgcagggtcgtgcttccccacaggctctgggagaaaacccatttcttgcctcttccagccagtggtggtttctggaattccttggcatgtggctacatcactccaatctctgcttccccttttgacgttgccttctttttttttaagacggagtctcgctctgttgaccaggctggagtacgtgatctcggttcactgcaacctctgcctccggagttcaaacaattctcctacctcagcctcctgagtacctgggactacaggagtgcgccaccacacctggctaattttttgtatttttggtagagcgccatgttggccaagctggtcttgagctcctgacctgaagtgattctctcaccttggcctcccaaagtgctgggattacaggggtgagccattgcaaccggcctctttttttttaagataacagtaatgggctccagggattacgatgtagctatcttttgcacagccagtttttagcttcagaggcatgtcctccccgcatctgtgcagtgctttttcctggaccctcttgtcatccctctcccactcccctgtgccctccccagtccctacctctcatttctcttggctttggttcttgtcttgattctgatgacacccacagctctgtctccagcccaacatttctctcctgaggagtctggaggcccgtgtagcagcagtcggaccattcccctggatgcctcccttacttccagcacgtcagccctgtggctcctccactcagcctcctgacatctttctgattcgctcactcatgatcctgttccttcctccacagcccctgcccttgtccagctcagtcttcagctgcatcagtgatttaaatcctccctgatacacacaacacatgtatgtcacctgtgacttctttcctccccaacccagccacgctgcttaaagttgtctctatattctgttttcacgtatttcctgcttgccgcaggcttgctccctccactcttgggaaacaagtctcaccaaggtttgcccagcgctccgctttcctgttttctttccatttttttgagacagagtcttcactctgtcacccaggctggagtgcaatggctgatctcggctcactgcaacctctgcctcatgggttcaagcgattcttgtgcctctgcttcctgagtagcagggattacaggtgcccaccaccatgcccagctgatttttgtatttttaatagagagagggtttcaccatgttggccaggctggtctygaatttgtggcctcaagtgatctgcccacctcggcctcccaaagtgctggattacaggcatgagccatggtgcccagccagctttcctgttttctttgcccatattattgttgatcctgactgtctcccacatcagactgggtgctccctgagggcaggagctggactggattcatcctatggatcctcagcattgcctgacttagggcctctcagagatttagtgtttttttttctttttttttttttagagttttgctcttgttgcccagactggagtgcaatggcacgatcttggctcaccgcaacctctgcctcccaggttcaagctattctcctgcctcagcctcccgagtagctgggattacaggcatgtgccacaatggctrattttgtatttttagtagagacggggtttctcccagttggtcaggctggtcttgaaatcccgacctcaggtgatccacctgccacagcctcccaaagtgctgggattacaggcgcaagccaccgcgcccggcctaagatttagagttattaaagagtggttgggtgaacgcatgaatgcatgagagagtgaatgaatgagtaaacaaattagcaaatgtattaacgatttaaagaattgagtggatcaataagtcaggcctcagggcctttgcagtagttgttgcctctgcctggaattctcttttccaagagacctcatggcttaatccctcaccacctgaggtctctaatcaaatgtcacttttttggcaaagccttctctgagccttccatttaaaattgcagccttggccaggcatggtggtttacactgtaatctcagcactttggaagcctgaggcaggaggatcacttgaggccaggagttcaagaccagcctgggcaacacagcaagaccctgtctctaccaaaaaaaattaaaattaggccgggtccagtggtgcacgcctgtaattccagcactttggaagatcgaggtgggaggattgcctgagctcaagagattgagaccaccctgggcaacctagtgagaccttgtctttactgaaacttttttttttttttttaatttaaagattggcagggtgcaggccaggcgcagtggctcacgcctgtaatcccagcactttgggaggccgaggcgggtggatcacgaggtcaggagttcgagaccagcacagccaagatggtgaaaccctgtctgtactaaaaatacaaaaattagccgggcatggtggcaggtacctgtaatcccagctgctcgggaggctgaggcagagaattgcttgaacctgaggcggaggttgcagtgaatcaagattgctccactgcactccagcctgggcgaaagagcgagactccgtctcaaaaaaaaaaaaaaaaaaaaaaagattggcagggtgcagtggcacacacctgtaatcccagcactttgggaggccgaaggggagtggatcacctgaggtcaggagttggagaccagcctagccaacatagcgaaaccctgtctctactaaaaatacaaaaattaaccaggcatttggcttgtacctgtaatcccagctagttgggaggctgaggcaccaaccacaataacttgaacccaggaggcggcagttgcagtgggcagatctcacgccattgcactccagcctgggcaacaagagcaaaactccatctcaaaaaaaaaaaagaaaaaaaaatttaaagattaactgagtatggttgtgcatgcctgtagtcctggctgctcaggaggctgaggtgggaggattgcttgagcccaggagttcagggttacagtgaaccatggttgtgccattgcactccagcctggcaatggagcaaggccttatctcttaaaaaataaaaataaaaataggccagtcacagtggcttacacctttaatgcccagcactttgggaggccaaggcaggaggattgctggagccctggagttcgagaccagcctgagtaacatgtcaataccctgtctctacaaaaaatttaaaaattacacaggcatggtggtatatgcctgtggtcctagctacacgggaggctgagatgggaggatcgctcaagcccaggcggtcaaggctgcagtgagctgtgattgcgccctgcactccagcctgggtgaccgagcaagaccctgtctcgaaaataaaataaaattgcagcctcctccacctcttccctcctccttccctgtttatttttccgcataactccaggaaacacctaacacattatgttttcggtaattatgttgctaattgtttgtgtcccctactgaaatgtcaacttttgctcactgtggtttctctagtgcccagaacagtgcccagaatatagtcagtgcccagtaaatgtgagctgagtgagtgactaagcccccagtcccttcccacactcccatctctgaactaaccaatctctcctttcctcaggctgcatagagcctggacctgggcactggggtgagctgagccggacaccagtcccatctaaaccccaggacaaagtggaagcagctgaggcaacaccagtggccctggacagtgacacctccggggctgaaaatgcagcagtgagtgctatgctgcacgctgtagccgccagccgcctgcctgtttgcagccagcagcagggtgaacccgacttgacagagcatgagaaagtggccatcctggcccagctgtaccacgagaagccactggtgttcctggagcgcttccgcacaggcctccgtgaggagcatctggcctgctttggccacgtgcgtggcgaccaccgtgcagacttctactgtgctgaggtggcccggcagggcactgcccggccccgcaccctgcgtacccgcctgcgtaaccggcgctatgctgccctgcgagagctgatccaaggtgtgggggccagatgggcgacagtgggcacatatggggagggaggggagactgaggcagagggaattagagaaaagaatacaagagcagagacagagatcctgggagagaagttctgagacagagacagggacacaggaagagactgagacagaaatgtaaagtaagggggagagatagacaggggtccagggaagagaatgggacagacaatgagaatagatcagaatttagtagatgtyagaagtggcatttcagattggtaggctgaggacacagtacacagtgctgtgataattggtcatacctaaggaacaaaacatgagatccctacctcataccatatacagaggcatcaggggaaaccaaaaggagtatgtacatgaccttggggacacagaagccttctgaacaagacacackgtgaaaaccatgaaggaaaaaaaagatagctttttgaccatgacataattaaaagcatccttgtgaccacaacaccagaaccaaagttaaaagatgagagtgaatgaagcagagtgagttaagttgccgttagggagaaggcacaagttatagagaggttcacagagaaagagagagaggctgggcatgatggcttatgcctgtaatcccagcactttgggaggtcaaggtgggtagattacttgagctcatgagttcaagaccagcctgggcaacatggcgaaatgctgtctctacaaaaaatacaaaaattagctgggtgtggtggcrccctagctactcagaaggctgaggtgggagaattgcttgagcctgggaggtggaagttgtgtgagctgagatcccaccactaagctctagcctgggcgataaagccagatcttgtctcaaaaaaaaaaaaaaaaaacacagatgtggaaatgaggatgaaaacagaaggaagatgggccgggcacagtcactcaagccggtgatcccagcactttgggagggcgaggtgggggtggacctgaggtcaggagttccagagcagcctggccaacatggtgaaaccccatctctactaaaaatacaaaaaaattagccacatgtggtggcaggcaactgtaatctcagttacttgggaggctgagggaggagaattacatgaatctgggaggtggaggttgccaaaaaaaaaaaaaaaagaagaaagatgaatgaggtgggggtaggtgacagaaactgaaaaaagcaggaaagatagaaagatggagataaaggaagagatggagagagatccagagccggggtgggtgataatccaagttggggagaaggagggatagaaactgaatctgctagaggctgggcacagtggctcagacctgtaatcccagcactttgggaggccgaggcaggcaaatcacttgagataaggagttcaagaccagcctggccaacatggtgaaascccggctctactaaaaatacaaaaaaaattagccaggcactgtggcaggtgcctataatcccagctactcaggaggctgaggcaggagaatcacttgaacccgggaggcggaggttgcagttagagttaatcgagatcacaccactacactccagcctgggcaacagagcgagactccatctcaaaaaactgagtctgctagaggatgccacaaacagctgggggtaagattgctggcaggagtggggaagctgagcaggacagggacagtcacagcctatggtgctrcagaggccaggagtccgagcagtttctttgccctggactctgaagacacggctaggaccagtggaggggagggaccagggcaggtttaactgttatttgagggacagagtcactcgtgcagaaacaggcagccaggggtgatgcagggaactcaagttttggggtagtggggaagccaggcccacctgaggggttgctgcatagaggagcactcgagagaggatggatctagggccttccaccaccaggaggctttcccagggatacacgggcagatgccccacctgacctgatcccttgcacacacatgccaaatccacgtggatgtacacacatacacgccccacagtgaaggcgtgtccactgccagccagactagggccccacaaacaggcacacaacctagagacacacaacytctgctgcattgtcctgcatgctgacacccagacagacaggtgtctgtgggcatatgctgggcctcacaggacatgtgtgtgtacataggccatgyacacgtccatgggcaggagcttgtgcatcgtgcctggacacagttgtacacgagctccagaccgtcagagcctcagaggccaggatgtagccaggtctgcccatgcacacacatgcttggatgcatgaatacatgaatacacaggaagatagaggctgggccacatacacacactcgggtgcctgcacgagtaatcacatgcacgtgacctcaggtgcctgcatgagtgcttgcgcacacagcttcaggcacctgcatgagtattcacgtgcatgcctcaggcgcctgcattattcacacgcacgcctcaggcgcctgcatgagtactcacgcgcacctcaggtgcctgcatgttttcctgtgtttttgaatgtgtgcatacacacacttggactgtgtatgcacatcatcccacaagcatgatcacacacatacccacatggacactatctgctcagtcgctcaccccatgcccaccctgtctctcctctgtgcagggggcgagtacttcagtgatgagcagatgcggttccgggcccccctgctatatgagcagtacatcgggcagtatctcacccaggaggagctcagtgcccgcaccccaacccaccagccccccaagcccgggtcycccgggagacctgcttgcccgctctccaacttgctgctccagtcctacgaggagcgggagctacagcagcgtctgctccaacagcaggaggaggaggaggcctgcttggaggaagaggaagaggaggaggacagtgacgaggaaggtgagggccagtagcaggragaccccagattccagacaccccagccctaggcctgtctgtctccacttcatggcagcaggctgggcccccaacctgcaaaagccgacattgcgtccctcccctgcccagcctgactctctgtgtatgcccttccaaccgctgcagcatccccatcccccactctgaggcaccaaatgaaccctcgcctccaggtctggacaggctgttccctccgccaggaatgcctctcctcccacccttcmggtctcagatcctgacccgaggatacagtctccagagcactatatggtcatgtgttttatgygtgtccctggagggcagggaccagggccatctctgtcactagtgtgttcccagagccacccagcgcaaggctgggcacaggagcagcagctctctgtggactctgtgctcagtgcctgcccgagtgcacccgcattcacaccccctctcctctccctctgcagaccagaggtcaggcaaggactcggaggcctgggttcccgactcggaggagaggctgatcctgcgagaggagttcaccagccgcatgcaccagcgcttcctagatggcaaggacggggactttgactacaggtgctcctgtgcctccacctccccatcccccagcccagcatcccacggcctttggtcacatgcagagcccttaacaagctgtgggggtctccctttgtggagctacaaggccccaaaacagttccaggatgtggggttgaacagccaaaggaagaggctgggtgacctcggactagccttgtccatctcagaccctcagtctcctcacctctaaggcaggggrtggacagggatgacatatagctcagtatcaatgaaaccctgaaacacttccctcctggcaatggcagaggctactaccccaagccccccaagtctccctaggaagcccaacctcttccgcttcaccttggacctcctcatgctgcaggaagtaacccctggcaaagttcatgcccggcatggaggggcctgcactggctgcccccacagttacagttgttcatttctccagtagcaccccagggctgagacacgtgggccacctgctttggaaaaggacccaggagagtgatgtgtcagtcaaagattggttttgtcatttaaggtagctttgccttgtggtcccaaacactgggcccagcagcagaggaccctccttggtttcacatccagccccgatgacatgtgaaatgtgtgaccacacataagcggaccctacgtccgtcctgaggtgggctcatcaggaaagtgggaattgtgattgcccctgccgtggggcccagccatggtcaccagagcctcytcccattctgggatccctggctcttgaatggaatctggctgctccacttccagccaggcaggcctgctcagagccccagttcctgcacgcaaagtggtgagcagagggcctggaccatggggaccctcattcagcaggcatcactgctgttcccaagccagggcccaggaggaaattgggggtggcagggaccacagtgtgttgcctcgggagggcagcagtggccccgacktgtcccccatccgtgcattcagttggcatgtgctgagcatctgtgatgtccacaggctctggggataaggcggggaccaaaaccaacgaaaggcttccctgcctgaaaaggggtcccactctagtgaggaagatctagaattttctagcacttcatggtgatggggccatgaggaaaagtgaagcagtgggaggggagtgacagggtggctagggaaggcctctctgaggggctgacagcaaaggcctgcaggaagtgggaggagcattcctggcagaggccatagtaggtgccagagcccccagcagcaccaaggggcagaaggggctggagcagtcgcaaggggtcgcaagggggtaggagatctctgagtggccaaatcaagctaggcttggcaacccaagtgcgtgctgctgggtttacttgctgccttagggcatgggcagctgtcctgcctgtggtcagctctggctaatcccggcctctatccactggagggcagtagcaagcccccagtgatgacgtcaaaatgtcaaaatgccgtgggggcaaaattacccccaagtggttctttgttgagagccactgcctgcttgagaatgtaagcccatgtgtcgccacattttacagctttttaagaaaaactagagctttggggttttttttagacagggtctcctttgtcacccaggctggaatgtggtggtttgatcatagctcaccgcagccttgacctcctggcctgaagtgagcctcccgcctcagccaactgagtaagctgggactacaggtgctcaccaccacgcctggctactttttcaatttttttgtagagacagggtctccctttgttgcccagggctccaactgctgggctcaagccatcttcctgccttggcctcccatagtgctgggattgcaggcatgagccaccatgcccagcccagagtttttgtgcaaactctgatttggaaaatgttcccttgagttttaaaccctgagagttttaaacactatctcccttgggagggtcagctctgacggctgccagcacatggcctttgacatcagggtgccccaggcctttgacctgggcatccgagggtcccagggagacccagtccttgacagcctcctcctcctgcagcacagtagacgacaaccccgacttckacaacctcgacatcgtggcacgggatgaggaggagaggtactttgatgaggaagaacctgaggatgcgcccagcccagagctggatggggactgatggccgccacccttcccaccgcctgccccatccccatccccaacaaggcagctgattccaggcctgctcagtgaccctttctctagggggacatcagggcagtgccccacaacccacacacaccaccatctcactgggtstagtctcatctcagacaacccccacccccactgtttctsgggttccctttctcatctctcccaccctgtctcctgcctctgtctttcttggtgtctgtctgggcttctttctgtctctttctgtctttctgtctctctccctacccccgctccctctttccagtgctctggctggctgtctctccctttctccccctctctctctgccttaggctctgtctccaccgcagggcccaaggtgaaagtcctccccttgccggaggccagctggcagggcctttcgtggctggaagtggccagtttggttccggtgctgacccctaggccccagcgcagctgcctcccgtgctgtctgtctccccctctctgtttatgtctgcgctgtgtctcacactcagagcctccttgcttctgttaggttcccatctctccttctgcctcactctgggcctcttctttctacttgtacatttccacctctctaggcctctgctctcactgtccctctctgtctgtctctcagcctttatctctgggttttgatccccsactccaggctctgggccccttcttcccccttccctcaaacctggctgctataggcagcagaaccctgaccactgagtaatacagccccaggggagggaggagaccccaggcagggaggatgggggcagctctcttctctccccaggacccaggctgtggatcacggggcctgccagcttgagtgtagagggaggggggactctacccttctcagccccaccagcccccctctgcccaaccacaattttcccttcctccgccttcctctcccwctcctgtttacactccccaaatgcrcacaggctgttatcatgggtcctgagtcatcccacacacagcctgccccagcgtccctgcccccagctggccgcagggcccgccccatggagccccctgccgccctgggctaatgggagccagatggccgcctggtgactcagccaccgggcctgtgggaacccaggcgtcccgccttcccatgcccccacacccggctcctgctcccccagcagacacacacaggagggcctggccactgttgagggggcacacagggcaagggtcaccaagtcggggcctagggactcctcatgcctctgagatggaatggtggtatcctgccgtggccaagcctgaaggaccctcaaaactgcctcctggagtccacggttcctgacctccgagcctcagctatgccctctgggtcaaccagaattagagccagacagggaaagtgagagctggatggaggcagacaagatgctcagagcgactattaaagaacgaaagcctctgctacggagcgcttctgtcctctgtcaggcccgagcgaagtgcctgacaccgggttggatcctcagatggccccatgaactagtgaagtgggtcaaaggaggcctggaaagatgttgcttcctcaaggccactcggccatcagaggcagaaatgaaacaggaacccaggcctagaatcacaaaggtcctagaaaccacttggctgtctggcctctcaggtgtcagggccatccagagtgagacagcattggagggacaagtgtgcatgcagatgtcctcagacgggaaggtttgagaagggtcagatggtaggcgggcctaacaagggctccstgctagccactgtcccgcacacagacaggatcaggtcatcttgatatggagatcagtccccaaatcactgaattgtcccagcagtgctatgccctaggtactaccaatatcactcctctatttcccagaggaggaagcagcagctagactccaggaccttggggtcatayctctcagaaagccaagagtgcaggatgagagctgtctgtctcttacctgcctgtatttgtgccccatttttaaagagcagagggcctgggccacaggaaaggtatcagcccttggtgataggcacattttttaccartctatcatttggtcattaaatttgtttacaatatactttgctatacgtaaatttgttgtgtaggtttttaaaaagcgatgagagacacagaaattgagtcagaattagggttagtcagatggtcaagacgtgagcatctagctgacagacagaggtggagccagtcccagggacagggattagatggggagacaggaagagaggtggagacagagtggggtagggatgacgggagacacaccccctggtcactgcctctgagacctgggggtggtgggccccagggcgggtgcctcccatccccctcccagttctcccggggtcggggtaggtggaaaggctgagtcagggagggcgggccccgctgggagacaacccctaggtgggcatccggcccccacccccgtgtctcctgtccgtcctggccctggcctggctcgctggcctggccgacaccccgccccccacgtctgacacctccatgcgtcctgccaaagcaagctgcctccctgcactcttccccctccagctccagtcactctgtccctctgtcccccgtcccttctccctgcttctgtgcgtttctttccagccctctgccttcctccctcaccgccactgctctgtcttctcgttctgtctccacacctctggctgtcggtgtctccccgtgactttccgtctcccctctctctcctcccttgtttttcccatgcctctccctccctccctccctccctctcctccccaccttttccactccgtgtccccagccattctccatctctgttctcagctcctgtcacctcgtttccccatccctttctctgctggagtctccctctggggggctctgtcctctcctcactttgccctttccctctcgctgctgtgtgtcttggcccgccccccgtgccccccatctcctctgtctcccacactctgggaagcccggctgggatatccaggttggagcctcactggcggccactggaaacccagaatgaggggtcatcgcctctcgcccacccagaaagggcgcaggagggggcagcaaggttgcggggcctgtctggccagaaggaaatgtctgtgctgtggcctggtcacccccgcccccaggacctgctgggctgctgccgcccccggccggggctgaggccgagtaaacacagcaaacacagccgccggcagcctgggatatttataccgaggctgggcgtgggtccagtgcccaccacagcccctgccctgccctgccttgcctgctgccacagccagctccgagccagcgtggcaccagccggcaaggggacgcgccgcagacacagcctgcgctgggtatggaggccaacaggcactggccgctcatgatgcaggcggcttcatggacgcaccctgtccccctcccctgaaaacaccagcacacaatgtggacccacactcgcagctgctcacaaacacacatccacccctgctgagaacgcaaaatcccctcaacgatgatgcaaaacagacccacacaactccacacactgcagtcaccagcctacatgtgggaacacagcatgcagacaccaccttagcacctgctcacagcacccacaggctgggaacaccagtccctgagatggacacacagccccgaagtacagccctccctcacacagacaaacactgagaaccacaggaagcatgctggatgcacaccacgtagacaaacatgctcagaataccagcgacacatgcactgatcacagtgcaacccagaaacaactcaactcatctgcctcatatgtaagaaacacacacggccgggcgcggtggctcatgcctgtgtctcagcactttgggagaccaaggtgggtggattacaaggtcaggagttcgagaccagcctggccaacatggtgaaatcccatctctactaaaaatacaaaaattagacgggtgtggtggtgggtgcctgtaatcccatctactcgggaggctgaggcaggagaatcgcttgagcctgggaggcggagcttgcagtgagacaagatcgcgccattgcactccagcccaggcgacagagcaagaccccgtcttacacatatacacacacactcactcccctctcctggagaaacaccattcccacagatgattaacatatgcagaaaacaccacatttcaagtcaaacttacacttaaaaatgcacaaatttacactcagaagaacagtgaagatgttgagaaaaatatcagacacacaatatgccccagatacatggccgacttgcagaatcaaacagtgccagagcataaaacccacagaaaatacaacagcttgcccagcagaaatacaaaatgcagacgcacaccccagaaatgcagcgcagccacaaacacacggagctaacacgtgctggggacacacacagacaagaccatccataccaaacagcacacaggcccccagaacacccatgccagacgcagctcacgccacaaagcttggaatcacgcacacaataagttcctgaacacacaaatccgaatccacactggaacctcaaatactctgcatgtccagagactaagggggaaggggctttctctcacccaccaatctccccactcccccttgctgacccgggtcccaggcccgtcttgggggcgggggagggggcaggaaggcctgagctggcctcccccagcagcttcctgccccacgggggctggacaggaagctggggctccagccggaacccaggctccccccacgacttccctctgtggccccgggccgcctgcagaggcaggggcggggcagggggaggaagcggggagccccaaaccccctgccctgcccctgcggtcggccacaggcgggggcagacttgtcccgacggggctgagccacccatcgggcctgggtgccagggtggcagggcaggggcagtgcgcacgcggccagaggaaggtgctgagcccacagtttcccctccccgccctgtggggctgtgccagctcagccggcagccctgggcaggtgggcggggtgtgtcatgagggcgtgttgggcaggccgaccacaccgcgaatgtgcagccagcacttgtcctcaggccgaggcacgagctggggctgggcatgtgagggccgcgtctgccaccctgggggtgtgtctgctccgtctgggaccctgggtgtgacagtgtgtctgggcgtgacgtgacggggtcgctgcaatctgtggggccctgtgggactccccaggctggaattgtgcgtgtgtggcggagggtgtgggatgtcagactgagtgggtaagaccgacctgctgtctgtgaggttgtgacgtgtcagacctctgtgtggggtgtgtctggtgggactgtgacaggtccgactgtggacatgcaccctggacctgtttgtgactgtgaacccatggaggaggaggtggctgttgagggatccatttcctgtccgggctctgatgccgtgatgcgtgtgcgtgcatgacactgtttgaatcagtgtctggtgtgcggtggttgcgaccatgaccctgtggaatatatttgtatatgactgtgttgtgccaggtccctattgaagtctctgctcgtgttgtgtcccagtgaggctccgaggctgggtggtgtttacgtgatgggctgacactttctctatttgtatctgtgtatatgtgggctgcagctgctgccaaatgacacagcccatgtgttacgggccctgcaggagtctctgtgtgtccacggcggctctgagaggtgaatatttgtgtagtgtggggcaccgtccgtgtttcccgccgtgtgagtgtgtctgcatgtgtacacgcaccacatcctcatagggctgcagcgattacagccgagtcactgtgtcctagcttgtgactctgcctcttggggccagacctcagcatctctatacctatccatttgttggcatgtccttgcatagtgaactcctgcctccccactcctccctcagccctgtgtgctttgggacctgaggccagaggagtaaccacatttctacccctatgctgagctgggagggccccaggtccctggcacccagacccagtgctgccaacagctctcatgcccacaggcaaaggaaccgcagcactcatactgtccttcctcccaggacaatcactgggtgtggggaagtgaaacctaggagaaagagcagaaactgagaggcaggagaaagaggaagcaggagagaattcacaagcaggaccatagcagatgggaagaaatggagacagcagagggagacccacctgtggctgctgccatttcttgcctggacagctggtctgtctgtgctcaccctcaccctgacacttctgtccactcccaaccatgagcaagacggcggaccctctgagcgcctaggtcaaaccctgccatggctcctgtcttccttgagtgcaagttctttttttttttttttttgagatggagtctcactctgttgcccaggctggagtgcagtggtgcgactttagctcactgcaacctctgcctcccctgttcatgcgattctcctgcctcaggcccctgagtagctgggactacaggtgtgcaccacaatgccagactaatttttttttgtattttttatttttatttatttatttgagatggagtctcactctgtctcccaggctggagtgaagtggcgtgatctcggctcactgcaacctccacctcccaggttcaagcgattctcctgcctcagcctcctgagtagctgagattacaggcgtgcgccaccatggctaatttttgtatttttagtagagactgggtttcaccatgttggtcaggctggtctcaaactcctgacctcgtgatctgcccgccttggcctcccaaagtgctgggattacaggcgtgagccactgcgcccagcctttttttgtattttagtagagacagggtttcaccatgtggtccaggctggtctcaaactcctgacctcaagtgatccccctgcctcagcctcccaaagtgctgggattgcaggtgtgagccaccgtgcccagtctttttttttttttttttttaaagatgcagtcttggctgggtgcgctggctcatgcttgtaatctcagcattttgggaggccgaggcgggcggatcacctcaggtcagaagttcgagaccagcctgaacaacatggtgaaacttcgtctctactaaaaaaaaatacaaaattagccgagcatggtggcgcatgcctgtaatcccagctacccagctacttgggaggctgaggcaggagaatcgcttaaacccgggaggcagaggttgtggtgagccaagatctcgacattgcactccagcctgggcaacaagagtgaaaatccgtctcaaaaaaaaaacataaaaaaaagatggagtcttgctttgtcacccaggctggcatacagtggcacagtcagggctcactgcagccttgacctcccaggatcaagtgatcctcccaccttagcctccagagtagctgggaccacaggtgtacattttttaaaagtgttttgtagagatagggtctcactatgttacccaggctggtctcaaatgcctggattcaagtaatcctcccatctctgcctcccaaaagtgctaggattacaggcgtgagccaccccgcctggcctgaactactatcttttattgtcttcttcactatcccccactaaagcaggttcctggtgggcaggaactcctcccttaacctctctgggcttgtttcctcacctttaaaatgggtgttatcagagtccctgcatctcagagtgttgctatggtgactgaatgagttcattaatgtaaggcacttcaacagtgcccaaggtgctcaataaatagatctaactacagtagtgttccccactggtcccctgtgccttgatgccgggcaaaggaatagtgcagacaggcaggaggaggcagagagggagagagagggagtgggagtgggggaacgtcagggatggagacccca

SEQ ID NO: 17947 - DNA, 21442 bp, Homo sapiens
gagatcatgccattgcactccagcatgggcagcaagagtgaaactccatctcaaaaaataaataaataaataaagtaaaataaatacattgaaagaaaataggatggtgattaccaggagctgcagaagaggggggaataggggagttgttttgtttcaaaaatgtgtttactttgcaaaaattttagttttgcaacatgaaaatggttgtggagattggttgcacaatgtaaatgtacttaacactattgaacaatacagttttaaacagttaagatggtaaatgtgtattttaccacaattaaaaggcttatttatttatttttatttatttattttgagacagagtctcgctctgtcacccaggctggagtgcaatggtgcaatctcggctcactgcaacctccacctcctgggttcaagtgattctcgtgcctcagcctcccgagtagctgggactacaggcgctcgccaccacgttcagctgattttttttgtagttttaggagggatggggtttcaccatgttggccaggcttgtctcgaactcctgacctcaagtgatctgcctgcctcggcctcccaaagtgctgggaatccaggcatgagccactgcaccgggcctttttttttttttttttagaggtgcagtcttactttgttgcccaggctggagtgcagggtgccatcatagctcactgcagcctggacttcctgcactcaaggcatcctccggcttcagcctccaaagtagccgggatggccaggcgcggccatacatggcaaaaccccatctctactaattagctgggcgtggcggcaggtgccttcaatcccagctacttgggaggctgaggcaggagaatcacttgaacccaggaggcagaggttgtggtgaggagagatcacaccattgcactccagcctgggcaacaagagtgaaactctgtctcaaaacaacaacaacaacaaaaatgaagtagccgggaccgccggctgtgtgccatacttggcttaaaagcattttgtttttgagacagggtctcactcagttgcccaggctggagtgcagtggcacaatcacagctcactgtagcctccaactctcaacctaagcgatcctcccacctccgccaccagagtagctgggactacaggggcatgccaccacacccagctaattttttgtattttttgtagtgatggggtttcatcatgttgtccaggctgctctcaaactcctggattcaagcaatctgcccgccttggcctcacaaagtgctgggattacaggtgtgagccactgtgcccagccccatattctattggttagaagcaaattacaaaaactagccatactgaagggaaggagaattaggctccacttactgaaagggggctgcccaagcatttgtggatatattttaaaacagcttcaggccgggcacagtggctcacacctgtaatcccagcactttgggaggctgagtcaggtggatcacttgaggtcaggagttcaagaccagcctggccaacatggtgaaaccccgtctctactaaaaatacaaaaattacccgggtgtggtggcacatgcctgtaatcccagctacttgggaggctgaggcaggagaattgcttgagcctgggaggcagaagttgctgtgagccctggcccacagaacgagactctgtctcaaaaaaacccaataaccaccccccccaaaaaaaaggtgacaggttttcactctgtcacccaggctgaagtaccttggcatgatcacagctcactgcagcctcaaactcctgggctcaagggatcctcctgcctcagcctcctaagtagatgggactgcagacatgtgtcaccatgccctgctattttttttttaaacgttttcgtagaaatgagggtctcactacgttgcctagtctggtccagaactcctggcctcaagtgatcctgttgctgtggcctctcaatgtgctgggattacagacagccatgaaccaccaggcctggccaactttcgataatgtggttagataattcaaacttaaagctgttggaactttaaattattccaagccttgagaggaatgttgctatgtagcctgagtcacgtagcatgcagttacaacttctgctttttcctgtaaatgattaagaatgaccaagcagtgccagagataagatcacctcagaacattactcctaggccgggtgttgtggcctcacatctgtaaccccagcactttgggaggcagaggtggatcacttgagcccaggagtttgagacaagcctgggcaacagagtgagaccatgtctctacagaaaaaattattgaaaaattagctgggcatggtggcacacgcctgtagtcccagctactggggaggcttaggcaggaggcttgagcctgggcgttcgaggctgcagtgagctgtgattgtgccactgcactccagcctgggtaacagagcaagatctgtttgttgttgttttgttttgtttttgagactttgtctcactcttgtcccccaggatggagtgcaatggcacgatctcagatcactgcaacctccgcctcccaggttcaagtgattctcctgcctcagcctcccgagtacttgggattacaggcgcccgccgccatgcccagctaatttttgtatttttagtagacacgaggtttcatcatgttggccaggctggtcttgaacccctgacctcgtgatttgcccgcctcaacctcccaaagtgctgggattacaggcgtgagccaccgcgcccagccccagagcaagatcttatctcaagaaaaaagaaaggagaaagaaagaaagaaagagtactcctcctcctatcagaatgttaacgcaatcttccctgcagcatagcaagatgtactaatgaaactgttgtaacatatgtactggtcctgtagcctggaataaactctatagttaatcatattttcctttcttttcttttttttcttttttgagagtagaagtctggctctgtcgcccaggctgaagtgcggtggcgcgatctcggctcactgcaactgctgcctcccaggttcaagtgatgctcctgcctcagcttcccaaatagctgacaccacaggcatgtgccaccacacccatctagttttggtattttttagtagagacagggtttcgctatatgttggccaggctggtctcgaactcctgacctcagggtatccactctccttggcctcccaaagtgctgggattacgggcatgaaccaccgaatccggcctcaatcatattttctgaatctcattatttatagttgacgataatttattttcttttatttaacatgtatacatgggagccttcagaatgaagacctcagccgggagcagtggctcatgcctgtaatctcagcactttgggaggccaaggtgggcagatcacctgaggtcaggagtttgagacctgcctggccaacatggcgaaaccccgtctctactaaaaatacaaaaatgaggcaggaggtgccagccaggttgtggagagccttgtcatgcatgataagactttggcttttaccctgagtgaaatggggaccactggacgggtctgagcagatgggacctgacttaggtgttcacagggttccagctgcatgtggggtgcaaactagaggggttggcaaaggggaccccagagacaaggtccctgtcatagtccaggtgatagatgaacttggacagatcaaggtgcagggcgacaaagaggtgagaagtgggatttagggtgtatttcaaaagtagaggcagtaagatttcctgatggacaaaatgggggcttgagaaaagagaatgcaaggctggtgccaccactaggggaccaggggccccaagagctgaaaggttagagctgtctacctcacccacacagcatccagaaataaataaataaataaatacattttccccagctccagcttaaaggacagaaagatcatttaaaagtgaaacctctgccaggtgcagaggctcactccagcctgggcaacagagcaagattctgtctcaaaaaaaaaaaaaaaaaaaaagtaaataaataaaataaaaaagaaaatacaaaaagtagctgggcccaggcgaggtggctcatgcctgtaatcccagcactttgggaggctgaggcagaaggatcacatgaggccaggagttcgagaccagcctgaccaacatggtggaactccatctctactaaaagcacaaacattagctagatatagtggtgggtgcctgcaatcccagctactaaggaggctgagacagaagaattgcttgaacctgggaggcggaggttgtggtgagcagagatcatgccactgcactccagcctgggcgacagagggagactctgtcaaaaaaaaaaaaaaaaaaaaaacccggccggtcacggtggctaacgcctgtaatcccagcattttgggaggctgaggcgggtggaccacctgaggtcaggagtttgagaccggtctggccaatatggtgaaaacccgtctctactaaaaatacaaaaattagctgggtgtggtggtgcacgcctgtagtcccagctactcgggaggctgaggcaggagaatctcttgaacccgggaggcagagattgcagtgagctgggatcgcaccactgcactccagcctggatgacagggggagacgccatctcaaaaagtaaaaaaccaaaattataacgagggtacaacatttcaataggataacatttatattaaacaattcaacggaatacttcactagttgatatatgcattattaatggggtctccctatattcgaacttctggcctcaagagctcttcccgcctcagccttccaaagggctgggattacagtcatgagccaccgcgcctagccaatggtagcttgtaaatactttgtatctattggcctggctgggtggctcacgcctgtaatcccggcagtttgggagggagaactgggaggatagctagagcccaggaggtcaagacaagactgggcaacatagcaacatagcaggactccatctcttaaaaaaaaaaaaaagaattagccagccgtggtggtgcatgtctgtgataccagctacatgggaggctgaggtaggaggatcccttgaacccaggagttaagaggctgcaatgagctgtgatcgagccaccgtactccagcctgggtgacagagtgagacccttttaaggagccttgatgggacctgatgactggcttgatgtgggaaatgatggcatctaggatggcatccagggacaacatctccatttcttgattgataaatcaatcaataggaaagaggattttctgcaaataagggaatcttagttcctcatttctcttcgctaccccaaccgctccttgctcagaatcaagcagtaacagtgaacttggtagtagctccgagaaggaagttggacttatccaacttccttccttccttgtccttgagaaacctaggggaactctaaaacggaagcagaacccactccccaacttctccactctctgaatgaggagtgatttttttgctttgttttccagttacaaggccggggatgtacacgaggtcctggaaggaattcccccttggtcctggttcaatctctgatttgtgatcccggaccacagagagctcttcggtggggtaggcgcagcacggagcagttagggatttgcttttttggtaaagaaggtatctgggagaaactgcactcaaacttcctcagccacactcaacatggcagcttcctagccacgcccaaaatggcggaaccctttgccgtagctggagagacgctattttcccaaaatggagcggaggaggaaaatgtccatcacagcttcaccccgccccccgcagacggctagcaccaattagtagcgcgcagagcgagtacaaagctaggggaggagcctgctgttgccccagcaacaaccacggaaaccaagacgagcgcggtcgcggaagtatcrcggcttacatatctcgcagccaggcgggtcctgggagaggcgcgagccaggcctggtcggcgcccgcggaraaaagaagcagtcaagcccatgaactacaaccccggttgccgctttctcctctcctaaccgttaagtgcgctaaggtaggaatgacgcatgcgctgcgcttagaggcggggttaagtcggacctgaactcataacgcatgcgccttatggagcttgctgggggagggaagcggggtggctgrcgtgacgcggaaggcgggtcttttgcgctcgtgggcggagccatagccccttcgggcggggctttccgccgacctgaacccgaaaaggttattttggacttcccagagttaaatgctggttccccagacaagggtccccccattttttccaggctttcatgggttggcaattaggatctgtggtcaagacctcagcctcaggggtgtgacgaagctagcttggaatcctagtactaccctttacttgctgggcctcagtttccccccytgtcaaatggagataatacasttacctcacagggttgtgattatatttttcccctcccagggccatggctgaggtgcacgtgatcgggcagatcatrggggccagcggtttctcggaaagtagcctcttctgcaagtggggcattcacacaggtattcccccaagcctggttcatttccacaccaagacccctagcctagaggctacatgctccttcctccaccccttaacgcagactcttaacctcatttccatcagttctcagtactccaggcccagcccacaccctgtccacatgagtctcaagctcccatctttgtgtgtgtgaggggtgggatacagacagggtctctctctgcgcccgggctggagtaaggtggtgtgatcatagctcagtgcagcctcgaactctcgggctctagtgatcctcccgcctcagcctcctgagaagctgggactacagacacgcaccaccaaatctggctaattttttttattttttgtagagacagggtctcgctatgttgcccaggctggtctcgaactcctgcgctcaaacaggccacccacttcagcctctcaaagtgctaggattaaaaacgtgagccgccacgtcccaggaaagtaattttgttcatgcttccccaactgaggccctatagagtcatggtatagtgtaatggttagggtcatgggctgccagatctgcatttaaatattaactcccccacctattaattggagacctttggactcgaccactttgagcctcagtttccttgtttcaaagtgaagctaatagtagctaagaagcagcacaggtttgaggttaagagcacagactgcctgggttcaaaaccagttattgcttgttaaggcacccttgggctgattatgtgaacttgggcacttctcttcacctcgacttccttgtttgtacaatgagagtcatagaaatatttacctgttgaagttgtcatgagtactaaacgagtatcaacagcacttagaataggaatagggctggaataggaagtgctcattcagtgtttgcctggcttatacaagactttgatggggtcttgtttgtaaagcctggggtatgttgttgcgtggcacagatgaatgtctatgaaacagatgtggccatttggcattatcatgtcttcaggcctgagtcctagtccctttttttttttttttttttttttttgagactcgttctgtttcccaggctgtagtgcagtggtgcaatctagctcagccttccaggttcatgccattctcctgcctcagcctcctgcatagctgggactacaggcgctcgccaccatgcccggctattttttttttttttgtatttttagtagagatggggtttcactgtgttagccaggatggtctcgatctcctgaccttgtgatctgcccatctcggcctcccaaagtgctgggattacaggcgtgagccactgcgcctggcccttttttttttttttttttttttgagacagagtctcactctgtagccaagctagagtgcagtggcacgatctcggctcactgcaatctctgcctcctgggttcaagcgattctcctatgtcagcctcccgagtggctgggactacaggcacccgctaccatacccagctaatttttgtatttttagtagagatggggtttcaccatgtcggccaggctggtctcgaactcctggccttaagtgatccgcctgcgtaggccttccaaagtgctgggattacaggtgtgagccactgcgcctggcccctgggtcctttttgattctacaggtaagtgaggtggaagttgaaattcccaggaaatcggaaccctccagctgatggatgaggggcaggctctggagtcagacttggtttccaggttggaccactcaccttctctgtgaccctgggcagaggctgtcccctcttggagcctcagtttcctcatttgttcttcatagggctgttgggaaatcttgcttttaaggagcctgacgcagggcctggtgcttccctcaactcagcccagaagggagtaatgactaacctgatttttattatttcagggagttgctggggatgttgatccagccaagaatactgaggcagttggatgaaaggcttgggctctgcagttagagctgagtctgaatccagtcccatgatgggaccttggtctgctatagtcactgctatgtcaccagcatggaaaacagtgcttggcacatagcaggtgctgaataaatgttcatgaactcaccttctcagagcctgtttctttacctgttaaatggggattatattagctcccacctcctaggatcacttatttgtccaagaaacatttattgagcaccttctgtataccaagagctgggtttgtggtcttggggatccagcagtgtgcaaggtccctgttttcctgggccatacagtaggggagacagaaaataaataagcaggccaggcgcggtggctcatgcctgtaatcccagcactttgggagtccgaggcgggcagatcacctgaggtcaggagtttgagaccagcctggctaacatggtaaaaccccatttctactaaaaatacaaaaaaaattagctgggcatggcggcgtgtgcctgtaatcccagctactcgagaggctgaggcaggagaatcgcttgaacccaggaggcggaggttgcagtgagccgagatggtgccattgcactccagcttgggcaacaagagcaaaagtctgtctcaaaaaaaaataaataaaataaaataaataaacagataaacgagtgcagttgggtgtggtgactcacccctgtaatgccagcactttgggagactggagcaggaggatcacttgagcccaggagtttgagaccagcctgggcaacatagtgagacacccgtctctacaaataaataaaaaattagcaaagcatagtgctgtgtgcctgtcgtcccaactacttgggaggttgaggtgggaggattgcttgatcctgggaggtcaaggttgtagtgagctgtgattgtgccactgcactccagcctgggtgacagagggagatcttgtctccccccacccccccaaaaaaagaaaggagcaccgtgattccagacagtggtaagtgctaggatgaaaagaaatgatgtggcagggactagtgtttggtgaagagggtcagggagaacccctctgtggaagtggcacttgagctgggccctgaaggatgaaaacaaaagctagggatggggacacccaggagcagagctttctaggcagagggaacagccagtgcaaaggccctgaggtggggagtcagaagtgggacagtgaggccagagggtgatgagggagggggagagtgatgggagatgaactcagggaggggagcaagagccaggccacgtgggccatggtggagggtctgtaaactggggggtgaggaggggattaagagtcctagagggtggattaaatgaatggatgcttaaagtacttagcatagcatctgggatttagttagtactcggtgcattttctttttttcttttctttttttttttagatggaatttcgctcttgttgcccaggctggagtgcaatgggaccatcttggctcactgcaacctccgcctcctgggttcaagtgattctcctgcctcagcctcctgagtagctgggactatgggcgtgcgccaccacacccagctaatttttgtatttttttagtagagatagggtttcagaatgttggccaggatggtctcgatctcttgaccttgtgatctgcctgccttagtctcccaaagtgctgggattacagacgtggctaattttgtgggtgtgtgtgtgtgtgtttttagtagagacagagtttcaccattttggccaggctggtctcgaacccctgacctcaagtgatccacctgccttggcttcccaaagtgctaggattacagatgtgagccactgcgcccatcctaatttttgtatttttagtagagatgggatttcgccatgttggccgggctggtctcaaactcctgacctcaggtgatcagcccgcctcagcctcccaaagtgctgagattacaggcgtgagtcactgcgcctggcttgtttgttcattttttgagatggagtctcactgtgtcacaccagctggagtgcagtggtgcaatctcggctcactgcagcttctccagcgattctcgtgcctcagcctcccgagtacctgggattacaggcacctgccaccactccagactaatttttgtatttttagtagagacgaggttttgccatgttggccaggctggtcttgaactcctgaccttagatgatccacccccccctaagcctcctaaagtgctgggattagaggtgtgagccactgcgctcagccttaatttttatattatttgtagagatggggttttgccatgttggtcaggctggtcttgaactcctggactcaagggatctacctgccttggcctcccaaagtgctgagattacaggtgtgagccactgtatcctaccactcagtgcattttagctatcattatcacccctcagtaggatcgaaattgttatgtgtgtttcaggatgcgctcctggagggtacccttggccccatcttaatccttggactaggcttgwaaatatggggtgagaatcgtaataaaatgatattgaagacttatcccgtgctcactatgctcattacccattcatggattaatgggttaatggattagtgggttatcatgggagaggaagtggtggctttataaaatgagagagagagacgtgagtggcatgttagcacactagccttgggactctctgaagagttccagcaagaaggctcttactagatggggctcctccaccttggtcagtctcctataactgtgagatagaaattccttttctttataaattatccagttttggatattatgttaagagtaacagaaaacaaatgaagacaatgaggaatgcattattactcagctcattttatagatggggagaccaaggcagagaaagctaacttgcccaaggttgcagaggcaggaagaggtagtgccaggatttgaacccagatacttggttccagagtccatgcttcgtaacccctaccagtagatgccacagagaaacagtcctayagccacagcggcatccccttcccratggctgcctcccacccctctatgtcccggctctcactgcaggggcggcatggaagctcctgtcaggcgtgcgggagggccaaacgcaagtggacaccccgcagataggggacatggcttactggtcccaccccatcgacctgcacttygccaccaaaggtcttcaaggtgggtatcacacctggacccgggkccaggctgaggggagggggccagtagcctctgaggtccctggggctgggaacaccaagacctgtccctgctccccataccacgtaggtcccttttgcagccaagtctggccctggagaggctgagctaaggccttcccaggcctgctcaataggcgatcccaagtttgtatgattagggcagaggccagggtggagcaggaggtgggaaggtggggggtcagggtgggaggggaggtggcattcaagtaaagagacaaaacgagagtctccaataaagaggaagccgggaggcagggtctgagagaggcaagggctgtttctccaggaagggctcctcggcttgaaagtagagctgctgctcaaaggggaaatcagtactgggggaggagcggcatcagaaagcctttctagtagaaaatgtgggttcctggagatgagttgattctgagaaattgcctaggtaaatgtgccatatatttcaccaatataaagaacgtctacctggtacctgccctgtgtccagcctgtgttgggtgatgccagggagacattgaggatcaaggcagtgtcccttagccttgtcctcacagggttcaccgtcctatggggggacacacctctctccagacagtggcacctcagagtgggcaggactaagataggtgatttggagaggctgtgggagcccagaggaagtggctgactctgtcagggaggtcagagagggcttcctggaggagggggcttctgaactttgctgtgaagggccagcggagctaataaggcagagggatagaagaaggttctaggcagagggagctacgtggaagactcaaaggggaaagtgagccaagggcatctagtggattgagggagagcgggacggcagaggggaaaggcagaaggggacaggccatgcagggccttgagtgccaggctgaggagctgaggccatctcctgaaggcacttgggagccagagcaggtaatggacaagtgagatttcaccttttttttttggagacagagtttcactctgttgcccaggctggagtgtagtggcaagatctcagctcactgcaacctctgcctcccaggttcaagcaattctcctgcctcagcctcacgagtagctgggactacagccacgtgccaccacatctggctaatttttgccttttttttttttaatagagatggcgtttcaccaaggtggtcaggctggtctcgaactcctgacctcaggtgatccacctgcctcggcctcccaaagtgctgggattacaggcatgagccaccgcgcctggctgagatttcacttttaaataatctttctgtcttttaagctggagctggggaaaaaaaaaatctttccggtgctgtgtgggtgaggtgggcagctctaacctttcagctcttggggcctccagtcccccagtggtggcaccagccttgctttctcttttctcaagcccccattttgtccatcaggaaatcttaaactgcctctacttttgaaatatatcctaaatcccacttcttacccttttctcgcccagcaccttgatctgtccaagttcttctctcacatggactatgacaagaatcttgtctctggagtccccttccccaacccccctggtctgcaccccacatgcagctgggaccctgtgaacacctaagtcaggtcccatctctgctctgctcagaaccctccaatggtccccatctcactcagggtgaaagccatagtcttagcatgcatcacaaggctctccacaaccaggctggcacctccttcccgtctccccacctcattctgctctagccatgctgtccccaccaggcacactccgtctgggctccagccatactgtccccaccagacagtccccccccagggccttggcacttgctgttccctctggctaggagcactcttcctctagatggccacatggcctactcccttccttccttttagcatttgctcaaatgtcaccttcttaatgaagcttccttgatccccttcttgctaaagcggtatccccaccctcaccctacccagctctgttttccctcacagcaattaccaccatctratctaccctataatttgcttatttactacattcgttgtctaggatatcagcttcacgggggcaggaatttttgtctgccatccatgttcatgtctgccgtgtccccagctagctagaacagagtctagcacaggagaagggatcagcatgagatgagatggggctggatctccaagggctttgactaccagactgaggagctgaactgtgttctgaggacatgggcaaagctatggaaggagagaaagatgcttccagatgccaggtggaaggtggattagagaggggcaagaaagaaggccctgggcccaaagrgagcagggcagggacatgaggagggaaggcaggaggtgtccctgacaaggcccatgatggttacctggggactggaggagcaatgggctgccctgacatggggtcatggaggaggataacacagagaggaaattcagcagaggtctgattagaagggccttgaatgttgaagaggttggactttatactgagggcactggggagctatggaaggatccttagcaggggagtaacatggatttggaaagatcactttggctgctgtgtggggatagataagacggtgggagcctagaaaggaggctgggttggaaactctgggacagaaacccagagaggaaaagactgggcctggggtctccagtgagtatcagggagtggggaatcagcaggagtctggtccccacccatccctcctttcccctctstctcctttcctgcaggctggccccggctccatttccaggtgtggtcccaggacagctttggccgctgccagcttgcaggctatggattttgccatgtgcccagtagcccgggcacccaccagctggcctgccccacgtggcggcccctgggcagttggmgagaacagttggcacrggctttcgtgggtggtgggccgcagctgctgcatggggacaccatctacagtggggccgaccgctatcgcctgcacacagctgctggtggcaccgtgcacctggagatcggcctgctgctccgcaacttcgaccgctacggcgtggagtgctgagggactctgcctccaacrtcaccaccatccacaccccggacacccagtgatgggggaggatggcacagtggtcaagagcacagactytagagactgtcagagctgaccccagctaaggcatggcaccgcttctgtcctttctaggacctcggggtccctctgggcccagtttccctatctgtaaattggggacagtaaatgtatggggtcgcagggtgttgagtgacaggaggctgcttagccacatgggaggtgctcagtaaaggagagcaattcttacaggtgtctgcctcctgacccttccatccctcaggtgtcctgttgccccctcctcccactgacaccctccggaggcccccatgttgacagaccctcttctcctaccttgtttcccagcctgactctccttccgttctgggtccccctcctctggtcggctcccctgtgtctcatcccccggattaagccttctccgcctggtcctctttctctggtgacccacaccgcccgcaaagccacagcgcatctggatcacccgctttggtggcgcttggccgccaggaggcagcaccctgtttgcggggcggagccggggtgcccgccccctttcccccagggctgaagggacccccctcggagcccgcccacgcgagatgaggacggtggcccagcccccccatgccctccccctgggggccgcccccgctcccgccccgtgcgcttcctgggtggggccgggggcggcttcaaaaccccctgccgacccagccggtccccgccgccgccgcccttcgcgccctgggccatctccctcccacctccctccgcggagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcctcccgcaaagacttttccccagacctcgggcgcaccccctgcacgccgccttcatccccggcctgtctcctgagcccccgcgcatcctagaccctttctcctccaggagacggatctctctccgacctgccacagatcccctattcaagaccacccaccttctggtaccagatcgcgcccatctaggttatttccgtgggatactgagacacccccggtccaagcctcccctccaccactgcgcccttctccctgaggacctcagctttccctcgaggccctcctaccttttgccgggagacccccagcccctgcaggggcggggcctccccaccacaccagccctgttcgcgctctcggcagtgccggggggcgccgcctcccccatgccgccctccgggctgcggctgctgctgctgctgctaccgctgctgtggctactggtgctgacgcctggccggccggccgcgggactatccacctgcaagactatcgacatggagctggtgaagcggaagcgcatcgaggccatccgcggccagatcctgtccaagctgcggctcgccagccccccgagccagggggaggtgccgcccggcccgctgcccgaggccgtgctcgccctgtacaacagcacccgcgaccgggtggccggggagagtgcagaaccggagcccgagcctgaggccgactactacgccaaggaggtcacccgcgtgctaatggtggaaacccacaacggtgagctcggaggggcaggggagccgggaggggggcccccagggggcgccggagtgccggggccacgggtaggaagtgactggcagaagaaactggctggaggaagaggacaccccggggcaaagggaacgtgtgatggtgggaggggggtgtccgaaagaggatggcactgagccccctaccacccaggtgtctggtcttggagaggaggagatagcgaagtggaccgcttctagagtgcgacagaaacatgcggggtcgtgggggcagtcccctagagggagacaagcaatagggggagggtagaaggctccctcttccaggacgcgttgaatggggggggggtcgtggggtgccaggtgcagagaagggagcctggtgtgggagaagcgaagaccccagcatttgggaaaggagaggcgctggagaaagttgacccagagcttgggggtcctgaggtggaaagattcaagaaggacagaaaagctagatgaaggcaaccccagagggtgccaggaaagtgagagcggacccacttccagaggctgccaggaacacgcgggatgcgggggtgggggagagtcgtagaaagagaaacagaggtgcgtgtgataaatgtggggagaaagggacgggaggttattggaaggaggaggcaagcgggagaggagcggagactcgggagggcgcccgggatgcagaggtgtcctcggtgtttcacacagggacgtgagggacagagtggggagcccagcggaggaatcgagcttccagaagacctagagtcctgggtcatgggaagggctttaccgagaggggagacaggcgtgggaaaggtggtgtgagcggggaggaggagagatacccagcgccatccacgctgcgagcagcgagcccccccattccccgcaggatgcaggggaatgggctgagcggagtccagccgcaggggaagtgctgggtggggggtgactctacaagaccgaggtgagaaaaccaagctgggaggagtgagaaagccccacgtgggtgccacgcgcggggggaggagcctgcgcttccaccaaggggcaggaggaccccgctgcgctaaacgctggcagtctggaccccaaagtcccagttcctctcagggtggctggggaaaccccagcgtccggcggcctcatcctcctcccttccctttccttcccatgcccccggcgggggcggggatcgctcgcggagcccggggcgagacggggcaggtctggtccccgccctcctggctgcggcgcctcccgccctcctcaccccagctacgggcggggctcccactcagccggccccgtcggcatccatgcgaggacccaggcgtcccgcgtggttcagagccttggggaagatccctcaggtttcactgactcttgggcggtgtgggcttgcgggttccctgcccatttctgcgccagtttacagctccagcccaatgacgcgcactccgcacccaagtctcagccttaccttatcttccgtggcttcaccttcgttgtagaggttcctttaacactgacacctccaatcctcttctccccaacaaatgcacatgtgtctcgtctcgcacgtgtctccccatctgcctctttcttttcgtctccgttagtctttctgtccacgcatgggtctcctggtttttgtctctccgactattttctctccctttctatttttctcctccacggtccggttgcctcgtctccgtctctgacatctccccgcctctccctctctgcatcaccctccaacccttcctctccctcctctctgtcttcctccctatctgtcttccccagccaaggctctgcctttcctttggggtttgctgagtaacctccgggccaagaatagggcttactggggctgggtggggagggagactggggaggaggaggaggatcgaagggggccgtaggggaggggtttcctctgcctttctcaccagtctcttttcacacccccactatgggaggctggaagcagttgccccagttgatccagcagttcatggcctgttccctcatccccatccccaaacttttcctaaactagaaaataccttggctgggcgcggtggctcacgcctgtaatcccagcactttgggaggccaaggtgggtggaccacctgaggtcaggagttggagaccagcctggccaacatggtgaaacccggtctctactaaaaatacaaaaattagctgggcggggtggcgggcggcgcctgtaatcccagctacttgggaggctgaggcaggagaatcgcttgaacctgggaggcagaggttgctatgagccaagatcgcgccactgcactccagcctgggcgacagaaactccatctcaaaaaaaaaaaaaaaaaagaaaagaaaacaccttaattccttttctccccactacagccattcctacccagaatgaacttcactttccctaaccagctggggaagggagttaagggtggaaaactaataataaaaataagtagaagaatcacttaggggttaagagcacagtctctagctgggtgggtgtggtggctcatgcctgtgatctcaacatattgggaggctgaggcgtgaggatcccttgagcccaggagttccagcctgccgtgagccatggttgtgctactgcacttccgtctgggggacagagtgagaccctgtctcttgggggaagaaaaaaaaaaagcacagtctctggaatgagacagcttgagtttgaatcccagtctgcagctatgtgaccttggggcaaattacttaatctcggtgcctcagtttctcatctattaaacgggtataataatagtataaggttgtgaggtttaaatgtcttcatctttgtaaagtgctttagatagcatctggtaaatagcgctgttttgtggttttttgttgttgttgtttttgagacagagtcttactctgtcacccaggctggagtgcagtggcgcaatctcggcacactataacctctgcctctcaggttcaagcgattctcatgcctcaacctcccaagtagctgggattagagccgtccggcaccatgcctggctaatttttgtatttttagtagaaacggggtttcaccatgttggccaggctggtctcgaactcccgacctcaagtaatcaatccacctcggcctcccaaagtgctgggattacaggcgtgagccactgcgcccagccagcactcttagacgtatacatgattgagtgaccagtgtatgcagaattggtgccacatggcttgacctgggtcatctaatttcccactataatactggaatgggttctagagtcactctgtcttgtcttacacctggctcagagagaggaattcacttgcccaaggttacacagcgcttaaattaggagagtctgtgtgggaatgcagggagcttaatgttattgctgtttttcaaagaataacaggaaactgacattcagaaagagggtgttaactgcccatggtcacacagccaagaggcagcagaggcactatctgagtccaaagcctgtgcctttgatccttactctgcattttaggggctcttgcatttggggcaaggaaggccagagcaaacagagtggttccccttggtgccagccttagtcgacttgagagatgatgctacatgagagaggaatgtggttaggacctattttacagaggaggaaacaaacctagggggagaaaccacttcctcaaggtcacacagctaaaaagtatcacagtcagggctgggcgtggtggctcacacctgtaatcccagcactttgggaggccgaggcgggtggatcacgaggtcaggagatcgagaccatcctggccaacatggtgaaaccccatctctactaaaaatacaaaaattagctgggcatggtggcatgcgcctttagtcccagctgctcgggaggctgaggcaggagaattgcttgaaccctggaggcggaggttgcagtgagcagagattgcgccactgcactccaagcctgggtgacagagcgagtctccgtctcaaaaaaaaaaaaaaattcatttaaataaataaataaataaataaataaataaataaataaataaaaggtatcagagactgactccaccccagagctgtcagctccaaaactcctagagttgggagcaccagctcccctcacctctgccaaacccctgatcgcctcccttcatttctccctgctagaaatctatgacaagttcaagcag

SEQ ID NO: 17948 - DNA, 13682 bp, Homo sapiens
acgagggttggggaacaggtggttagcacttcatcctcgtctccctcccaggttagaagggcccccctctctgaagacccccactccctgggatgctacaatccaatgatggaagatggcattagctacaccaccctgcgctttcccgagatgaacataccacgaactgggtactgagggtaccaggagggtgaccctgcaccctgggagggaggcgggaggaaaagctctgtcccgcctgccctctttgtgccaggcccatgccaggcaccctgatacatgctctgcctcattcccactcggcaacaagcctctgggtaagggccagtctccagaagtggacctgctccttcaagtcagcagcacacatgcccagtccgttcttatcacaaagatcaagagctcgtgatacacacccacgcctactccctccacgcacatttgcacgagctcctactgtgagctttgggcactggggaggccacaggttttacataaggggctgaggttggggtgctgttgggggctctgggtgttgagagggaggagagttcgtgggagatgcttcatgcgtggtcgtctatctgccctgtctctcagagatgcagagtcctcagagatgcagagacctcccccggactgcgatgacacggtcacttattcagcattgcacaagcgccaagtggtaaggagggtctccccaggtctccccagaggggctgtggaaggctggggacagggcctggcctcagtggtgggtcccacataggaaggagttgggtaggcatccgtggtggcagaggttgggtgttggagacggttgctccggcagagctggccagagccaggcaggtacctccaggtcctggatgccggccacagccagtttcctgacacgaggacacccgcctgggcttttggacccccgggtggaatgaaggagagaatgcggagaaaagcggcggtggaggctggcgacagtggggccaggctaaccaccatgcggttttctcagggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaaccagtgaactcttttcagtctgtggagtcagagtggggatgaggagaggggaaagtcttcatggggcctggggggaaggaaatggagtcacagtggtttactgatcaaaccagcagattagagagtctggtgtcttgttaggaaaagcatactggctttgcagacagacaaacatgagaacttgaatcttgattcttcggcttaactagcccggtgatcttggcagggctcgccagcttgcctgagtctcggcttctccatctgtaaagtggagagggaaaggccactgcctaccacgcaggtggcccacgataggaagtgaggcatcgtcttctatatgctggagccacattgagacccagcacagaagccgaaagtcccccagaaaaccaacctccatcctttatttgcatttttcgaagaatgtgaaaaggggaagccgattcaaaacagctcttcccaaaagtgacgctacccaattcttgcacaacccatagctgccagagaaagtcttgaagaccagccaccctgagaaacctcacagcttttctgtcattcgaggtcctctgcacccgttctctaattctgttcactgattcagactttccagttaggtgccccagctcccctctccgcttctcgggtttgatctttctccacccattcacctgcttctgcaaaggggctaaagcccattctccttagagggcaggggtgtaattatctgatcatcagggagattggctcctggcacgtggcaggtgtccccaaactgccaccttcctctcccaccttcctttccctcccatctctgctcagtacccggacggtaactctaggaattatggttcagggaggccttgatcgccccatcaatccactttgtccctggtttgattctcgtgagcaccattaacttttctggaggaaggtgaggctttaagaactgtttaaagcccaggcgtggtggatcacgcctgtaatcacagcactctgggaggccaaggtgggcagatcacctgaggtcaggagttcaagaccagcctagccaacatggtaaaatcctgtctctaccaaaaatacaaaaattagctgagcgtggtgattcacacctgtaatctcagctacttgggaggctgaggcaggagagtcgcttgaacctgggaggcggaggtagcggtgagccgagatcacgccactgcactccagcctatgcaacagagtgagactccgcctcaaaacaacaacaacaaaaactgtttaaatgagacaggagggtgttggggtgtctgtgcccaaaatggggtctggtgtcattcaactctttcttcattcattctgcacacagatactgagcacctggaaatgcacccagtacagagccagttgttaggacaccaaaaagataaggcgtaggaccaaccttggggatctctagtcgagagccgccaagggtttttaaggcaagataccctggagggagctgaggcagtcctaagcctgaagggcctggcttaagctccctggcaaccatcgagcatcttccccttcccaccctgtccctcagcacagctgctgacataaacctactacatggctgattgaccatgagatatggccatcaatagacattgctgaggcgtgaagagcaggtgaagagcaggtggccaggaagctagggggccaggactccagacgcaggccgccctccacaaccccagctctcacagtcctcccagggtccagacaatggatcgtgcatttaggttcccaaacacctgctgtgcaacgtgtagtagacaaagcagaccaaagcctttgccctcaggaggccggcattctagctcaggagccagccaagacgatgtcgcactgaagaaagacaacaaaagtgagattcacaggagggatgagtgtggctgaggcacccgggaaggccctcggagaaggtgaccttgggcaaagatccagacgccaggtgggtggggccaaagcagagaagatctggaaaacccaatggctccccagggcttcgctcttgctgcaggaggggaaaccacactgctgtggattcttcctccattctgtccatttctcagttcccaacaacacactgaacagtaggaggccagttctccgctcacagcgggcgctgcaccccaggtgctgctctcgagaaaaaggcgagcatggaccaatttagtggctccgaggtatgaaaagcagtgagatggtgtctttgagggagttagtgataggctgagacccccttgctgtcccccctgaagcctggtgaccagagctgccaggaggccacacagagagaggtttatgatgggggacctggaattcggaaggggcagagtggtcaggtgacccatacacgcctgagaaaactgatgtggagagctgtgttgtcattctgaggcaggaaatagagacagactgacagacagacagaaagacacgggcacattgagagacagagacagaatcacagagcagagctggcttctcaccagcaggcgtgggcacacctgagagagcatccagagaggttagaaatcttccttaggtcctcctgggaggctcaggtgaccccagtgggaaacatgaaaggctgggaggacttccagggctgagagaaggaagctacgcagccggccggtgccacattccctgtgccttggggagtgtcccccagtgtccccagccatgcaccctggggggagtcggcttggacatctgtgccaccccttgacaggcagagtgggggccacaacctgggccctccagtgctggtcagcagaggctgcccccgccccttgccttcctcctcccgctccttcctccagccctgggaaggtcggaagccaccaccatggggctagtgcggaagcagagggagaacagaggggccctcctcgcaaaaactaaaacaagcccacagcctgtgcagaaccgcacccgggtgtgatcactccttaccccacacacccactgccacttggagatggcttcatggctgcagtcacagggcaccctgtgttgtcaggggtgagccagtgaggcccgggacctgcccaggggtgcatcaagggtggagaagacctggccccagcgcaggtgtgaacaggcaggagggctggggagggaatagcgctgggttgtggccgagcccccaagccctgctcttgagaggcactggctacacactcggcccctacccagacaggaccccaattcctccctggcccctctgtgttcctgcatcttcccagcccctcacctcctctggcgtggcctcacctccagccgggatgccccattagctgctcacccaagctgctagaacctcaggctaatggccctgtcacccgccctcctccccttccggctcactgcccatcccgggcatcctccatcagcccgctgaggggactgctgagcctcagagacatctggcagcaccaggaggtgggtccctctctctgtggctcctctcttcacctgactgttccccagacccccagaccccctgcccaggtggcccctgagaactgctaagctcaaccgtgacatggatggggcccagctgacccttgggctctccctgggggacccccttttcctgtccctggccacaccctcaccttatccacacccttctcctccctgctgccccgccggctttccaatgtgggtggggggtgggggcagctcctgccttgccagggaaccagggagggcagtgggctcaggagtcaaactcccattcccagggaaggctcaggctgtgggcccagccctgttctgaattctctccacccctcctccccacagagtctcagaaatcgagaagctttcttcctctgggacctgtgcgccacatcctatctcctgtgacgctgcaggagcttccctggttttaagaggtgacatggtggagagaaagcacaggactgggggccacaggtcctggcttctcatccaggctccgctgctccctgactgctgcctttctctgtgggcctcgtttcctccctgatcccaccaggtgaattgtaattctccacacagggctggaacccgcgagtgatcccaggagcccctcctctccggggccccaagatctgaggacagggagccaggttgcacacaggagccgtgcaggccaggacggcggccccatggacctgcccccgcagctctccttcggcctctatgtggccgcctttgcgctgggcttcccgctcaacgtcctggccatccgaggcgcgacggcccacgcccggctccgtctcacccctagcctggtctacgccctgaacctgggctgctccgacctgctgctgacagtctctctgcccctgaaggcggtggaggcgctagcctccggggcctggcctctgccggcctcgctgtgccccgtcttcgcggtggcccacttcttcccactctatgccggcgggggcttcctggccgccctgagtgcaggccgctacctgggagcagccttccccttgggctaccaagccttccggaggccgtgctattcctggggggtgtgcgcggccatctgggccctcgtcctgtgtcacctgggtctggtctttgggttggaggctccaggaggctggctggaccacagcaacacctccctgggcatcaacacaccggtcaacggctctccsgtctgcctggaggcctgggacccggcctctgccggcccggcccgcttcagcctctctctcctgctcttttttctgcccttggccatcacagccttctgctacgtgggctgcctccgggcactggcccrctccggcctgacgcacaggcggaagctgcgggccgcctgggtggccggcggggccctcctcacgctgctgctctgcgtaggaccctacaacgcctccaacgtggccagcttcctgtaccccaatctaggaggctcctggcggaagctggggctcatcacgggtgcctggagtgtggtgcttaatccgctggtgaccggttacttgggaaggggtcctggcctgaagacagtgtgtgcggcaagaacgcaagggggcaagtcccagaagtaacgccactgctcggrggaaggagcatggggcaggagggcccggctgcttctccaggcccctgcggggggctgcttcggaggaactgcagggcagcctggcccggaggcctccctggagccactcaagcagagagcggcgcctgctgagggcagcaccccagtcaagagaggagcaccgagccagagcacggtggcagggggaggtaagtttgcccctgcacgtgtcgaggaagtttgtcccttcctcgcctatctttctctcccctctgcacgtcctcacctgcctgtcttccgtgggccgcgagcagaggccttgtacttacgggaaggaggaggcagtctgtttctgacycacaggaactgccactccggtgatgcacttgaggacagctactctgaaatcagttcccaggagagaacatttgatttccgagtaggagaggaggcaggaggcaggataatgacgctgttataccatgtgaaactcgcaagggggcagccttggagcttggaacggaggctggcaggaaaagatgcttcagccggggagggaaaatgcaaggtcccgcagtgatgggcaaaggctacggagttgactcttgaacaacgtggggatggggtgccgaacccccacgcagtggaaaatctgtgcatgactttgactcccccaaagttcaactactaatagcctactgttgaccaaaagctttacccagtatataaacaattgagtaagacatatttgaagccaggcacagtggcttatgcctgtaatcccagcactttaggaggccgaggcgggaagactgctcgaagccaggagttcaagagcagcctgggcaagatagtgagacccccacctctacaaataataaaaataaaaataattagctgggcgtggtggtgcgtgcctgtagtcccagctactcaggggtctgaggtgggaggatcccttgagcccaggattgaggctgcaatgccatgatcgcaccactgcactccagcctgggtgacagagcaagatcctgtctctggaaaaaaaagaaaaaagacatattttgtatgttatatatattatgtgctgtattcttacaataaagtaagctagagaaaagtacatgttactgaaaacattattagaaagagaaaataccttcacagcactgtgctgtatttatcaatactgtaagttttgttgtctgtttataagagaagttgtctgtctcaagcggcagtaaccgcggctgcagatctcaatctgtggtagatatcaagcagttcaacccttttttataatgtcatgacttttctttgcttcttggaagcagctctggcatcactagtggccccgcatttggggccaagggggttattcaaagtttacggtattgcattaaacatggtgaaacatatgcaatgactatgaaagatcactttttacttctgtacacagtgtactggcgagaactgctcaccaggaggtgattagcttcacgtggtgttggaagcagatactcaacagttgagctcacggagaaagcacaggaggtggctacgaaattattataggagtacagtatgtctacagtaaatatgcacttatgactttaatactgcacatctttatgtttgcttgcatttctcttgacttcaaatggcatcaaatagagtttgtgtttgcgtgcatatatttttgataaattttaacttttttgttttgttttgtttttagacagagtcttgctctgtctcccaggctggagtgcaatggtgtgatcttggctcactgcaacctccgcctcccaggttcaagcaattctcctgcctcagcctcccaagtggctgggattacaggcacctaccaccacacctggctaattttttgtattgtaagtagagatggggtttcgccatgttggccaggcctgtctcgaacccctgacctcagttgacccacccgcttcggcctcccaaagtgctgggattacaggcttgaaccacggtaccctgccaattttaactttctataagagatttgcccagcctgggcaacatggagaaaccctgtctttaccaaaaatacaaaaaatttagctgggcatggtggcgtgtgcctgtagtcccaggtacttgggaggctgaggtggaaggatggtttcagcctgggacgcagaggttgcagtgagccgagatcatgtcattgcactccagcctgggtaatagagccagatcctgtctcaaaaaaaaaaaaaaaaaaagctttgtatccattttggcatacatagactagtatgtgtggcagtaaatagactagtggcagtaaatagactagtacctacatatattttttgtattcgtggcatacttaacttttgcttaatttttaaaatatatttctaggcttgtagttcctctgtaagttttttcaaattgttgcaaatctctgaaaatgtttccaatgtatttattgaaaaaaatccacaagtaagtggacctgcacagttcaaacctgtgctattcaaaggtcaactatatagtctgtaatacgtgatgggtgtcacgctgagtgtctacagtgagtgttgtctcacttcagcttcacacaacgctgtggtttagccttgccactgccgtacggatgagcgggtgttcactacacgaaggtactgggcagaggagcaaacactgactaaattctagcctgtgctttgctcaacaagccacatgcctgccttgcttgcatcaagggaaggagtattgtgttctaatttgaagaaatacaccagccactccttaggcagcacttggtgcgggatgggctcctctggaaagggagcacctaatttgcacaaaggtgctgcaccaggtagctacgatcctggaatgggatgaagaaacttgcctaaggccctacagcaaggaaggggtaaaagcaggatgtgatccttccaagcagaacccccaagagccaggggacatttgggaaacctgggggtgtgggggttaaccctgtatttgtggtccatttcgcaaaggatagcatcccacatccatgagagggaggtcagaagggagtggctgtggctgtgaaggagacagacacctgggcacctgctctaaattacagcaatgccatgcacatgatgatgtattggagcacaacaaatggcagccaccagctggggtgcacgcaccaatttctacaaatgagctctgttcaggctgaaatgtctacgcatgcaaggatttttcttgtaattgatgatatatccccagcgcccagaagacagagtggcacgcagtaggtgctcagtaaatgttcgctcaatgaatgaatgaatgcctctactagccttccaaagaaagttctatgtctgttttatcaatatggaaacaggccagagaaattaagtaacttcttttggaagccagaaacaagcccggcacttgtgcagtgacaacaccagggaatttcagtaaaaacccaaactccaccccagggagccccagtgcctcctcccgcatcacagggtgccagggcccactctctttgactcctgctccatagcccctgctgggtactgggctgcttctcccagttcctcctgcctccccccacttagggcaaatccagtgcctccctggggcccaggagactcagtgtgatccaccccaggcgcctctcactcctgtgagacccaaacctcctatcagctcccccagcaggccaagtctgtgcacccgtgactcccctgccccagtgttccctccagtggctctttgcctcttcagtatccacgtcttcatgatccttcccctactccatcccccaagccctcaccaccaaatgtaatgtaaacagcatgacagcaaaaactttttgttcacaactgcgtgttgttttttttttttttttttttttttagacacagtctcactctgttgctcaggatggagtgcagtgacacagtcatggctcactgcagccttgaattcctgggctcaagcgattcttccatttcagcttcccaagtagctgggaccagaggcacatgccactaaacccagctaatttcttttttctttctctcttttttttttttttttcccctgtggacatagggtctcctcatgttgcccaggctagtctcaaacaacctgtgctcaagcaatcctcccacctcagcctgccaaagtgctaaaattacggacctgagccaccgtacccagcctactgctgcacttttaacagcttaattgagatattatgtacatatcatcaaattcaccaatgttaagtgtacaattcaatgatttttagtaaatttactgaggtgtgagtccattaccatcagctagttttagaacattttcatgaccctagtaaaggattttacttcatgttcatttaaacttaatcttgggccaggcggggtggctcacgcctataatctcagcattttgggaggctggggtggacggatcacctgaggtcagtagttcgagaccagcctggccaacatggcgaaacctcatctctactaaacatacaaaaattagccaggcgtggtggcgggcacctgtaatcctagctacttaggaagctgaggcatgagaatttcttgaacccgggaggcagagtttgcagtgagccaagattgcaccattgcactccagcctgggcgacaacaagaccctgtctcaaaaaaaaaaaaaaaaaaaaaaaaacaacttaatcttcatttctacctccatcccccagacaaccacgagtctactttctgactctataactttgcctattctggacatatcatataaataaatgaaatctgacaatatatgtacatggtcttttacgtctggcttgtttcactcaacataaggctgtagtgtgtatgggtagctcattccttttctttgccaaatagaattccagtatatggatgtgccacttttttattcactcaccagctgatgggctgccaggtaacatttccactgttggtgactatgaccaacactgctgtgaacatttaggactgagtctttaagtagacctgagtttccacttctcttaagtaaatacctacggtggaattgttggatcgcatggtgaatttatgtttaactttttaagcaactgccacctgctttccaaagcagggacaccacctcccattattctcaccagcagtgaatgaggcccctatctctctacattctcgccgaccataggcattgtctgactttttgcttgtggccattctagtggatgtgaaatcatatctcattgtgccctgtgattgtttgaatgaactaatagatcacctgtgaaactggacagcacttgggtttgaaccctagtggtgacatttcacaagctgtatcacctggagcaagtcacttccctacggtgaaggacaaggattttatgacataaaagcgttgccctagaagcagtgtctgctatggattatgtgcccatgaaaaggcagctgctgtcatcatcgccaccaccattattattgttattattattacattgtcaccccagagataatcctgcaccagtgacagggaaaatagcagctggcatccgctgcctgctcacgaccacacgccaggcttccgtcaaaccactcaacatgtattagtaatcttttaatcgacctacatattgttttaatttgcatgtgttaatgcgttgatctatgagatgggtattatgatgagctctgttctgcaggggagaaagcagaaacatggagaatttaagtcatttcccccaaatcacaaagtcaggaagaaacagacctcacggagctcgctctctgtcattgcatcacacttcctgcccttacaaggcaaattggataaatgccattctagagaagcagacaaaattcaagtgaagaaggggagaggaagacgtcggctggggcctgcttagagcatcccagctgagactgcatgaggagggaggcacgcagttgtggaatttgttccccttttagcatgctgaccagccctggcaacggagctcaaggcatctatgtgccactgctcaacagtgagtgacgtcatgggcacggccaggtctttatcagttctgccggataaatagccaactgcactaggtctggagagacagcaaggtgctgtgcggcagagcatttggggtctcaaagaagcaggtgagcctgggcccgaggggctgggtggaggagcaccttggtgcttctctgctggggaagggacaggggacagggcatgctcaggaagacaggcaggctgaccccgcctggaaggcacccagagacaagaggggtgggcgtagtgacctcgtgcccttttaggggagatgctgctggccagaggccgttagggcccccactaccaactccatgttactctctctcaccagtggccaccaccatggatacaggccccgaccagtcctacttctccggcaatcactggttcgtcttctcggtgtaccttctcactttcctggtggggctccccctcaacctgctggccctggtggtcttcgtgggcaagctgcagcgccgcccggtggccgtggacgtgctcctgctcaacctgaccgcctcggacctgctcctgctgctgttcctgcctttccgcatggtggaggcagccaatggcatgcactggcccctgcccttcatcctctgcccactctctggattcatcttcttcaccaccatctatctcaccgccctcttcctggcagctgtgagcattgaacgctt

SEQ ID NO: 17949 - DNA, 35959 bp, Homo sapiens
tttttcttttttttcaaattcatcatatctactgatatcttttagtagtttacacccaatgttcaagtctctaccatctttttattaaaaaggcaaaacagaatattttcttttacctgattcattttaccagagaatttcattttatttttcaatttccttttttattattaatactgtttttgattggaaatcacaatatacgtttatggggtacaatgtgatgttttgatatacgtatgcaatgtggaaagattaattaagctaattaacatatccctcacctcccctacctataattttttatggtgagacatttgaaatttattctctttattttgaaatatacaatacattgctattgactttagcctttttgctattcaatagatctcgaaacttattcctcctgtctacctggaacactgtaccctttgatcaacaactccccattcccttccatccctgcccctcccatacccccatgcctctggcaaccaccattctgctgtctacttctgtgagctcagctttattagattccacatataaatgagatcatgtagcatttgtctttctgtgtctagattatttcatttaacatagggtcctccaggttcatccatgttgtcacaaatacaggatatctccacttttaaaggatgaaatactattccattgtgtctataaccacattttctttatccattcatccattgatggacacttaagttgattccatgtcttggatattgtaaataatgctacaataaacatgagcatgtagctatcccttcaacatactgatttcagttcctttggatatatacccaccagtgggattgctggatcacatagtagctctatttttagttttttggggcacctccatactgcaaaaactgaatctttttttgtttcaaggattcacgtaggagaatctcacatacctttgcagctactgtctattctttcttccaaatttctcaaaagggggctctgcacttatttgttctacttcttcattttccatttgctcaattcattgcattgtggcttctgccttcattttctgctaatacagatcaaatcatggggatccataacctccatgttgccaaattcaaaggatacgttttttttttttttttttttgccttgaccttattggaaatcttttctgcatttgatgttgttgaccacttcttcccccttgaaagtctttcctctcttggatttcttccatgacattactctctcctgatccttctcttacccttctgctaattctcagctttcttcttgactgtctttttctgtgctggctcctaaacactggcattccagagttcagttctcagtccttttctcttctcactctatactcttctaggtagttgttggaatagtcctgttgaaccaggcttggttgctcacccctgtaatcccagcactttgtgagaccaaagtgggaagattgcttgagtgcaggagttcctgacctgctggggcaacatagtgagacccccatctcttcataataaacaaacaaaagaatagttctgttgaagaagggtattggattgagaaagtttttgctaggtcttgaatttgacttaggaattccacttcatgtagcatgtgggaagactttattccttatagattttccaaatgaaaaccgccatcaagaagaaaagaggtgtgtcagatcaatcataagaaaatttacaataccaaagcagtacttatatatagtggaggataaagctgccttcattccagaagtgtctttacttttaatagagatgaaagctctatactttcatataggtgacttgggtgccaactgcctagtaattctaattagctagactaccaaaccaaatagcataaagccactactcttggtaaatgactctagatggatttgcttataattcaattttttcctgataggtccaaggtaataattttcaaagtctgctgcctcagaggaacccacattggtcagaaccaaatgcagcatttgaggtggctcataggctattcattggttgctcccacaccatagaaagcatcagaagagggaagagattacagtagggaaaggatgggtgaaaggcacaggttgattccccattggtcaggagactttgcagacctcagaggagatcaggaattcaggaagatcgcctgcgggtcaaatacataaggaaaaagatgcccatgtgaactgcacatgggcatccctagctaattagagtcctcccttcaacctcatcatgcaatctatgtccttcttacctgaagagatttccctgaatactgcagccttcctgctcaatgagattgggaagacaaatattttggtgggctatctgtaaatgggtgatacttctggattttttttttcattttctcaaaaataaatctagatgtcattttttaaatctacaattccatagctaatcaaccaactgatcactgatttctgggaattctacctcttgaatatttattaaacctatgcaattttctccatccctagtcccaccaccagagtccaagccatcatcatctttaacctggtctcttgcttcctaactggtctatattcttccaattttgctttccacctatctattcttcctcaggagctgaaagcgatcttctaaaatgcgagtgtgaacatgcccctctcctgcttcaaacccttccatgattttccattgcccttaaaataaaggtcaaacccttagctcagcatataaggccctccttgatctggcactttcccaccttcctatttcatcttatgccattctccactatcacaactgttaggctgttcttgtgttgctgtaagtaaatacttgagactgggtaatttataaagaaaagaggtttagggccaggtgtggtggcttatgcctgttatcccagcactttgggaggccaaggcgggcggatcacgaggtcaggagattgagaccatcctggctaacacggtgaaaccccatctctactaaaaacacaaaaaattagctgggcatggcagtgggtgcctgtagtcccagctacttgggaggctgaggcaggagaatggtgtgaacccgggaggcggagattgcagtgagccgagattgcgccactgcactccagcctgggggacagagcgagactctgtctcaaaaaaaaaaaaaaaaaaagaaaagaaaagaggtttaatcggctcacagttctgcaggctatacaggaaacatagcaccagcatctgcttggcttccagggggtcctcaggaagcttttactcatggcagaaagcaaagtgggagcaggcatcccacatggctgatcagaagcaagagagtgtggggggagaggtgccatacactatttatttatttatttatttatttgagatggagtttcactctgctgcccaggctggagtgcagtggcgtgatctcggttcactgcagcctccgcctcctgggttcaagtaattctcctgcctcagccttccaagtagctgggactacaggtgcccgccaccatgcccagctaatttttttgtgtttttaatagagatgggatttcaccatgtggaccaggctgttctcgaactcctggtctcaagttgatctgcccaccttggcctcccaaagtgctgggattacaggcctgagccaccacgcctggccatgccacacacttttaaataaccggatctcacaagaactcactcatcatggggaagacagcaccaagccatgagagatccacccctacgacctgaacacctcccaccagaccccacctccagcattggggattacaattcaacatgagatttgatcagggacaaatatccaaactatatcaacacccatactgaccttcctgtatttctcctgctacttggaatacttttctcttctcctggctgacctctagctccttcatccctttccctcactgaattgtcacttcctatgaaagcctcctaaacttcccaggccaaattaagcccactcacatagctcccggtacatctccttcaagacactcatcacattcctaattacatatttaatgtctctttcccctgttaaatttcaagctgtatgagagacggaactgtatcttgtttcttgacctgttgctagcaccaaggacagtacctcatacatagtaattatttgatgaaagaaaatgaatgaatgaatgaatgaggacacttttgttcttctgggtaattcttcttcatctttcaagaacccaggtcagatgtcatttcctccaggtgagatgcagtcaaatctgattcgtctttagatccctagggcctggcttgggacctgatacatggttcatatatcataggcatttgtcaaatcattataaactattggttgtgaattcataattgttgaaactgaatgataggtatatgagggttcattatattgttctgtctgctttagtatatattggaaatttgccataataaaaagttaaaacatttatatttaccacaagtaaaataaaagtatattcaaagatgactttgaagcttctggcttgggaagccagtagttggtgtcattcattggaatggatggaatggagttgtgtccagtgtgggatgtgtgttgtgttgtgtgtgttgaagagggttctttttcaccccagtgaaactccttaaaagactaataaagggggatgaaacaataaattgaggctggacactgtgtctgacgcctgtaatctcagcactttgggaggccgaggtgggaggatcgcttgaacacaggagttccagaccagcctggggaacacagtgagaccccctctctactaaaatacaaaaagccaggcgcggtggcacatgtctgtggcccaggtactccgggggctgaggcgggaggaatctgagccctggaggctgaggcttcagagagccatgatcttgcccctgggtgacagagtgagaccctgccttgaaagaaagaacgaactcagatttggatatctttagttttaggcacctgagagggattagcatgtagaggctttctggatggtaatataacctctcattatccttgatggcctctgggtcactgatctgaccattgggatgtatcccactatccagggagggtctgtagtaagtattgcaccccaccatcttccttacatctttacacttttcattcacaatatccccttccttgtgaatttctaccgggaagcaatgtattcttgacattttccaggccttgatgtcagctttatgctcagcagcagaggtatttcagtgtcaagaaacatcggagttccagtctaaattcatcactaactgtgactgcgggcaagtcgctttacctctcttaatcttagcctcagcctctgaaaaatgaggataataattctggtgattttacagagctgatgtgaagattaatgcgcgttaacggtttaatagagagcccggcacggtgtaagtggtcaataaatacgagctattattatgagcaacgctgtgtcctcagagcctccccaccaggacgtcagggagcggtgcagcaggagcggcgcagagtgcctcccgggaatccttccccgcgcggccgcggcgccgcacagccgccgccattcgggctccagccccgtccgcgcgtctcccggcgtgggtgcgggaccagggcgctgcggggcgcgcagggtgagtctgtggaatagtagtggaggacggcgccgcgctaggcgggggtcccagggagtcggctgcaggggtgtctgctgggagggctggaccgcggggctcaccgaggtccgagggccgcccgcagggtgaggcccccaagaagctgcggcaagtgccgcgcccgccgagctcgctcccgcgcccgccccaagatggcgcccctccccctccccttgcgcgcgcctccgccgctcggggcgcggccccgcggcccgcgcgctcctgggcgggggatgttgtgatggagaagccgcggcggagcccgaaccccgcagcctgagccacctccgtcatctgggcccggggcctcaccgcgcaggtaggaggtgtccctgccccggcccagccccggtggctgcgtcccgatcaccagcggccggcggaccctgtagcccctaccctgcggcagcccgggtcccccggccggccccatcccccatccccgggtcgcccttccaccgcgcgcccgcagaccgtcctctcatacccaccatcgcagggtccactcgggccctcacaccgtcccttccgctgccctttacctcctgcccctcggggtgactaggggcgggtatggaggacgcgaagcgaggggcagtgggtgttgggggaggggaggcccaggtccgggaaggggacgtggggtggggtgggctggcaggccgcgccgattccagcaggggtcccaggccctggatctgtcaagccgcattctgttgccctcagcgaccgaggggtgtgccctggggcggctgtgtccccagctcagccaggaggcctagcactgscaagaacactgattagaagcagttttcccactgccaattcctaacctgttttgtatcrgcctgtgtatctcttgcattctgagcccctctagctatagtcccagctctctccgcccttcagagtcaacgcttgctgtcttcatttccttacttcccattcattcttaaaagcactccactctgtgtccctgacacccactgaaactgtctaggccaaggtcaccggagacctccttgtggagaactccagtggacactgttatctcctttacctttgagtagtattcggtggggtatgtcaactcactctccttgaagcattttcctgctttctgccctacagcattgtctgctcttctcaatctcatttgcttcctctcctcctctctttagatgctggtgaggctcttggctctgtcccgagctgtcttctctcagtatctgttctttctccccagatattttatctactcccaaagcttcaaatttcatatatatgctaatgattcccaaatttatatatccagcccagacttctttcctgaaatccagactcatatgtccagctgctctcttgacatctccttgaaagacaaacaggagttccaaacctatagattccaagctaaattatcttctgtggttttctctgtaccccacttccaaatctgttcttccttcgaatctcaaaaatggctctttgccaatctggagtcatgagcaagacttgagattaacccctctctcactctctgcatctcatttcaccaagttctgtcacatccactgcctaaatatttctcaaatccattcatttcgctctttcctcactgccaccaaagttaatctgggccaccaccattttttttccttgactactttaatagcataccctcttgcctacctccctttaactgttctcaacacagtacccagagtaatcctttgaaaaatgcttccaatcacttattcatgcaataaatatgatttcagcacctaatatatgccaggcactgtgttatgtcctgaagatataattgtgagcaaaagagactgagtccttggagctgacaatctaggagaaaaatcaaataagaataacattacaaatgtaatatgtaccatgaagaaaagctgtatggtgccttgagaacgcacaagagcagtagctaaactggtctcggggatagggagagagggttggaggacagcttctctgagaacatgacgtttgaactaaaatatagtggatgagtagaagttaattcagcttagagagtaggagaagaggtcccaggaagcatggaaatcacatgcaaacaccttgtagaaggaaaacacatgtcttcsaggaatcagaagaaggctactgaggctgcagagcagtgtgaccaaagccagggrcagggaggaggaaggcaggcgccagactgagcaggaaatttaggccatgttaagaatttggtcttaagggccaggcgtgatggctcacgcctgtaatcccagcactttaggaggccaaggcgggcggatcacctgaggtcaggagttcaggaccggcctggccaacatggcgaaaccccatctctactaaaagtacacaaaaattagccgggcatggtggtgtgtgcctgtaatcccagctactcaggaggctgaggcagaagaatcgcttgaacccrggaggcagaggttgcagtaagccgagatcttgccactgcactgtagcctgggtgacacagcaggactccatcgcaaaaaaaaaaaaaagggaattttgtcttaaggtctttgtccttgatggtagtggatgtggagagtagatgaagtccagaaatttttctcagagaggaaatcatcagtacctagagatggattgaacatagcaagtgcaggagaaggacatgtcaagatgtacccctacttcagattcacagaataggatggattctatcattccatgagccgggatcctgaaagaggaccagttagtgtgtgggagtgggaaacatgagtgggtctattagcttgagacatccaagtggagatgttgagtagaaagttgaatgtacttgtctggagctcaggtgaggggtctgaaatggagatttgaattgggaaatcatcagtgtataactgaagctgtgggcattaatgaatacttatactgattataggatgagaaagaggaaggggcatgagaataagccataagaaactccagcaggtaatggctaatagaggaagatgagccagcagaggagtctaggaacccagcaaacagtaacaagaagtgtaaaagatgagatgagatgaggagtgtggagatgasagtgtggaggccccggatagaggctggatgagagattcacggggtcagatgctgctgggaggacaaccaagacgagcactgtgtctgttggattgaatgacacaggggtcatgttgaccttggtaggagctgttactgagtcgtgttgggagtggaagcaggtttggaaagggttgagsagtgagtgggaggtgaggaagtggcaacagtgagtggagacaactctctcaggaagtttgcctgtatgggggaggaaagagagcagtgagtggatctggaggagcgtcaggtcaagttgggagaccgtggatcctattgagaaggagaggttgatcatatagaggagaaaatagataaacagtggtataaaattcctggaaaggcatcataggaagaatccaaatcataggtgaagcagttggttttgggaaggagagaaagggataggtgctgaagtttggttaggtttttatgtttgaggatgttacccagttggatggcttccctttcctctgtgaatcaggaggggagatcagcctctgagasgggtggccaatggagagtwatgtcctagtctcaggcaggcctttgctgatgtctkggctgtagtaagccccaggttcctgtaatgccctcctcttcctccttcatgatattcagtcaacaaatagggaatgctatgggtgccaggcactgttctagatgttggygttacactgcattgtaacaagttgttcaatgactgtttcccgctgaactgagaactcctccagaggaagaaccatttcttttgtcttcatcactctcccctgtgtctagcacagtgcctggcatatgggaagctgtcagattagacaactcctgactttgagcaagactcaaccccaacccctgtggtctgatgccaggatcttcaggcttagtgactacttctttcacttcctgccccgaggcccctgcccaactccctgccttgagccagaacccagttggctctttgcatcctttggtaactccaatgagaggggagagattaggttgtgttccttctttaaaaaattggactgagatcatctttttgacctcgagcagtggggtgttggtgaccacaccacctcaggctagatgctcaggcttcagcacttaaacagtttcaccattcttcctctaatacttcctgccctggtgaccagattggcggggctgccctgaggtcaacttggctcttcactgtttcagcctcacagtgcatgcactcttctcagatcatatctcctagtgcctaggaggttggtctctgcctgacctttgagaaacctggctctgtacactactgcttcagagaagggtttgccatccttaaggtcctctgagcatggcagagtygtggagtcttctgcttcctgacacccatggagatgccactcttgaacagtgtctgtgccaagatgttggtttaagctacctccctcgctcccttttcctagatctcagccctcacctctccaggattcctgtcccatcttacttcccactcagggaccctttggcattctctgacaccctcccaaacactccctttgctcctccccagcccattgggccacacagcctttcttggtatttattcccagccagttctgagcttcctggatcctcccaccccctgtgtctgtcccgttcatccgtcctttccttctgcaacagcccagtctgtgtcggcacacggcacactctctttggtaatgggaatgtgaaattgaataagacaccgtctcagatattctgatagaatgtggttctgggtgttgtgagacacgaaggagagaacagtcacttgatggtggggagagaacaggaaagactgcttaggagctgtaactgctgaggttagttttgaaatacaagcagaggttctcacaaggggagacagaattccaggccgagggagcagtataaacaaagacccagggctttaagagtgtgcgacatgtttcagaatccgccacgcttcatgtggctagagtataaggtataaaggaggcgggaggtggggaggggactgacaggttatagaggccggcttaagagggctcttgggtgtctgcgaacgagtgcaggcgttatccgaaaggcagtggtgagccctctcattttctgaaccagggagtgacacaatctggtttccatttttggaagattactgtggttctgggaggaggtagagctatttttttcttcatttattccagtggctgtgagttttctcattggccaggaggagtcacactgagcagatcaacagccccacgtgaggcagacacgtgcgcagaaacctttttcatcttacagatgtgtgggtagcatagcactagtgtctgaggaactagagacgtagaaaggtgagctatggggccgggcgcggtggctcacgcctgtaatcccagcactttgggaggctgaggcgggtggatcacctgaggtcaggagtttgagaccagcctggccaacatggtgaaaccctatctctacttaaaagaaaaaaaaaaaaagaattacaaaaattagctgggcgtggtggtgggcacctataatcccagctactcaggaggctgcaggaggttgcagtgagctgagatcgtgccattgcactccagcctgggcgcaccgcacctggagagatgggcaagccctgctcaggtagctgcaagacctgtgctcagcgctgagaacacagagggaaggggggtagtggtgagtcagggaaagaaagaactccttagtagaggaacagggagatagggaactctcagataagacatcaaggagaaaggtctgtacagtgggaatgagaaagagcacagtgcagtgtttgttgggatggtcagtgagggagaattgtctgttgggggaagggtcgggtagggcaagagaatcagtgaggccatcgagggaggagagagtaatgtggtaggggctgtctgaaggagggcttgcatggagggctcaggatgagagagaagtgggcagtggttggtcagggagaaataactgaaatcgggggctggtgagggtccagggagagagcactttctcttgggggtccgggaaggagagcagcagagcaactggaaggtcagggagagtggggaggatggaatggggccgagggtgggtccctgggtggcgggctggaaggatagttgggactcaaatggttgcggagaaactgacccacgaagggctgtgaggaggcagagggagsggtctggagggggagctgtccttgyggaacaggacgtcctcttacctgagaggcaggtggagtttgtttggggcaccatraggcatagtaacgtaaccaaagtgttttctgacactggcagaggagatgccaaagcgaagcctggaggaaatggggactgattcatacattcattcagcaaatattaatggagttcctgctctgtgccaggactacgctaggcactaggcatactgtatttaaccaaaaaggcaaaatcctcaccaacatggaaattataaattatagtcatgaggagacaatcattagacaaagtaaataataaattggcttgtcagatggtgacaggcgctggggaagagtttagggattgctgaggaggggcggaggtagcctgtggttttaaaatgggtgttcagggaaggcttcactgaggctgtgacatttggtcaaagatctgaaaggctgggccggacgcagtggctcatgcctgtaatcccagcactttgggaggccgaagtgggcggatcacgaggtcaggagtttgagatcagcctgaccaacatggtgaagccccgtctctactaaaaatacaaaaattayctgggcgtggtggtgggcacctgtaatcacagctactcaggaggctgaggcaggagaatcacttgaacccgagaggcagaggttgcagtgagccaagattgtgccattgcactccagcctgggcaacaagagcaagattctgtctcaaaaacaaacaaacagacaaacaacccccaaaaaacaaagatctgaaaggctgaggggcccaggggaaaggctcccatagtgatccaggacagggcattatgagggctggcagagggaccagtgcccaaggggasctacttcatggaaattgtcaccaagatgtagcttcatctgsccagagaagccatgaattgcagccgagcgccctccctctgtgacctgccttccagtgccatgccctgtagggctggttctgcagcttatttgctcctgtcctcacagtccctagtatggggtgggcttgggggctggttgagctgagtgatttatgggaataggaacacagccggaggagcttacagtgatggggcttgggatggaagtgcggccggagaggggcagtcagtgatcagtgtccaaaacacacgagcyggtcccactctagtggtgttcctggcacagtaagccccgggtggatgagctggggggtggggaggcacagagagccattgtgtggaggccttkctggtgggaccragggcaggcgccagctgtgccatcccagaaagctcagggcaggggatatagggatggggtgggcctcagacctgggcctggactgtgatggggatgatagtgctgggacagaagttgaacccagtcattctcataggatagagagccatgggtgctagcctgcttagtgcagggagatgaggaggcacagggcatagccctggggcagaagcagtgatgctgctgttctggaccagaggctcaacagcatctcccctccgcaccccacaggagctgccaaggccatgtctgttccatcatcactgagccagtcggccattaatgccaacagccacggaggccccgcactgagcctacccctgcctctgcacgctgcccacaaccagctgctcaacgccaagctgcaggccacagctgtgggacccaaggacctgcgcagcgccatgggggagggtggtgggcctgagccaggccctgccaatgccaagtggctaaaagagggccagaaccagctccggcgggccgccacggcccaccgtgaccagaatcgcaatgtgaccttgaccttggcggaggaggccagccaggagcctgagatggcacccttgggccccaaaggcctgatacacctgtactctgagctggagctctcagctcacaaygcagccaaccgaggcctacgaggacctggcctgatcatcagcactcaagagcaggggccagatgagggagaggagaaggcggccggggaggccgaggaggaggaggaggatgatgatgatgaagaggaggaggaggacttatcttctcccccagggctgcctgagcccctggagagtgtggaggcccctcccaggccccaagcccttacagatggcccccgggaacacagcaagagtgccagcctcctgtttggcatgcggaacagtgcagccagtgatgaggactcaagctgggctaccttatcccagggcagcccctcctatggctccccagaggacacaggtaccttgtggagcttgacatgggcatgtgggagggtgtgagggcagaggttaggactctcatacagaggccagtgccagcctgatgtgagctgagagcccataccctgaggccacagcaggccatgtccaggctttttcattcagagagtgcttggacattctggtagatctgaccatcatgcatgcccggatggatggatctattcattatgcatgccaccatggttgataagtggactagtttactgggcactgactaggtaactggccctctgctcagcattttcaggctttatccttacaataaagctgtgaggtaaatattatgatgattcccatattacagataacaaaaaagagatccagagaggtttagtagctttctcsagaccacagacaggctgagattacaatagagctgaaatctaaaccaggtctcagtccaggcctgagctcttggccccgtgttatgctgccgccaatgcatagagcacaatgcactcaggtgcacttgggacagtcggccccgttttttttttttttgagacagagtctcactctgtcgccagtctgccccgttttaacaggtcacgcctgttgggagcagccagcagctccccacagaggtctgtttggaaagactgggaatgttgtgtgcttataatccacatgctccagcaccattgcaaggatacagttttgtcaggagtaggatattgactaaaagttagaaaagaaaaccctttgggtagggggaggagaatagatactaggactccagggcttaatcattaaatatgtccatttaaattaagctgagtctccacattttctaatgtcgtgtagcgaatacaggaaaagctgaggaacaaagagtggagataatgggctatagttacaaccaaaaccctggagttttgtagatggaggtctaagaaagattaggaaagacccctatccttaccaggtggcggacacaatacccataccccaaactgtgcaatctttgtggagaacatgcagttcagatgagcctagggctgcacaccatcccctttcgaaaaactcattctggacattttcaaacatacacaaaaatagagagaaaagaataatgagcctgatttacccacgagccagttttaccaattatcaatacataactaatcttgctacctgcatgctctcttccgttcctaggcccagcgtaggttattctgaagcaaatacttttatctataaatgtttacagctgggtgcagtggctcacacctgtaatcccagcattttagaaggctaaaatgggtagattgcttgagcccaagagttcaagaccagtctgagcaacatggcaaaacctctcctctataaaaaagacaaaaaaattagccgggagtggaggcatcagccactgtggtctcagctactcaggtgactgacctgagaggatcatccgaacccaagaaagtcgagactacagtgagccatgattgagccactgcattccagcctggatggcagagagagaccctttctcaacaacaacaacaacagtttacttttgcatttctgaaagataaaactcttaaaaaaaaaacccaccacaatatcattattgtacctacaaaaatttaataataattctttaatatcattaaatatcctgccaaaaaaaggctggattgagcctgggcacagtggctcacgcctgtaatcccagcattttgaaaggctaaggtgggtggattgcttgaggccaggagttcagaaacagcctggttaacatggtgaaaccctgtctctacaaaaaacacaaacattggctgggcatggtggcttatgcctgtaatcccagcactttgggaggccgaggcaggtggatcacgtgaggtcaggagttcgagatcagcctggccaacatggtgaaaccttgtctctactaaaaatacaaaattagctgggcgtggttacaaacgcctgtaatcccagctactcgggaggttgaggcaggagaatcacttgaacccgggagacagaggttgtggtgagctgagatagagccattgtactccagcctgggcaataagagcgagactccttctcaaaaaaaaaaaaaagaaggaaaaaaaaaatgtagagacagtgtctcaccatgttgcccaggctggtcttgaactcctgttctcaaacaatcctcctaccttggcttcccaaagcactaggcttacaggtgtgagcaaccatgtctggcctgatctatctgttaaagttatgtttgatcaagttccccttctatttttttcgttgttgttgtttgcagttttgcttttgttttttaactggagaatcatgttgcttgtcctgagttttctatggtttggatttttcagactctctcctgtggtcatatttaccatgctcctcttcccctggatttcctgtaaattggtagttagttctagagccttgatcagattcagatttgagcatttttgtgttttgcttttgcaagaatatttcataggtggtattaaatacttctactaggccgggcgcggtggctcacgcctgtaatcccagcactttgggaggccgaggcgggtggatcatgaggtcaggagatcgagaccatactggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggccygggcgacagagcgagactccgtctcaaaaaaaaaaaaaaaaaaatacttctactaaaggcaaagtctgattgcctctcttttttgtgatgttagtggcctttggtggtcattgtctcaactccttttaaaaggaacagcccctcctgcactccagctgattatttttgggattggggtgaggaaaaatatagtctcaatgcagccagttaaagggaaactgaaaactagatattggtgtaaaatagcccaatttctaaacgttaacaacaaattctattttttaaaaagcactgtgcaggccacacacaatctatctgaggcttgcatcagtctgcaggttgtaggttggaagtttgcaagactagggggtgtgagtcagtgaccaaatagaggcctagttgctcacttgcccctgggatggtcactgtgggggctgcaactctgaactacctatgaagcttctaggagtagggggatagtactgctgaagagctggggcgggtttgctgggcagtgacctcagcaaggatgttggagtggcaagaggattctcaaggatcatgcactggtggagacattgtgaattgaggatagaggtgggggccagcccaggaaaggggccaagtcactcttttacaactgtgttgctatgaccatgagggctgcagagaaggtttgtgctcctgcagaaatgaggctagaattgagcaaaaattatattctccttcctattgtaggatattcatagagctatggattgaatgcataaatgcatgaattcatgaattaaatgaatgatgaatgaataaactttactacctgtattgaattcatactctgctccaggccttatcgtaaatgctggaaatgtatactatggggcaaagatgttcttacctcctggccttcacagcctggtgaggagacaaagaaagaaacargtggttatgatcagtgcgatgagctctctggggctggggaagtacaggaggggcccctgaccctgcctrtgagagtggtgggggagagkgcaatgggtcagttttaagaagggacctgtatactgatgtctgaaggagaggtaggtgatagccaggtgaaaatcgagagtaagggaggtgggctgggagaggacaagggggcatgtcccaagcaaagagagagaaggggagtggctggaggtaaggctgagaggcagacaggggttcatgacagcacataaaacctggggaggaatttggactttatcctgagggcagtgacaaaacaattaagaggattccgttggaaaattacttgattagtttagcatctcagaagaatcatttgggctgtactgtgcagctgagattggaggagaccagataggaagagaaagaccagttatgatgtttttgcaatgatgcaggttaaaaaaaaaaaagctagtagcctgggctatgttagttatgtggggtggagagaaggggaaagctttaagtcaatcactgattcctgagcaagtgagtacacctggcttcaccactaaggcatttgtggatgaacgaatgaaggaaggaaggaatgatacgtgaacatttaatgtattttatatgtaagtgtcgcatgaatcgatgcaggagtgaaggtgtgcgttctggaataaatgcatgtgtgtgaaagcaaaggccggggtgggctrcgcttggagggagatgtgccaagctccagaagggcctcccagatggccaaggggggagaaactgcccttccaggacagatcggaaggatgaagctctttgaagcwggaaggtacaggctgacagggatggcagatggattggtgtgtgtgactcagtcaggagatggtgaactggtccccagattccagaagtgtccagccagccctcatgaagcaggctgtggctgtggagggcatggaggccctagggtgctgttcctggaaggttttagcaggagagtcctgaggcaatggagggtctctagggaacagcaggtattccctgagcctcagctaagtttcaggtgcctattgaaaaccttattccatagagtgtgagttagggggaagtgggggtgaggagaggcggtgatggctgcctagaaggtggatgggcaagagcccctcctctttgggtgtctgtgggcccacgtcatttggaagctgaggatggtgaagcaccctgcctgaataactctcgtcaggtgtgcagccaccttggcgtaaccacgcccactcccagccctgctgtgtctggttgcccagcagcagggtcttgggactgcctgtcccttagtactgcctcttggaccagtcaggattcctggtttccctggtaacgggaagcacgtcagcagtctgggcgctcccagccggtcctggtgctgcggttgccgaggagacgctgcagcctagctgggccctggcaggtgaggggtggggggtggtgctgggaagccccaagcccagcctcaagcttgctggggctcaggacctcaaagcccacccttgggttcaaactgctgtgcaggtcctggacaggggcgggatccctgaaggccttgaaaccacaccctatttatgctgacagctataggctctgcagggccccaggcagctggggtattccttaggggctgagtctcctggtatccctaagactgggcttggcttaggcactgaggtaaccactggagggtgggatggagattcaggattgggggaggggagccagggcgaggaagaagaggtgtgagcagaaggggctggggtctcatgaacctccctttctcctcccttccccaccccccaaggagattccctagcatggtggtcctggcccctccctagcaagctccaagcgggggaggatcttgcctggcagacgctctgccctggtgagaagggggcgggatgagcttttctctgcagcccagcaccaggctgtgagcccagctggctgggctggaggggctgtgaggagggagggtggaggcaggaggggccgggaatgagcgccatgttctcccaggactttttcctggccattatcctgcaggacagcagcgcaggtgaggggcagcatgaggttgggcctcatgtggggtggggctgacagggagagaagagttagaggacgcatgagcgggttacagggttggagtggtgtggctctgccggcagacaagggtgtatgacacagatgcgaggtatgtgtgtatgtgcatgacatgtttgcttgcatctgtgtgcagcaagggtcaggaagtgagcgtctgtggtgtctgcacacatttggcagggtttgacgtgtgccgtgtgtctgagtgtgggtccgcctgtgtgtgtggtacccacacgtgtrttggggccattgtggtgtggtatctgcacacctgtgtggcaggggctcgtatgtttagctgcatgcacacacacctctgtggtgtctgcataagtgtatggctaaagtttgtgtgtgtgtgcccctgcacatacatgtgcacctgtgtgtgatacctgccatctgtgctggcattttctgtgttgcataccctggtgtttgtggctgcacaggtgtgtggtagggcttgtatgtgttgtgtgtctgtgtatacatgtacgtgtgcaggagctagaaagtgttcaccttcgtgttaactgagataatagatatgtatgaaaggaggttaattggggtcacccaacattcattgctcccttccttcttccctccctgccttcctcctttccacagtgtggccacattagccaccaacagggcccaggaggagacctgagccatgtcccctactggtggccccacatgtggtgactccagactataggctctaggcagaagcaggrrctgtgttgtggtatagctcttccmccmccccttctcaaccatggggtctcagaggggaccgggcataggcaccagctgtctgctctttgggtaggctgaccctcaccaagcctcccacctggcagattccttctggaaccccaacgccttcgagacggattccgacctgccggctggatggatgagggtccaggacacctcagggacctattactggcacatcccaacagggaccacccagtgggaaccccccggccgggcctccccctcacaggggagcagcccccaagaggagtcccaggtgaggctcacaggcctgttrattttgggccaggggtggagggagtgtgtgctgctggagtaggataggacactcactcactactcccatccctcctcctagctcacctggacaggttttgctcatggagaaggctttgaggatggagaattttggaaggtgggtaaggggacctgctttaccacgggatagctggaggaggggcatcattttgatactgattcctcaatccccttcccaaggatgaacccagtgatgaggccccartggagctgggactgaaggaacctgaggaggggacgttgaccttcccagctcagagcctcaggtgagctgccagatgcagtgagctggcagtgggatggatctgtctggaaggggccttgggacagctccatttatgggagccctgtgccaagtattaccatctgccttcagcccagagccgttgccccaagaggaggagaagcttcccccacggaataccaacccagggatcaaggtttgttcaagactgacacccattctgagtctggggccctcttatttgtcagacagcccctaatgttgtgctctgaggggtctcagcgcagttccccaggtcctgagttaggagttcttccagtctcagcacagagccctgtgtctgagctggaggcacttcagtttttaaatcaaccagcccaacagccaggttgggggcccttgtagtcttagttcaggtgcttttttgtactagctggggtctcatctgacatctccctcaccctaaccacatccccctctccctaaccacatcctgtttggggagcttctccgtcttagttcagaacaccctgcctcctgccacactctgtagtcaggaactctccagttttgactcagatcctctacctcctgcccctcttctgtgtctggcagtgtttcgccgtgcgctccctaggctgggtagagatgaccgaggaggagytggcccctggacgcagcagtgtggcagtcaacarttgcatccgtcagctctcttaccacaaaaacaacctgcatgaccccatgtctgggggctggggggaagtaaggacctgagccgggggtagggggtggtactgtgagagtgtgaagggaattatgagmgatgggaggtctgacctgcccacaagcaggctggggaagggggatattggcccatcctaagtggcagccctgtgggatggatgagcgaccccaggccaggaccttgggagatagtsgcctaacaacggtggagtcaatgtgagagatgacacgtgacctccactagagtgaggcctgcagggcgggcggtctgacaccaaagcaggggccccagagctgtggctaacatcccctgagctgcaggggtcagagatcagccaccatcctggctggagtcccactgagtgcctgcttctggtcctgcagggaaaggatctgctactgcagctggaggatgagacactaaagctagtggagccacagagccaggcactgctgcacgcccaacccatcatcagcatccgcgtgtggggcgtcgggcgggacagtggaaggtgggaatagggcttgggattcgagggtgggagttcatccagcatcagagtcctcctctctaactctgttatttgcctctcttgtgctgctggacccagagagaggtactatgcctattttccccctcctacacctggaccagatgcctggaagcacccaagctcccctcttctgccctgccccttcccacccgctatgctccaccattaccctccacctcagcatgcttgcctgtctacccctccccyccaagaaggcagcacctatgggggaccagctgtgggcagaagccctggaggagctgtgatgggcagggaggacgtgggtggggtggggaccaggctcagcactggatggtactgggagacactgaggtgccccttccccaacagggactttgcctacgtagctcgtgataagctgacccagatgctcaagtgccacgtgtttcgctgtgaggcacctgccaagaacatygccaccagcctgcatgagatctgctctaaggcacggccccctccactccctggactagttgccacctttgctctacaagggtgtgggtggggtcactgagtgctgtaggggggccccagggcaatgaggctctaatarattctccctggctcctcgcctcccttccttcctcagatcatggcygaacggcgtaatgcccgctgcttggtaaatggactctccctggaccactctaaacttgtggatgtccctttccaaggtcagtgkcaaaacccctccaggtccagctcagctttgttggcaaaggtgggtgacccaaggaaaggcatgagctcctggacagcgctgatagaaaaatgaacacatgaagactgaatactccaatacgtggagggactccggttaaagggaggcaggggacgagatgaaagtagggcctcggctgggcaagtgtccarcttatgccctgctggtggggctgcgggtragcaaggtctgccaccatgatcaaccttctcttctttcccatagtggaattcccagcgcctaagaatgagttggtccagaagttccaagtctattacctggggaatgtacctgttgctaaacctgttggtatgtgtgtccttctatacccaggggctgctaccttgatcctaaaactctgcccctaccctctgccttccaatacttcttctaccagaccttcctcatgcttggtgtctccctaccctttaaaatgcatcccacctccccatacttctgtcctagctctatttcctgtcctgcctatagcagcagtcagcacgccttcgctgagcatcagccacgtgagtggtgctgaaccaggcacaaagggagaccccactccttcatcccatggaaaagctttggtgggattgggaggctgatgttagatgactggaggacaccagacagcagcctgtagctgggtttagtgttacagcaccagctgtgggctgggagcatctggagaaggaaacagtgagcataattgtcacatacttcattgttgcaaagaattttttttttttttttttttaaagacaagtctcgctctgtccgccaggctggagtgcggtggygtgatcttagctcactgcaacctccgcctcctgggttcaagcaattctcctgccttagcctcctgaatagctgggattacaggctcccgccaccacgcctggttaatttttgtatgtttagtggagacggggtttcactgtgttggccagggctggtcttgaactcctgacctcaagtgatccacctgcctcggcctctgagagtgccgggattacaggcgtgagccactgtgcctggcctgatctggttaactcttatatttcagtgctttcctagtgtctgctatttatttgtttattcacttaacaaatacctttgaagcttaccatgtggcaggccctggactaggcacagggagaacagtggccacagtcccattttcctagaggttatagaaggttatggtagaaaaaaaccaggaattaataaaataatcacacaaataaatgtgtgagttattcgttgagagaaagtagcaagatataacaaaggaatttcatctagtctgaggttgtaaaagacttccctgtgaaagtgacatttgaactgaaatccaaaaaataagtagaagtgaatgcggtcaagtggaatggaggtgggggtgggatgggggaagatcaggktctacagtgggaggcactttggcatttccaaggtactgaaagaaggccaatgcaagatgaggccgacagctgggcagtggtcaggctgccaggtcagggacctcaggggctatgttaatgattttttcttcatcctaagggcagcaaggagttattgaagtctccgagagtgcacttgccttaatcagatttgaattttgaaagctcactttggctatttcatggaggggactgttaagtgggtggaggtggatgtgagcagctcagttaggaggctcttgctgtagtcctggccagtaatgagagtatcttgggcaacaatggagctgaagaagagtgcgtggattcaagagctgtttagacgggtatagtcaacaggcctcagtgattggttcgatgtgggtgagggacaaggatgactcctaagttcctggctgttggaccttctggatagtggattatttctttcaaggtggcagatgcttgaagaggccaatttgagcgtagagattgtgagctcacttttggacatgctgagtttgagatgcctttggggaatctgagaggcaaagtcaggttggcagttagattcacagatctggagctgagaggagaggtctgggctggagataggagttttggcattattgggttgtagaggtaatcaaagccatggatgtagagtagcttggccctggaaagtgggcatcctgaagtgagaagggaaatgaagctagtcatagccttgaggccctccaacattcaatggatgtgtagaggatgaaactgccaaggatagtgacaactggagagaggcaggaagaagaaaagaggctacttgaaraagaagtggtagggtatcatgtcaaaagacacacaggaagaactcaacaaatgtttgatgaatgaaataaaaaatgaattaatgaataaatgagacttgcttcagattacatggccaggaaagctagacctgggagtcaaaccccggtcatctttaattctctgcactttcccttataccgtgctgactttcacgtccaaaatcttacattgaaagaggggacccttcttagaaaaggtggggattgaactgaggttttgaaagaaggtttggatttgcagagtggagtgggtatttcatttggattcgatggcactgccaaagacttggagctggaggtgagaaaagcatgctgacccttacgcctttgctttcctccttctcgtcctcaacttctaaacccttgttggctcttccatttgttacccccattcccatatgtgcttctttccatctaccacttgactctggtcctccctatgccagatcaactgcctgtgacccttgactgctccgcttggacaagtggtctctaaacttacttcctgctttatcttatgctcgtttttaaacattagcccatccagaagctgcaatattcattcattaattattcatttatttaacaagtggtaatgaatgcctgatacatgtcaggcactattctagcttcttggcatgcattaatcaacaaaactgacaaagatccctgcttttatttagctgacattctagcaaggagagacagacaataaaatgagtaaaccatggagtatgttagaaggcaacaactgatacaaaaaaaaaagaagagaaaagcacagcaggattagggggattgcatgtggggctggaggtcaaggtcacagtgtaggttttagtcctgagttatcaaatctgacagcctttttccataccttggtccactgctttcactgcttccctgccaaacttcccaagactctgaggccaggctccatctcccacagccccatctattcagcagtttgactatgatgtccctttcacacacctgaactttgagatttccaattgccctggcctaaatgtcataaacatcacacccctctgcctggcttttgaagcactctgcaatctgacctggcccatccacttctgtgacacttggttttaccagttcgggtgcatttgcccttgttgccttgagagtgacttgctcatgcatctggaatttcttcagcagataagccctgtgttagaattggggacagagggatgaattaaattccatttctgttcttgagatggccacggcccagtgtggaaaaaagttttccagcagttacaagacgttatggtaagagttgtctcagagttgtcctctccctgccctgcagcaggcatggcttcctagacagcacctagttggagccctgaaggatgacagtctgaagtttctcagtccagcagggaaagggcactcaagacagaggcttttccctcagttgcagtctgtgtctctcaagggcattctcttctcttgctttgtattccccatctgctttacaggccatttgccaagattagttgttaataataatgctacacaaatcatctgaagctcagggagcagtaaaatatgaagcttgacagctctggtgaggccagtttttggaagacttgtatgcttttgggagcagtttggccttgatccagctagaagtcagatgagcaaggccaagatgggagaagacatgcaaggaagacatttgtcctctgcccaaaagagtccacgtggtctgctcctagtgggagctgagagccactaaaaggggcagagggcctgggagtggaccacagaggcatgtgccttttgcactggcattgtgcagagacagtagatcacacagccagcgtatgagtgtggggactagaactgatgcctttgccacaacatgtgctcctgccttggtgctctgctgagtgcaagcaaaagtgggatccatgaggggaaatgtttaacagcagtttgaggtggaggaggccatgtgttataagggaaagttgattgatctgaaagtcaggaaccttgggttccttggctcttgagcacattatagacattcttgagtagaactaagatcttgaaagcccttctagttctgaaaactagtaatatagagaagaggtaggagaaaggcatggctaagaacccaggctctggaatcagactgcctgagctcaggtccccattcctcgatgtgacctaaggcatattacctatctcttccgtttccttatttgtaaaatggaaataaagtaatctattgtgatgttgttgtgtgggcacaaatgaggtaatacactgtaatgacttagcacaatgtgatacagagtaatcactcctcagatagatatcttaaaaaataattgggtcttgggagaggactggcctgtagggyctgatttgggagttattgtggtgtgaagcaatgtgatgtctgagtgtgatgagcgctgagagagcatgatttggggaaatcagaactttgagaggtcagtcagttcagaagtgtggaggaataggcagagccggtgaaaataacgagcctaggatccaagattttaaaaagtaggaaaatgtccagttactgaagccaggggaggagagccccagggaagggatacttggacagcgttgtccaaaatgtaggctggcaaagtggggatggggcaaaggccctgggtttgattgggtggaactagaggtccagggtagagctggggtatcctctgtctaccctcagtggtatcttgtgtccatatgttctaggggtagatgtgattaatggggccctcgagtcagtcctgtcctccagcagccgtgaacaatggaccccaagtcatgtcagtgtggcccctgctaccctcaccatcttgcaccagcaggtaaagagctggggtagaagtcgtggctgcgccttgccatagaggggagactgggggtgaggggaagagctgctaagatggatgtggaacacagtgtggggttggtgttcctttttaactgagttccctccatgcagacagaggcagtgctgggagagtgtcgggtgcgtttcctctccttcctggccgtgggcagagatgtccacacgtttgcattcatcatggctgccggcccagcctccttctgctgccacatgttctggtgcgagcccaatgctgccagcctctcagaggctgtgcaggctgcgtgcatggtaagctactagtagggtggtgtggtggtggcgtggccccatgggaggtaggctggrgagtgactgccctgcttgcctccgcagcttcgctaccagaagtgtctggatgcccgttcccaggcctccacctcctgcctcccagcaccccctgctgagtctgtggcacggcgtgtagggtggactgtccgcaggggtgttcagtcgctgtggggctccctgaagcccaaacggctgggggcccataccccatgaagaagcccccaccttccctccacctgmttgtgttgggccccagggaactaaagggtgtgggtcagggaggggtctagaggctattcctaggcctcaggcctcccaratatgcccctccccagtagstacggttccctgcctaggagctggggagggagagatctaatcccttcaaggaagtgataacactggagtggtaacaagaggagcaggaagcaaggccagccctggttctccatccccatgtgtttcaggtggaacaggaggaactggtccaggccaggcctcatcctcctggacccagcaggggcagaaggaggaagggactggtccaggcatgggtcccttccccctgctccatgggcacctctgctgtattgatatcactaataaagtctgtctgcactgctgtgtgccttcttatgcctgtaccacaccatcaacccattagcctgtgcctcagttatgatcttgctccaaagatctccttgccctgcttgcctggaaagaagaaattgggacagtcacacaggggtctggagtccaagtctcttatctttattttaacagactggcagcatcaggtcgcagcagcagtacagggttcctggctgggcagcacaggcctggggcgacagctcctgtcttgtctgcccagggcagtgtcaacttaggcctctactccatggctgtgaaaggacagcagcctcaaggcagtctagctcctgggcacaggcagccaaaccccctcccatatccagctaaaccagctccaggaaaggagaaggtcctgtttccccggcatccttggggcccagggactggttctttcaccggatgatcttgcctggttgaaccacagcagcatttgggctttttcaccctttcctacatcaagaactttcccaaatgtgggccctggggccctagcaaaacagtggccttggccacaggctctgggcctctgggaggctcccatctggcatcaggtggcggcacagagcagggctgtcagcacgggcagagagctgggcacaaagagtagccagacggcagggcgtgccacagggctccgagggtgggtggcccttatggtagagaaaccagaaggtctggaaaagttgcatgtcgccccgcatgcgatataccaggttgtgccaggcggtaggcagtgtgttgggcagcccataggtttctcgagccctgtagagaagctgccagtgcggtatggctcccggtatgtttgcctgggtcagattcaggatgtaggtctcatggtccaggaccacgtgagagctcccggagtagtttccatctatttggtacacacggtaacctgcaaggatgtggggctgactggaggggcaaggagcaagggtaactccagggaggggccacacatcctgcccatgctttgcaggctctggctccaacctccttcccctatcccaccaactccaggataagggaggctcccttctgcctcactcaccaggattaaggccgatgtaggtagttgcactgggtgccaggaaggctacagccagcggccggctcagagtctcttcatcatagaagacctcaaattcatccacatgagtgtggccaaagaactgagcagccagggtgttctcatacctggccagaaggtactacattcagaagattctagggaggggtaggaagacatctggggagataggatgccctctttctccaacctgttctagtgaggagcctccccactccatgggacaacagggatggtgagatgctcaagggaattttcagccttcagacactcaccctgtccctattcccaccctcatctccgtcctacctggctacaattcggtaataattccagctccagctcttcagacagtgccctgggggaatgtggccaattatatgcacctagtagggagaattaaggatggtaatcagggcatccaggggtccaggcagccctggctagagaaagggggactgaatgaaggctttcaacagtgaccatgagctgaatccccagggaacacttgttgggaatgccaggaaaataaaacttctgtgcccagaggtgctccagctcaacaggagcctgcttgtcccccagcaccaccgtgttcccactactggccctcactttgtctcctcgatcctcagcagcctgaagctcccccaccagccactggagctgtcctgcgggatccgtggagttgatcaagagccagaagttctcacgggaacaaaaattcatattgagagagatgaggcggagaccggggtatggggaaagagcatagaaccccccaattctgaaacaaagtaaacatgagaggtcaacacttgttccaatcctggtcctcctgtgctgggcatttgggtggagggtaaaagcatacatgacatcttccccacctgcaaggagctcacagtctagccagagaccaaacagttctaattattgggtctgtgtgacacaaaagactctgagggcagagggctccaggagtatgggggagggataagagttagctagaatgggaagcaaggaccacacagagggaagatgacatgggatggataaggtgggaaaaactggagcacttaaaaaaaagggggaaatcatttccagagggccaacatgagcaaagacacagctggggcatagagaggttatgctgccagacctttgaaggagggtggctggagataagagtagaaagggagggctggaaagctgggtgcagtggttcatgcctgtaatcccagcactttgggaggccgaggtgggcagatcatgaggtcaggagatcaagaccatcttggccaacatggtgaaaccccatctctactaaaaatacaaaaattagctgggtgtggtggcgtgcacctgtagtcccaggtacttgggaggctgaggcagaattgcttgaacccaggaggtggaggctgtagtgagctgagatggtgccactgcactccagcctgggcaacagagcaagattccatctcaaaaaaaaaaaaaaaaaaaaaaaaaaaaaagggagggccaggagcagtagctgatgcctgtggtcccagcattttgggaggccgaggcgggaggattgcttgaggttaggtgtttgagaccagcctgggcaacatagcaagatcttgtctctacaaaaactaaactaaaaaaaaaaaaaaaaaaaaagcctggtgcggcaaaacagtagaaagggaaggaggagtcagattaggggagccaaatgaagagcactaaggactcatgctagagcaatcagagacaatgccccaggttcccttctcccttcactttcattcacctttcttttcccttcctgggtttccacggacgataagtacctgagggtgcgcagggcttcggcaggcagccagggctcccaagccttggccatcgcttcatagagccagcgggaggagtggttgccctcaatgaaggggggagggaagctattgacaggtgtgctttcatggttacccacagcagggtacactggcactggccccaggaacttcctcacaagtgctgtgacggtggtcagggcccgcagttggtcctgacgagtctggtgccagacatcatgtgcggggatgtctcctgtccagtacaccatatcaaaagggccggctgggcccagcccactcaacaggctctccagggtcctcaggggcaggtcacacttgctgtattcgccccagtatccggcacctggccgggatgcgggcggcaggccagaaccccggcggcagcacagtgggtctgcacagtcagggtccgtgccctccaggtagtcatgatcccagtgcaggtcagtgaggaagaggatgcggctgacaggggcacctggggctggggggctagggggtttggggggcggcttcggcacagtaggcaaagagatgttccaagatgagaaaatgtcccagtgcccacaggtggagcccaggagcaggccacaggcctcagatgggctcagcactgagcgtctccacacctccaccatgtcatcctcaaagaggtggacaatggattggcacacggcaggtggtgctatcttcagcagattgcacagcttgatggccacggagcccacgcgagccacattgggttccttctgcagtgggaggagcgcatggtgagaaatcagaggcagagcagaggaaccaggccaacccctggccaccaccccttgggcctccatttccaaactggggctgggcaggactcagtgcaccaagctcagtgcacacctttgccttccagatattgccctgtaactcaggcagcaccaggccatcgcttcttctttagctcagcggcctgtggcatgaggcctttgcttggcaagctgacttcctcaggcactgtctgcattattttcttacttcacaaaggtcacaatggggtgatggtggcatgtagccatgggtgtccccaaaggggagcaaactcagtgatggattgtagatgccaccctctccatcagggatgcattctgagcccagcgcaccagcatcagccccagcccccagccccagcactcctttcggcctcctccactgcagccccttcagtgctcaccttcagcccgaggttgatggcggtgaatagacctttgcagattgggcaggtgaggttcccccacccaaagacatctcggagccggggcactatgcgatgtaacctggcaggatggccttggggagaaagagggtgagcctctgccggagcccagagaacccgagagtcagacagagccagcgccagcgccagcgccagcgccagcgccagcaccaggcccatccaaaggagtccgggggctccggcggtcccgtcttgtccctgctcccggccggacctggggcagctctggcggagtgacgctccgtagcggggcattgtcgcgcttcctacacggggctggttcgtctgtcccgtcccccccggcctggaccctagccagccctcagggccccgggcggcgccggggacacccgattacccttctctgtagtcggctgactgctccgcggccggccgcaaagcagctccgccccttcctcttcctctgatctctgacagctgatctctcggtggcgggcggctgtcaacgctgcgtaggctggggttgcgtgggggtccgctgggccgccccgattccgccccctctccctgcccccgccctgccccgggcgcacgggctgcgggggtggggactctccctgaggtcaccaggggctccgccttgaggtcacagccgcgggaggccgtgctcgtgctttggagctccatgtgatgtggtcggtggaagacgtctcctttgtcagaatccgcgctcagattcccggaatagctgccagaccgaccccagcgtttagcccgggaaggggaggtaggagagagcagggcgggcaggatcctcccactgggtgtgttgcctctgacaggaaggcgccttccctcgattccccatgctctgccactggcaccagccctcttgagtcaccctgagaatcactcacctgtgattcagatgaggaaacaaaccttagagatggtgaagagactaggaagccgtaaagaccatatagccgtgggggccaataacatgggcgggaacccaattgggtctcccacctccgtgtatccacgacagtaaaagcgagcatttatggagttgtttatgatgtgccaagcaccaacccaggcactttataattaataatcttcaattctcacaacaaccctaagaagtacctattatattggggctcagaaatccatacccaaaatatggtggtttgacttactaagttaagccttaaggtgtgtctggccttcctactcccgcgccctctctcccaaagccgttacctagcgtccagacccatcaaaaggaacaacggtttttttcttcccctccctacaaaaccaagaatataatcacacctgaacagaccccttcacatgataatgtgctagttaatctgttccctgatccattccttctccctcagcagaattcctcttcccctcactcccacaaccccctttgcctgaatgacacctaagcttctgaactcgtctgggaagtgggtagtcactctgtggttccccgtggacacattaatacaatttctatgccttttcttcaattaatctgttttttgtgggttgatttttcagcagaatttcagagggcgaagggaaagtttcccttggtccctgcaaatactattattaccctcctttacagataggatgaggcacaaagaagttaagtggcagaatagcaattaaaccctaagctgtttgacgagtgcttctgaggaatcctcagagctatcaagtcctgtcagttctttcctttgat

SEQ ID NO: 17950 - DNA, 50529 bp, Homo sapiens
  misc_feature (1)...(50529): n = A,T,C or G, or insertion/deletion polymorphism (see Tables 1-2)
gagcgagactctgtctcaaataataataataataatattccatattctattgtatggatagaccacattttgtgtatccattcaccagctgacggatatttggattgtttcttctttttagctattatgaataatgttgctaaggagatttgtgtacaagtgtttgtgtggacatatgttttcagttttcttgggtataaacctaggagtggaattactgggtcatgcggtaactctacacttaactttttgtggaactgccaattttccaaagtggctgcaccattttactaaaggctaaatttttttttttttgagatggagtctcactctgtcgcccaggctggagtgcggtggtgcgatctcagctcactgcaaactccgcctcctgggttcacgccattctcgcgcctcagcctcccaagtagctgggactacaggtgcccgccaccatgccaggctaattttttgtatttttagtacagatggggtttcaccgtgttagccaggatggtctcgatctcctgacctcgtgatctgcctgtctcagcctcccaaagtgctgggattacaggcgtgagccaccgtgcccggccccctaaaggctaaattttaataatcattacaatcttcaggatctgactcttgcttcccatctctttccctgtcttttaccacaagcagtagctccaccagtaaataccactcatagctttctcatgcacaccatgctgtttcttgactctaggcctttatttctgcttcaactgcctggaaaacctgctagcctccactcccttaagacaactcagtggtcacctcttctctaaagcccttctcgtccccattcctgcttcctcaggaaaagataggtgtctcttcctctccacacctatacacatagctattaacaaactttaaatgtcatgacatactggatttcataactatgcttcttcatctgcctcttgcactgggtggaattcttttttccttttttttttttttaaaggcaggatcttgctatgttgcccaggctagaatgtagtggcctgatctcagctcactgccacctccacctgctgggctcaagccatcctcccccctcagcctcctgagtagctggaattacaggcatgtgccatcatgcccagctaatttgttttttgtatttttttagtagagatggggtttcaccactttggccaagctggtcttgaactcctgacctcaagtgatctgctcgcctcggcctcccaaagtgctgggattacaagcatgagccactgctcctggcctcaagagctcattctaatgccatcttttcaacaaataccttttctgatcatccccctcagcaaaaaaaaaaaagaaaaaaaaacctctcatgggactcgctttcattatcatatttaaatttacattttgtttacatacacatctcttctttttttcttttttccagtcttacccctgtataaactggatgaagctgctgccaatttaaccaagtgggaatcccagtgctaattgtctgctggatgggatatctttattggagcagattaacatagcctcaaatttgtggtttgtgaccactgatttagcaaatacattgtttttcttttttctttttctttttcttttgagacagggtcttgctttgttgcctaggctgaagtgcagtgtcacaagctcagctcactgcagcctcgacccccaaggctcaagcaatccttccacccagcctccacagcagctgggactacaggcacatgccaccaacgcctggctaatttttttttttttttttttgtggagacagcatttcaccatgttgcccaggctgatctcgaattcctgggctcagctgatcctctcgcctcaacctcccaaagtgttgggattacaggtgtgagccactgcacctggcgaacatccttttcttttttgtttttttcctttgagacagagtttcgctcttggtgcccaggctggagtacaatggcacgatcttggctcactgcaacctccacctcccgagttcaagcgattctcctgcctcagcctcctgagtaggtgggattacaggcatgtgccaccaggcccagctaattttgtatttttagtagtcagggtttctccatgttggtcaggctggtctcgaactcctgacctcaggtgatccgcccaccttggccccccaaagtgctgggattacaggcctgagccagcatgcccaaccaacattcttttctaaagcatgttggtcagaagcagtccaccacggaggggatgaacaacagtatacagtcatggtctttcatcagggctatgttaattctgttctctgtcacgatgtaatctaaaaaatgtggaccatttgcacattctgcagagtatcacattggtccaccatcttgtaactttacatccttcagacgtctttttttttttttttttcttttttttaaagacagagtctccctctgttgcccaggctgaagtgcatggtgcaatctcagctcactgcaacctctctgtctcccggattcaagcgattctcctgcctcagcctcccgagtagctgggattacaggcacacaccactatacctggctaatttttttgtatttttagtacagacgaggtttcaccatgttggccaggatggtcttgatctcctgacctcgtgatccgcccacctaggccttccaaagtgctgggattacaggtgtgagccaccggacatcttttaagtagaatgaagactacttagaggtaggaaccaaccctaccttggtgatttttgttcctccaaatatctttgcacataataattcaatatttattcaaagaaaacgttatatactgtttcataccacaaacaagattgttctgtccttgaaaacaaaaccttttgtatctttgaatcaggaaatattctataaatgcctattgacctactaatttcctcttccctaacaatcagatactctaccaggatatgtagatatcttcttcagggcaccttgcacttagcagagtcccaaatattttattttctccactctagcaccaccaaatcatgtaaagtatacagccactcacatttcacatcaacctctccattcttatgcatagctccttccagccacccctctgaaaactgactctcctaaacatttccgtaagacccaggatcatgttttcatatatacccatcaatccatttatccaaaacccacttgtaatttaacaagtgctttttatttttattgaagatggggtcttgctatgttcctaaggctggcctccaactcctggtttcaaaggatcctcccacctcagcctgcagagtagctgggattataagtgtgctccaaccaccatgccccgcaacaagtatttattaatctaacttcacttttatggagtttttgttttttaaaatatagagatggggtcttgctatgttgcccaggctggtcttgaactcctggcttcaagcaatcctcatgccttggcctcccaaagtgttgggcttacaggtgtgagccactgcacccagccctaacttcactttttttttttttttttttttgagacagtctcaccccagttgctcaggctggaatgcagtggcatgatctcagctcactgcagcctcaaactcctgggctcaggtgatcttcccacctcagcctcttgtgtagctgggactgcaggcacgcagaaccatgagtagctggaactacaggcatgcagaaccatgcccagctaagttgttttttttttttttttttttgagacagagtcttgctctgttgctcaggctggagtgcagtggcacgatctcggctcactgcaagctccacctcccaggttcaagtgattctcctgcctcagacacctgagtagctgggactacaggcgtccgccaccactcctggctaatttttttgtttgtttgtttttgtattttcagtagagacagggctgtgttagccaggatagtctcgatctcctgagctcgtggtccgcccccctccgcctcccaaggtgctgggattacaggcaggagccaccgcacccagccactttatttttagtagagacggagtttcaccatgtcgcccagaccagtctcaaattcctgtctccaagcaatcctcccacctcagcctcccaaaatgctgggattacatgtgggcaccattctgcccagctgtaatttttaaaaattattattaaaaaagaacaaaacacatagatgccctagactcaactcagctctactgatcaatctttaggggttaggactaggcttttgaaatgttaaaacacccagaaaactgatgaccagtcaggcttagtatcccccatctctaccattcatatggtacttaatgtttcatatttaaatggaaaggacacctcacacttttttgtttttcctatagttcctactcagagaatatgcctaataaatattttatgagagtagtacagaagtatgactccatttttctcttatatttcatttcagtgtggaaggctctttagaaacactattaacataacagcattatgtcaaaaagcgccaataacattctcaccaacttttctttttaaaggcattaggtatagctagactgtaaaaggcaagtggtgtgaagcccaaacctaagatcctaagatctaggatgagtcaagacttcatagtctacatgagtagaggcagcatctagaggaaaacaaaagtatgtggctatcaaattccaaagaagccccattttattacagagaaaatacaaagccgtttcctcacagggaaaagtacagtttcccttctccagggtgacagatgagccttttccgaagttctcagctttctcttctatcgaaacttcccatgtcggttaaagtgtttgtagagatagcggatgcgtttattaaggttgtgcaggtcatcagcgaacattctacttccaaccattttcctctttcggatacaacgttgcaattcattccctttccaacctcgaagccatatgggccccctgatcagttctttggggtgcttttcaaagtttcctgtgtaatgtgagagaacacattagatccaagacaagagaactcatcctacaccagctaagctttcaacccacggttgcatcttgctgagcagcacctatagacaaggcacattacagtacagaacaatagcacagactctggagccagactgcttggggttaaaattctgatgctgccatttattaactctggaaaaattgtttatttttacttatgaagtaaaaattatacgaggggactcagaacagtgccaaacacaatgtaaacagctacataagtgtttgctcttactattgagcacagtaccactctctacacaggaggaaaagatagtcgttacagcctaattgccattctgaaattgtgtaccacgtcgaaggtcaagtcttacccaggatcccgatgttgtcatacactccgaacatggcccttttctcgttccaacgatcaaccactttggggggcgggagagtgagccttataccgatcaatctaggcacacctggggatggggaagggagggaattaatctgagccgcctattatactacgaagcagttatcggggtgcctacatcagccacttaccaagagagaagcttctgcacgccagaggcacccagtcccacaggcgcctacctgccccggataagaggttccctgccatttctctagtctccccccttcaacagcacaccaaataagcccaagaagatgacaggaaccgtccccgccaacttcacacgagtactaaggcgaagacagccatcttgggccttacccaggtagctgtgggcacaccgcccacctacgccccatccgcaacagccacaagccccgccccccgggttccggcaggaggggcctctaccacccttcccgcctcagtgcttccggtccgcctgccggaagttttggagcgccggacaagctgaggtccgcgactcgtcgctaagattccccaaaactgagatttcaagaaaattcaccctttccgctttctttggcgcccttcaaccgtgaaggaaatgaaggttgagaacctggaacccgcttccaatgaccaagccctttctctgtgcctcacaacagtcttgcgctgtagctgtttttattacccctattttactactggggaggagatttgaggtcctgaaagtgaagtgacttgctggacgtcacttagcagaggagatggcgaaacctggattagaggcgatgccttctaactcccagcgtggacttgcctcctttcctgggggtgactgaatgcccagccagggacgcgacgtctctggccagcagaaatacggcctcctccccgccgactgggcaaagggggaccttgcggccaaggagggattcgcaggcgggccgggggtgggagcgggggccggagccggagccttggcccgcccccgggcggcgctgtgattggccggccgctccggcgggcgtcgcgattggccgtcctgcagccgttgagatttgaactcggtatttgtggctttgcccgcgcgttgccagactcagaggcggccctttgcctctgcctgccggggattggccggattctccgccgacttgaaaactgccttgctaattggtgcgtgttgtgcacgcgtgttttttccttttcatttcagcctgactgccggaatcagagccgcgggtgagatccccaggtaagatgtggtgttgcaggtcgtaaaagagtaggaaagtcgagtacatggcagtgtgacccagtcttgggcaaaatacaataggcctagtaggtatatccctggggcgcgatgtgtgagaaactgtaagtctgacagatccgcaacggaagttgttaagcaaatcgcttaacagatccgcaacggaagatgttaagcaaatcgcttaactttcttacttcaatttccgctctgtaaactcatttgtattattatgcacctcatgggattgaggttaggatacttagatcagatatgatacatgcaaacagcctaacagacttggcacaggataaataaatcatcattgttaatgctcttaccattctggtgcaggaagcccactagcccatgctggggcactgttttggcctcagacgagatcagaccattctctctatacttaaggagctttgcacataaaaatggaaataatagtactttgcacattaatatgccactttatagttctttaaacaccttcgtactgcttgatttgtttgatcatcagagcaactttatgaagtaatcagagtttagtaaccctgtttttacagataaagcccagaggtttaagtgtcaagaccaagtgccaaagtcactactagaattagtttctagtccagggtcaatctcagatcccgtaagataatgttactagcttgctataaaactaaaarccattatatatgttgggggtggggaactaacaaaaccagatgatgttactagcttgctataaaactaaaagccattatatatgttggggatgggaaagtaatagaaccrgatacgaagacaggtcttgaatatagaccctgactttttcactgtttggtttctagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagaggtaagagtccatagctgtcactgkacytagctctttcaaaggaccatctcacatggaattgctacattgtcatttctgttccactacaccaggaagcatcataagagcaagaaacatgtttttcctattttgctgttttatcctaaaattgcatgggatgcatgacccaaagagtacattcattaacttccttttctggattagtcaaaaacagtcttggtgtatgtgattactctttggggaaaagttattttccatctttaccccttactgtgtgtcaaaattaagtcctggtggatttaagagttataggagtggatcgctttttcagaatgtctcggacttaactcgacctgtttttggtaatacctttttggagtctttttggatgtgcaattatggggacaaaaacccataatatatatgtaccactgcaacactgagcaatatatgtacagtgcagtcacctactgaaacctgtaaatgatcaaaagcaccttttgcattaccagaaagacttcataatgtccttgtacttgttgggagcggtcttgtagcagttagcttgctttggagaggtatagagattaaagactggagccaggctgcctggatttgaatcctggttctaccactctgaccttagacaagttacttaattgtctcagtgccttggtttcgtcatctgtaaatatagagataataaccaattcatttgttatcacctacaagaagaagggttggttaatgcagcagctcgacaatatggtcctagcttgtctcctcttggcttttctttcatggttgctagatcgcaacttctttttgtttttcttttttttttttttttgagacagggtctcactctgttgcccagactggagtgcagtgatgcgatatcggctcaccacaacctctgcctccccaggctcaagcgattctcctgcttcagcctcccaagtagctaggattacaggtgcacgccactaccgcctggctaatttttgtatttttagtagagacgggatttcaccatgttggccaggctggtcttgaactcctgacctcacatgatccacccaccttggcctcccaaagtgttaggattataggcgtgagccactgcaccagtctagatggcagcttcttgctctaatgtccagaagtggaaaaaggaattttctttttgtactttttattctttattttattttgaaagacaaggtaaagactctcttgcccaggctggagtccagtggcatgaacacggctcactgcagcctcaacttcccagactcaagcaatcctctcacctcagcctcccaagcagctgggatcacagacatgcaccaccatacctggctaatttttaaattttctgtagaaacagtgtctccctatgttgcccaggctggtctcgaacttctgggctcaagcagtcttcccgcctcagcctcccaaagtgctgggattgcaggctggaatgcagtggcctgatcacagctcactgcagcctcaatctaccaggctcaagcagtcctcccacctcagcctcccaagtagctgggaccacagacatgtaccaaagtgctgggattgtaggcatgaggcaccatgctcagccagacttttttgttaaaaactaaaacacctacacacattagcctaggcctacacagggtcaaggtcaccaagaagtcactagacgatgggaatttttcagctgtattatatttttatgacaccactgtcgcatatgtggtctattgtttaccaaaatgttacagggcacaggactgtacaggtaagagaaatagaattacccagactggtttaactgatcaagcttattacctaggagcctccctaaacttgagcatatcaaccatttggtaagcaaggaagaaggcagagtgtggaggttgcctaatggatggcaaaccaacagtgtccacaggtatactattctgtccatatcatgtggatatatgtgtcaccaattgaacatgctgcatactatgacaaactactcttcacttattataatgatgcatcatttttttaaatggtcaccttttttttttttaagttctggagtacacgtacaggatgtgcaagtttgttacataggtaaacgtgctgtgttggtttgctgcacctatcaacccatcacctgggtattaagcccagcatgtattagctatttttttcttatgctccccctccccccattccaccctctaacaggctccattgtgttgttcccctccctgtgtccatgtgatctcattgttcagctcccacttgtaagtaagaacatgcagtgtttggttttctgttcttgcattagtttgctgagtccctgcaaaggacatgatcttgttcctgtcacttttttgttgttgttgttgttgttgagactgagtctcccttctgtcacccaggctggagtgcagtggcgcaatctcagctcactgcagcctccgcctcccgagttcaagtgattctcctacctcagcctcctaagtagctgggattacaggcaatgccaccacgcccggctaatttttgtatttttagttgagacagggtttcaccatgttggtcaggctggtctccaactcctgacctcatgatccacccgcctcgacctcccaaagtgctgggattacaggcgtgagccaccgcgcccagccacttttttttttttttaaagagtcttttgttttttggagacaaggtctcattttgttgcccaggctggagtgcagtggctccatcccagctcactgcaacctctcgggctcagccgcccgagtagctgggactacaggcatgtgccaacatgcactgctaattttgtgttatttgtagcaacgaggttttgccatgttgcccaggctggtctcaaactcccgagctcaagcgatctgcccacctcagcctcccaaagtgctgagattacaggtgtgagccactgcacccagccaagagtcctttttaaaacaattgcattgctttgatgattttggtgtttagaatcctgaatacaacttctcctataaataagatcaaatcatttaattcatttaacaagtatttactgatcatgtgctgtgtgccagacattgttctaagcattgataatacaacagtaaacaaaacagacaaaatgacaaagttcttcctttcaaggttcttaacaagtaataaacaagtaaatatgtagtacagtaggacccttatcccaggagatatattccaagacccttattagatgcctgaaactggaatagtaccaacccctgtatatactatggttttttccctctacctgcctacctatggtaatgtttaatttacaaattagatacagtaagagattaacaacaattctttttttttttgagacggagtcttgctctgtcaccgggctggagtgcagtgctgtgatctcagctcactgcaacctccgcctcccaggttcaagagattcccctgcctcagcctccygagtagccggaactacaggcgtgagccaccgcacccagctaattttttgtattttagtagagacgggtttcaccatgttggccaggatggtctcgatctcctgaccttggatctgcccacctcggcctcccaaagtgctgggattacaggtgtgagccactgcgcctggcctgtttaacaataatattaataaaatagagcaattgtaactatgccagcatcactacccttgcactttggggccattattaagtaaaataaaggttccttgaacagaagccctgcaacagttgatctgataaccaaggtggctactaatgggtgagtagggttgcatatacagtgtggatatgttggacaaagggatggttcacatcccaggcaggaggcggcagggcagcaccagattttatgctactcagaatgacacacaacctacaatttatgaattgtgtatctctggaatatttctttctttctttctttttatttttttaagataagggtcttgctttgttgaccaggctggagtgcagtggctcaatctcagcccactgcaaccttcacctcctgggctcaagcaattctcctgcctcagtttcccaagcagctgggactacaggtaagtgccaccacgcctggctaattcttggggggtttttttgttgttctggagacggagttttgctctgtcgcccaggttggagtgcagtggcaaggtatcggctcactgcaccctccacctcacaggttcaagcaattctcctgcttcagcctcccaagtggctggaattacaggtgcccaccaccacatccagctaattttttttgtattttttagtagagctggggtttcaccatgttggccaggctggtctcaaactcctgacctcaggtgatctgcccaacttggcctcccaaagttctgggattataggcgtgagctactgtgcccagcctatttctggaatatttcatttaatattttcagacttgagattgaccacgggtaactgaaaccccagaaagtgagaacacagattggtgaggaccactgtgtgtaagatggttgtaagagccaaagagaaaaataaagaagacagtgtggccaggcgcagtggctcacacctgtaatcctagcactttgggaagccaaggtggttggattgctcaagctcaggggtttgagaccagcctggccaacatggtgaaaccccatctctaccaaaattacaaaaaagttagccaggcgtggtggtgcacacctgtagttccagctacttgggaggctggggtgggagaattgcttgagcccaggaggcaggggctgcagtgagccatgatcatgccactgcactgcaacctggccacagagctagaccctgtttcaaaaaagaaaaaaaaagaagtgtactgggaatggtggcttgtccctgtaatcccaaccacttgggaggcagaagcaggattgttaaggccaggagttcaagaccagcttgggcaacatagtctctaaaattaattatacaaagcttaaaaataaataatataaagaagaagatagtaggacctgtcatttcatgttggatcatcagagaaggcttkctgttacgtcacgtttgagcagagaccttaagaaagtaaggaaataaactatgcagattgttagggaagagcattccaagcaaacagaaaagcctatgcaaaggccttgaggtgggcaaatgccaatagagttggagtgcattaagctaggaaaaagagattaggtaggaagtggtacagattattctagaatcttgctcctcaaaatgtggtcctcagatcagcagtgttaatatcaggatctcatgatctgggagcttattagaaatgcaggatgtcaaggcccaggatgtcaaagctgctgaatcaggaaatctgtattttaagaagattcccccaggcaatttggatgcaattataagcttgagaagcactgatctctagagcctcgtagatcatggcaaaaacttgaacttcagtgtgaatgaacttgaaagccattgggttttgagcatgggagtgacatggtctgacattttaaaagattcactggcgactgtgttgagcagagactataagaggcaaggagagaagcagggatactagttaagtggctaatacagtaataccaagtagattggactggagggatagcaggggaagtggtgataaaacgactcaggatatattttcaaagtagagcttttacaggaatgctgatggattggattggattatagggttagtaaaggaatctgagatgagaatgattacaaggctttttttttttttttttgacagtcttgctctgttggctctgtcacccaggttggcgtgcagtggcgtgatcttggctcgctgcaacctctgcctcccaggttcaagcaattctcatgcctcagccacctgagtatctaggattacaggtgtgcaccaccacgcctggctaattttttttttttttttttttttttttgaggcagagtctcgctctctcgcccaggctggagtgcagtggcaccatctcggttcactgcaagctccgcctcccagggtcacgacacctggctaatttttgtatttttagtagagatgcggttttgccgtgttgtccagtctggtcttgaacttctggcctcaagtgatctgcctgcctcggcctcccaaaatgttgggattacaggcgtgggccaccacacccggccttacaaggctttttgacttgagcaactagaagaatgaagttgccatttactgagatggggtagcatatgggagggagaggtttagattgttggttatgtgagtgcagagttcaagggagaggttgtcagctaaagatacacatttaggatttaatactcagcgtgtagacagcacttaaagccatgagattgcagtgagtgtagatggagaagagcagcagtttgaagaccaagacctgagacagtccagcatttagaggctaggaggatgaagaagaaccagtagaagaaattaagaagcagtcattggggcagaaagcgaatgaaggagctaaatggacgctaaataaagagagtgtttcaaaaacaaaagagaggtcaactgcagattaactactggatttattgatgtcatagtcactggcaaccttgacaaagctgtttcaggagatggtgggggcaaaagcctgctaggaataggtttttaagaaaatggaatgacagagattagagatgatgaatttacataatgtatttcttttaagatgggcagcattatgtgtgtctatattgagtaggaatgatcagagagggaaaagctgatgctgcagaaggaagagggaacagttgttggagcagtgcctttagtaggtaagagagtacgtgatctggtacacggggaggagatggctttatcagaacatggacagtttatccacagtagcaaaaaaaaaaggcagagtgtatgtatgggcatagatgcaactagtgcaggtaaatatagagcttggggcagttgaaagttctcttctgtctgcttctgtttcctcaataggaagggaaagcctttaactgagagtgagtttgggaagaaggtcatggtgttatgagcagaggataggtgtgaaataattgcctagaagaaaacgaatagacttgggagtacgaatgcccacttcaggttagtagtcatgagtttaacgtaagactagtcagcttgtttctgtgtttttctcaggccatttttatttgtgtggtcacatgaatggagtaaccagaaagttgrtttaacctagatttgccaggggagtatgtgttgttgttgttgttaattagtggaataagttacaagtatcacagtatctaacaataggggaatagtaaattaagatagatataaggccgagtgtggtggcactgcctgtagtcccagctactcagaaggctggggcaggaggatcgcttgaacccagaagtttgaggctgcagtaagctatgatcctgcactgcacttcggcctgcgcaacacarcaaaccctgtctcaaaaaaaattgtttacaaaggtgtttttgttgttgttgttgttgttgttgctttttttttgagacggagtctcactctgtcacccaggctggaatacagtggcactatctcggctcactgcaacctcctcagttcaagcaattctcctgcctcagcctcctgagcagctgggattacaggcgcatgccaccacacctggcttttttttttttttttttttgkatttttattagagacggggtttcaccatgttggtcaggctggtctcgaactcctgacctgatgatccacctgcctcagcctacaaagtgttgggattacaggcgtgagccaccacgtctggcctacaaaggtttctaatacacttactgtaatgctaaattttaaaaagcatgacagagaagtgaatatgtgatacaagctcaacaatggaaatacgatgtatagaaaatggactgagaaaaattatgctgttataactgaatgcctgagactggatatttataatgaatagaaatttattggctcacatttttttctggagactgggaagtcccaaatcaatgcaccagtaactggcaagggccttcttgctgcattgtcacagggcagaaggcagaagggcacaagtgaacccactccccagagccctttttataatagtatgaatatatcggtgaggggttgggcacggtggctcacacctgtaatcccagcactttgggaggccgaggcgggcagatcacaaggtcaggagttcgagaccagcctggccaatatggtgaaaccccgtctctactaaaaatacaaaaaattagccgggtgtggtgacgcgtgcctgtaatcccagctactcaggaggctgaggcgggagaatcacttgaacctgggagccggaggttgtagtgasccgagatcgtgccactgcacttcagcctgggtgacagagcgagactccatctattttttttttttttwaaaaaagatggtgaaaccccgtctctactaaaaaatagaaaaattagctaggtgtggtggcaggcacctgtaatcccagctactcgggaggctgaggcactgaattgcttgaacccaggaggcrgaggttgcagtgagctaacatcatgccactgcactccagcctgggcgacagagcgagactccgtctcaaaaatatgtatatatatttgtgagggtggagccctcataacctaaacacctcccattagactccaccttccaacactgtcatgttggggattatatttccaacacatgaattatgaggggcacattcaaaccatacagcrtgctaagtgttgttctgactggtttgcatggactatctcattcagttttgacatatatatatacatatatatatatatakatatatatayayayatatatataccattggtccttgaacaacgtgggggttagggatgacaacccctgtgcagtcaaaaatctgcatatgtaagttttgactgccccaaaacttaaacacttatagcctactgttgaccagaagccttacaagtaacataacagtttttttattttgttttgttttgtttttgacagagtcttgctctgtggcccaggatggagtgtggtggcgcgatctcggctcactgcaacctccacctgctgggttcaagtgattttccggccttagcctcccaagtagctgagactacaggcatgcaatattgcacctggctaattttgtatttttagtagagatggggtttcaccatgttggccaggctggtctcaatctcctgacctcaagtgatctgtccacctcggcctcccaaagtgctgggattacaggtgtgagccaccgcgtcgagccttaatacatatgttttttatgttatgtatattatttactatatttttgcagtcaagctagaggaaatgttattaagaaaatcataaggaaaatacatgttcagtattgtgctgtatttatcgacaccataagtttacatgatgaatcatgtaaaatggcaggcaaccacagctgcagacctccgtccatggtaccatatgaagcaatttggcttttcttgtaatgtcatgactcttttctgcttcttgggaacacttccagcatcactagtggcacttcattatgggtcccatggtgtyatgtaaggtttatgatactgctttagacacatgaaaaatacctgaggaaccacaggagatcacttcttgctgccatatgcaatttttgttttgagacagagtttcactcttgttgcccaggctggagtgcagtggcatgatctcgactcactggaacctccgcctccccgggttcaagcgattctcctgcctaagcctcccaagtagctgggattacaggcatgcaccaccatgcctggctaattttgtatctttagtagagacagggtttccccatgttggtcaggctggtctcgagctcctcacctcaagtgattcacccgcctcggtctccaaagcgctgggatttacaggtgtgagccagcgtgcccggtctgccatatgcagtttactggagagacgaactgctcactggaagatgattaacatctcagagtttttaagcagatacttgcaacatttgagctcaccatagtatcgacaagaggcggctatgaaattattacagtactacagtgtgtactgaagtgaattttatgcagttatgatttaatactgcatctttaggccaggtgtggtggctcgcgcctgtaattctagcactttgggaggcctaggcaggtggatcacctgaaatcaggagttcaagatcagcctggccaacacggtaaaaccctgtctctactaaaaattcaaaaattagccaggtgtggtaaatataaaaattagccgggtgtggtggcatgcatctgtagtcccagctcccagggtgactgaggtgggaggatcgctggaacctgggaggcagaagttgcagtgagctgagattgtgtcactacactctagcctgggtgacagagcaagaacctgtctcagaaaaacaaaaacaaataatattgcatctttatatttatttccgtttctcttgggctgtgaatgatgtcatgtactgtctgtgtttgtgtgtgaggttttttggtgttttttttttacatggggtctcactgtcacccagcctggagtgcagtagtgtgatcacagctcactgcagcctcagcttcctaggctcaagcaatcctcccgcctcagcctccagaacagctaggactacaggtgcaccccactgtgctcagctaattttttattttttgtggagatggggtcttgccatgttgcccaagctggtcttgagctcctgacctcaagtgatcctcctgcctcagcctctcaaagtggtggggttacaagtgtgaactatcacatccagcctgcatcaagttttgataagttttaactttataatagacatatatatttggccgggcacggtggctcaacccctgtaatcccagcacttcaggaggccaaagtgggcggatcacgaggtcaggagatcgagaccatcctggctaacaccgtgaaaccccgtctctactaaaaaagtacaaaaaattagccgggcatggtggcgggcgccggtagtcccagctactcgggaggctgaggcaggagagtggcgtgaacccgggaggcagagcttgcagtgagccgagatcgcaccactgcactccagcctgggcgacagagagagattccgtctcaagaaaaaaaaaaaagacatatatattttatggtagtaaatgataaaatagactaggatctacataaattttatgcgttcatgacatatgtagctttaaaaaaaaattagccagatatggtagagcatacctgttgttctagctactcaggaggctgaggcagcccgattgcttgagcccaggaatttaaggctgcagtaagctgtgattgtgccattgcactccagcctgggagacagagtgagactttgtctcaaaagaaagaaagaaaaaattccagtatatttactgaaaaaaattagcatattagtggacctacacaattcaaatcgtattgttcgaagattaattgtagacatacatakgtgccttacttttctccagtgagagggcctaaaggcagtaatactctaatagaaatgagtgcaagtaatgcctagaatttggcttctacataccattattccrtaatagccaggattccaccaagaatggttgattacaggactgggccagggaaaatacaagatgagcccagaacatcttttattttatttatttatttatttttgagatggtgcctcaccatgttgcccaggcggatcttgaactcctgggcccaagcgattctactgcctccacctcccaaagtgctgggattacaggcttgagcccagcccatctcatgatacaagacagtcagggaacaaaaatgaagggaggctgggtgcagtggcccatgcctttaatccgagtactttgggagtgttgggaataacactcaaaatcctaaggaaaatgaacattcaaacaaaggattcttaggaaagcaattttacttctctgcagaggggtgcctctccttggccagtcgccgtgaaagcacacctgaacaaaggggcacgagagcctttattcctgacgcaagtcctgcccctgtacccttttcccatttgccggggtcgggttgcacaattagcccaattggctaaacatctgaactttctttagataaggtgggcacataagggagagaggggaaaaggtgaaggggtgtctgcaatgatctagagagctagtcttctttccaaataagggaaggaatagtaatagtaagaaatagtaagaaagaaaataaagaaatagtaataaaggaaagctagtcttctttccaaataaggaaaggaatgtgagctggtactgataagcctggtactgtggcgtgtccaggcatgtaacaaaggcagaaacgaaaaaaagagaaaaaggaaaaaaggttgtgggggagtgctatgaattaaagaatagaggattgatcaggctatttgaagagaaacctcatcatatcccacaggaggctgaggcagcagatcagttgatcccaggagttcgagaccagcctgggcaccaaagtgagaccctgtcgctacaaaaaattaacagaaaaaaaaattagctgggccgggcgcagtggctcacgcctgtaatcccagaactttgggaggccgaggcaggtggatcatgagatcaagaccatcctggctaacatggtgcaaccccgtctctactaaaaataaaaaaaattagccaggcgtcgtggcacgcacctgtagtcccagctacgtgggaggctgaggcagtagggagtaggcagtaggatcgcctgagcccaggaggtcaaggctacagtgagctatgtttgcaccactgcattctggcctgggcaacaaagcaagaccctatcttgaaaaaaacaaaaaaatggaagcatgttcaaaggacacaggccaagttgaaggagattgcagagaccaagtatgggacaatttgagcaggaaaataaatagtaatagtaatggattaaagcacagaataagacaaatatccctaagtccattctgctataaataagtgaataactaaataaagggaaagggacagctaatcgttacaatagcattcccattagtaaatgtagaaggaataatagagatagaaaatcaccatttagtaaacaccacagcagtaattgtggcaggcaagaatcattcatggatgcttcaattagtgggcaaaaatgtgatgtgaaacaggacatttacgtagtctgaaagtatcttcccacaaaaatactggttgcaaaggggaaaataataatgttacagtggagaaatgtggcagacactacgaagtgatcaaagttaacatcagcagtaataagacattcacttcatgcacctcttgatacgatgcctgaggaccaaccctcccttctgctgtaatcttacgaaaatacataacttcaatataatcgcgagaaaacaggccaacccaaattgagggacattgtacaaaataagtgacaagtactcttcaaagaagtgtcaagatgatgaaagataaagactggaggagaggaaggagacctgacaactaagtgcattgtgggatcctgaagcagaaaaaggacacaaataggataaactttttttttttttttaaaagatcctgagtttgtgttccctcctaactactgtaagttggacaagtcatataactactctaaggtgtaaagtaggcgtggtactgtctgcttttgctcaggtgtggtgaagctcaaacaaggctttaattgtaacacaaatataagatatcatcatcattattttattttatttttttttgagatgagacggagttttgctcttgttgcccaggctggagtgcaatggcacgatcttggctcactgcaacctccacctcttgggttcaagcaattctcctgcctcagcctccctagtagctgggattacaggcgcctgctaccacacccagccaattttttgtatttttagtagagatggggtctcacgatgttggccaggctggtctcaacttctgaccgcaggtaatccacccgtctcagcctcccaaagtgctgggattacaggcgtgagccaccatgcccggctctcatcgtcattataggttacattgaagtgaactgtttgtctcttttttgtgattctaccaataaaagcaataaacctagttttctgccatggatagaatttactgaaaaggtttctcttccctccaaattgatttgttttttccatcttcatagcttttcaggctgcctttcgagctcaggggcccctggctatgctgcagcactttgatactatctacagcattttgcagtaagtgaaacacccaactggtactttaaaaagaactggtgactgtttgtcctaactgtgcatgttagtcctgaaattccaagttataggttcacygataaatgcctctggatattgatatctctgatgagcatgtacccagcttgccaccgtatttattcagttgaacaatttcacgtgtatttttaaacattcgattccaygggttagatctgatctgttagaaggggctctgcaggctccttcctgtctcacccccacactttctttccctcatagtcactttcgaagtatagatcctggcctcaaagaagatactctgsaattcctgataaaaggtgtttatgggtcagggrgtaggggatggaaggtgtttgttatcgtttgtttgtttgtctgtttgtttgtttttcctacattttgtcagccacatgatgataycaaggctgttgtgattcagttggtttggctaagcccagggacctttggcctgttaaaggtctgtaatcttggtgggcgatacagagttatgtgtgttcactgtaagggcagaccaacaagaactttttcctacttttgagctacctctttttaataggggtgattcttccagttgctggagagaaattgtggtaactggagtgagagagtaggaacagggcatgttcagggtatcagggccaagggtcctaaaggacttagcttgtgttatggccactgagagatgaaacacagatctttggtaatctgatggctgcaagtgctgggtgttttgaagttggggtatatgaaagaagtgagtgaaactgactccaagattctgcccctcacagtggtatcccgccactcccaggagcttccagctatcctggatgatacaactttgagtggatcagatagaaacgcccatctaaatgccctcaaaatgaactgttaygctctgatacgtctcctggaatcctttgagaccatggccagccagacaaaccttgtggacctggaccttggtgggaaggtaatttggagttttgggctcacgttatatggggtctggggagataggggaatagatggaaaagaagggaatccaatgatccacaaatcctttctgtcctcattgagaatttaggagaaagaactcaaaagtgtcacacgttttcttcctggacaagtagcgctgtggaacttgtaatatttcttccgtattaccttctatgttgtcttggtactagattgtttgggcactcagactgacagatcttgacccacttttttcccttattttttcctcaatgtatacatgatcctttttagggtaagaaagctcggaccaaggcagcccatggctttgactgggaagaagagaggcaaccaattcttcagcttttaacacagctacttcagttggacatccgtcacctgtggaaccactcaataattgaagaagaatttgtcaggtgggtagggaggatggctacagataatactgagctgtgagagtgaggctctgttgatagatatgccgtttttttgtttttgttttttttttgtggggggacagagcttcactcttgtcgcccaggctggagcgcagtggttcaatctcggctcactgcagcctctacctcctgggttcaagcrattttcctgcctcagcctccygagtagctgggattacaggtgcccgccaccacaagctgatttttgtatttttaatagagacgggttttgccatgttggccaggctggtcttgaactcctaacctcaggtgatctccctgctttggccccscaaagtgctgggattacaggtgtgarccaccacgcccagccagaagtctatttttaaaataagtaaaataagtttgatggaagaaggttgtgattttaaatcagctactctaggcccggtgcggtggctcacgcctataatcccagcactctgggaggccgaggcgagtggatcacctgaggtcaggagttcaagaccggcctggccaacatggtgaaaccttgtctctactaaaaaaatatgaaaattagctgtgcatggtggtgtgtgcctgtaatgccagctacttgggaggctgaggcaggagcatcacttgaacctgggagagggaggttgcaatgagctgagatcgcaccattgcactccatcctgggcgacaagagcaaaatcccgtctcaaaaaaaatagatagggccaggcgcggtggctcacgcctgtaatcccagcactttgggaggctgaggcaggtggatcacgaggtcaggagatcgagaccatggtgaaaccccgtctctactaaaaatacaaaaaaaaattagccgggcatggtggcgggcgcctctagtcccagctactcaggaggctgaggcaggagaatggcgtgaacccgggaggtggagcttgcagtgacctgagatcgcgccactgcactccagcctgggcaacagagcaagactccatctccaaaaaaaaaaaaaaaaaaagatagatagatagatagacagacagacaaacagacagacaagctactctagtaagacttctttgagatggtgacatttgagcaaagacccagaggaggtgactgagagctatgagaatatgtggaggaatagcaagggcagggaaaaggaatagcatatgcaaagaccttgaggagggagcgtgtccagcacgtacgagcaatagcaaggaggccagagagctgacagctgagagcaggtacgagggttaggccgtgaggccatgggagcagtggggagccagaccgcaggttyttgtgggccatcatggkgactttggcatttcctcagaatgaagtggagccactggggagccacaagcagggaggtgaggtgacctgacttgtacttcaacagggccatcctagctgttgtattgaaatcgactatggagggaaaggggaagcaagagaccagttaagaggctgttccaataactcaagcaagagatgatggtctcttagaccaaggcgtggcagtggagatggggagaagtagttggattctatactttttccttaaggtagagcttacaggatttgctaacagactgggtgtgaggtgggagggagagttcagtcaaggatgactctcccgggttttggtctgagcrtttggaagactggagttaatggtaactgagatagggagaaggctgtgaataggtgttttgggaggaagatcagatgttctgttttggacatacaaagtttgaggtgtttattagccacgtaaagtcagatttggacgttgaatatatagatctggagttcaggagagaggtctgagctagagataacacatttgggaatataatagtattcagagccgtgagactgaatgaaatyaccaaatcagtaagtgtagctaaaagagcaggaatccaaggactggtaccctagggcactccagcattaagagtgaggatgccgggtgcatggctcacgcctataatcctagcactttgggaggctgaggcaggaggatcacttgagcccaggagtttgagatcagcctggacaacatagtgaaactgtgtctctacaaaaaatagaaaaattagctgggcatggtggaggctgaggtgggagcatcacctgagctatgaggaggtcaaggatgcagtgagccgtgattgcaccactgcactccagcctgggcaacagaggcagaccctgtctcaaaaaaaagagtctgaggaggaactagccaaagaaactgagaaaggagtcttgttcttgtgtcctggaagcgagataaagcatatatttcaaggagaaagtgagtgattaactgtatcacatgcagctgtgaaagaccacttgagatgcagattgaatcagtcgttatatttaggaatgagaagtcattggtgactttgtcttttttttttttttttttgtgatggagtctcgcaatgtcgcctggcctggagtgcagtggcatgatatcagctcactgcaacctccacctcccaggttcaagggattctcctgcctcagcctcccaagtagctgggattacaggcgcccaccaccacacccagctaattttttgtatttttagtagagacagggtttcactatgttggccaagctggtcttgaatgcctgacctcgtgatccacctgcctcggcctcccaaagtgctgggattacaggcatgagccaccacacccggccaactctatcatatttttatgatatatttaggttctttgtcagcatcacaactggttgaaagttggtaatcttgaaggaaggagtacctaactggggtcagcaaagcaaagcaacttgttatagaaagtaatggctagaataaagaaaaccctgactttgggagcagtagggatagaatgaatgaggcagggctctgatacagttggatccagacagctgctttcatcatctcaaactcttcctttctcagtttggttactggctgttgctaccgccttctggagaatcccaccattaatcaccagaagaaccgccccactcgggaagccataacacacctgcttggtgtagccttgacccgttataaccatatgctcagtaagttaccagtcgctttgccccgccttttttgtattgcccataatttctcatgtttaatgcttccacaggtgctacagtgaagatcatccagatgctgcagcactttgaacacctggcacctgtactggttgcagccgtgagtctatgggcaactgactatggaatgaagagcatagtgggagagattgtaaggtgactcttccttctcgaagtttctcatgcttattttccttggggagggaataaagaaagattggaaatacattatctgtgcaacagtagattccttcagatattagatacctgtcttaccttcccttactgggaactgaataattgatctatgttgctatggctgtgttttcttccctgtgtagagagattggacaaaagtgtccccaagagctgagtcgagacccttcagggacaaagggctttgcagcattcctgacagaactagcagaacgtgtcccagctatcctgatgtccagcatgtgcattttgctagatcacctggatggagaagtaggtggtccactaggggtcactgagctttttctggggattttaagtccagcgttgaaaggctgtttcttaacagaacaagaaagtagctttgacaagttgtctagatttatcattgtgacatttcctttctgtagagaagcaggtcaagtttgttgaataaggagctctttattaatctgttaatctttcaattcacattgcttttatccagttctggtaagggagatgacatttctgcagcttaagtctagtaagagcaactcagctttgattttttttttttcttggaggtaggatctggctctgtcacccatgctggagcatgatcatagctcattgcagcctygatctcctgggctcaagcaatcctcccacctcagcctcccaagtagctgggacttcaggcacatactaccatgcctggctaatttttttagtttttgtagaggtggggtcttgccatattgcccaggctagtctcaaactcctggtctcaagcaaccctcctgcctcagcctcccaaagtgctgggattgcaggcgctaccatgcttagccttcagctttgattctgagtcccatctgttcctcaggataaagcgtcttcccaccagctggcttgccttgcttcctcaaacaatgaactttctcaaatcaacccatgtcatctctctcaattctcttttatgcctgaatgctaacctggctgattcccatactgatgttgggcactcctaggtgaatgtcaaggacaaagacagtccacttgttcatctcatttactttaactttttgtgcaagaccctattctctggttcttagcctggcaaaaccttaaccctgctctccactagattatgtattggacttgctggcactcttaaggctgatttccatgtttctgtctcattttctgtcagtaaagcatctgaaggagagtgggagggaaaggaggggatatttattagtaaggattaaagactttgaggccaggtgtggtggctcacgcctgtaatcccagcactttgggaggctgaggtgggtggatcacttgaggtcaagagtttaagactagcctggccaacatggtgaaatcccatctctactaaaaatacaaaaaaaaattagctgggtgtggtggcgcgcacctgtaatcctagctactcgggaggctgaagtgggagggttgcttgaacctgggaaatggaggttacagtgagccaagatcgcaccactgcactccagcctgggtgacaaaacgagactctgtctcaaaaaaaaaaccaaaaaaaaccacacagacgggcgcggtggctcacgcctataatctcagcactttgggaggccgaggagggtggatcacgaggtcaggagtttgagaccagcctggccaatatggtgaaatcctgtctctactaaaaatacaaaaattagctgggtgtggtggcgggcacctgtaatcccagctgcttgggaggctgaggcaggagaatcacttgaacccgggagtcagaggttgcagtgagccgagatggcgccacagcactccagcctgggcaacagagcaagactccgtctcaaaaacaaacaaacaaccacaataacaaaggctttgagacctcagctgaagggtagttaataaatgcttttcaaatgtgtgttggtgagtggatgtgatttttttattcagctactaccatgctttcctgtgtgagccctatgaggaaaaattggttttggcccttgttctagcattctctgagcaacaagtcctctttgggattcagctttctcctgtgaccttgggagtgaatacctaggcagttaatggaaaaagttatggccaagcacaagcaagcttcgccttgactaaaggtttgacccctctatgcttctctctcttagaattacatgatgcgtaatgctgtgctggcagccatggcggagatggtgctgcaggttctcagtggcgatcaactggaagcagcagcccgagacaccagagaccagttcttggatactttacaagcccatggccatgatgtcaactcctttgtgcggagccgtgttttgcagctcttcacccgaattgtccagcagaaggtaaccaacttctatgtggcaaaaacatatggtacctctccatataccagtgtaaagaggaatccagtgttgaagataaatatctgccccaaagaggtctagaattcacatttttattatcagtagtaaaagtcttcctctaccaaggacgaggatatctggctccctttaaggactctaatgtgtcttaccactacaaggagtactcctaatctatattctgtagaaagggtttttagagtgagtgggtagctcagtttagagtatacttaaagatcatcttgaacaaaatggatgatgtgggacttgagcagattcttctcttcctaccctacacaggctctccccctgacacgtttccaggcagtggtggctttagctgtgggacgtctggcagacaagtcagtgctagtatgtaaaaatgccatccagctgctggccagttttctagccaataatcctttctcctgcaaggtaagtagacttggtccaccaaaagagaaggaattaaatggaaacagggatgaaattatgtcatttactgaccctgctattcattttacctgatagcttastgatgctgaccttgccggaccactgcagaaggagacccagaaattacaagagatgagggcccagaggcgaactgcagcagcttgtaagtagttactgccttggagtcctaatgccagacaggcttctccttgcagtcagaaactctagtgaaagagactaagtgacactctcatttagctgcagtgctggacccagaggaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaagctagttacaagtaggcaaaagaatgggatattcttcgtgatctgtttatgtttagagttaacctttgagaaacttacataatgtgtcttttaaattaactgcacacagatatgctgccaccaggtgatggtagatgttttcatgtagtaatggtctgaccataggcctagtccacaattaagcatgtgtttctactttataaatgtttaaaaaaactactgaaacaattaaatgttaacaatattataatcaaacatgagtcctccttcaattgaagaagagcacctataaataagttctagttgtatgatcttgaataagttgcttaactttctgtgcctcggtttcattatctataaaataagaaattgattagatcttatgatctctaaggactttctaattctaaatttcatgaactaataatatcaaacatgcttaatactaccttaatcttcaaacctagtatgaatcctgatcttagagaaaagatttctcctagtgtttttgtgactctagaacttaacaacaaaagcccttacagccgtcaacaagttttttttttttttttttttttttttttttgagatggagtctcactcactctgttgcccaggctgcagtacagtgacacgatcttggctcactgcaacctctgcctcccaggttcaagcaattctcgtgcctcagcctcccaagtagctgggaccacaggcgcgcaccaccacaccgcactaatttttttatttttagtagagacagggtttcaccatrttggccaggctggtcttgaactcctgacctcaggtgatccacccatctcagcctcccaaagtgccatgattacaggcgtgagccaycgcactcggctgccaacaagtattcttaaacctcagccacaagttatttgttatttatttacttcttacctaattgggctgaattttttttttggagacggagtcttgctctgttgcccaggctggagtgcagtggtgcgatcttggctcactgcaacctccacctcctgggttcacgccattctcctgcctcagcctcccgagtagctgggactacaggcgcccgccaccacgcccggctaatttttttttttatatttttagtagagacggggtttcaccgtgttagccaggatggtctcaatctcctgacctcgtgatccgcctgcctcggcctcccaaagtgctgggattacaggcttgagccaccgtgcccggcttgggctgtttttagaaggctagagagtggcttgtttgccctatgactcccttatgttactttagtgtctctctttttattttgctaaagcaaaaatagagactatagttttataagtgcatgttccaccaagcattctagtattttctcctgtcaattagaaaaggattgtttgtttttgagacagaatctcactgttgcccaggctggagtacagtagcgcaatcacagctcactgcagcctctcactgtagcctcaaccctgctgggctcaagcgatctcccacattagcctcctgagtagcctggttaatttatttataatttgtagctgggattacaggtacacaccaccaggcctggcctttgccagcctgggcaacgtggcaagaagataacatgtagacaagcagtcaaacatgtattctttttttcccccttttatatgactgatagaattctctgcccactgatctaccatcttgtttttttcacttaactatgtgtctcagtggtttttaaaaatatttatggctgggtgcaatggctcatgcctgtaatcccagctacttgggaggctgaggcaggagaattgcttgaacccaggaagcagaggttgcagtgagctgagattgctccgctacactctaccctgggtgacagaggaagagtccatctcaaaaaaaaaaaaaaatttatagatggccaggtgcagtggctcacacctgtaatcccagcaccttgggagcccaaagctggtggatctcttgaggccaggagtttgaggccagcctggccaacgtggcgaaatggcgaaacccatctctgctaaaattacaaaaattggccaggtatggtggcacgtacctgtaatcctagctatttggggagctgaggcatgagaatcactcgaacctaggaagcagaggttatagtgagccaagatcatgccactacacttcagcctgggtgacagaacaagactctgtctctaaaaaaaaaaaaaatatatatatatatacacatatatatttatacataaatagtttcccactctcctctttttttgagagagagagtgtctcactcttttgcccatgctggagtacagtggtatgatcacaactcactgcagctttgatctcccaggctcaagtgatcctcccacctcagctccctcgagtagctgagaccacaggcacacaccattacacccacaggcacacaccatcacacccacaggcacacaccatcacacccacaggcatacaccatcacacccacaggcacacaccatcacacccggctaactttttttactttttgtatagttgggtctccctgtgttgcccagactgatctcaaattcctgggctcacgtgtccccattattttttatgactacatagaatcttattgtctggatgtgcctgaattaactaattattgaaagtttattgtttctaaacttaggaaagtttttaaacaggtgtttggagtaggtttatgattttaaaactttaaaaagccttattggagtttttttgaagactgtagtaatgccttgtaggttcagaaataggaaaagtgtttgcagatgagcagtcaggggaaaaaaataggcaaagtgttttgagccctaccccttagtaggtgctgtaacaactttttaagcatgttaagtgctccttttctctgggcagtaggtccagggacttgatagaatcatgaggtaagctcccttacaaacggctgcagtgacattcttctgggtactgacaggctggtgttctttcagaaaggccatcattctcactcgagaagccacaggccacttccaggagtccgaacccttcagtcatatagacccagaggagtcagaggagaccaggctcttgaatatcttaggacttatcttcaaaggtaatcattttccttcttcagtcaataaataacacatgtcaactggtatttactgagcattaactttatgccatcattggcctggttaacagaacctggtgctgaagagcccagagatgaattggcattacttttgctctggaatggaagcagcccacgggcctaagattgatagtcacagggtgactgtccagaccatagcggtctttaggtatggtttttgagaaatttagatattttagagtaagttttaatttcatatcttcacattgtgaaaagagatatccagggccagatgtcgtggcttatgcctgtaatcctaacactttgggaggccaaggcaggaggattgcttgagcccaggagttgaaaatcagcctgagcaacatgacgaaacccccatctctacaagggataccaaaaaaaaattagccaggtgcggtggcacgcacctgtagtcccaactgctcaggaggctgaagtgagagaatcaccttagcccggggaagttgaggctgcagtgagcggtgatcattgccactgcacagcctaggcaacagagtgagaccccatctcaaaagaaaagaagaaggaaaataaataagtaaatatccaggaatgttgacagctgttggattcccctgtatccccttgaacgaaaccatcctgtacttctctaactccttaggcccagcagcttccacacaagaaaagaatccccgggagtctacaggaaacatggtcacaggacagactgtctgtaaaaataaacccaatatgtcggatcctgaggaatccaggggaaatgatgaactagtgaagcaggagatgctggtacagtatctgcaggatgcctacagcttctcccggaagattacagaggccattggcatmatcagcaagatgatgtatgaaaacacaactacaggtatgccagagtccctttctataaggacagccttggggttcttttggattttttaattttttaaatttttattaacaatagagatggggccttcctttgttgctcaggctggtctccaactcctgggctcaggcaattcttctgcgtcagcctcccaaagtgctggtattacaggtgtgagccactgcacccggccatggatcttggagttcttttccatattttattgatatatctatctgctcctttaaaaggcaggggttctcggctgggcgcgatggctcatgcctgtaatccctacaaaactgggaggccaaagcaggaagacaggttgaggccaggagttcgagagcagcctgggcaacatagcaagaccccatctctacaaagaaacaaaaactaactgggcgtgatggcacacacctgtagttccagctactcggaaggctgggcaggaggattgcttgagcccgggagtttgaggctacagtgagctgtggtcatgccactgcactctagccagagcaacagaataagaacctgtgtcttaagaaaagaaaaaaaaaaggcaggggttctttttttctgtttgcttcctctagccacttacagcttatacattttaatgcatatagtatttcatgataaggcatcataggaggagtcgacattctcagggaaaatgcggaaggcctccatttgcatcttgctacattcagaaaggttctgtcgttaggtattgggggagttttgtgaagtagataggtgacatttgtacatgttctctcagtggtgcaggaggtgattgaattctttgtgatggtcttccaatttggggtaccccaggccctgtttggggtgcgccgtatgctgcctctcatctggtctaaggagcctggtgtccgggaagccgtgcttaatgcctaccgccaactctacctcaaccccaaaggggactctgccaggtatatggggtgcttttgcctttgctgacttttccaaggtcagcttctcacaggacttcccttgtctcctaaaggaagaggtgcatttctccaggggagttccagatccataggcagtccatcatagtggggcttagggtggggctcggtttccagggagagcagttttgtagcactgtggtgggatagccctaatcactgtttgccaagttcagcttcccaatcttatagtgaccgctgatctctgctgttcccacagagccaaggcccaggctttgattcagaatctctctctgctgctagtggatgcctcggttgggaccattcagtgtcttgaggaaattgtaaggcttcctgctttctctttctttattcattcaacaagtattttggttgttttttttttttttttttgagacggagtcatgccccattgcccaggctggagtgcaatggcacaatcttggctcactgcaacctccgcctcccaggttcaagcaattctcctgcctcagcctcccgagtaactggaattacatgcatgtgccaccatgcccgactagttttttgtatctttagtagagacggggtttcaccatgttggccgagctggtctcgaacccttgacctcgtgatccacccgcctcaacctcccagagtgctgggattacaggcgtgagccaaagcgcccggcaacaagtattattgagttattactatgtatttagcaatttacttagctccagaaagaagtataagactatttgctttcatgttcccaactttaaaggaaccaacagtctagttggtagtgaaaaaccacagaacatttttagaacaatgcagcaggtagataataaagtgccagaatgagttgtacgggtaatggttgtcatagcaataataacaacctcacttatatggtattgaatatatgacaggcactcacacgttactcacagtaacttgtttaatcctcacgacagccctgtgaggtagcattatctgcattttacaatgagaaatctgaggcacagagaagttactgaacttggctggttacagctagttagtggcaaagtttgagattcaaactcaggcaataagagctctagaaaacatactcttaacttctgtgttctactgagggatacagagtaggaaagagagcggtttggggtagaatggtcaaggaagcttcctgaaggtggtaggacttaagctgggtcttgaaagatgagtaggatttagagaatcagagcaaggagggagggcatttcaaacagaacccaagaaagagcacagttcacattgtagaacaaagaagactgtgttctggttcaaattatctggaaaagaccaggcgcgatggctcacgtctgtaatcccagcactttgggaggccaaggcagcagattacctgaggtctgaggtcaggagttcgagaccagcctggtcaacatggcgaaaccccacctttactaaaaatacaaaaaaattagccaggtgtggtggtgggcacctgtagtcccagctacttgggaggctgaggcaggacagttgcttgaacccaggaggtggaggtagcagtgagccgagattgcgccactgcactccagcctgggcgacagagggagactctgtctcaaaaaaaaaaaaaaaaaaaaaaatctggaaaagataataaagttgtgaatgtaggttggaactaaactgtggaagtccctgaatgacttcaggagtctaggactttaactgtgttagccaggcacccagcattttagtgagacattctgctttgtagcatttgcattgcgggcacagagagtggaggtggcgctgggaagcgtgctcctgccagccacatttttctcctcactggggaaaagaaaagagcctggtggtggtgattggccatgatgtcataggtcagttaccggcaaaagccctacaagaggcaggggagagcacctgcaaactggggtgcaacagaagggacgtggggaagcagaggctgaggagaccaacccatgggaaggaaggcccgtggaggctgctgcagtgggcagtaacgaggggctggacttgaggattggagaaatcactgcagaatgggcttaatggaagacaaatttttaaaggaaaaatagtgactgatttgtaaaaaaattagatgaccgaaattttaagcacatattactgatagagtgttgataccactggcaaaatgaaaaggcaaggaaggatgatggcttccatgttggacatgttgagtttgtggtaacggcaagaaaacctgttagaaatctccagacttagaactatggacccacgtggaactcaaaaggtcagtttcgatatgtcacttgaataaaatagttttgaaggcatgagagtagaaaagtagagaatggaaagcctctcaagaccctgctgtacattttgaacctcctcttttctttttctcttcctaagtattacttttgtctacttcaggttcgcaatatcatcttcagaaaagcagaccaaagatcaaggaattgttcatttttggcttgagccctttttcttttctctttagctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacggtgaggctcaaatctagcaggcaatggggtgggagagcaaaggaaggttctgagagggctccttttccttcagtgacattgtcacagtgaggcccaactgagctctgctgtgagttataacgccacctaaatggaaaagcaaatagtgagaggaccagccctcctgcctagtagtagtgggattcagtaaagcaacaggacccaagaggctggccctgcggcagagccacgctatagtgctccacggctctagacaccacatgaggtgctggtacctacccctattggccctttctcccccgatgagtccaatccatgactgcctttaactctgtggcttccttcccctagaggaaagccagaaattgtgggaagcaatttagacacactgntgagcatagggctggatgagaagtttccacaggactacaggctggcccagcaggtgtgccatgccattgccaacatctcggacaggagaaaggtatgtgrgggtggttccaaactaaggagagtggagattctcgtgtccaccctgtacacacacccacgttgtcttgctctccacagccttctctgggcaaacgtcacccccccttccggctgcctcaggaacacaggttgtttgagcgactgcgggagacagtcacaaaaggtgagctctcagggaaggccttgggcagawttgggccctttgttgcagtaaacaacttctccctcctcctctgcaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgagtaagtgggcaggggttgacccactgcggcagccagcttctgttctccctgcagggccaggagccactgccaccaccactatctgcaacaacccttagtgtacactgtgtcgtttttgtctaagttgaagttgggccagttcccacccccaactcttactacttcactagtttgaatagcacgtgagcaaggggaagatcagtaaaaatcggattcaggtttgatgggacttaaaaatgtctctttgccccaccttccctctccctctcctccagaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaaggtgtgtgaatgtcctcagcacttcccagatttatttcatacctcagctcagaactgagctgatccccttccggcaatctctgctcctctgctattacatgaagcgaagagtttctgcctctctgtggctactaccgtaggaaaggttcgtgtgaacaatgacraaactgtcagtgatcacccaggaaggaaagatttaggtaaatgcagagtgtggagttagagacctcagcataaaacagaggctttgtgtctgaggcagggtttgttagaacacgcacgtacccgccggccttttccatcagcttccattgctggcctggccccggatggggccctgtgttccctccactagaggcaatgatgtcttgcagacaaataagacacagagccttgcagcgctggagaaaagtctgacctctgtgactttgaaccattgtctggcgtgatccatctgtttaccatatataggaaacgatgtcttccatgaggaagaggtgcagaaacacgctttggcaacttaaaacaaatggggacctcattgttcccctgcttaattcaggaatcctttctctttacagacacatttgacaattctctaaatgtttttgtagaatttgcccttcctcactttgttcatgcaaaacaaagtatgggctggaatcaaaaatgttgtctctgcttatccatgatccccaatttcattccctttagaatacgagctctgagaccaccatggaggaggagctggggctggttggggcaacagcagatgacacagaggcagaactaatccgtggcatctgcgagatggaactgttggatggtaagaaaaatggctgcactcagcagtttcttcccaattaagataacctgtcccaaacctgcagttactcttccaacaggcaaacagacactggctgcctttgttccactcttgcttaaagtctgtaacaacccaggcctctatagcaacccagacctctctgcagctgcttcacttgcccttggcaagttctgcatgatcaggtaggccgtggggttggtacccccttctcaaggaagatggggatgaaatggcttccctaatgatcctcttcttgctcttagtgccactttctgcgactcccagcttcgtcttctgttcaccatgctggaaaagtctccacttcccattgtccggtctaacctcatggttgccactggggatctggccatccgctttcccaatctggtggacccctggactcctcatctgtatgctcggtaagagacccctcacaacgtggtggcagttcccaggagccccggagtctgttgagagtcagtgtgagaatcaccagggctcttcccctaggctttggcatcaccgcgaacatctgcttgatacttgacctgtacaggcccctggctaagagtcaccccagtgggactgacacttctggttagaagcttcacctctttcccccactccagctttcaactctagacagctttctgactgcttctggagtggcagagcatgggataattgattcctgctgagggccttttctaccagtgttagggtgtagcccggaggtctcggtccccatgacccgcaattccattcctagyctccgggaccctgctcagcaagtgcggaaaacagcggggctggtgatgacccacctgatcctcaaggacatggtgaaggtgaaggggcaggtcagygagatggcggtgctgctcatcgaccccgagcctcagattgctgccctggccaagaacttcttcaatgagctctcccacaaggtgagaggcagagaggcactgagggctggctgcagagggaatctgtaggtcacctcatctccttaacatggctctctctgtcttacagggcaaygcaatctatratctccttccagatatcatcagccgcctgtcagaccccgagctgggggtggaggaagagcctttccacaccatcatgaagtattgctccccgggccctggggcacattttccacatagcaygggcttaggaatcagacacacctgtatttgaattccacctcggctactctttagctgtacagccttcggcaataacttagcctctctttgtgcctatttcctyttcttttgaggctgatgatacttaacccttagttcttgaaaatattaaatacgataaagttcctaacatggtggcagacatacagtagcactcactccctagcagctgctcctgttaatttccattcacagtgaaaattcctgagccgggggcggggtggggtccctctctgctgaatgggacagggcaaggggagtggtgaggcagacaggggccgtggcagagaacatcagagaagacgagtgctgggggagggtccagggttggtcttagtggatggcagagctggccctgggccatcgaacatcctcatctycccttcctgcagacagctcctctcctacatcaccaaggacaagcagacagagagcctggtggaaaagctgtgtcagcggttccgcacatccckgtatgctgccctccctgagggttctttgtgctgagcggggccctgcaggggagaaaggcccatccctcaccccttcaatgcccccactgtggcatccctgggactggggaggctgatggggaaggttgagcctytactagctggatctcccagttcctcacaaagcccttcctatctgcagaactgagcggcagcagcgagacctggcctactgtgtgtcacagctgcccctcacagagcgaggcctccgtaagatgcttgacaattttgactgttttggagacaaactgtcagatgagtccatcttcagtgcttttttgtcagttgtrggcaagctgcgacgtggggccaagcckgagggcaaggtgagcagcacaggacacttcaatgcctgttgggttctgggctggctaagacatctgccggccctgggcagcatacggctcttgcagtcaccttcccgtcctccttatccccagctgggttgcaaccaaattgccagagtgacctaagaccagatctttgtctccagttctttttttattactccaaaaacacaaccaaagcagcatctcatccaattcttgtttgtttgtttttaatagtttttatttttcagagcagttttaggttcaaagcaaaattgagcagaaagtacagggagttcccttctaccccttgcccctacacatcacagccttccccaccttcaacatcctgcaccagggtggcacatttgttacagctgaacctacacttacacatcatctcctaaagtcatggtttaccttggagttcactgcacgtaatgacatgtacccaccattgcagtatcatacagaagagtttcactgccttacaaatcccctgcactccacctatttatccctctctccccacaacccctgatctttttactgttgccatcactttgtcttttccagaatgtatcattggaatgatccggtatggagccttctcaccttggcttcttagtaatgtgcgtttaaggcctccatgtcttccatggccttgtttctttttaatcagaagtaactgttttcaggcctgctctgaatctccttttctccctccaggctataatagatgaatttgagcagaagcttcgggcctgtcataccagaggtttggatggaatcaaggagcttgagattggccaagcaggtagccagagagcgccatcagccaagaaaccatccastggtacgtaaggcagcctgtgcgggcgagaccagactgggccctcccctcctgcagtgatttgtttcttcttcttttttaaatcacgttttcctgccttttctaggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaaggtatgatgctcccgcctgttcccgrccgagaaggcacacagctagggtgcagagggctggtttccataggacctgctgcgggggcctgagtgtagatgctctgccccactgccgcagaagggcctctcctgtacagcttggattttatttcttctgtgcggtgtgggattgtctcacttgttctctgatatctattttttcaccatctttgtgactcagctttttcttattcctttaattctttgcatagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctcttttttwwaaaaaaaaaaaaggccgggcactgtggctcacgcctgtaatcccagcactttgcgataccaaggcgggtggataacctgaggtagggagttcgagaccagcctgaccaacatggagaaaccccatctctactaaaaataaaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattwaaaaaaaaatgcctacacgctctttaaaatgcaaggctttctcttaaattagcctaactgaactgcgttgagctgcttcaactttggaatatatgtttgccaatctccttgttttctaatgaataaatgtttttatatacttttagacattttttcctaagcttgtctttgtttcatctttcacattagcccagtttcatgcagcagagagagggttatcagtgcagagagagatgagtgagcccagagtcctagggcctgtcccgggatggcagatgagcttcctgccccgtcactgccacctttcccctctcaacctctggaccctgcacagtgaccagacagcctctctggggagaattatgcagtgcctaggctccagatcagtgcttctgaaccgggggcaattttgtctgccagaggacatctgacaacacctggggcctgttttgttgtcatagcctataggggaagaatgctaccagcatttgtgggaagaggccagggatgtggctcaacatcctgcagtgcacaggatggcccctcaacaaagaatcacacggcccacaatgtcaatagcgtcacagttgagaaaacctgctctagaccaagggttgctttctgccgtgtgcctcaccccacccccactcgtgttccctaatcccatctccaaaggttggcagcagaccggcccaggctcgtggaagttcagatcatgatcccctccagctctgcaggagacaagacctgtctcccagcattcctcattgttcccgggtctgcagagggcgtgagctatgctgcaggcgggctgccccctgaagcctgcgcacccctctccagctcctcaagtcttctctgctgagtcaccttcgaaccggaggctgtgagctggctgtcgtgaccacactggtgcctctgctgtcatgacaacagcacactacgtcagtagtgctccctgggcactgagctccctctttgcggggagaagacagtaatgaaaaatgacaagcatgaggcagaggggaagatcacgcttgggtggtgcaggagcatggaggtgctcttaatgctctcaatgagaaagggttaacggtcctggttgcaggaatagctgagtcagaggtggggcttcctccactcccccaccccacccctttcaccattagggaccttcttgccttgctcttgctactctgctctgggtggtcattgtgaaaagcccgcaccaaccatgccagtggcagccagacgaggacacagcctggctctgggtcccagcaggaaaggcaatcccagaaaggcagggtcagggactggagtcctgtgggtgctttttaagcaaagattatcaccaggcaggctaaacttagcaaccggcttttagctagaagggcagggggctggtgtcaggttatgctgggccagcaaagaggcccgggatccccctcccatgcacctgctgatgggccaaggccaccccaccccacccccttccttacaagtgttcagcaccctcccatcccacactcacaaacctggccctctgccctcctaccagaagaatggatcccctgtgggagggggcaggggacctgttcccaccgtgtgcccaagacctcttttcccactttttccctcttcttgactcaccctgccctcaatatcccccggcgcagccagtgaaagggagtccctggctcctggctcgcctgcacgtcccagggcggggagggacttccgccctcacgtcccgctcttcgccccaggctggatggaatgaaaggcacactgtctctctccctaggcagcacagcccacaggtttccaggagtgcctttgtgggaggcctctgggcccccaccagccatcctgtcctccgcctggggccccagcccggagagagccgctggtgcacacagggccgggattgtctgccctaattatcaggtccaggctacagggctgcaggacatcgtgaccttccgtgcagaaacctccccctccccctcaagccgcctcccgagcctccttcctctccaggcccccagtgcccagtgcccagtgcccagcccaggcctcggtcccagagatgccaggagccaggagatggggagggggaagtgggggctgggaaggaaccacgggcccccgcccgaggcccatgggcccctcctaggcctttgcctgagcagtccggtgtcactaccgcagagcctcgaggagaagttccccaactttcccgcctctcagcctttgaaagaaagaaaggggagggggcaggccgcgtgcagccgcgagcggtgctgggctccggctccaattccccatctcagtcgttcccaaagtcctcctgtttcatccaagcgtgtaagggtccccgtccttgactccctagtgtcctgctgcccacagtccagtcctgggaaccagcaccgatcacctcccatcgggccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcctggcgggaggcggggtccgagtcaccgcctgccgccgcgcccccggtttctataaattgagcccgcagcctcccgcttcgctctctgctcctcctgttcgacagtcagccgcatcttcttttgcgtcgccaggtgaagacgggcggagagaaacccgggaggctagggacggcctgaaggcggcaggggcgggcgcaggccggatgtgttcgcgccgctgcggggtgggcccgggcggcctccgcattgcaggggcgggcggaggacgtgatgcggcgcgggctgggcatggaggcctggtgggggaggggaggggaggcgtgtgtgtcggccggggccactaggcgctcactgttctctccctccgcgcagccgagccacatcgctcagacaccatggggaaggtgaaggtcggagtcaacgggtgagttcgcgggtggctggggggccctgggctgcgaccgcccccgaaccgcgtctacgagccttgcgggctccgggtctttgcagtcgtatgggggcagggtagctgttccccgcaaggagagctcaaggtcagcgctcggacctggcggagccccgcacccaggctgtggcgccctgtgcagctccgcccttgcggcgccatctgcccggagcctccttcccctagtccccagaaacaggaggtccctactcccgcccgagatcccgacccggacccctaggtgggggacgctttctttcctttcgcgctctgcggggtcacgtgtcgcagaggagcccctcccccacggcctccggcaccgcaggccccgggatgctagtgcgcagcgggtgcatccctgtccggatgctgcgcctgcggtagagcggccgccatgttgcaaccgggaaggaaatgaatgggcagccgttaggaaagcctgccggtgactaaccctgcgctcctgcctcgatgggtggagtcgcgtgtggcggggaagtcaggtggagcgaggctagctggcccgatttctcctccgggtgatgcttttcctagattattctctggtaaatcaaagaagtgggtttatggaggtcctcttgtgtcccctccccgcagaggtgtggtggctgtggcatggtgccaagccgggagaagctgagtcatgggtagttggaaaaggacatttccaccgcaaaatggcccctctggtggtggccccttcctgcagcgccggctcacctcacggccccgcccttcccctgccagcctagcgttgacccgaccccaaaggccaggctgtaaatgtcaccgggaggattgggtgtctgggcgcctcggggaacctgcccttctccccattccgtcttccggaaaccagatctcccaccgcaccctggtctgaggttaaatatagctgctgacctttctgtagctgggggcctgggctggggctctctcccatcccttctccccacacacatgcacttacctgtgctcccactcctgatttctggaaaagagctaggaaggacaggcaacttggcaaatcaaagccctgggactagggggttaaaatacagcttcccctcttcccacccgccccagtctctgtcccttttgtaggagggacttagagaaggggtgggcttgccctgtccagttaatttctgacctttactcctgccctttgagtttgatgatgctgagtgtacaagcgttttctccctaaagggtgcagctgagctaggcagcagcaagcattcctggggtggcatagtggggtggtgaataccatgtacaaagcttgtgcccagactgtgggtggcagtgccccacatggccgcttctcctggaagggcttcgtatgactgggggtgttgggcagccctggagccttcagttgcagccatgccttaagccaggccagcctggcagggaagctcaagggagataaaattcaacctcttgggccctcctgggggtaaggagatgctgcattcgccctcttaatggggaggtggcctagggctgctcacatattctggaggagcctcccctcctcatgccttcttgcctcttgtctcttagatttggtcgtattgggcgcctggtcaccagggctgcttttaactctggtaaagtggatattgttgccatcaatgaccccttcattgacctcaactacatggtgagtgctacatggtgagccccaaagctggtgtgggaggagccacctggctgatgggcagccccttcataccctcacgtattcccccaggtttacatgttccaatatgattccacccatggcaaattccatggcaccgtcaaggctgagaacgggaagcttgtcatcaatggaaatcccatcaccatcttccaggagtgagtggaagacagaatggaagaaatgtgctttggggaggcaactaggatggtgtggctcccttgggtatatggtaaccttgtgtccctcaatatggtcctgtccccatctcccccccacccccataggcgagatccctccaaaatcaagtggggcgatgctggcgctgagtacgtcgtggagtccactggcgtcttcaccaccatggagaaggctggggtgagtgcaggagggcccgcgggaggggaagctgactcagccctgcaaaggcaggacccgggttcataactgtctgcttctctgctgtaggctcatttgcaggggggagccaaaagggtcatcatctctgccccctctgctgatgcccccatgttcgtcatgggtgtgaaccatgagaagtatgacaacagcctcaagatcatcaggtgaggaaggcagggcccgtggagaagcggccagcctggcaccctatggacacgctcccctgacttgcgccccgctccctctttctttgcagcaatgcctcctgcaccaccaactgcttagcacccctggccaaggtcatccatgacaactttggtatcgtggaaggactcatggtatgagagctggggaatgggactgaggctcccacctttctcatccaagactggctcctccctgccggggctgcgtgcaaccctggggttgggggttctggggactggctttcccataatttcctttcaaggtggggagggaggtagaggggtgatgtggggagtacgctgcagggcctcactccttttgcagaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggc

SEQ ID NO: 17951 - DNA, 25327 bp, Homo sapiens
ctggcatcctcccctccttcccacttctgcccccaccccatgtctctgtccttgtcccagccaggccctgctccctctccagccttgacagcccctccccctgcctatgccaccctgggcccccgcccatctccagggggctctgcaggggccagttcctccacctgtcctctgggggggccctgagagggaaggagaggtttctcacaccaaggcagatgctcctctggtgggagggtgctggccctggcaagattgaaggatgtgcagggcttcctctcagagccgcccaaactgccgttgatgtgtggaggggaagcaagatgggtaagggctcaggaagttgctccaagaacagtagctgatgaagctgcccagaagtgccttggctccagccctgtaccccttggtactgcctctgaacactctggtttccccacccaactgcggctaagtctctttttcccttggatcagccaagcgaaacttggagctttgacaaggaactttcctaagaaaccgctgataaccaggacaaaacacaaccaagggtacacgcaggcatgcacgggtttcctgcccagcgacggcttaagccagcccccgactggcctggccacactgctctccagtagcacagatgtctgctcctcctcttgaacttgggtgggaaaccccacccaaaagccccctttgttacttaggcaattccccttccctgactcccgagggctagggctagagcagacccgggtaagtaaaggcagacccagggctcctctagcctcatacccgtgccctcacagagccatgccccggcacctctgccctgtgtctttcatacctctacatgtctgcttgagatatttcctcagcctgaaagtttccccaaccatctgccagagaactcctatgcatcccttagaaccctgctcagacaccattacttttgtgaacgcttctgccacatcttgtcttccccaaaattgatcactccgccttctcctgggctcccgtagcacactataacatctgctggagtgttgctgttgcaccatactttcttgtacatttgtgtctcccttcccaactagactgtaagtgccttgcggtcagggactgaatcttgcccgtttatgtatgctccatgtctagcccatcatcctgcttggagcaagtaggcaggagctcaataaatgtttgttgcatgaaggaatgtctggagagctggatggggcatcatgaagagggtagggggtggatacaagtcatcacccaagcttctgggaggtcctggggctgggagagggtacagactcccatgccccttggctgcaccatggaagtgaccattcttcacggggtcttaagagggacaaacgttctggtgaattcctccatgggtgttgctgagcgtctgctatgtgcccatggccatgttagggtggaagggggaagacatgatgccaccccttcaggggacctacctcacagtgtttggggagacttgccctctccactgtctgaacctccttttccttctctgctttagtcaccatcatcactaacctccccatcccccactccacttgctgagtcccacttaccacctggcggcaatgaaccctcatctgcctgcctcccatcagctgtctggtggtggtggaggatgatgaggctcaggccagtttctcctggaaatgcaaagccttatatggtcttattggtacatgattgcagagaggggcacagggaatcctcccagctttagtaaaggagagactgaggtccagggaggggctgaaggatgtgcgagtggaactccagctctccgatccttgtttctcccccactccagcataagacctggaatccagaagtgaccctttctcaccatctttggggattctgtccctgccaccttagtcttattcatcttaattgcagtctccctgttctgaggagccaaaggaggaagagactttcggggaaagaggagaaggagctggtgacaggggtaggaaggtagacagggtcatgacctgaaacggtgtgacgactgctgacttccctttcctggacttgagctgatgaaggggaaatggtgttgcagtctcctctgtcagagccctcaggtgcagacggcacttgtctgccccctcagcctcagccttggcccacctggtccccagtgccctctcctctggctggggcaggaggacctgccggacatagccagatgtattacggatgactgcagtcagctcccccaggctcctgcttctcttgcctcctgcttttttccccagagctgtctccttatctccattcacttgtctatgggttactcctggaccctggggttaggagttggaatcaggctgttagcgataaaagggttcaagttgactcattttccttatcaggcttagtagttgaagtgacttgctgagcttcataattcttagagaacctgccatgaacccagctccctttctatgactcaccctgccaccctgtgacacatagagtctgaatggcaggtctggggctagaacccacgtcatctggacttggagtccagtgaccctttgggttaagcatgtgtgtgtgtgtgtgtgtgccatgatgcgggaggaaggtccctgctctctgtagctgttttcttcatcctttgctctacaagccctaacagccgattctgtcatccctagtctgcccctctcctgtttctccatctcctctgaccatgatttttttctgtccctggagggatgatggtctcattctcacctcctccacgaaacgtgttagcttttcatattcctagatccactcacttctcatcatctttttttttaaacaaaattttattgaaaaatgtaatatgacgtgtcaaagttgtaaagttattgagtaaataagcatgtatcctaaatattgaaaaatattctccttttgtaccaggctatgtgtcacggctttggcgctttgcacagactattagaaataccttataacattaaaaataggacattgaggccgggcgtggtggctcatgcctgtaatcccagcactttgggaggccagggtgggtggatcacctgaagtcaggagtttgagaccagcctggctaacacggtgaaaccccgtctctactaaatacaaaaaattagccgggcatgatggcacatgcctataatcctagctactcgggaggctgaggcaggagaattgcttgaatccgggagtcagaggttgcagtgagccgagattgtgccactgcacttcagcctgggcaacaagagtgaaactctatcaaaaaaaaaaataggacattgaagttggtttctttttttgatacagagtctcgctctgtcacccaggctggagtgcactggcaggatctcggctcactgcaacctctgcctcctgggttcaagcaattctcctgcctcagcctcctgagtagctgggattacaggcacgcgccaccacgcctggctaattttgtatatttagtagagacagggtttcaccatgttggtcaggttggtctcgaactcctgaccttgtgatccgcccacctcagcctcccaaagtgctgggattgcaggcgtgagccaccgcactctgctttttttttttttttttgccgccctctcacataccatactcccctgtatcacttatccttctgaagttgttattaaatcattaatacaactagctgggcatagtggtgtgcgatggtagtcttagccactcggaaggctgatgtgggaggctagcttgaggccagtagttctaggttaggtgagctatgattgcaccattgcactttagcctgggtgagagcaagctcctgtttcaaaaaaaaaattaattgctaccacttactaaatgcttaatatatggcaaacacttgccaaacactttatatgcttgatttaagcatcaagctagctctgtgaagggtaccagcaggtttcccattttttagatgagcagaccgaggttcttctcgctgcttcatactggaaacttgcacttgattctgaggctcctgcttcttcaagaacactgctttgggttcgcttctcctgtccctggggtctccctttgtgatggtggtgagctgcttcctttctgaatccagcttcaaccctacagttctccagaagctggacgatggggtggagtaaagtcagctccccccgcagtgagggacactgaagctccattctcatctgcggatcacagaggggaagccaggaagagccaggggacggtggacttggggctgggaggtcatctcagagggataaggggtgaggagctctggtttcaagttccaaagccctaggacctccctcttctctgtctgcctgcatttctagcagcctcagcagctagcaggtctagctgcctgcatttctagcagcccagcgcccttgggcggggctggatgtagggaaggtcattgtaccaagaagatagttgggtaaatgtggtacctttgttgtaggattctcttgggagatgtctgcatcaatgaggatggcataaagtaaccagagtcaggatgtggggtctgactcagtgacagaaaaagtggcagtgtgtctctcatagccaaaggggcccttggaccggcagtcgggagtctggggttctctgttggctctgcctcctggcacattgggtttctggacctcagttttctcctctataaaaccgggcagttgggtgggcacggtggctcacacctgtaatcctagcactttaggaggctgaggtgggcagatcatttgggcccaggagttcaagacctgcctgtgtaacatggtgagaccctgtctctacaaaaaatacaaaaattacccaggcgtggtggtatgcacctatagtcccagctgcttgggaggctgaggtgggaggattacttgaacctgggaggtcgaggctgcagtgagctgcgatggtaccactgcactccagcctgggaaacggagcggaccctcaaaacaaaaacaaaaatgaaaaacaagcaaacgaagaaataaaaaaacctagggggttgtagtcgatgatctgtaaggtgagttataattgatgtattggaatatttaggaaaagggcactgggaatatgctaggaacacctgatggaggtatctttatttccacggcagcttcgtggatacgtctcattgattctcatggcatcactttccccatgtaggtgggcagacattgttacccctgtttaataaacaaggaaccaacagaggcttaggagaggagttgcctgatgtcgcatgattggtggcagagccaggatcaacagtggggcagggtggggggacctggccaggcagagactggatgagacctggggtgaggaatggcaggcacccagtcagggcagaaaacgagggttgggacttactttgagttttggattggatcagtaaattcccaagaaagagggagactaggaggctagtgaagaactctggagtaaaggggaggattactaagggacatggagtacctatcatgtgtcggacgcttatctatatctctcccatctgaacaaatccttacaggaaccccaggagacaggttatctccactctgcaaattggaaaacagatccagacagtttcagttatgtgtctgagaagttcatttatgtgtccaagacacattcttagctaaaaagctaagcattctgaattggaacccagagaatttgactcccagactctggatcttttcactgctgtgatccatctgggaaaggctagtgatgtgggcaaggggcttattgccccttggtgtttggttgggagtggtcggattggtgggttgggggcacaaggcagccagatctgggactcctgtgcttgtgactggactacaaagagttaaagaacgttgggcctcctcctcccgcctcctgtggcctcctcctccagctcttcctgtcccgctgttgcaacactgcctcactcttcccctcccaccttctctcccctcctctctgctttaattttctcagaattctctggactgaggctccagttctggcctttggggttcaagatcactgggaccaggccgtgatctctatgcccgagtctcaaccctcaactgtcaccccaaggcacttgggaygtcctggacagaccgagtcccgggaagccccagcactgccgctgccacactgccctgagcccaaatgggggagtgagaggccatagctgtctggcatgggcctctccaccgtgcctgacctgctgctgccrctggtgagaccagggacaaagggaagagtgggctggtgggcgaggcaccttccggctggygtgggccctctccgggagggggccgagcctctcctgcccgggcctggtcctggcgccagcctcaggcctgcaggtcctaacctcagccactgccagtgtggggttccccattcatccgccttttggagtaggggctgcgctgaggcaggggaatgggagaagtttgaaagggagagagtaaaaggaagccctggcccctgacagcggtggaagtttgtgggcggccaagggaatgtgggcaggagataggcccagggtggggcagatttggcggggaaaagaagggagtgggagtaggaagattagtgctcggggagtccagacggttctgaattctgtccctccggtcagctggctggcctggagggtgttgggccgtggggaggcgaggctgcctgtggaacttggtggagcacaccctgtagggcaggattttggcggctggtgaagtgggggagtgagttgaggagtggggatgggctggtgtggtgggtttgggatgctcatggtgggaggtatttgagaatgggctgggacactggatggggcagggcaacccagtggacagtgtccccagtgccctggccaagccccggcctctcacctggggacattctttacccttttgcctgctgctaggcaggtagccgctgtgggactgagccttcccagggagctagtcctacccccacctggtcagtgtccctgggcctgtcctccagcttcccctccccgctgcttctcacagacctaaacaacaatcccttggtttcttattctacagttcagtttggggaagttggtagaaagttgttttcgtcactggaaaatgtccctttctctggcctcagccttgtttcaatgtatccttgatcgtcctccacgtcttggtccgggaatcatcctgttcagatgtcctgggcccatctagtcaggcagattttccctgccctgcccggcctctgaaggctgcgcctacctcccctctctttagtgccttatactcttcctctcctaccattcctttcttccagcaatctccccagactctcctcagacttctcagagcctctttttttgaaatcttttctcgctaatcctccttcccctcctctctgctccgctctggtcccggccccaggtccccaggcagcacgtctctggtcagggtctcactcttcttcttctgcctcctcctgcctccttagtcccacccgctcttcccttcttcccactgtccttcccccacggtctccccaccagccagctgccctgacatcctgcttctgttttctgtttgggggcggcccctggctccctcacatacctcctgcatgaacaagagcagcttatataacctaaccttccatgccttcgtttctttatctccaaaatgggtgtcacagtcttgacctcatactgttgttttgaagattgaatagactgatacatgttaagtgttcatttgatttattaagtgtgcgctctgggctagacactgtgataggtgctgggattacagcagagaacaaaatccctgcccacagctttgacagtccatcaggggaataggttgtagcaaatagaaagcactcaataaagtttttatattgctgtgactagtagtaattactgggtggctacctgtgttgggaaaacagagggtaaaggtagcctgaacaggtaaagggaagtgcctgcgtcctggggtgcttcagcccaggtgggattatgtctcctaagggacagaagcctggcctggagctggargaaagggaaaacaaagggaatgcaacatccttctgaatttctcaccattcagtgggcaatgcagagctcacagtgtgtgtgtgtgtgtgtgtgtgtgtgtgtgtgtgagagagagagagagagagagagagaagtggggtaggggagtagggaagaatgatacaggagagactgtggcaaagcaaacaggattttgctgctctcaaagagcttacagcctagtaaccaagatggcttacagtgaaaaatgatttcagagcaatcccgaggaaaatatccacaaatgcattgtgatgtggtgtcctggagcaccagttgggaggaggaggaactggggaaggaggtgagccttagtccactgcctttccttgcttagcaggtctcagctcctgcgctcagctccagaaaattcaggagcttccccacgctgcttcagtgtccttcactgtgcaactgcagcactccctgtatagatctcagtgcctacaactgactgtctttgactcaagtgagagctcttgagagcacgagctgtgtattatccacctcagcatccctagcacccatacgggacctgtcacattaactgtgccccttaactatttgctgaaggaattaaggaacaagagatgtgtcagatgggatggcggagggaaagcctcatagaaaagtggatgtggagctgacatctgaagtcactgcctgtcagggtagctataaaggagggaagcagagttggatactgatgtgaggaagaggagaggaatggagagatgggattttgtgttgatgggcagggtggcaggaagccagacaccttggttcgggagtggaaaaaccatgttgagaaacactaagaaatgtgaatgggagaattagagggagtgggggagaggatggaggaagagtgttgaatatggttccaggtggaggaattcattcattcgtttattcagaagctgttctcctagggcacattctgtgcccagactgtgattagaagtgaggtgaggcatctcagatgggtgctgtggttcatgcctgtaattccagcacttcaggaggccgaggtgtgtggattgcttgagtccaggagttcgagaccagcctgggcaacacagcaaaaccctgtctctacaaaaaatacaaagattagcggggcatggtggggcgtgcttgtcatcccagctattcgggagactgagctcgggaggacggcttgggcccaggaggtggaggttgtagtgagccctgaccacaccactacattccgtcctggtggtgaaggttgcagtgagctatgattgtgccactgcacttcaccctgggtgacagagtgagaccctgtttcaaaaaaaaaaaaaaaaaagtagtgaggcatctgtggaagtcttcagatcatttccatgaccatggaaatgctgtttggagccaggccctggagatggagaggaaggttcacacacttgtgcgtgcaagttaaagcctgaatgaagatttaaaaagtgtgtaggacggatgggagcaggagagaggctagaagacacttgcaataacccaggtgtgaggcaacccaggaatgcggagaggacygagagatcacagggggaggcctcgcaagatgaactgacacatgggatggcggcagggatagggatggggccctggggagagagcgtggcaagttctcagcattcgtccgggaagtcgatggtgtgtcatttgtctaggtgaggagatggatgaattccgtctggggcatgttaagggtcagggaaatggtcatgtggaagggtgcgcctaccaagctggaggagaggtgctgcaacttctttctgcctttgtatcattcagacacactgtgttcactcatcagtggttctcaaaaggagaggagcacaccagactcttaagtaagggtgtgtgtgcttgtgtgtggggaggtggggggatggtctgaaaactctcccccggagataaatatattcctaccaggggtgctgtctcctcacctccctctttgggaatcactggcttctactagagtggaagacagatgtatcattagatcgatcagttgatccatatttatctgctcccagtctggaggtctggttctgggagytgagrggacaccaggggaggataagacactttctgaccaagacattttttgatctctcatcttataaggttcgtggtcactttggggagatcatatctgtcacccaacataaccatattatgataagagccaaaagtagatagggtcagttcacgtgcttcgagttcacagggactatgggtctaaggagccggggtggaggaaacagacatygtcaatggtggcttcacgggagggagatgggatctcaactgggcccttggaggagaagctgccacgacctcccccaacaccttgacattaaatgaacagacacatgaatgagggggaaaggaagactaattgggtccctgcaaggtggctggatcggggtcagaccacaaggccgatctcagcgtcgcctccccactctgcagccccagcacaggaagtcacactttaaagcctcctctggcggaaattgtgggggagttggaggggtgttgggccaccccctcaactgtctctccacaggcaccccagcttcctgcccttctgctccaggctggagtctgggcctaaagagctcacctcctgtttctcctgttttgcttcatttacgcaactgctgaggactgggcttactggggccagctggtgccagcagtggtgcccagtggtggggagtctgagggccctggctcctagggatcagagagggctgacctggagcattctgggggccaggggaagcctaggaagcagggctggttcttccatccggcatcccttcttgcctgctccctcgttcctggaagtgggtgttcagggctctggaggctttcctgtattgccagtgggcttggggagggtctgtggagactcagaactggccttgtttcctaaggattgtctggggaccccagggaggcccccaaacccagcacaactggtcagaaccagccaggctgtgggaatgcggtgaacccagggtgggagggcagccttggcttgcttcctgctgggackggggagtgttgggggatggagtgagagctcacggaatgggtttagctgttggagacttgttgaactgggaggaggagctggggcggggcctcagctaaaggccgctgaggggctaggaggagccaagtggccctcagggaagggagggcacagacctgatgggcggaagccagggtcgagggagacttcccttcgggatggaatggggagagggaggcatttcccggaacatgtgggccaagtgggacaagggtctgtggcctggctctttgcatggggaggggatggatgggggttgagtggggatgggaaggagggacttggccataggaagaagggattagatggagtcccacttgcatgcaggctggtgccttctgcctttctgctgactcatgacccttgaggagctggggaagctgctagttccctctcccctccctaggtctccctccctctggcctgagtcactggggcggagttgctgggaaaagatttccctttcccggatctgacttaacccccagagtgctggaaagagaagggaacacgtggcctgagaaagcctctctccctccctccctccagggaggctcatcccccactggccagaggtccctgaaaagctccctttaaggctgtctggggctggsgtcccccagttcttcatcatgactctgcctcaagccccctggatgggattcaaagtaccagtgaccttaggtgctccagtggcttcttcggggaaaggaaccacactttcaggactgggaagttcttcccatcaccaccccaaacccttcctgttgccctggaagccccagtcctgttctcagcagaggtggcacggtgttggctggtgcgggcaggggaaggttgttgtcctctgagcaggggcacacgcctccacctgcgggggctgctgttgtgtttctgtgtgtggcttcccctgtttgcggctgaggcttgaacttccgggcctgcacagcttacagctgcagcgtctccccgtggctgactcagggtgactggcctcctgctccgaaatgtggagttggtgaggctgggtggctgtgggctgcctgaccctccttccctgccctagggtttctgtgatctggtgagtcagttgctccccagtgtttaacagacattgaggacaccctcttatctttacacaaagtgtctcttatagtagaaaaaaaaaatgaagcccagggaaaaccagaaatgaagctggcagagatcaaagtccaagttagagctaaatattcactcctggctttgctttcctggcactgatgccggaacaggacaagccatttagctgctgtggggttggcctgagactgcaaagcacaccttccagaatgccatggtgtgcagggggctccaggactccccagcacgccctcagctctgacctgacagtcatccaagctgggtcgctagccttggccagctctatttgcctatgtcctgcacacctttgcccactcctgcccccgtctcaactttgtcccccgtctacccatgcaggatccccaacctttcccttttactctcctccccatttgtccttgccaaccccgggtgtttgtaaattttgaggtggaggggatgggccagggaatgtgagggcggaggcagattgaggtttgatacaaacatgtaaataaacttccttcttctgtccactccccaggagtggtgctcacgggaacatcactcgcccccaccgccagctgactttttcagaaagcttttcatggtgtaacatattcctgggatgtgcatagatcctcattgtttacctctgtgaatgttcgcaaagcgatcacacggtgaacccagcacccagatggagaaacaccgccccaatctttagggctgcttgttggaagaaggggccatcactgaagtaacctgccaattcccaatcaaaaacacatcctttcaacatctgccctgtgtccagcactgttagctgctgtgggggatttcacagtaaggataaaatacagggctgggctcacgcctgtaatcctagcactttgggaagccaaggtgggaggatcacttgagcccaggattttgagaccagtctgagcaacgtaacaagaccctgcctctactaaaaataaaaaaaaattagctgggcatggtggtkcacggccgtagtcccagctattcaggaggctaaggtgggaggactgcttgagcgtgggtggtggagggtgcagtgattgcatcactgcactccagcctggacaacagagcaagatcctgcctaaaaaaaaaaaaatacagcttagatctggggcctactagctttgagttgagggaacaaaaatgaacacacaggacaactagagaacaattaagcatcagattgtatggccccaactgtctaagtttcaaggaagaactctaaacttagtgagtggcgtggcctgggcggaatgtttcactgaggaaggacttgagccagggaagttttagatctgctacccctaagcttcccatccctccctctcttgatggtgtctcctctatctgattcttccccaggtgctcctggagctgttggtgggaatatacccctcaggggttattggactggtccctcacctaggggacagggagaagagagatagtgtgtgtccccaaggaaaatatatccaccctcaaaataattcgatttgctgtaccaagtgccacaaaggtaggggcaagtggaaacggtgaatgccctcaggtctggggtgctgcttctttctctgcttcttccagttgttcttccctaactttgctgtctctcctgggctgggattttctccctccctcctctcctagagacttcagggaatcggccctggctgttgtccctagcatggggctccttccttgtgttctcacccgcagcctaactctgcggccccattcacaggaacctacttgtacaatgactgtccaggccyggggcaggatacggactgcagggagtgtgagagcggctccttcaccgcttcagaaaaccacctcagacactgcctcagctgctccaaatgccgaaagggtgagtgtgcacaggcaggagagtcaggcgggtcttgagtggtgtgtgggtgcctgtctatgtgcaggctggtgggtgtgggcaggaaggtgtgtgttttggtgggacactgcatggatgtgagtgtgtattacagagacacacacttaggggtatgtcaggaaggggatgcagggacaggaggatgcaggactcataccccatcttctcccctcaccagaaatgggtcaggtggagatctcttcttgcacagtggaccrggacaccgtgtgtggctgcaggaagaaccagtaccggcattattggagtgaaaaccttttccagtgcttcaattgcagcctctgcctcaatgggaccgtgcacctctcctgtgagcgcagctctcctgaggccaagccctctccccaccccaggggttggccccttccccatgcggtggcacttcctttccktccccctcctgtattctgtgggtctgacaaccaactcctctctggccgcccccaccctgtccctcrtcacttcctctgtcctgtggggtgggggtgcaggcgctyctcctttagctgtgccgcacttctccctacaggccaggagaaacagaacaccgtgtgcacctgccatgcaggtttctttctaagagaaaacgagtgtgtctcctgtagtaagtgagtatctctgagagctgctgggcactggatggtggcatgggttgggacgggtgactggtgggaaccattagctgggcaacagatgccaggatgccccagagtgctcagggtcctactggctgagtaggagacacttcgttaagacaccaggcagtccttccccttgctcttcaaatctgaagaagtctttgaggatggaagatcatgccccaagggctggcagcccttccaactcagatatgtagattcttggatctacgatagctcattggttctaggacatacactcttatagctctgaaatcaaacctcctataactggtgactcatcatggttgaattggcagctctgtttgcgtctgggtagtaatgtaaagaaaagtgccttttattcttgatggcgtcttaggtttgatgcaatatggtatttcctcattagtcactgtccaggcctccttactcctggctccacagaggctgttcttgtcactcacttgcaaagaataaactctgagggctctcagagtttgaaccccagcatagccacttactggctatgtgacgttgggcaagtttcttaacatctctgagcctgacttttcttttggtgttttttttttttttttttttttgagacagggtttcactctgtcacccaggctggagtgcagtggtgcaaccgtggctcagcctccacctccagggctcaagccatcctcttgccttagcctcctgagtagctgggattagaggcacacaccactacacccagctaatgttttactttttgtagagacagggtcctactatattgcccaggctggcctcggactcctgggctcaagcgatcttccgcctcagcctcccaaagtgctaggattacsggcatgagccaccacgcctggcctgggccttagatttcttatatttaaagtaagcataatgacattcatttggtgaatttgtgagaaccaaaaacaaagaaacaaacaaaacctacaacacgtctgacacaaaactatttattttccattaatcttcttttttttttttttttttttttttgacacagagtcctgctctgtcgcccaggctggaatgcagtggcgcgatctcggctcactgcaacctctgcctcccagattcaagcaattctcctgcttcagcctcccaagtagctgggattacaggcacgtgccaycatgcctggctaatttttgtatttttagtagagatggggtttcaccatcttggtcaggctggtctcaaactcctggtgatccacctgcctctgcctcccaaagtgctgggattacagccgtgagccactgcacccagccggcttcatctcttcttgaaatcacttttataccattctatgtggttctcaccatgagcttgagtggtgggctaaagtgcctctccctgctttcagcttcctgctgggaactcactctctcaagttccttccagcaccaccccatagagttcccatcactccacactgtccagtgacaactcccaacatggaagatctgctagttctacagggtgctctctggctgccccagtaacatgtgtttttaaatttttcacatgcatgtttgaccccgactccccgaagtcaggtactgtaactagcagtgtcatttaagaaaaagccctttaacctctctttgccaaaggattcttatcagcaaaacagtgatgaaacaacaatcccataacagctagctggctaccttctcaagcacttattaaatgaggcataatgattttgcttaatcctcaatcctgagaggtgggcgatccctgtggtgatgaggaaaccgaggcttgggggttaatggcttgcctagattcacactgctagccaaggaatgaactggaatttacaccctgaccctgactgcttttcacattttctacacagccttttcaagatccctgccaattctaaaattaaatgattctatgattaactgtgtttcattcttctgcatcagttcccaaaacaaattatatcaagagacagcaaaaatatttgtaaagaaaggatgtccaacaatctgtgtggttgtttttctgtgttcctccaatggtagggcctctgttcaccagtgccgtctcttcttttagctgtaagaaaagcctggagtgcacgaagttgtgcctaccccagattgagaatgttaagggcactgaggactcaggtgaggagargtgacctggtgcccatgctcacctgccctctccctcttcttgcccccacccgtccatccatcccacccatccatctatccctgcggcccccctctgcccgctcctctgaccaacacctgctttgtctgcaggcaccacagtgctgttgcccctggtcattttctttggtctttgccttttatccctcctcttcattggtttaatgtatcgctaccaacggtggaagtccaagctctactccattggtgagtgggggctttgggagggagagggagctggtgggggtgagggaggacatgggtgggtgcgatggacatgtgtggagggaggtgaggagtgtcccctcagttcataccgctggggactctgggcagaaggtggccctggatggctggggagatgtcgagctgcatcagtagctctctcgtccctggggccacataggccctgaggcatgtcaccacaagtcccyactgccagctgagtccagggtgccagggctgagagaggaagtgaaatttatgatgctttctttcttyttcctcagtttgtgggaaatcgacacctgaaaaagaggtgagatgaaatgagagagttactcccaaatgtccctgaccattccttataattgcctaatgctcagatcccctggaatcatccttcactttccgggggctcgcctcattccctctaagtcccaacccccacgtagaataaagagggccggggctggttttcgctgccgcactaatgctgcgccaccttctctctttcagggggagcttgaaggaactactactaagcccctggccccaaacccaagcttcagtcccactccaggcttcacccccaccctgggcttcagtcccgtgcccagttccaccttcacctccagctccacctatacccccggtgactgtmccaactttgcggctccccgcagagaggtggcaccaccctatcagggggctgaccccatccttgcgacagccctcgcctccgaccccatccccaacccccttcagaagtgggaggacagcgcccacaagccacagagcctagacagtgagtttctcccgcggctggagacgaggaggctgggggagggccgggggagcgcgggaggcgctcccagaggggaccacgagaggcggagggcgcgggatgcggggcggggcctggggttgccgcccgaggctcaccggcccgcgtccccgcagctgatgaccccgcgacgctgtacgccgtggtggagaacgtgcccccgttgcgctggaaggaattcgtgcggcgcctagggctgagcgaccacgagatcgatcggctggagctgcagaacgggcgctgcctgcgcgaggcgcaatacagcatgctggcgacctggaggcggcgcacgccgcggcgcgaggccacgctggagctgctgggacgcgtgctccgcgacatggacctgctgggctgcctggaggacatcgaggaggcgctttgcggccccgccgccctcccgcccgcgcccagtcttctcagatgaggctgcgcccctgcgggcagctctaaggaccgtcctgcgagatcgccttccaaccccacttttttctggaaaggaggggtcctgcaggggcaagcaggagctagcagccgcctacttggtgctaacccctcgatgtacatagcttttctcagctgcctgcgcgccgccgacagtcagcgctgtgcgcgcggagagaggtgcgccgtgggctcaagagcctgagtgggtggtttgcgaggatgagggacgctatgcctcatgcccgttttgggtgtcctcaccagcaaggctgctcgggggcccctggttcgtccctgagcctttttcacagtgcataagcagttttttttgtttttgttwtgttttgttttgtttttaaatcaatcatgttacactaatagaaacttggcactcctgtgccctctgcctggacaagcacatagcaagctgaactgtcctaaggcaggggcgagcacggaacaatggggccttcagctggagctgtggacttttgtacatacactaaaattctgaagttaaagctctgctcttggagacagtggtctgtcgggatgggaggtgggggcagaggcccagatcctgaggggtgagatgggaaaagccctgcactagggccaggtagcccatcaccatcacgccaagtgacagaggagtagcaggttcttgttctgaacaccgtcatctgttgcccaagctggagtgcgctcactgcagcctccaacccttgggctcatggggtcctcccgcctcagcctccggacacaggcacaccaccacacctgggtaatttttaaaatttttttttgtaaagacagggtttccctatattgcccaggctggtctggaactcctgggctcaagggatcctcccacctcagcctcccaaagtgctgggattacaggcagccatgcccagccagggcagtcatttttatgcacaactttctgtggggctcaggtgcacctatgatacataaatttacagttcttgatccccaaacagagcaggaggcagggtgcctgggccaggcttcctttgggaaatgtggtccttgaggtagagtcacagatgccggagggtgaccagcactactggggagagatctcctctgggagagatgcatgccaaaggtcctctgcattcctcatacctctctgaaaagacaggagggggtgttaggcgacattcagtggcaacgggtgagggtcaggtgaagagtgaggcggagagcccttcctgcctcagcccctgttcctgctttgccctctttctatactacaccccaccaccatacagacatccccgtctgccccctcccaggccagcttccctccagcacttacgatgcggacagaggggtgtccagctgaatgatgtggggcccccgcatcctctgcagctgggcccgagtcagcttccgtggcctgctgtcccggggctcctcggccccctcaatcctttggctggccagctcctcccggatctctctgagcatgtcctcagcccgcattgggcgcagggatgtgtggccagctttcaggaacagaggcccctcttcttcctcctcccctgaggactcccaggggctttccccggcagagtcagcatgggttggggaggagggaagctggccccgaagccgggccctgtggagtgtttccaccaccacattccctcgctcggaggccccatcttcttcctcagaccaggttggtgggtcttcctggggaagactgcctccttttaggattccttccggcagttcgggggcgcttcggcgttgaggagcttgggggtcgggagggtggggacgcagagggatgtcccggagttccagggtggagaaggtgaggcgagggtcccgccgaagggctctttggcgtagacggctcagtggggagcgggaccccgtgggggtgcctgggatcaaagtgccgtagccagagtctgaggtatcatctggcacaaggggagcatcttcatctgtgtcttctgtcaccaccaggtgggggataatggtcgagaactcaggagtcctacagttaatggcaaagagtcagatgcgtaggggtcaagttcaagtccagggagtttcccttgatcactacatccagaaatggcccctcctccaaacttattttggtatcatctttccatcgcactgtgattgtttttctcatctggctggctagattttaagctcctaagagagtacgggctgcctctatactgttttatccatagcatctggtccaggatcttgtatcgagtgggtagtcaggtttttgctgagtggttcctgaacttacctgatattatcctcaatgatcgattcttcttttctccttaagctgctgccaagcagtggtgctatcctagacgaacctcacactccccggggatttggcagctctaatattctgcagatccacacctaccttcactctcgagcttgctcctctcacagtgctcctgtgtgactctaggcaggctaactctgtaggctgtctgtgccctatcccccacctccaacccaacacggctggtaccaaccttccgacccaacacagctggtaccgagcttccctaccctgccctacgcctgcgttcctctatctattcccaattccaccaaaaatgtgcagtaatgccatttctcagccttatggctccctcctcctgctcggggagaccttgtagtccgtgtgagccttacctcccctctgcgctgctctgagagccctccagggaaggcgtggagggcctggtgctgggggactccctgtcctggtcccgatagagggtcaggagctccctcttctgttgaacatactcctctgccttcagcttctgtagggcggcctgggacaggacactttcgttattaagagctctcatttattgagcacttgctgtttgccaggcaccctgctaagtgcgttacatatattaccttattttattttattattattattattttttgagactgagtcttgctctgtcacccagactagagtgcagtgccacaatcttggctcactgcaacctccacctcctgggttcaagcgattctcctgcctcagcctccttagtagctgggattacaggcgcccgccaacgtgcccggctaatttttgtatttttagtagagatggggtttcaccatcttggccaggctggtctcaaactcctgaccttgtgatccaccccccttggcctcccaaagtgctggaattagacgtgtaagccaccgtgcccggcctacattaccttatttaatctttacaaaaaccccatgaaccagatatttttaccccaccttactactgagacatggagactctaaggttaagtaactgtctgagggggtacttcttaccataagaaagtggggtggtgccgggatttggtggcaccaaactctggagctagtgttgggggtgagtggggtgaacagaatggcccttttcctacctgtacaggtcttcctgcttctcatgtcccattggcagacctgttatcaggtcttccccctccttcaggaagccctccctggttggtggtgatggtagaataagtgttctgaattggtactggttgctccttcaagagcatccctctcctaccacctgggcctctgccctgaagctgggaggagcaggagggcagaacgtgggcagaggtgggctttgtcccaggctgaggactctgctgtccttcagagggaggaaagttcctagaaggctgaggagaggacgcattatattatctgccttctccctccctcagcgatttcatacaggtaccatcaaaaggaaatagcgccatctgagaaaaaattttcaaagcacttttgcacatgtggtcatttgatacacatcattgccctgtggtgtggagaacatgaatgttagcccattttacagacaagaaacctagacctagagaggtgaagtgacttgctcaaggtgccacaggtatggagaagcagagctgggacagggccttgctctttgagtcctagttcagtcactgcaacactttcaaggacagccttgaagggtaaagagttacagaaggtcggttgttggcttggggaggggtagggggagggagagggaagagaaggtggcagagctgaggttggaggcggaggcaagccttggcaaaagggaggtactggtggctgctgtgggcagcactgatatcaggacttgctggtatggccatatccttgttaaaatattgaagtcttccatgctggtaagggaatggctgctgcctgggcctcaaccacttcccccatccccatgatctagcaactaagggagataacctctggcacagcagaggacctctagtgcagcgctcctttctgattggttgatgcccatgctatactaattgttaaatatttccactatctccccagcttgaagtatatgagccagcaactcctgggcacctggactttcccaaagcctctcaagaaacccggggagcagctgggtcaggacaagagacgaaatggatgaacagggataggaaaatgacaccaggcttatagttcccattctgctttttctggctctccagtcacttattcccaaggctgacagcattctcataagatgtggtctgttggccggagcaggggagggtacctgggggtaggaaacctgccagggccgggacctggggcaggactccctctttcccaggcctcatctcccaactccatgtgaagggagggaagaagtgagaaaagagagggtggaggcgctgggccgatctgcttgtcctgctggggtgcccttttgccccacaggacccaaattcaggtttgtgtttcgggtgccaaggaagggatgttacgggaaagaagaactggaaggaagcagggtttctgtaagggacgttcaatgccatcatctctgctaaacttgccccttgcccgaccccaggaagaggctggaggaggcggcggcgggggaggggggcgagggggagccctgagtacggggtagggggtcgggggaatgggcgggatggggctcttggaggtgcctcccagcgagcccaaagcctctccagcaaccctgggagaattttctcggcttggttaagaggagagacacatgggggcagaggggacgggaaaggaaaaggaaattggcgcttaagccagaatgtgacccccctacaaaactgagaagaggaagggagggcccctagcaggattcttcttcctttgtacccatggagaggaaatgcctcctttccctgctgtctctggggtggctcctagattcacccactctcctcccagaactccccagtgccggactaaaaccgaactctgaaacgtgcccactgacttcctgagcaacagatgcggatgcgtttccccagtcagcagcaggccctacccaggccccaaagaccacccctttcttctaatgatgacaacggcaaacatttatggagtgcccatacagtgctgggccttgtgcctggccacttgcggactgtctgtcctgcgtgcactgcaactccccaagaggtgaagtaactccctgacagctgctcgggcctctccttcagaccctggctcttagcctcggctgcctccttcagtctccctgctttaatttcttggtcgccatctctgacggctctttctgttcctgtctctgttccttttcctcttctcagtccctgggcattccccaagattcagtctcttctccctggagaagcttactttctctaaaagtgtgagtcatcacagctagacccgctaggaataaatctgcaagtcaacgtttctgccagggtgagaaaacaatagtctgccccctggggattgctctatgaaagggaccaacagagtttctactgccctcttcagtgtataaagactgatggctctagagaggattccctaataatctggtgtgagacaatagcaggaaaagtcatttcaaagtttcagttttctttgttttgctaaggaaggccagggagccttggtgcatatcttggttatagatcttgacagatctttcctgttagcctggagtgagactaccaggggactgagttgttttgcatagtaaaatacccgtaattttcagtagctcttgggattctgaaagggagaaggtgagagtctggctgttgttctgtgactaaaaaccaaaaaaagaggagaaagttctgaaggtggaggtggcagttccgaaggaaaaaaggcagcctgccattcactgccagccccactggctatcctggggagttggggctctagggacaccgatgccactagcttgcgcttttgtccctgggctcccccttgagcctctagccttcaggaaaatgttttatttaactttttttttttttagacaaggtctcaccctgttgtctgggttgtagtgcagtggtgggaacatagctcaccgcaggctctatctcccgggttcaagtgatcctcccacctcagcctcccgagtagctggg

SEQ ID NO: 17952 - DNA, 394468 bp, Homo sapiens
  misc_feature (1)...(394468): n = A,T,C or G, or insertion/deletion polymorphism (see Tables 1-2)
cggagagataaaattctctgcaatataggatgttttaaaaaaatattttccttaagggaggctgagtgtgtgattcttgaataaaatgtgagatcaaactgatttttagtctccctgggaatgaagatcctgatgactcaactggaagagaattcagaatcatcaaaattgtttcagcctggtcaggtagggtggtcaagctgctcacatttatgataggaaagcatagtttacatctgggcacttaagcacagggctgtgagttcggagctaaaaattggcccggagtgacctgaaagctgtctactctgtactgtttgtgcctaacctgaaattttgctgttttcttagggtaaaattatgaaaattccaggcacctgctgtgacacatgtgagtgcgttactaatatcttgtcccttgaaacccatcagagcaagtccaggggctctttgcagcttgctccttgaaacccattagcaagccgcatgactgttctttggagtaagctttatttcagaaagatatttcgtgaccactggtcagtcattatgttcagtcttgcagggagcagcctcccctccttggatgtcatcagactgccctcttgaactcccttttagatcccatggagcaatctctttccccttttcctgcaaactccctcctgtctccagcttcttatgtgccttttccctcataggatctttgattgctcatagtcctatcctgggacgatatgttccctctctaaccaaagcttcttgaagacaggcaccttggatctatgatcctgacagagtagactctcaacacatatctattcatgagtgtgctaaagctatctcaaagagaaagcgaagccaccagctggctgacaacagcccacatgtgctgtgggggctggtctaagtttatcaccccctcttcttcactctgagctcctctttacctcgtagttatgtcctactgattggttctcattgctcacagcagcagctttggagacgagacacaaatctgcacatcagacagtgttcttcccatacatgcttgtgtttgtgagcacaaataactttcaggatcccaatgctaatgccataatttctgaatatagaattacttgcctggactaagattttttgttttagattagggtatttcttttctgccctgggttcacaggtccatgcttgtttacagatagagaaaggaagagtgaaaacatgaatactttcagtgttcaatcattcattcttgacagcccctgcaattgctgtaaccaaatctcagatcgaggaagcactctgaaagcatgtctttctatgattcccatttgaatggtttaagaatgtgaagtcaggaaaccatcagagaagaagaattctctctaggcacactgcacgtggaatttgattaggagactgttacctacaaaaccaccacaaagggtctttgttggtcaactcattcaagaggcttcgagatctttaataaggacaataagccaggctcagggccttaaatccacagcaacatagtatagtatgctggtctaaatgttttttttttttaattcatcctcttaatgtaattggcaggctttccctttacaatgaaattatctagaaattaggaggcagactaatatgtagttagggttgatttagatttcgagccatctaaggacagaaaactcccagtgttcagactggaatggtgagctgggattaaatttttgaattcccagtgggccaagtagagattcagatctgaatgccactaacccctgtgtgaaaggaaacccccatgtcagcaacctggagtcagcagtacccgaagagaggccttcacaaaggtgcctagggatcttctcggtccccagagaggcagggtatgcccttacatcaccatgacttcgcctttcctcttaccccaaggcaggaatgaagagatagtaattatacttattgactacttcattgcccattagcttctgaatgtagttacaagcacaagagggttgctttagccatgtggtttttagagtctacaatgatacaaaggcaagtcttcctcattttacatcaccatagcacagtgaatttaggctcttcctgcaattaaaattgtaccattaagtgagttaagtccagcaataactatatctctgcatatttcgggccaggaacagctgaggtgaaccaggataactgaattccctccctgtggctggctttatttggttactgtgaaagggacctatttccagcccagtgagggcactggggctgaagagtgttctctagaaccccagccagtcctcaagtttcatctctcacctgtcctgtaggtgaggagcctgagtgcaacgacatcactgccaggctgcagtatgtcaaggtgggaagctgtaagtctgaagtagaggtggatatccactactgccaggtaagggctctgcttcaataagggctgggtgtggagggctgagcctccgtgttcggatacctatccttagttacattctagaaggatctggaaaattcgcagggaagagaagggaaataaactggaagcatttttttttaagcaaatgttttattgaagtaactggaaatttttgactccaggaaaaaaacaaaaatggaggaaagactcagcaaatcctttacagaaaatggagagttatttatgcaagatgggggccacaattcttgaagatcagtcaaacatatataaaattttcctgcataaaacatgcataatcaggcataaaacattttatgcattaacatgcataaaaattgcagctagaggggtgtgggtatgatattattaccatagagaagaggacatgtcagacctatgatcttcctttacaaattgcctagctgtcctgggtgcttctgggtgagatcagacctgccttgcttggagggggtcagggagaaagcaggctgccccagagccctgcctaagccaggacttcccaccattgtgaagctcccatcttcctctgctttcttgcagggcaaatgtgccagcaaagccatgtactccattgacatcaacgatgtgcaggaccagtgctcctgctgctctccgacacggacggagcccatgcaggtggccctgcactgcaccaatggctctgttgtgtaccatgaggttctcaatgccatggagtgcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgcaaaaggctgctggtgcactgtgtcgtagggctgagatggcaacggtgggcaggggctgagttctgagaccggttctgaggaaggaagcacaggccccatctgcaagcctcagtgtcagtgtgagatactgccaacctctggggaagagtgatgtctttgcctccaggggtgggaaaggcatagcatggggtaggcctcttctgaaactcagcacaaagtaaaagggattttcccagcaacactggattctccagtctctgaatggaggggcttctgaacatagcagaggggtgggtcctggagccaggctcctgctgagatagatactattgttgtcacatggctggcagtgtggagaaggtgtctgaccaggtgtgcaaggatttctctgagcccgtggctcacagggttcctgtgtacccatagtggcccctgtgggagggagaggtgctgacgactgatggggacctggaaacagggtgctggcaggtgcagtagtgtggtcacccaactcagcctgaggccatgagccccagatttggaggcagacctgggctccacacatggccctcgctcagctgtgtggcctcaaacaagccccttggtggttctcagactcagtttcctcatctggaaaacaggagtgttgttctcactcataaggtggtaaggataaacaacctcagcctaaaatagggcctgcaagtccttaggtaactgtaaattgctctgtaatcatgtaagaagtggcgagaataacaatggggagatcaaggctttcggtagggaataagagactctaatgttaacagcagagcattagagatttcctttgtggtgagggctggaccggctgggtttctatcaggctttatgcttgatgccaaggtcctacatactccagacatccttcagtggaagaggaagtggtgtagataacaccaaacatcatccagtccccaaatcactaactggtactgtcacttgcagttagagatggtccttccttaaaatgtatggaagaattttcatgtacatgctggcaagatggtggggactcttgctggggagaatacccatgagaaagaaggggatgtcctggattacaagaatttgatgaagaattgattttcattccaaatacttttgacacaggagagactcagctcattgaaagtactggataatggaatcaaaagggacttagacatcatctagtccactgtccctcctccactcctttacaagtgatgaaagcagctcagagaattcaagtgacttgccaaaggtcataactgctgggtggcagggccaggttcagaacccaggtgacttgacacctgcataagaactcccaggccaccccatcagagccacaccatccctgttgcttacactcctcccgtgctgacatggggaccagtgactgctgcacccttaagttcccaccacttctgttactgcctgagcttaaccttaagagaagccacattacaggaaaatggcatagattatgctgagtaggcttggtggggagtttagtggggcagaagggaggaagaatggatagaagttttatgtaactactcagtaattcaaaggttactgtctctccatccatcaccccactcccaactttgggtagcctctaaggtctctcttggtaggaaaccagatccagggacagggaattaactgtcactcttctgactgatcgcctaacactctagctggggacaaggtgttattggaggcatcagctctggagaaattcagcaggaaggctaggctaccactgcagcataggtggttgattttccaactgcctgtgtcttgctagcttgaacttctcatgtttactgatatgtcattttaccgtcaagaaaaaagctgaatcggaaaactgcatgttttgattattttaaaaaaacccaaaacgatggaagagagctgggtaaaaaggatgcaagaagagaaacttgtggggctagtgtgtgcggagcggtgtctcggcagtcttcttttatttacaggtattccaaaggcactatctgtacctggtttcagggaccctcttttttactcaccctcagaccaggcaagacagagtgccccaaagtggatgttttaaggggagtctcaaggaaggagtatatagacactaagaaactgctggagggaaagaagaaagggaatgaatgaaagagcaatggtgaccatttttcaatcgtttggggattgaaaagacataacggtccctggaagtagacagggagaaaggggttgttagggacagaaaggagcagaatagcagagtgttatgccacagactccagggcaggctgcctgctttggaatcctaggatcctcttagaggcaagttacttgccatttaacactgcagttctctcatctgtaaaatgggcacactgcagtgattgcctcatatacttattgttaggattaaaataactaccatagggaaagcactgagaagggtgttgggtggagaggaagtcctgtagaagcattagctggtagtacttgcagtggatggaataaaggcctgggttgggacatcacatcttgtggttttccttctgctctgccctcgactgtggtgtcacttactcccctttgcttccccaggctccttctctataaagtgggatctatcatgaccagcctaccttatcaatataggagagaaaatcttcatgcctgaaggtcagtgatcacaaatggcatacttgaccttaacatagtacttcttcattttgggggtccatggtattaatgaacttgttttacttctgtgcatcttggagttgcagattccatcgtgcagaagggccctttggaggtcttccctcccatccccctgcccaggtccgtgaactgtcccggggagctggcactcctcttcccctctggggatggagcttccatcatctactccctcaaccttccttaaccctcctagcgtctcatgggagagctcttataaaatggacccctcctcctgcctctggcagcccctcctgttttgcggtcccttgtgcacttactacctgcctcttctcccttttgttctgcttaacctaggggaaggtgaggacagctggtctccacctagtatggagacaggtgtgggagatccgccgtccaggggctcgcccccactcccgccccagggctaactcttgggcagtggatgaccctttggggcggcgggaagaaggttttgctggcaggattggaaactaatcagccagacagttcatgagataatccggctgaatttttacactcgaagcaggttgtggggcgttgccccggctctgggggagcagggagcgtttactgtctcgcccctcagccccacggacccgagtgtgtcctggactcaacccggccgcgggaccgcgctccattctcgacgccccgctcccagcacccgggcgcccagggcgcagcggggagagctgggctgtggctgcgcggcgccggcggccgggagggatgggggaggaggaggcggcagccggcgaggggcgggcgcgccgggacggagctgagccgcgatggaattagccccgcggcggcataagcctgcccagaagcgcgcggccgcgggccggcggggtccgcgtccacatcatggcgactcccgggccgcgcggtgagttttccggctggacctggtcctggtctcctacaggtggtaggagggagggagtgaaggaggcggcatccgaactcccacycttcgggattggggacccccaagggagcctgggcagggtggtgcgggaagttgaccccgtttttccagggtagggactctgagggacgtctatgtaatttccgagacgttttttgttttttgttttgttttgttttttttttaactcaaggagagggaaggtaggacaacagaggtttgggcggccgcttctctgtgattggttaccaatccccacctctgtgatgttgcctctccttgttacaagtcctggggacgtttagcctacagcatctgaaggtaagtaaacaataagtaaacaaccagccggactgggtttaactcagcaacggtccgytgaggacagagcaaatttgactttggcatccctggagtggcctctcagtttcagaagttttttccagtgtcttacccaaaaccgcattcaggaagggttccaagatcaggcatttacaccccaggctgcagggaaacacagctataccttcccgagggacttttcttagaagaaaagcaaattgaggtggagtatggagaagaaagacgttattttattgcttttgggcaggactgactttgcctgggacagggactttgtcggctgttgtgtttctggtaattcttgagacaggcatgaagagggaggtgcccgctcctttggcatgaacaatgagctgagtgcactgggaggtggtgtcagtcacagtcctgatactttgtgagcagatgtggagaaataccaccccgggaccatgtggaacctcgtctgggacagaaggtcccactgagcaaggtcgggtctcagcccaaaggcaggtggcaggtggagggaggatcttagacaaggtgaaggtgcttccagaggactgtggtcctcttggccctccacctgccgagcctttgtccttggaacctggcatcagagcccctgcccagtctctctgtcaccctggctcagctgctgggcatccagggctcatttgctcctctcagtgtgtcttaacgtgcacccgtcatttccggagccaagcacctgattcgatcctttccagcaactgcttctgctgtctgagttgcctctatgtgggtaccagagccactctgctggttgactgtagagactgtgtgaggggtaagggtgggatccaaacacacacctcaagttctagtccagtttccaggtgtgccatctcttcatcttccattgtggggcaaggctgcagggtgagaggcatttgggcctactggggagtgtgtctataattttctgtaacaaagacctaattttctggaaagctacccattctgtgggctgagagaagcccatcccaccctatgtatgacgttgctagagcacatgcatagcaggtatttggctgctagggacggtgttattgtctctagtacacggtataatccatctgtattgtttaaaaattgttttaaaaatgtcagtagtttttagggtacggggttttgcttttggttacatgggtaagttctttggtggtgaattctgagattttagtgcctcctcacccgagcagtgtacattgtacccagtatgtaatcttttatcccttatccctcctcccacccttacccgctgagtccccaaagtccatgatatcattcttatgtctttgcatcctcatagcataactcccacttatgaatgagaacatatgatatttagttacccattcctgagttacttcacttacaataatggcctctagctccatccaatttgctgcaaaagacttattttgtttcttttcatggccgagtagtattacacacacacacacacacacacacacacacacaaacacacactcaaacacagacatcccacattttctttattcactttttagttaatgggcatttaagttggttccctatctttgcaattgtgaattgagctgctataaacatacatgtgcatgtgtcttttttatataatgacttcattttctttaggtagatgcccagtagtgggattrctggatctaatggtgttctacttttagttctttaaagactctccatactgtttttctatagtggttgtactagtttacattctcagcagcagtgttaaagtgttcccttttcatcacatccatgccgacatctagtaaaatttttgactttttagttatagccattcttgcagcagtaaggtgggttatctcattgtggttttaatttgcatttccctgatgattagtgatgctgaacattttttcatatgtttgttggctgtttatatatcttcttttgagaaacgtctattctccatcactattcgtaactaagtggttagcgaaggcctctcttaggagatgaatttgaacagagattgcattaaatgaaggaacaagccatgcagatatctggaggattgtctagcaaaggaagtaaaggcaaaagaacccatggcaaggagatgcttgggctgtggagcttcccctgtggggaagctaagggctgcagcagagggatcaagagggagagaggtaagagccagccaggttgtgtgcggtcttgtggctcaggccacgtgttcctggcattcaaagggaaagggaagacagtaagtaacatggctgtcattatgtaatgaaaggagactggtttatctacactaaaatatcacgagttcatggtgatattgatgtaagacattgcccaacataacgagctgtattttcattagtaggtttttaaaatgagtattatttatcacgtgggcatttatcatattatttttaattttaaaagaggaacgtttttgccttattcttttctggtccattctaccccattacactttaaaaaatgctatttgaaaaccatgaaatttatatcataactaattaataggttaaacctgttatcctaaaagtagtgacttagtcatagggaacagtcaatggctagtagtctrtttggagcagtgacactgagtctctttttccttctctgtgtaagaaagggatacgcggcactccatcaggaagttcttaggaagaattcttaatcgcatttccatttgttatcctttcccttcagcctgcagaacatcctgtagcattgttagaggtgcagttctgctggtgacattctctcaacttgtgtttttatgaaaaatgtctttatttcatccttatttttgaaggatacttcattggatatagatgaatggtttgatagctttttttccacccccagccccagccctctgggtatcactcttttggtctccattgttttgacgagaagctagcctaaattcatatttaaatattcttcattatcttattaatgtataatctcttttgaatttggtagtgttcaagatttgatattcagttttggttttcagtattttgactctgatgtatctaggtgtggttttcttttttttttttaacttgagtttgctggacttcttaaatctgttattacaagttattgtattttatcaaattttgagacaatttcagccactatttattcaactatttttattttattttttttcttcttcaactatttttgatctgcttttcttttcttctttttgtggaactccagtcacatgaacgttagcttgtttggtatcgccctactagtttctgaggtgctgttaaatttttccaatctttatcctctgctctctagatttgattacttttgttggatccatctttaacttcactgatcctttctctgccgtctccagtttgctgttaatcccacccaatggatttttcttttccataattgtaatttttaattctaggaattccattgaaaaacagctttattgagatacaattcacataccataaaatgtaccctttaaaggtgtccagttcagtggctgttggtatattcacagagttgttcaaccatcaccgcaatctagtttaaagcatttgcrtcatcctaaagagaaacttcacactcaatggcagttgctcatttttcctccctccccctagcccttggcaaccgcgaatccactttctgtctccatggatatgcctattctacacattttatgtaaatggaaccatacaatgtgtggcattttgtgtctgtgttctttcacttagcataatgctttcaaggttaatgtgtattgttacacatatcggtacttcattcttttttatagctgaaatctatttccttgggtggataggctacattttgtttatccatttgccagttcatgggcatttgtgtgtcctagtttttgttactataaatgatactgctatgaactttcaagtacaagtctttgtgtgtacatgttttttagttctcttggtcatatacctaggagaagaattgctgggtcatatgtttaactttgattgtcagactattttccaaagtggctgtaccattttacattcccaccagcaatttatgagggttctgatttctccacaaactcaccagcagttgttrttattcatctttttattatagccatcctcatggacgtgaagtagtgtgttactgtggttttgcctgaaccyaggagcaagacaagcctgtcactggagaaggaaaagctcctctgcctgcaaatccccaagcatgcttaggcttcctggtcttagaagtgtgtgcctcaatgatggggaggaccctccacttggacggcttctgtgtggctcttcgacttctaaaacatacgttagagaactgatgataataccagtttaagaatcagagggtgcaggaatgggttctatacaatctatctaaattcaaatgctaaattttgctaaatgtagttaacttgtgcctaaatgatttgatccagtttataggtgtactggaggcatgcccaccttccatatcaaasgggaaggcaagcatctttctctaaattgacaacatcgrtatgtggcattccaggaggagcctcaagaagcaacagaatctgttggccaactactgtcacacaagctcaccatccatccatctatccatccatccatccatccatccatccattgatttaaaaaccatttaataagcatttaccatatccctgccttgtcctgggtgctgaactggatctsagagcctacttggggagataaatgtggaaatgtataactttaacacaatataaggtgtgaacatgctacaccaagcttttcatttttggtaggcctctgtgacagagactactagctgcttaccaaaatccatgttctcctcttcttcctgaacacacagctcgaccttatttcctagcctcccttacagttagttatgacactgaattttagccaaaggaatctgaacagtgacatgtgctacttctggccctggcccctggaagccttccatgcctgttcttccatgcgctttctacctttcggaaaacaggaatggcattactgtgactcatatagtatccttcaccatcggtgtggataataataaattacttataagagcgttaacccagtccactgagtgactgttcatgtcaaatctccatatttctaagccttgctcaacagagcctttcccaaatttccaccaacctaacagatttaacccacctcacacttmtgcataccacaggtggggagagatactcaaaggcagggatggaggatggatctaactcatctttgatccttactgcagcctgacacacggtaggtgctcaatgagtgggtgtttcattgagcaggtgctcaaattgaaatgttgaaaagaagagcagggagaaacttctaggcaaagtcatctcttctgtgctttgtggtttagaattctggagcttttgattatgttgaatcaagtgttcttgaggaaacacaaagttttttttttttttttttttttttgttggagtcttgctctgtcactaggctggagtgcagtggtgccatctcagctcactgcaacctctgcctcccgggttcaaacgattctcctgtctcagcctcccgagtagctgggactacaggcgcgcaccactacgcccagctaatttttgtatttttagtagagacggggttttactctcttggccaggatggtcttgatctcttgacctcatcatccgcctgcctcggcctctcaaagtgctaggattacaggcctgagccaccttgcctggccacaaaattattttaaaaaaaaaatattggccttggttacaggtgctcctgtggcctacctcaggacaagaaaaaaggttgggatcttagcttatcttgtttttttctttttgagacagagttttgctcttgtcgcccaggctgaagtgcaatggtgcaatcttggctcactgcaacctctgcctcccgggttcaagcaattctcctgcctcagcctcctgagtagctgggattacaggtgcctgccaccacacccagctaatttttgtattttttttcagtagagacggagtttcaccatgttggccaggctggtcttgaactcctgacctcaggtaatccatttgcttcgatctcccaaagtgctgggattataggcgtgagccaccatgcctggcccttagcttatcttaataagtaaataaaatagactgggtgcagtggctcatgcctataatcacagcactttgggaggctgaggccataatggaataactggtcctgggatagacattctgtcataaattataatactggaaaaaaatatgtagatcagttattttcaggtactgaacaagcaccagcatagaagtacaatccctgaaagaagagaaatttagccctctgagtgcaggctatttaccaggggtcagggatctggagtccacatggaggaaaggatcccactgaactgagaagacagagataaaaatttggagcagcaaaatgcctggaaatgcttattaaatgcctggaaattatggggaagaacacagagaggaggaatgtgtgtgaaaggaggtgcccagagggctctttggggacccttcgtgagtccttggctaagagtgaggcttcacatgcacagggtgaggcatatgaagtttgccagagagaagctgctgcagcattgagatcagaacagaaatggtagaagtcgaacggtactgggagatgttgaaagtccatcccagccagagtggcaagacctcatgagcatgtcctaacattccagacatgtagctgagacccccaggggctttgttttaggagtaagaagcacacggtagagaaaaatttactctggatggtccctgaagaacactaaggccaagcctagaaagatcaatagggaagacaagagtttagaggctgaacccttccagattagagcctcttgagaaacaccttggattttccacagcataccctggcaacaacagcaaactcctacataagctcaaagtgatcagcycatagttgaacttcctgctagaaagttaaaaaaaaaaattccaaccccctcgataggaagataatgttttatcattcacaatgtccagtataccataaaacttactagacatgcaaataaatagaaataagtgatccatgaaaaagagacaaaggaaacaaaatgaaaaggcagccaatgaagtggaaggaaatatttggcaactgtgtatcagataagaagttaatattcacaatatataaggaactcacacaatccaatagcaaaaatacaaataacctaattaaaaaataggcaaatgacctggatagacatttctccaaagaagacataaaagtggccaacaggtatatgaaaaagtcctcgacgtcaccagtcattagggaaatgcraatcaaaactacagtgagatatcatcgcatacctgttaggatagctaatataaaaaagtcaggagataactcttttggaaggaatgtggagaaaaaggagcccttatacactgttggtggaatgcagtttcatgcagtcattgtggaaaacagtttgaagttgctaaagaaataaaaaaatggaaccaccatatgacccagaaattcctattctgggtatatactgaaagaagtaaaatcactacctggtaaaggtatctgcactgccatgttcattgaaacattattcacagtggtcaagatatggaaacaacctaagtgcctgtcactttatggtatagaattttggagctttgatgatgttgcatccaagtaaatattctataaaaataaaattctataaaaattctggagctttgattatgctgaattcaactagagagtcatgtacaaagaatgaagttggaccctttcctcactcatacataaaaattaactcaaagtgaatcgtagatgtaaatgtagtagttaaattgataaaactagaagacaacatagaagtaaatcttcgcaaccttggtttaggtgatgttttcttaatgttacaccaaaaccataagcattctgtctcagtttgctcactctaacaaaatgccagagactggcttgtttataaagcacagaaatttatttcttacagttctccaggctgggaagtccaggatcaaggtgtcagcattcagtatctggtgacagctgctctctgcttccaagatggcactttgtttttgtgtccttacttggggggagaagggcaaaaagagggtctagcctgttcctttgagcccttttataagggtactaacccatttgtaaaggcagagcccttatgacttaatccttcccagagggacccacttcttaattctgctgcattgagggttaagtttcaatatgaattttggaagagacaccgatagtcaaaccgtgacacatcagataaaaaatagacaaaatggacttcataaaaattaaaaatgctccaaaagagcatttttggttgcaggtgcttctcttgactccatcaagaaaattgaacagacaacctacagaatgggagaaaatatttgtgagtcatatatcagacaaaggacttatatctggaatatagaaataactcttataactcaacaatraaaagatgaacctgattttaaaatgagcaaaagctctgaatagacatttctccaaagaagatatgcaaattgctagtaagcacgtaaaaagatgttcaacattattggtcattagggaaatgtaaatccacccaaatagtggtgcttctttcttctaatatttcaagatctgtgactagatctgtgctccctgttttgactctgttagtgattctctagactaatggtctcaaccctggttgtaccatagaatcaccccagataaattaagtccaaatctgtggaggtgaaacccagacatcaatattttaaccttcttgggtgattctaatgaatatccaaggttgagaacccctctgtgttcccatttgtctttttccagttgcggaatcctaatattttaagtctggcttcccatgacaggctccttctccacacagaataggtcttgtatgcttctgtgccccttctccagaactttttttctcccagttttgtcctttgggatatggtggccataatttcacagatgctcaaatgaggacatatcctggttttgaataagagcgatctgcatttggctagaccacagtagcctggtggaggagaagttatgagaaaataaaaaatgtatttctcaaaattttcccccactagttattatgctatctccagtcacccttaaagtctgacccagtaatgatgggagtccctaggtgtgtctccagtgccttcatgaacaatcctctcgactttcacatggtgttaccattgtggtggatgtttgctattgaacctccttttctcacactctgccctcaaagattattatgtaccaggtcatatgctcagggcttaggatacagaggtgaataagataggtactatgcctatcctcaagcagtgtgcaactagcccattaagctcactgtctatacaatatgaattcactcataccagttaaaaaagctgtaacagaggcattttctgagcactttcctacagactataaataaatatatttgggatattttataaaattctcaggattgttcctatccctcatgtctgctgcatccttccataacccccagcatctcacccagttccaaagtcctcagtagcctgagagtgggagctatgattggaagagctgttttaggctttaacctcagtcccagtccattttgggtaggagaaacctattcctactttggagagatgagaataagaatgatatctttaatcttggttacacccaggaggaakagatgggagatgtttatgggtggtggagaatgatgagggacacggagrgagcccattgaatatacccaggatgtcaatggaagagcaaacagagcaaatctgttgcaaaacaggttataattaatgagccaacagaccagttttgaccaattttatgttgtacactggctacttcctcatgacatgtaaggaggggcatttataccttaatctcatcagccatactccaaaccaaagtgtaggatgggctgccaatgagtaggtttcatttaggcaactcatccaagtcccaatttgtaaattttgtcattgagagaagcacttcctgaaatgaatttctcattcgattacattctcaataagataattctctcttattcttattctcttggtcttaactgttaggatcttgggtctgatcattgactataaatgctatttgtaaaaagacctttttaaagggtgagggatgttaagaatgtccagccaggaagggatttaccaagtaatgttggccatttatcttccttttgcacagcattgcttagtggagaaaagtgtggactgagtgtgctggtgatcttggacaacttacctggcctctctgtgcttcagtttcctcatcagtaaaatggtgacaacaatggtacctacctcagggttatcgtgaagattacataaattgatacatgtaaagtgtttaaaacagtgtctgacacatgtaaagtgttagcgattagtgttgtagttgttactagtagggcagttctatgttcagttcagcacaggggaatccatcctgtttcaaaattcactcacaagaaaggattcctcagttccctacatcgttacctccaaaagcttttagagctcttattgcatccagagtcctgtgctaggaatacagagataaaaaaggcaaatctgaacttctagaggacttccttcagtggttagggaaggcgtggtataggagtaggactttacctgggtatgacttagcttagtggagaggacatgccaaacagaagtaacagcctaggcagaggcacagagtgagcatcagtctggggacaggtttgactaaagaggaatgttcttgtctgatggagggatttggcagcagagacatgtaacagtcagctgtgtaagtctttggatgccaagttgtttgtaagcctcaagacagtggaagttttgagtagcagtgtgaccagtgaaataaaattttgtgaattttataaagggtacgtgtatcagaaaaacagttaggaatctgtccatccatttattcacctacccacctgtccatccacccacccrcccatccatttatccatccttctcctggcacctcatttatcctcactacagccagggccatctttctaatgtaatctaattatgttgttctcttgcttaaaatcttttaacattataataaattgtgaacctcgttaacagagtggaatttggggtggttgtatggttggggagagaagtttagagacagaagggcaaataaaaaagcagatcaccttctgggagctgcaggcagttcattctctggagtttctgtgcatgtgtggctgtgtgtgcacaagaggagagtcactagcaggagatgacagtgggaaggttgacaagaaagatggtaaagggccttgtaggccatgttaagaagtgtgcactatacaccagatagggccctttctgtgcccctcaaatctcaccacgtagctggccccttgtggggactccgcaggcagaaaatgagggtgaggaggctagcagtcattgctctcaggagggccataatctcaaccagccaggcccgaggcccattgcaatggatcatacaaatcactgcctttcttcctggagtctcctttcctcctttgcccattggtagatgcctagttaattcttctagttgcatgcaaaagccgtgtcctctgggagcctccctgacagctctagggagagctgagggcttctgcttccatggatccttcttcatactttcatgttgactctcctcccattctggagattatctccttgttagtcttccttcctcactagtctactttccttcctcactggtctactttccttcctctctagtctaccttccttccttactcgtctaccttctttccttattagtcactttcttaccagtcttccttccttactagtctatcttctttcctcactcgtctaccttctttccttattagtcactttcttaccagtcttccttccttactagtctaccttctttcctcactcgtctaccttctttccttattagtcactttcttaccagtcttccttccttactagtctaccttctttcctcactcgtctaccttctttccttattagtcactttcttaccagtcttccttccttactagtctaccttctttcctcactcgtctaccttctttccttattagtcactttgttaccagtcttccttccttactagtctaccttctttcctcactcgtctgccttctttccttattagtcactttcttaccagtcttccttccttactagtctaccttctttcctcactcgtctaccttctttccttattagtcactttcttaccagtcttccttccttactagtctatcttctttcctcactcatctaccttctttccttattagtcactttcttaccagtcttccttccttactagtctatcttctttcctcactcgtctaccttctttccttattagtcactttcttaccagtcttccttccttactagtctatcttctttcctcactcgtctaccttctttccttataggccttccttccttgtgattacccagggcttgatggaaggagccagattctgtttagctttaattcccaatgttttatacaatacctgggaagttaaatgggtctgcaatgaatgaacagagatgtgaaatactgcacgtatatcatccccaccccaacctcccaaagaatggtcatttgctgtgcttggagcctggcatgatggtgtgggtaatgggggtatagggggaaggccagcagtggatgagtgttgggagatgaagtggtccagacgggtaggtgcggactcgatcawraaagaccctgtatgtcatatatgacaatttggtcttcatcctaagaagagtaggcaaccacagagtgggactaacttggtgagattgtttcaaaatggtaatagtagctgtggtgtgagcccaggatgagagagaagcaagataagcagtaggaaggccagcttacttctatcagaggggaacaaggcaaggatgcaaactgtggtggtggcatcatcaggaaaggggggcatgtgcattggagagagagggctaattctgagccaaggctataagacaagcagagcccaggaggcggatatgcaaatggattttatgtgtgtgtgagtatggagggaactggagagcagtcctgttactgtggctgcatatagagactgagggaagtgctgttctgcaggacctctggggcaaggggtggggtaatcaggagggccattgggcccaaattttaagcctggagcttcaaattttggctgttgtcctgggtccaattcatgcaagaagcaggatgagacctgggtgtaaatgttgattctaactgaaatgaagtgcccagggcacttgaggaggggtccagggggagggtcttcaatctgaaagcacccaggtctctctgaggcttctaccagggcatgccttcagcaggaccatggttgcctactcttcttaggatgaagaccaaattgtcatatatgacatacagggtctttcctgatcgagtccgcacctacccgtctggaccacttcatctcccaacactcatccactgctggccttccccctatacccccattacccacaccatcatgccaggctccaagcacagcaaatgaccattctttgggaggttggggtggggatgatatacgtgcagtatttcacatctctgttcgttcattgcagacccatttaacttcccaggtattgtataaaacaytgggaattaaagctaaacagaatgtggctccttccatcaaaccctgggtaatcacaaggaaggaaggcctataaggaaagaaggcagacragtgaggaaagaaggtagactagtaaggaaggaagactggtaagaaagtgactaataaggaaagaaggcagacgagtgaggaaagaaggtagactagtaaggaaggaagactggtaagaaagtgactaataaggaaagaaggcagacgagtgaggaaagaaggtagactagtaaggaaggaagactggtaagaaagtgactaataaggaaagaaggcagacgagagaggaaagaaggtagactagtaaggaaggaagactggtaagaaagtgactaataaggaaagaaggtagacgagtaaggaaggaaggtagactcgtaaggaaggaagactggtaagaaagtgactaataaggaaagaaggcagacgagtaaggaaagaagatagactagtaaggaaggaagactggtaagaaagtgactaataaggaaagaaggtagactagtaaggaaggaaggtagactagtaaggaaggaagactggtaagaaagtgactaataaggaaagaaggcagacgagtaaggaaagaagatagactagtaaggaaggaagactggtaagaragtgactaataaggaaagaaggtagacgagtgaggaaagaagatagactagtaaggaaggaagactggtaagaaagtgactaataaggaaagaaggcagacgagtaaggaaagaagatagaaaaggaaggaagactggtaagaaagtgactaataaggaaagaaggtagacgagtgaggaaagaaggtagactagtaaggaaggaagactggtaagaaagtgactaataaggaaagaaggtagacgagtaaggaaagaagatagactagtaaggaaggaagactggtaagaaagtgactaatraggaaagaaggtagacgagtaaggaaagaagatagactagtaaggaaggaagactggtaagaaagtgactaataaggaaagaaggtagactagtaaggaaggaaggtagactagtaaggaaggaagactggtaagaaagtgactaataaggaaagaaggtagactagtaaggaaggaaggtagactagagaggaaggaaagtagaccagtgaggaaggaaagtagactagtgacgaaggaaagtagactacggaggaaggaaagtagactagtgaggaaggaaagtagactagtgaggaaggaaagtagactagtgcagaagcctgggagagtgcggatgctctgtctcccacagggcagccctgggcctgtctggttttgctggaagcagtggctttgggaggttggggatggaggtggcccctcatttcagggcccttcatacttcagccaccaggagttaggartgagacagtaatgaygccaagagggaaactcagaggaaaagcccaactgcccagaagtccagttccctcaggacacctcctcctcctgctgctggtctctcttggaggctctggaagttgcctaggtccctgctgactcaccttgccccctattccatgcttagtgaactcactttctgccctttctctgcacaatctggccctgtcttgctcctgactgtgtctcctggtctccttggctttggtgtttcccctgtcagctacatgcccaagcttctctcactcttaccagctctccacattctgtgcctgcccctcccccctgttcagaagggcctttctagctctcggcctatgcagtgaccttgaaggttcctgccagactgtctggggatatagcattatttggaggtcccagccagaacttctgcctctcagccatcttcctctcaccccattagagatgatgccttcaggctatgacctctgccccatcagcatgtgggcttatgccttctgcagaaccttttaatgttttcaaaatgctttttaccaatatcaggacgtagcatgggctgtttgtactttggtgtaaattagctgattagcaaaagagccagaggttaaatgaggaaatggtcgttggaagccctgatggtagatggacagtggagggtggaatacagggcacagaagctggggaggggctttgggcaggcccagaaaggagatttcggaaggactggtttggggagactctgaaaacaggcttcacctgttttttcattgagatttgggcctctccatccttcagtctctgttcttttctctcaatgtctctgatcctaccccttcttcatctgcctctgtagagtgacctaaggtacctgcagtcctgcgagtggtgaggttggctccaatgagaagggacagaggtstcacctgaggccactgatatgaaacagccaagactgtaccgaaaggattaaaaaatgtgtggtcatccctgatgagtaaacccacttgtactaataatggtggggacagacagccagtgcttctcctgcttagtctggggaagcttccaggaggaagtggcaggtgagcaggcagtgggctgggagagaaagggaattccagggacttgaagcagagcagctggaatgaagtggagaagagacggatgaaggaggcagcatggacgtcctgaagtagggtttgataattatcctgtgcatttttcatagctcatgtacttccaaggaatgttaatcttttctcttactgtatcatcacactcactttatgaggaaaagatataataatgacaccttctcccaaatcaccgaagtaaaaactaagctcagagaaagggtttgtcttggggcagggtgctggtggtgaggccttcctccggcaacatcacatgggtcctcgtggcctgcacctcctcccartcctgcacaacccaacttgtggaaccttactcatgtctaggttggaaggaaattagctttcttagtagtatctgaatattccagtcttacaccttgattagcagctttttgaagcaagaatggattgctttggattttctgggtccctaaggaccaaaatagtaggtggcccacaactagatgaagagtgtgtagggaarcatggtccaggcagcgggaagaatgcatgtaggatgctgggctggggagctggtgtgctagagcagaggtgtatggcgggaccccagggagccagcaggagagagggggtggagactggcggggcagaatgcagggtcccagccsgagagccatgggagccccataagtttgtgctcttgagggtgtcctggccagatggatgtttgtaaggacccctggctgccttgtggggaacagggacagggagcagggagatctgttaggagggcatcgccgtcctccaggggaaggaggctgacagctggcactagggtgggactcatggaagggtgaagaacagaggggtttggcagacatttcaggggtaaagtttataggatcggtaccaaattggacatggggcatgaggaagaacagctatcaaggctgcttctrgatttccagctcgttgactgtttggtggagcatttgcaggagcaggaaatgctgaaaaagaatcctgttttggagaagatcgtatgtttggatttgggcatgttgactttgaggggctgggaaacatccaagtgtagatgctgagcaggcaggggaatgtgtggacctggtgcctgcaggagagcaagagttagagtgaaacttaagtgtcgtcagcaataggtgacaatgaaggtctctggagtggatgagagtgcccagggagagagctggaacgtggagaaaggcccaggccccagccttacgacatccatctcctcaacccagacgtgggtaagccatgcccccaccctcacggcattgcagttatgaacacccaaggatctgttgttcaaggcagcgtggaaggagagccaaggcaacggtgaaggaaggaaagattctttccaaatgggtgacatgttccacgggctgtgtacgatggcctttccttctaattgacctcattcacctcttctaagcttcttagggagttctcaaggtgtgtgctcacctgcctcacccttccccttcctgagggcaggcgtcactcgcgttccccttggccttcctctcacgtctgaaggtggctcccttgtgtctttattgcctggagtgcctctccagagctgggacggctgggatggctgaaccgtgtgctgtgctctaatcacttgtggggagagggagagaagggaagcagagttcccaggcagccggatccgtgtgtcagagagcgagccgggggagcaactgcgatggctagtgagggccctgaatgtcagcctcaaactccaggtggcacctttaggggatggtggttcctggacagcagctggaccaaagctttgcattgcccttgaatctgagctactctgagccacaggtgcaaatctgaatgtagctgccagggtagggtggcccttgagtgaacatcatctttatcatgttccccagtgatgtatccagtggtcttgggctttttagacatgcatctagaggtttccaggtcttctctggggtagagtccttctgttccaagttctgttctcaggcacttgtggggcaggcatgcaggaaggcacaagggaagtgggaggaggcgagattgggcacaagggaggaagccccttttttagagccctgagcctgagccccatcacatgtaaaccaaaaaatatctgagacaggcctcaatcaatttcgtttattttgccaacgttaagaatgtggttggaagagaggtctgtgtctttctccaaagatcattttgagggcttcaatatttaacggggaaaagcaggctgtgggggaaagagggaggctgtgggaatctgcatgttgcaggagaaaaggagcagttagggaattatcaatgatgtattcatcttgcgctttggacaaggtgaatatagagtagctgcctgtggagctatctagccttttatctgtagctgtctgcttaggaacaaaaggaaaggcagcgtcttgcctgactcagctttcggcttaatattttcctttcggcagagtgatatggggtcctgagttttcattttcctcccacaaggtgtgcccacgcctgcccttctgtgctgtctccctagggagtgcctcccgtgcctcctggcctttcagaagctacccaccctccaggacccagctctggctcagttaccccagaagccgactttgacttagtctttctggtctcccacagtgtggactagaacccacagtatagaaaggaatgatgaaagctttcctctgctggtcacagttgtgtttcctgcatgtcagctctgtcttcataaagagattatgtttctcaagtgcagggaccgaatgttctaggacccctgaaactgtgctggagggctgagcacctaaggggctgctccacaagttggcaaagggccgggagttctgtttcaacagactggaagagttgcttttgttcattcattcactgagcaggtgcttagggctgagttggagacataaggtgttacttctgctcacttggaggttaaaatgcaaacactaacgattctaatcacagcctttgatcacatgccgtcaggctaatcactgctctgggtgctttgcaggcattatcttattctcattctcactgcaatcctgcaagtttgagattctcattttacagctagagaacaagcacaaagaggtcttagagctggcaagtggcagagctgaggtttaagcctgggcactggctgtgttgcttttctaggaagtgtttctcagaggagagaatagattgagtctgacctgcgctgagaccttggcaactcgcggttccagtggggtctgtacaaagtgcagctggactatctactctctcagttccctccaattctagcatgcagtcattccatcacctactagggacttttcccttcaggggagacactggaatttttctgaagtggtcctgcattcctgccgagaaggggctgcagacctctggggcctgggtagaggcagcaggtgcgtgaggaccctgaaaggacactggaggacagtcctttgttcagttgttcagaggacccccttggtctgtccttgctctctccccgagggaggtgggggctggccagggtgccagctggtgctgctgccacgggagaggcccaaagcctaagcctttggtattaattcaaggtgtctctccaggcagtgcccccccaccaccctgacttgctcaatgccacccctttcttatctgggaattatgagagattatgacagccatgatccgaaggagctcctgctggtggctccacgctgtgtgtgtgcgtgtgtgtgtgtgtgtgtgtgtatgtgtgtgtatgcgtgtgtgtatgtgtgcatgtgtgtgtgtatgtgggtgtgtgcgtgcgtgtgtgtgtatgtgtgtgtgcgtgtgtgtgtgtgtgtatgcgtgtgtgtatgtgtggatgtgtgtgtatgtgggtgtgtgtgcgtgcatgtgtgtgtatgtgtgtgtgcgtgtgtgtgtgtatgcgtgtgtgtatgtgtgcatgtgtgtgtgtatgtgggtgtgtgtgcgtgcatgtgtgtgtatgtgtgtgtgcgtgtgtgtatgcagtcggggggccgcacttccttttccatgctccctcccttgtggccagtgtgaacctgggctttagggactaaccaaggaggcagctgtgaagcaaaatgggccattttctcagggctagtgtctgagtacactcagtacctcagtgtcttggatttccttcacctgaggctgttttgcctcccttgtctttccctctcacagatatacccctgctccctggctccccacgccggctgagccctcaggcagggtccagagggggccagggccccaaacatggacagcagtgtctcaagatgccaggtccccgggccccaggtctgcagggcggttccaacagagatcctggccagccctgcggtggagagagcacccgcagcagctctgtgagtactgggcrggggtggggtggggggataggccagccctgttgcaggccaccaaggagcctctggtctgggggatcctccagttgggagcacatgtgtgcgtgaaagagagagacctaggtttgggtagggccttttctcttctctgtctccaagtcaggcacactttcccagtgccctgttctggtcagaggagggtcaggaaaggaggaggcgtgggaggccagtcgatgctgccagttggtctgcaggccccctggttcccctcctgcaagcctgagcaactgtcttctctgctatggtggctctgagtctctcccttgtgcctggagcttcatctggttgcccaggtgacctctcaggtggctgcagaggcagctgggtttcaaaccagtaataaacagggaaacacccacggggagaggccggtccctcccctgcttcatcgtgttctctctcctcctcttctttccacctccccacctctggagtggaagacagcagaagtcagttccctgctgctgtctttgaaagggccctcaccagtggctggagaggaggatgtggggctgtgaatagtgcctggtgaattcccgtgggtgggagggtaggggtcgggtctggtgactagaaattggtctttgttccaatggatccagagaacctgcctgtgagtattctgtgtttaaatatatagtgtatctgcaggcagaggtgcagatctgcaaggaggtgagcgtgtgtgggccatggtgcctgtggaagggggtgtgtgtgttagagcgcactcgggtagatacgcgtgtacacaggccccttcacctgtatggtgcaggagtgctggtgcagggagacaagggtagaggtggctgcgtgtgcatctgcaggtgcttgcatgtgtgtgtgcaggcgtgggcgtgtggttctgtgtgtggaggcaggagtgcggttgtgaggggtttgctgctgcaggtacagtctgtgtgtgagtgtgtgtgtgcatggatgctggagcatgtgtgaaggcaccgatgcccagaytgtcaacaggtgggtggagggcctcgcaagctggcatgacagattaacttaggccattcggtccttttactgggggcactgggggcctttgggcctgagaggcttgcttctgagtccgtttccctgagcccagagcatagatcagcctcctctgtttctcaccccttactcaccagaccttgccctgcctctcctctctctctggccaggtcatcaacaactatctggatgccaatgagcctgtgtccttggaggcccgtcttagccgcatgcacttccatgacagtcagaggaaggtcgactaygtacttgcctaccactaccggaaacgcggggygcacctggcccaaggcttccctggccactcgctggctatcgtctccaatggggagacaggcaaggagcctcatgctgggggcccaggtgacattgagctgggrycgctcgatgccctggaggaggagaggaaggarcagcgggaggaatttgagcacaatctgatggaggctggactggagcttgagaaggacttggaggtgagtcaggcgggtggccagggacttggagatggaatggyaccacagaacygggctcctagtgagcagtgccacctgacagagagcctaggctttattctggcaggtggacttttttttctgctggagaaaccagattttgtttctttctttttttaaaaaaaattttttttgagacggagtcttgctctgtcaccaaggctggagtgcagtggtgtgatcttggctcacttcaagctctgcctcctgggttcctgccattctcctacctcagtctcccgagtagctgggactataggcgcccgccaccagacccagctaattttttgtatttttttagtagagacggggtttcaccgtgttagccaggatggtctcgatctcccgaccttctgatctggcatcctcggcctcccaaagtgctgggattacaggcgtgagccaccgtgcctggcctggagaaaccagattttcttgcccaagggcttgagaaagagtcttgtgttgctagtggtcctgattaggggattccaggtagtagtggtggggtggtggtgtgccaatctgttctttgggagttgggagttagcctagttagacattaaaggcaagaaatttcttcttgacattctcaggccacatctagtggccttctccatatggtttccttgggaggaagacctagtttccttgttgaattttggaataaaattcctctatatgaatctcattcactaaggaatgcgcttgtctggggtcccctgagggagctgatttgagatgtatttggaaactgagttgggacatacataggacatattttatcaacctataagctatagatactctcacctctggtcagtgcaagggaatccatggaaatccattcatacacatatccacctatccatccattcatccacccatctgtccacccacccatgcatgcatgcatgcatccatccatccatccatccatccatccatccatccatccatccatttatccacaccacagtgatcctttaaaaatgaccttcccttgccaggcgcggtgactcacgcctgtaatcccagcactttgggaggctgaggcgggcggatcacaaggtcaggagatcgagatcattctggctaacatggtgaaaccctgtctctactaaatacacaaaaaattagctgggcctggtgttgggcgcctgtagtcccagctactcgggaggctgaggcaggagaatggcatgaacctgggaggcagagcttgcagtgagccgagatcgcgccactgcactccagcctgcgtgacagagcgagactccgtctcaaaaaagaaaaaaaaaatgaccttcccttgccatctcccccaaactcattcctacccttcccaccctccctaccttcctgcaggtcacgggcctcatcttgggtgtgggctgatcaccttgacctcaggtctttgtgctattgccctctctgccttgggcaccttgacctcaggtctttgtgctattgccctctctgctttgggcaccttgacctcaggtctttgtgctgttgccctctctgctttgggcaccttgacctcaggtctttgtgctgttgccctctctgctttgggcaccttgacctcaggtctttgtgctattgccctttctgctttgggcaccttgacctcaggtctttgtgccgttgccctctctgctttgggcaccttgacctcaggtctttgtgctgttgccctctgtgctttgggcactcttcctcagacctgtgcatcacattccctctcttcagctctctgctcaaatgtcacctccttcctgacatcttccctgaccatcctagccaaaatacccccaccccgtccctctctgtccctcgatcctgccttacttttcttcatcacactcagcattgccacctggaataacaatgatagactttttttgtttgttttttatctgtgctcccactagctccatgaaggcagagatcttgtttggctcgctgcacatccccagcacccaggacagactctggcacatataggtgcttaataagtgtcagctgagtatatgagtgacctccctgaacctcaggtcccttatctgcaaagtaatagatgccttgctggattatacttaaacatgcctcatcattagatggagcaatgaaaatttcagcacaatgtctggtacataataggtgctcaataaatgctcatcatgatgattttaaaaggtgtcatgctgaggcttgaggtgccattttcatcagaagtttgcctgataagatttaagttggctgggtgtggtggctcatgcctgtaatccaagcactttgggaggctgaggctggaggattatgaggtcaagagatcaagaccagcctggccaatatggtgaaacactgtctctactaaaaatacaaaaagttagccaggcgtgatggtgcttgcctgtagtcccagctacttgggaggctgaggcagaagaatcgcttgaacccgggaggtggaggttgcagtgagctgagattgtgccactgcactccagcctgggcgacagagggagactctgtctcaaaaaaaaaaaaaaaaaaagattcaagttaatgctttcctcaaactggaaggtatccccagaggtcattcatcctttcctttcccctgtccctaggcagaatggcatgtggcctggctcatgcctcgtggtgctggcctgtgctgctttgccagacccttaaggcagaagacattcttcctgggttagtctttccacccatgtaggaagagggagctctcttagggatgcgttaggcttccttgctgtgggagtgctgattttcactttttgaaacccagagctcacttggtggctccagctggggtctgctgagatggtctctccaaggtgaagatgcattctcgctccaggaacttaccaatgtgggagctgtggtgcgtacctctgttgttgggtcttagggagcagaggccagggcttcactcagctgcctggttgggaagcagtatgtctgtgctcaagagagtgagctcttaaggccaattacatatgttcacattccaggcctgacttactagctcatgaccttgcttagcttacctcatccttttggtaaagcttcctggtctataaaaaggaaataacaggtctgggtgcagtggctcacatctgtaatctcagcactttgggacggtgaggtggatggattgcttgaggtcaggagtttgagaccagcctggccaacacggtgaaaacctgtctctactaaaaatacaaaaaattagctgggtgtggtggtgcgcatctgtagtcgcagctactctggaggctgaggcaggaggattgcctgaactctggaggtggaagttgcagtgagctgagatggcaccactacactccagcctgggtgacagagcaagaccctgtctccaaaaaaaaaaaaaaaaaaagaaaaaagagaataataataacagtactttcttcactgggttattatgaagatgaaacaaggtaactaaataaagtacctagaacactaacaaagaatattactgctattattattatttactgttgccaggtttagcaaacaaaaatgcagcatgcctagttaaatttgagtttcagttcaacagtgaatactttttttttcttagcatgtacaatgaaatattggggacatacactaaaaattattcactatggatctgaaattaaaatgtaatggtcctggccacccttaatgctactatcaacaccactgcccatcttggctgcccccgtctccccaccatgcttcattctggtttctgtcagatgttccccrctttggctgggaatttggagggcaaagagatggctcttgcgactgaccagtgttagactggggtcctggattgttgttcctgttgtataaccacccagactcctccctctcagcccccacccatggcttcaaggccactcagcacttcttcatgaggctactccaggtgacacagcctcccccagcgtccctgtcatcagacttccacctctcattgtggcctactgtcttgcagcgttgtctctgtcttccaaaaggtagttattatgatctgtgctgggacctcgcgtgtaaagcgttgagtttacttttcagccatggcacattactatcactgatctgcacaataacttgggttatttatttaaatctccccctgactctgcactgcctgctacctcgcaggcagtcattccaaggcatcgtcgttctggaaaagatacagtgtttktttttttttttaaattaaaaaaaagactttattgtgtagaacagttttagatgtacagaaaaattggaagattgtacagagtttccatctaccccattcccagtttcctgtattattaacaccttacattaataggatacatttgttacagttaatgaactaatactgacacattatcattaactaaaattcacactttattcagatttccttactgctgcctttttttttttttttttttttaacctgctgcgatttttctattcagagttgtcaggtctcctaagacttctcttggtggtgacagtttctcagaactgtatgcattcttaatttacatagaaggtactgttttatagcccattctgttttttacttttttctctagcactttatttttcagatccattcacgttctgcatgtacattgattccattattttatttttatttatttttgagaccaggcctcactctgtcacccaggctggattgcagcagtgtgatttcagctcactgcaggctcaactccccaggtgccggtgatcctcctgcctcagcctcctgagtagctgggaccagcggtgtgtgccaccatgcccagctaatttttgtattttttgtagagacggggcttcaccatgttgcccaggctgttcttgaactcctgacctcaagagatccacccacctcagcctcccaaagtgmtgggattagaggggtgatccacagtgcctggccagactccattattttaatgaatgagcagtttgcagccaccacagtgtacctagtcactcccctagtaataatgaacacttaggttgcttccagttgtgtgccactgaaaaaaaggatcgagaatgaatcgtcgcctcctttggggcagcattctgtgatatcccctgctccctccatgccatgttggtgttaaactgtgcttggagattcatcagctagaggctgtgaggttctgaacaacttttcaccatgttaagatgcttggccttggctgtgagcagcagcctggaatgggggcttcacaggagagggagacttgcttgactgcacctggtggcagtttgaacagtaggtgcggtggccccacctgctcagctgtcccacccttctgagctgggcaatcttttaggctctgggttcattgactttaaggcaaatggagagcaaatgggttcctatcagagacccattaaaaatgattcacttagccttacagatcaaaagaacttcgcatccactgaactctgtttgaatagcagataattcacttcccaccctccttgatacctgggcatgcttttgacaggatgataattggcacataccttccatttggcatttcactttttcattttttgtgcatatttccatgtattgatattgtccatgttcatattttaaagacaattcagcattttatcaaatgtctttatatgtcatttgataaaatactaaattttctttcaagtatgaacatttgctttcttagtttgaccgtttgattagaatttcatttaaagacgtcgttggagatgcttatgggtgacagagacgtctgcaccctaccaattcatataaatgagggccacctgttggtgctgtgcattgtgtcagagttgggggctaatttaagcagttcaggagactgccccagccttgagcgtccagagagtttcctgtagtcctggcgggactgcgagtgggtgagctgaacaggctctgacacagctctggggaggtctggtcggcccacctcctcccactctctcttaaagaaacctcctgctttgacccagagagcgagcagggcagaggcagagactcacatgcatgggtgtcaccaggggcacctgagggaggggtctgagaaccaggcacagtacaatcctgtggaagccaggagggcatgtttgtagacttttagctaaagacctctcaccttgcaggccctgaaatcctagcagacatggccccaagcttcatccttgtgggcagctagatagctgaaattggaaatggagaatggcatgacagggaggccaggtgcccccttactaggggctggctttcttgagattgagggaccaccagggaactgatagcagaagttggctttaaaattcagcgtggcctggcatcgccagcaggtctacgggctgttcttggaagggacagcgtaccatcagggaagtctcggggcccacagctgctttcgggaggtggagccctactctgtctcggtatcaggtgtgaatccaggaatttcccaaatcctttctctgcagagaggagactccctcctcctatgccatgagatgtctctgacccctgactcctcaccctgtaggtctggcagagcctggatgtctggcatctcaacctgaattgcagcactgagtcaaagggggatatcttgggtgtgtgacatcgtgccctcccagggaggcccatttagcagagaggactgagaaaatcagaatgtcgcctcactttcttttttctttttttttcttttttgagatggagtctcactctgtcacctaggctggagtgcagtagcgcaatcttggctcactgcaacctccgcctcccgggttcaagtgattctcctgcctcagcctcctgagtagctgggattacaggtgcacaacaccatgcccrgctaatttttgtatttttagtagagacagggtttcaccatgttgctgaggctggtctccaactcctgactgtgtgatccgcctgtctcggcgtcccaaaggcttcactttcttaaaaccagctgccactgtttctcaggctctgtcgccatcccactttccacctccttttcaggaagaggtcggggtgactttcagaaattctgtctttagagtgagatttaatctatggttttaaggaagaaaacggacttttctgagtgccttttgtgagcctcatcacgtgtggttttgctttcacttgtgctcatttagtcttcatgaataccctgcaaggggctgttattcccatcttggaggagacaggccaagtggcttggccaaggtcacgctgccactaaggggtcctgctgggatttggaccctgtctgagctttggagcttctgggatccttgtcatcccgaggagaaccaaccaagcactttatagtagttttctcttcctccctccccagaattcacagagattctctgcagaggtcagcagttacgtattcaaagcgggactgatttacggagtacctattcttcctttccagaaggagcgtgtggcgccagggccgtgagcccactggactctgggctttttgccctccctggaggctgctctgtggcctctgaagcacaggttggccctgggtgaccattttttgggacccagatcagtycatcacctcacagggcgaacactcagacttgccgctgtcttcctcactcttacctatataaaacttgtcttgaagcagttctcctcttataattctcaagtctggcttggttttgctttgctggggaaactagggcttagaatccttaggaaaaccttgctgtttggttttctagggtgacagcgtcccctggaggccttcctgcccgttgctccgtcttggacatccacagagggcaggctgctggtgctggatcggggcgtggtgtatttctatgggatggggatctccaggcccccattgactccattataaaatgaggctattttctcctctggagtgggatggttgcttgtgttcctaggaaaggatatagcaaacgcagggaaaatgcaaatatgggttttaatgatgccctcgtctctactgtttattcgtgacgctgccatgctctcctgagtgtaggaacagtcgtgccgctgctgctcacactaatgactggggaagatgcgatgatttccctctggctttggctgtgttcctgtcctgcttgtcccaccctgaggcagcaggctgggaccttgggcttctcccttgcctctttcctaccccgagggatctttggggaacacaacaaagaactctgcagcccctgcccctgggaccgcacagctgagacagggaggcacagtagggctggctggatttgatctcagaggggacgcctccgggcagcctggggtggggatgcacagggaaagcagggaggggcaaggcaagcctccaagcccccaaatccaggtacatgtctatttccatctccaaagactctataatgaaaacattaaccttcagcattctcctctgatgctcgttttagcctccccccaccccaacctccccaaccctgaggaggttagagcagctaatgtcccttctcaccgactaggaaacgtaaagcaccttgtcaagtgggtgagtagcagggctgggccttgaaataaggtcttcttgcttctgctcctcttgttctttattctctcatactccccaggaggtggcactcacccagccacagagatgagcagtgtccaggttttgcacaaagctgggcagtgggtctagtgaaaagcaggctgagggtttacacggaggaggaagggagctgggtgtggctctttaccaagtcctttatgtctggagtcttttaccaactgacagggtgcttctggagatctctaggattcctcagaaggggttggaaggaggtttctgggctttgatctgccatatcccaaactgcagtaccagatgctatggctcaacgaatgtcacggttgtccttgtcaagggtttctggtctgtgcatcaccttagccagctgtgtgctttgctgattttctttgttactgggtgccacctgtgatgtgtgagaagatgggatcataggacattatagttgtaacaacagcttggataatttctttcaatttcatcttagagcgggaactgaagcccagagagaatatgtgactggcacaaggtcagactgctggttaatgccttaatcagattaaatactgacattatagagtctatgcagacaaataagctaagggagtctggcttccttgcgttagtctgtcttcctcctagcaaagttattatctccctatctgactggtattcctggtacgactgtacttggtgttcgtggctggtgcctgccctgattcgcaatgtgttatgctggttgttaaatatcttgagtatcacccgtgcttcctactgtcattcacatcaatgtctgcatttggtgaagagagactcgggggacagttggtttctatcttgctaatcgtccctcttcatggcactgctagatgttttgggctctgagacacacattgagaaggaaagcccttctgcatttgtcacttgataagttcagggtctttatcggtctggggctggttgggcagtcacagcagctgtaaagcaactgccaggagggacctgccaggctcagtctctggcccctctctcctgcttttcatgtagcagacatttactgagcacctactaggtgctgggtcctgggtgggctgggagctgaggatgctgaggtgaataagacatggcccctgctttcaagggaagcagacctgacctgggagaatcaaatagggtctaaaagtgcagtaacagaggtgagaaaagagtcctgggagagtgaccgatggtctgatggactgggaaggcttaactctgttgtgaaggtctgggtgaaatcaacttccctctccctgcccgcagatgctggggtccagcaggagtgggtgagctctgtttcctacccttgtcagatctccaggaagaactcaccctcaggatgctgagatgctggcgtggactgtgcaagtgtgaaaggtttagctgaagtgggtggtgtacgtggtagacagagtctttaaggctttgaggtctgaggatacagaatggttatatctgggcttgacagatgatgagggtggttcttggggccacttcagccttaagtgtcctccttcactgaagacagagtctccctgctacccctggacagcttcttagggtgcttatatctgatgactcctggggccatatgacagcatcaagggttcttgaatcttgagggttttgtggatagaattcaggggtagaatccacaaacttgaatgatagaaaattacatctttattttcatcaacatttaactgacatttagtatttacttcaattaataatataggcaaaaacctacattaagatgagttcctgtgactgtcactaatagaagtaacacatagaggccaggttctgtggctcacacctgtaatcccaatactttgggaggcctaaatgggtggatccactgaggtcaggagttcaagaccagcctggccaacatggtgaaaccctgtctctactaaaaatacaaaaattagccaggcttggtggcacgtgcctgtaatccagctactccagaggctgaggcacgagaatcgctggaacccaggaggcagagattgcagtcagccgagattgtgccactgcactccagcctgggtgacagagtgagactgtctcaaaaaacaaaacaacaagaacaaacacatagatttgtatcatatcaaatttgttgcacaaatctcgaaaacaaattatactcatttgtacttagaaattatgccaatttttagatgtgtctctaggtctcattatttcatgtgttaatagagaaggaagtctattactatatcacaaatttatgtttaactatttggataactctgtttctatacatttagtctccttgttgcctcggataattattttatacatttaaaaacattctgagtagggtccatagatttcatctgactgtcctgaggttccattccatggccccaaaatgcctacatgcccttgaacatattccccaaagcctaggagaagccttaggtagagcatggcagtcctgcctggctgctgtatgaagggagatcaaataggaacgcccaccgcctgctctctgggcacgcactgcccagagagggctcctgaagagtcctgctgcaggtgcacttgtggggcacgggatgatgctgggctcctgtgtgctgctgtgcagctgcctctccgtgtgcacagctaactgcactttggaagcatgttgtttagtccatggtgtgcctgaacccaagaagggagctgagcactggaagacctgggttctaggaccttgtctgctgccaactggcttctctctggatctcgacttctattctggaaaaagggaaggttgggtgtgaaatcagggattctccagctatgtatctgacagtactgtcttcccatgacttggagtaaggtagtctataccaaaataaaaaaattgataaagtttttgcaatttactaaaaagtaacatgaataaagatagttttctcaatttacagttgttctaacatatctttttgttaaacctttggaagctgttaccccttgcctgccagtaagtacttgttgagggcaaaaggagtgggtgagaagtgagagaatattaatgggagcatgtggaattggccaatcatgtttaatttctaggcttagtttgggttgtgggtttttctacagaattattcctagttttaatggtggaattaagcatgctggtacgttaagaacctttgtaaaggatcttgcaaacagcatcatgatctgtgcatgttctcctagctcccaccagtctccagggccccttcctgctctgctattttgtggacctacagcgtgtaatgatgcattctgctcaaaaggcggatgacccttgttctgagtggactcatgattctgtgtggagtgaaggccattctccagaggagataatgctcctgtttacattcaggcaccaatacaagcaatggtgcaccccacttattccctgccttccctattctgtgcacacaattgtaagggaaaacaaagcgacagttacaatggaagcaaaaggaagagcagctgttggggatgttagctgtgtcactgtctgctgagcgggacagatgcacttaggaggcctcatcttctcttacctctcttggcttgcccaggagcttagctaaagtcagagggttccatgatgattcatggaaattgccatttatggcctaatgcctcctagggaaccctgggtccattctgatgtctcccagaatgtgtttaccattccttgagcatcactgggttgggagtctcggctactgcaaaccactccactgtggccagcagttggactttctgtccagcccagcaccctgggcagtcggactctcggcttggatagggtgactgctggtgttcgtattactgccttgttgagtttccactcaggaattgattattctcaggtggtaagggctgaggtctgtttgaccgtggatattttagcccatgctgttgatccgttctttctgggctcttccagcccagggaacttacacttagctcatccacaggccgttggagggtgaaggcttctcaggcctcagagaggacctgtgagtcttagcagcttttcaggaacaggaaacagaaggagtggaatttgatgggtgtgcttttctgttgttctctgcagacacgggaacccccaaaggcttcagagtggaagccccagggtcctcggagctggtgtgggtttgctgctggctccctgcacacgctgcccgtgcgtggttacgagtttgtgtgtgttgctatgtactgctctcacggtgcattgtggagttggggaggttgcattcagaccaactcaggccacgcctgtgagcagggtctggcatcccagctctgcctgctgaaggctgagagcatcagtggtatgcgtgggagctgccttccccactgggctccccaggagcacgatgtagcaagaagaacttagggtatggagagtgaagggccaggttcactgatgtgtgtctttgtgcaaggttcttagccatgccgggtctattttcttatctgggatctgtagcccacaccgttcatgggcgaaatacttcatgaattgtaatgtgtcataaaataagccaaagttggctctcccaccctgtctacctttgtgcttcaattttcctttttttttccccctctttatgggctgagttgaattcccttcctattttctgaatgaatgaaactgcttgatgagtggattaggcatccccaaagggagaaggtgcagggagtttactgtcttgttaggaaattagaaaattcatgaacagagagttaacagttcaaggcatatatgccaattgcctcttttctgggctcccagagtaaaaggtttcacaaatactggttatttgaataccatgattatgagtttgaataccactacttactagattcctaattttaggcgtagccatttactatctggactattatttgctgaatatttttgttaaattggctcacttttgaaacttaaatttattttaaagggaaacattctatcattatcagaaatggagaaccaatatcactggccaacagatagacaataattataaaaataggcacaaccgaaacaaaacgacatcattcatttctagctggatactgttggctgcaggagatccgagaccggggcctgcttactctttgttgagaaggaagcttagctagcatcagagaggttaaagacatattggaaacaaacggagactttatttttgcaggataattgaaaacggactttcttgttatttaaaaatgttatttgatgctatgttgcatccatccatcatctaatgcctctcattctgtacttgggcaacattaccaaagcacctagtacaccttctagagctatgcttgccgctgaatggattgaagacttttagaacagagactgtgtctttctaatttatttttatttctatttattttatttttatttatttatttatttatttattttgagacagagtctcactctgtcaccaggctggagtgcagtggtgcgatcttggctcactgcaacctccacctcccaggttcaagtgattctcctgcctcagcctcctgagtagctgggactacaggtgcgcaccaccatgcccagctaatttttgtatttttagtagagactgggtttcactgtgttggccaggatggtctcaatctcttgacctcgtgatctgcccgccttggcctcccaaagtgctgggattacaggcatgagccactgcgcctggcctttattttatttttgaaaaatagggatggggtcttgctatgctgttgaccaggctgctcttgaactcctggcctcaagtgatcctaccatctcccaaagtactgggattacaggtgtgagtcaccatggatggcctctttttttctttttcttttttttttttttttaacaatgtgtgacatattgataatataatagcctttagtgctgtttgttgaatgattcaaagcataatgcctagcaaagataatacattgtagagttgctccaggaggcagagatgcccaggagcttgagttgacagggaaggccaactggagaggaagcccttggtgccttctcctagccctgcccccaattatagcagcctgggatctctgtgtgtcagctcctatccttttcctgcactgaaaccttctccaattcctgcctctcattcaatagcagtattgcctttggttctcccatctccttcctcagtctgggaagaaaacaccacagcaatctgcagcccgctcagagccacccaccctgaggagacgcccgaagagagaaagctagaagccggggtgggatgaagggataggggagagaaggtgagagagaggagacctgtagggtgaacctgagtccctgaacaggctgtcatctggtccagtgttttggggatttggtgacctgttggggaaagaggttgagccctggggtgttagcagattttttttgtatctttccacccttccttcttttctagttctggccttctcttctttctttcaaccctctctggctctgtgccattgggcagattccaaggtcataatgattactttgtcatggacttggatttgtcatgggctcttcagaaaaaagacgcagacatgatttcctagggacagtatgtcaggcactgtctccttgtcctgaaagcttctctggtggtgggatcttttccagtcatcaggaacttcctattcagtgttgccaggaatacctgctctctctttcctgccactggggcctcatgaatcttgggcccctccctctctgatccctgtacttctgcttttgaagttattagtaataagagatgcttctactgtgctaggaacataaagtaactcatttaatctttaaaaccactccatgaagcgtatactaccactgcccctattttgcagataagaaaaccaaagttacataacttgatcagggtcatcccagcactgcccccagggtgatgggggagctgacattccacaccgtcctccctgccagagccccaggtggctccaggtgccacacggccctaacacgcaacagcacctggtgctcccttcaattctttcagcgttatcccccagcctcacccccctgggaacccttgctgccagtgagggattcaaaccctgagcctgagctctcagtcactgccgtgtcctccctctccagggatgaggttcctgctgtctgagcttggcatggggaaaggggagtcctagagtccactgtttggattgtcagccacttaagaaagttcaggggaggagaagaacacctctgaacttgagagtatcctcttcttatcattttgttccctgttccctttgttctgctgatcctgtcttccctcctgtcagcctaggtgggagcttgtgggttgggaaagagctggatccctgcagataccttttaattacccttgggctgtgtttgtggtgagaatcagtctgctcaggactgcccctgagacaggtgtatgggtctggagccagcaggcaggggtgagaggtggcaaggcttcccagggggagcaaggctagaggatgacactgcamaatttgaagatcgagaaggagcatcgggtgctgtggcatgtcggggccgtgtggtaccagggtcacctggggctctggcagggaggacaggacgatgtggagtgtcagctgcccccggaagcagtactgggataaacccacaggtgtgtgcgccgctcattcgtgctacaggcatcaggagaggtgatggtgggcctgcgaggcgtctgccctgggcacactcagccttcctcttctgtggcttcccttccatgtggttttcccatcactctccctccttccaatcccactcattcagacccttcagtgtaaccctgctttgcggcagctgcatttttctcagggatcaaagccttaggtgaatggtggtgtattgggcaccagcaggtggagcaggttctggaaatcacatcatattggctctttcctttttcaaggaccatggtcccagatgggagtccccccttctttactacagcttccataagctgcttacattggagactaatgctgcagcagccaggcaacatttgggctggaacactcttcaagcacagaggcctgcattgctctgggatgaagaaagaggggatgatcatgtggtgggcacatttggggaggtcagtgtttaatgaagaaagcagaaggcaggaaattgcccagggtcatgcaggatgacccatgtacatgtgtgggtttcctccatgtgggggctactcacggagggtgagtgcttaatctgctcaccacctcttgcattctgggtcaccccttcctgctgctaggatgctcagaagtgggagctaattcagtcattaatcttagcctaaaccaggctgaattacacagatatgctgggatcttccactctcaaatgcagagtacaaatccctccaggaccaaaggaccaaagggctgcggtttatctgtgctaccactcatcatctctgccagtttggataattgtgaattgtctgcacagaccttgctgtctacacccaccacacacacacacacacacacacacacacatctttgcacatcctagctgtcttactgtaatgcttggaaccaagagtggcagagctgggaaggtttcttgaagaagaaggttctggtgtaaagcacagtgagaatgccagccagaatctgaatttcagctgagccactagaggacatataaccgtggggaaattatatgatacttcacatcacttcagttttcttctctgtataagtaatctggctgaattgttttgaagaaggatggcacatagtgggtgcttaatatttgtccaggaaacaaataattaaatgatataatgtatgttaaagagcccagtgcagtgcctggcatatatcagaagctcaggattagctgttcttagagtttcttaatatcaggtccaaagatccctcaaactcttttgtctttttctggcctctgggatgacctacctgtaagttggatgtaatctcccatcctaattattcccagttcctcttctggcctggctttacagaccagcatgagacttcaacactgcgcaattgtccggtgctgtggagagtctgcattcagaaagacagaagcctttgtccttccttctttctagagtctctaaagctcttccaagagctaagacccccatgtcatatacctcaccaggaagctggatggtccctaggaagactcagctaaaatcatagagacctttgcattcctgggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcccattcccttcccttcccttcttttgtgattgagtcttgttctgttggccaggctggagtgcagtggtgcgatcatggctcactgaaacctctaactcctgggctcaagtcttcctccgccttggcctcctgggtagctggaactataggcacatgtcaccatgcctagctaatttttaaatttttcttttgtagagatgggggtctcactatattgccaaggctgattgcaaactcctggctccaagccatcctcctgcctcagccacccaaagtgctgggattaaaggcatgaaccatcttgtccagcctagctattttgaatgccattcttaaatctcacatccaaatttaagtgtattaatatagcttgttatcgtgagttttttaaaaaagtgaataagcaacctaattggtctgctttttaatcctggactttcagatatcaagtttgttcgaagtgaggtgcactgtagctttctcactatgctgtagtggaaggggatatttcctctctatacatctctgagtgtaatctagcctataaactgactgtaggaagagagaatataaactgcctcttttgctcgctcatgcagtatctcaaatctcaggaggaagttcttcctaagatctaaccgaaatccctccagagcaactgtatgttggcaaaggaataagtcaaatagcatctgtgtgattggcccctcggagtctaatgtacatggggaattgtctctggagcctcattttgatgctcttatgtcctaggcaatggagcaacaggattggaaaatatcttccttgtgggcctgaggaggagggattctgtgtatctgcaaataggagttcctttcccagctttgtctccaactcagaacaggtcatgtggtttttcccagctcttgaatttccattccatttttggctggtttgagttcctccatctctcgtctcctgcaacacctaccgagcaggtccactcaccgtattctgcagaatcatgcagtcgtgtgcatcagatgcttgaaggtcacctcatccatgcccccagctctggacaggctgtgcatgtcagggtccttcagacttcttcccagggggcttgcccatgctcttacgtaatatctccctatgtttctagagtctgacccgaacctttcttgctgccatctcaaacccttggtccacatagtggtggcctccagggaggcaaagaacagctgcttgtcctcccccttgttccttccttgttcttgttggggtatcacctccatgcatccagctcatgaatcccccagcaatttctttgtcaccagatcacattgcaagctcctgtccaaatgctgtctggctgcttcctgttccaagcatctccctcccacctgagtatttgtgtttctgattatttatccccagatgcaaaggccgcatttttccaggttgaatctgctcattgttacttcctgcctgggtttgctaacatctccaggtccctcttgcagccaccgctgcagccttgctcggtatggaaatgtgtatttccaggcttcagaaagcaaagcgtgtcgggaatgggacgaggagaatcagtgaccctgctgagagtggccccacctcatctgaagtcaaggccctccccaggagaacgtctgaattgatgaatacaaaaagccatcaaagtgctgccggcaggggaatgacctagactgagacctgtcccagctgttgggctttctctgagtctcctgagccgagaacaaggagacgccttcctgccctcttggccttgactctttccaaacagccatcaccagttctaattaaatactcagcagatgaagtgactgagcaccagaggggaggttgggaagatgctgtgtgcttggccatttcctgtcccggccccacccatggggaaggggattgtggtcaggctgtgccaggatggcagggaccacacgttaaatgcggaggtagagcaaatgctcccccatgtttttttttttaaagggagagttcactttagttttttkttgttgttgttgttgttttccattttattttatggtaagccctcgatgactcagaaagagttggaagggacctttgagagtctttaattagcgtctcattttacagatggaggtccatggaagttcagtaacatactcaaattcacaaaygcatttttaaattgtcctctgccctctagatgggtgctaaacactgggcatggaaagtgaaatctctcgtgactaggaggggctcagaaacggatgcctgatccaaacaaccatgtgttccagggagtaagtctcagcctgcctgcatttttcctcactctttaccttgagccagagctagaagatgaagctgggcatagtggtgcctctccatcctctcagggctcttggttgtccgtgattacattgaaatccagggctgtgatgtgggttgagttggatactgcttatgagagaccatcagaacttgggtgacaggggaactgctgaaaaacggaactcatgcatcctgtcccccttcccaattctcttgcttcctatccactgcagctttggagtattgaacatgttgctagttaggagggctcctcagaagatgctgatgaatttggaatgatttttaaattcatctggggaaataaacagctgcagcttgaaacacaaacacagacacttgtgctgctgtgtgttccccctcccaccatccctcctccctgatctgggaaaagcgcacacacccaaaccatgtagaaacgcagaaacccatgtgcataaactgaacaaccactgtgcaaaggaaaagggatgagctgtcctagagactggcagactctgtgctagaccagcagatgacatggttctaagaacagttatctggaatccgagggacctttgcatccctggtttgcagagctctttgcaaaatggagctgtttctgtcttctaagaatcttcagtttccctagggaaaggagaggagaaagggaacaaacatttgttggtcacctgagtccatgccaaatgtatatattaacaaaatcgttgtgaagtagcaattgttgttagattattattcccattttacagaaacagaggcttgcggaggtgaagctggggctccagttgagatctgtgactttgcatgacacaggactgctttcttattcccctggctctgcggagttgcctgagtgagcatctcagaatccaaagtctctgagggaccgtgtgattttaggggacagctgctaacccactaagtgtgtctgtttcctctctgaagatgggaatcatgcactttggctatttggctgagttgctagaattcttaataagatgaagtctctagtcctctgaggtgtgattaggaatgacaatgaaagagatgtttgccagtcctctaagctggaagcatcacccagaggcgactgtctcaatcaatgagtttactgtgcacttactatgcatggccaaggtgttggcggactccggagtcctggctcaggtgaacagcagggggagtctcttccatcttaatgagagatgagctgcttcttgggctgcagcttggttttacaggctcaacttttttccttgagaaactcctctttctaaaccccattaacccctctagctatggccttctcattctcctctcctttatagctaggcttttaaaaaagcctcttttggaagtatagcatatatcagaatagtacacaaatttttagtgtacaacttggtgaattatcactgagtggacaaactagaggaactgccatccagatgaagaaatagaacatttccagctttctggaagtcccccttgggcctccttccagtcgtgaccctacccccaccacccaaaggtcgtgactattctgacttctagcatcacagatgagttttgcctgtttttcaactttgtataaatggaatcgtataatatgtattttgtgtctggcttttgtttttgcccaacattaagtgtgtgcgattaatctatatggttgtgtgtagtagtggtttatgcgttactggatagtatttcatcgtttgaatgtaccacattttccttgtctgttgtactgttgatggacgttagggttgttttctgttttaggatattatgaatagtattgctatgactattcttttacaggtcttttggtaaatgcatttctaaagggtacacacctaggagtggaattgctgggtcatatggcaggtgatgaccagctttagtagacactattggaaagtttccaaagtgtttgcatcaatttatattccccattagtagtgtaggagagttccagtttccctacatcctaccaacacttaatattgtcagtcatcttaattttagccattytgatacatgtgtagtggtatgtcagggtggttttaatttgcaatatctggtgactgctaatgagataaaaaccttttcatatattttttttccagccatttggatatcctcttttttaaagtgcctgtttgagtcttatagccattaaaaaaatgggttgtctccctttttcatattgacatgaagggattcttcatctatacttggtacatcttttgttgagtatatattttgcaaatatcttcttctcactcagtggtttttcttttcactcttttggtggataaatgttctcaattttattttacgtcattttattgatcttttcctttatgtcagtgctttttgtattctgtttaagaaattatcacctatccaagctaagaatatattctttgttatcttccataacatttatttgttaacttttcacatttaagtccacagtccacatagaattgattttttttttttttggtctgtatgtggcatgaggtgtgagtcaaaattaatttttccccactttgatatcccattaacccaacgtcatttattgaacggaccattcttcctcattgctctgctggattattgaagccaggaatcaagactttgtctttgtatgggatctgcttctggactttattttattctcttagtctgtttgactatccttgtgccaatatctcattatcttaatcactgcatctctcacagactttttttggaagttatttctacttactatgcccatttctttacctgtcactcagcctactccaatctgcctctgcttcccactgctgtgccccagatgctcttgtatgggtggccagggtttctagtaggtgctaacctgagcagtttttttttctttttttagttcttagcttccttaacccttgagcaatattcagcacagtaggacattccttcctgttggaaacaccattttccctgatgctatccatacttttctgacttccttcctgcttctctggctgcttcctctaagtcttcttggctgggtctttctgctgtaatgaattcttttttatttatttttttctttttttacacctctcatgtctctgcatctatctgatgattaaatattgaaacttttcaaagctcatccctaggttctcttcaaaaaagggagatttaagaccctaaaaatcttaaggagtgactttacagtcagtcttaagatgatttattttatgttcaacatttctgttgccatctttatcgtaagagaactccaaaatttatatttccaattagaattgtcttcaaaagtttaaactatggattatctcaactggaatttttttcttccaaaactcttcccgaattacccttttaatccagttttaaatcctttttaaaaaaacctttctacctattctctgtgcactcagatcccaaccagttggggcttcaaataaaatatttaatttctttgagattcagttgccaaaaatcattaatagggagaattatttctctccttcatgaggaaatttagagaattatcaaaattatttctgtaaatttatttcctatctttagagacagataatatctctacacagtgttagttaccatcccatttaggttcctatgaagcacccattatcttcaatggtactgttttcatcttcattctgaccatctagaaggtggggcttaaaaggaggggaaaattgaaggcactgtatgtattaaagctggagtttcaatgttataagtgaatactaatcaggattttaataagatttaaagttcttttgtgtagtctactggttctcaatttgagcattatcagaattatctggagaacttgtttatgaatacatctttatgtgtgattttattagttgttgatctagggattacaacagatatactttttttgtttttgttttgattaatatttttatttcaatagttttggtggtacaggtggtttttggctacatggataagttctttagtggttatttctgagattttagtggacctgtcactgagcagtgtacactgtacccaatatgtagtcttttatacctcacccsccttccagtccccaaagtccattatatgattcctatgtctttgtgtcctcatagcttagctcccacttataagtgagaggatagaatatttggttttccattcctgagttacttcacttagaataatggcctccagctccatccaatttgctgcaaaataaattatttcattcctttttatggctgagtagtatcccatggtatatatgccacattttctttattcgctcattggttgatgggcacttaggttggctccatctttgcagttgtgaattgtgctgctgtaaacatatgcatgcgtgtgtgtttttcatataatgactttttttttttcctttgggtagctacccagaagtgggattgctggatcaaatggtagttctacttttagttctttaaggaatctccatactgtttttcatagtgattgtactaatttacatcccaccagcagtgtaaaagtgttccttttcaccacatccatgctgacatctattgttttatgactttttaattatggccattcttgcaggagtgaggtggtatctcattgtggttttaatttgcatttccctgatgattagtgatgttgaacattttttcatatgtttgttggctatttgtttatcttctcttaagaaatgtctcttcatttcttcactggttctgtttatgtgatggagtatgtctctgtttgcaaatgacatgattgtatatttagaaaaccccatcgtttcagccccaaatctccttaagctgatatgcaacttcagcaaaatctcagaatataaaatcaatgtgcaaaaatcacaagcatttctatacaccaataatagacaaacagagagccaaatcatgagtgaactcccattcacaattgcttcagaaaataaaatacctaaggaatacaacttacaagggatgtgaaggacctcttcatggacaactacaaaccactgctgaaggaaataagagaggacacaaacaaatggaaaaacattccatgctcatggataggtagaatcaatatcatgaaaatggccatactgcccaaagtaatttatagattcagtgctatccccattaagctaccattgaccttcctcacagaattagaaaaaactactttaaatttcatatggaaccaaaagagagcccatatatccaagacaatcctagacaaaaagaacaaagctagaggcatcacactacctgacttcaaactatactacaagcctacaggaaccaaaacagcatggtattggtaccaaaacagatatatagaccaatggaacagaacagagccctcagaaataacgccacccatctacaaccatctggtctttgacaaacctgacaaaaacaagcaatggggaaaggattccctatttaataaatggtgttgggaaaactggctagccatatgcagaaaactgaaactggatcccttccttacaccttatacaaaaattaactcaagatggactaaagacttaaacgtaagatctaaaactataaaaaccctagaagaaaacctaggcaataccattcaggacataggcatgggcaaagacttcatgactaaaacaccaaaagcttttggccacaaaagccagaattgacaaaggggatctaattaaactaaagagcttctgcacagcaaaataaactatcatcagagtgaacaggcaacctacagaatgggagaaaatttttgaaacctatccatctgacaaagggctaatatccagaatctaccaagaacttaaacaaatttgcaagaaaaaaacaaacaaccccatcaaaaagtgggtgaaggatatgaacagacacttctcaaaagaagacatttatgtggccaacaaacagatgaaaaaaaactcatcaccactggtcattagagaaatgcaaatgaaaaccacaatgagataccatctcacaccagttagaatggtgattattaaaaagtcaggaaacaacagatgctggagaggaagtggaggaataggaacacttttacactgttggtgggagtgtaaattacttcaatcattatggaagacagtgtgtgattcctcaaggatctagagccagaaatatcatttgacccagcaatcctattactgggtatatactcagaggattataaattgttctactataaagacacatgcacatgtatgtttattgcagcactattgacaatagcaaagacttggaaccaacccaaatgcccataaaggtagactggataaagaaaatgtggcacatatacaccgtggaatactatgcagccataaaaaaggatgagttcatgtcctttgcacagacacagatgaagtttgaaaccatcattctcagcaaactaacacaggaacagaaaaccaaacaccacgtgttctcactcacaagtgggagttgaacaatgagaatacatgggcacagggaggggaacatcacacactggggcctgttgtggggtggggggctaggggagggatagcattaggcgaaatacctaatgtagatgatgagttgatgggtacagcaaaccaccatggcttgtgtatacctatgtaacaaacctccacgttctgcacatgtatcccagaacttaaagtataattaaaaaaaaaaaaagaaaaaaagggaaaaaaaactacatacaaaataaagaaaagaaatgtctcttcagattctttgcccactttttgatggaattatgtgttttctttctttttgatttgtttgagttccttctagattctggatactagtcctttgttggatgcatcatttgtgaatattttctcccactctatatgttgtctatttactctgctgatgatttgttttgctgtgaggaagcttttaaacttaattaggtcccatttatttatttttgttattgttgcatttgcttttggggtcttagtatgaattctttgcctaagccaatgtccagaagagttttctgatattatattctagaaatgttatggtttcttagatttmagtctttgatccatcttgagttgatttttggatatacttgttttctttcagtctacttagaataaatattttaccacttcaaatgcagtaaagaagccttaccatcttagaagttcctttgcctttcctcctttgtatttgtcttatgtattatagttacacaaattgaaaactctatgagaaagtgttataatttttgttttcagttgtcaaacatttcaaagaatttaagaagtgagaatagtctatttgcacagacagttaacatttttctggttctttattcctgatgttctaagtttccttttggtacattttccttttttctgaagaatttcctttagcaattctttgaaccaagtctgttggcaataaattaccttagttttcctcacagaggagtctttactttcattcctgaatggtattttcacaggttatagaattcttgattgacaattcttttctttaagcattttcaaaatgttgctccactaccttctgaccttcatggctcctcatgagaaatctgtggtcattcaaatcactattttcctgtaagtaatgcattgtttatctctggctgctttcaaaactttttcctttgtcgttttcaatactttgattatgatgtgtctaggtgtgaatttctttgagtttatcttatttggggtttgctgaacttcataaatctgtttctggtttatacctctcaccaaatttggaaagtctgtagctattatattttcaaatttttttctatgctgtactcattcttctgaccttctggagcttcagtggcattaatgttagatgtttttggtttgccttataggtctccaatattttgttcattgttttcaacatgtttttttgtctctgttgttcaggttggataatttctattgatttcttcaagtatactgactcctctgtcacttcaattctgttattgagttcattcagtgagttttttaattcagttattttattttttaattataaaattcccatttggttcatttttatgtcttctattttttttttctgaaaatgtctctttctattcatttcaagagtgtttgctctttcttgggccttttttgtaatgactactttaaagcattggtcagataagtccaatatctttgtcatcggcatttgtctattgtcatttctcacaaaagatttccttgttctttgtatgttcggtaattttaaattgtatcctggacactttcaatattatgttatggaaatctgggttttatttaaatcctatttgtgttttatcaggcaattgatctggttgggttgaagttgcaagttctgaccagaattctgtaggtagtttcaaaatcagtttcattttcacagccttatgctatttgagtctatcctatggatgctatcaagtggccaggttgagacctggttagtgatgtattatgtagctcagtctttactgtcttagggtatatagtgtgctatttaggatcagatccatgcacatgcagctttagggtaagccaaagggttcatgaacagcttatgggggcattttgctgagctcttgcctctccgtgatctttgcagaaccttcctgtcccctgagaccctctttgccatccttcagccagaaatcttggaatctacttaccctcctctgccacatacttcccaaaactgcacctgtgtctggggccaagtggtgaaaggacgcacacagagaaaaaagcaacaggggtttgctccaacctcttgggagcaaagaggaatgttcctctcactctccttctaggggcctgtggtctagcatgtgaaagaatggagaaaagaaaacaatgggggcttccttccactctttctgagtgttaagagatgactttctttttctaaagccagaaatagagggcttctcctcggctctctctgtccatgctaatgaccccttctgggttttggactgcttgagtctaagctgactcaaaaagaaagtaattttgaggtggcatagaaggagaacgtgtctgaagagaaatgtgtgatctctacacagtctatcaggattgtaaatggacataccccaaaggtggagagagtggaatgtgatgaggtctgaatgcaagtaaaaaggcaaactcaatgaagtgagcttgggagattcaagttctatatgagctgtgacttgtaaaatatgggaaaggcaaacaatgttttctgtgtcactgcaagggaaagaagacagcaggtgaccaatcctgtaagtgaatggcagatattccactgtgctggggaggaaggcagtcactggaggaaaagatgtcagcccaggtttttgcagaaggccatgcaagatatttatccatcagtaaacatgaactgattgtgtaccaactsagatattgtacctttgtgaattcttcccctgctgcctcctcagggatgcccctgtttcctatgcatgcctttatgatgggcctcactgacttgcgctgtaaactgcatgttcatctctaccttgaggatggggactgcatctttttcaatctctaagttcctaayacagggcttggcmagaaattattaggctgaattctttctatctcacaatttaatgtgtgcctttaggaaaatcctagaagacagagttgcctaagaatatttaacttcagattaaggtatttataaagacaaagcagtctcttgacatattctgacatgtgaacctctgctctgagctgtgagtagaaggacctcttctgacagggtcccaaagggcttaagacaggggtctgttccattgtctaatgtgctccagtgtgataagttggaggcacattctgcattgacctgaatgtgccagtgggttggcaatgaggctgcaagcacctccaagcagctgccatagtagagaaatggactctggccatgggaggccttgtcatcttccccaggcccctggaagaattttccatgcagccaagggctcaatactcgtgggaattaatcacttctgggcagtgctggttttcccaagatgcaggtctggacagaaaaaaaaaaaaaatggaattttaagccccagggccacagactggaggggacctggtgagtcctatttcccatctgtgaacctgcttttgcttgtctacagacacattgcctctgattgtctttcctttctggacttttagccttaagggcctgccttatttgtgcaactcacatgagtcctccaggccaccaggaggtggtaaagggtcttggacggggtgcttcattgagcgaagctctatgatcagtaggaagttaatacctcctttaagaaagagttgacttctcagtcaggcactgacctaaaagctttcatttcccctctacctgagagccctactttggcattcctgggttaatggcctgtctggtggccagcatatcacagctgttaccagcacaggggctgtgtaaagaggaaacccagtcctggctccaagagactggcagtctggggaaggagatgggacacgtgtaagacaggggtcgtttaagagtcccacctttgtggagttgtcctgatttcctcacctgcgctcctggacacttattatgctgacccatgttttaccaagtgtctttttgtaatgtaatgtaattgctttttgtccaactgtccctcagcagcatgtaaactctctgagggcaggggccatgtggaattgagaggtgacagcgtgctggcagtccttgcagccctcgctcgctctcggctcccactttggtggcacttgaagagcccttcagcctgctgctgcactgtgggagcccctacctgggctggccgaggccggagtcggctccctcagcttgcagggaggtgtagagggagaggcatggkcgggaaccagggctgcgcgtggcgcttgggggccagcgcgagttctgggtgggcgtgggcttggcaggccccgcacttggagcaaccagccggccygccggccgtgggcagtgagaggcttagcacctgggccagcagctgctgtgctcgacttctcgtggggccttagctgcctccccacggggcggggtttgggacctgcagcctgccatgcctgagcctccccagctgtgggctcctgcgtggccccagcctccccaacgagcacagctccctgctccaaggcacccagtcccttcgaccacccaagggctgaggagtgtgggcgcacggcgtgggactggcaggcagctccacctgcggccccagtgtgggatccactggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccattcagctctctgtaaaatagaccaattggctctctgtaaaatggaccaatcagcaggatgtgggtggggccagataagagaataaaagcaggctgctggagccagcggtggcaatccgctggggtccccttccacactgtggaaggtttgttctttcgctttttgcaataaatcttgctgctgctcactctttgggtccacactgtttttatgagctgtaacgctcaccgcgaaggtctgcagcttcactcctgaagccagtgagaccacgaacccaccgggaggaaagaacaactccagacgcgccgccttaagagctgtaacactcaccgcgaaggtctgcagcttcactcctgatccagcgagaccacaaacccaccaggaggaagaaactccgaacacatccgaacgtcagaaggaacagactccggacaccccgcctttaagaactgtaacactcactgcgagggtccgcggcttcattcttgaagtcagtgagaccaagaacccaccaattgcggacacagaatcaacctctgtatgtctgtcccggaacaatgtaacttagtggttaagcactcatgctttgtgggcagacaaacctgaattcaaatccctgtgcaccaccaaaggtttcttctctctctcataaaacttcatgtttccactaaaaaaaaaaaagaaaaaaaaaaccggggggcatgttagtatctaccccatagagcttatgtgaggggcacagaggataacgcttgtaaaaagctcagagctgtgcttggcgcattgcaagtgctcaaaaaaagagttagcttctctgcttccttcccaagggtctccatccttctctctctccttccttctttatttcgaaagccgtatacagtgctcagaaacaactgatgtctgaaaacattagttggatgactgagaaaatgatggaagtgagaaaacaagttgtgacccagtgataaggctagttgagcctcccagggctagccagtcctcatttgcttggacgctgttggcaggctctgctgaggagcagggaaacatgggcaaccctgaggagcaacatcccccacagtggaagtggtttatccccagggctgggctcaggggcccttcttgagtgatctctaatcacacatttttactgagggtgctgctgtattaggtaaggttacttacttaaataatttaatatcaaaagatttaactttcactttcctatatttcagtgaacccatcattacatttcattggggtttggggccagtgaatgtatctcctctttatgtgtggattttatgaatttcttattcctctctgctttaaaaaaaatcctagcctaagttttaattatgatcactttcaagagacataatatttactgtaaatgtttccttttattgtggttaaatgtacattacataaatttaccattttagccgtttcaaaatgtatagttttgtggcattaagtacattcacattgtagcgcaaccaccactaccatccatctccacagcttttttgtcttcctcaactgaaactctgtacccgtcacacactaatgctccggccaccctcaacccagccttggaaaccaccattatactttctgtctctgtgaatttgactgaggacctcatataagtggaatcatgcaatgtttgtcctttcacgtccttttatttcacttaacataatgtcttcaaagtgtatccatgttgtagcatatatcagaatttccttaaaaaaaagctatattaaggtgtaattaatatgcaaagaaatacattaatatgtacaatttgttgagtttgaacacatgcaaacacccttgataccatcaccataatcaaggtaatagacatatccaacatctaccaaagtttctttgtgtccctctattttttaattctttaaatttcattttgtatttgtggtaagaacatttaacatgagatctagcctcttacattytgaagtgcatgatactattttgttgactgtagccactatgttgtacagcagaactctagaacttactcatctaacataacctaaactttatgcccattcaacaactctccatttcccctcagccccaggcaaacactattatattttctgcttctatgagtctgactacttatttcacatagcataatgtcctccaggctcatcgatgtcacaaatggcaggatttccttcctttttaaggctgaatagtattccattgtgtgtatataccacattttgtttatccattcgttcatttacagacgcttgcttccatttgccttggctattgtgaaccatgctgctttaaacatgggtgtacacatatctgttcaaatctctacttttcctctctgcttttaaacttgcttaggatggtctgggaagcttagatttatgggctgggaagggtctgttcagggtctttcctcctaaaacacagttccggagtcccaggccaggactctattcggattccttttggcctactccggacacctcctgggcatcattggcagtagggtgtgcagttagcactggtttcctatgcccatggrgaagagcagtggtgcagatctccaggaagacagatgagataaagtttgtgttggctttgagtggagtcagccttaatggactaaggacccctttcttgagtaggtgttgattcatggtcagggtctgtcttccagaaggaggcagaaatatactagctcaggaatcttaattagccatggacagtcctcaatatccccatcatggctcattaaggattgcaaggtgttgaggggcatttcaaagaactcrgggctagctagtaacgttgcacagtggttaagggcttgaactctggatttggactgcctggattcaaatcttgactctgccactctgggaaaacctttcttaggttcactcttttttcatctttaaagtgggaaaaagaatagtgtctacttgttgagtttattgagatgatttgtgatatagtgcattagaagcccttagtacagtgcctaatatatggtaatctgcgcatttaaagtgagttattattgttatcatctggttttattcttgcagccacctttctttggccagctttggtcactggacagtaagcatgaacctcagacatagcctgggctgaatctttagtgcaattttgattcagttgctcttttctctgcaaaactttgagatcagctcacccaacttgaaagcttggtgaaagctctgacaccttgtaaagcctcactccttcctaataactttctatatgagtcaggggccacccagtgtgtttatacttccagaccccaggagtggggacggggtggtggctgccactggcttcatagcttccaggcagccagggccaattggagaggtcaactccaccaaaggaaattttgttcggcttccacggaataggaatattaatctgacatgaggccagggaaggctggaccacagggagatgaaatagtggagtaagaatgttgtagtgctttctggtagaatcaggcagtggatggctgcagcaaatcagaaccagatttctgtacatggttctgatggtggtgggtgggcagggggtgttcttgctttagggtcccctctgctctccattagaagtcctggctgggggctgtgtttgcccttcttcatcatgctgtgggaggagagtgggtttgcctgctggcttccttttacttttgtttggtccattttctgttcagatggtctagagcaatctgcaggtccagcatattgtcctaggtcatgagttgaacaaaaggatctcaatggttgttgtttccttccaatgcacactctcaggcaaggtggaaccatcttcccaaggcaggctggcacctttgcctgggcaccaggaagggcttcctggtgtttcagttactgttgcctgctcaccacctctggaatggtgcagaaagtgccggctgtcctgggtcagtacaaagatggccatggggccctatcaaatcctgccttcaggccaccttgccatgatgcagtgattgcttttcctcaggagtgatttgcaggtatagcagtgatagggccatgggggaaggggacgaaaggacagactttaaattatgggcttggcattcatatcagcccacatctgaggctggccaggtggacagaggaagaaggatgacacctctgaaactgaagctgcccttgtcctttgaatggaggctagtaatttcatcctcttctcatgaattttgcaatgtcctggtggtggcagctagaatcactgcccacagtggctgttatctggtattgccttgcaccttgactggtgagaggcccagattccaaatgttcttccctttataatggggccatataatgtcatagttaagtgtgcagggtctggaggaagactgtccctctataggtttcccaactctgttattcattacctgtgtgaccttgggccacatttttaacttttctgtgacttggttttttcaatctgtaaaacaggaattttaatatatacctgacaatgctgggattaggtttaagttagataatgcacagaaaaggcttagagaaattcctaccacacatggctcaatcaatcaatgttagcaattataacaattaattctaattacatggtgctatttaaagtggatttaagaaatccagaaaatgtcagagctagaaatgacctatgagatcagtcatctcagcaaagtcctcatttcatagatggggaaatcgaggtctaagaaggcaaagtgtcttgccaagccccagttcctggtggtagaggagcagggacttgaagtgaagacctgggctcccggcctagagcccctccacaccctgcttctccatgggggccacctctcaaagcttgaagaaagtcatgcagaacgtccagagaccctggcagctgggcagacaccacacacacacacacacacacacacacacacacacacaccaccctaatgtcaaacacgcacacatgcacagaccaccctaggatttgtgctatttccaatcagtggcataaatgactgagcaagagaagtttactcaggatgcatattaaacagctaaatgacatttccatgagtgtttctacagagtggttgtgtatttatgagaaggcatctctaggtctggctcagcagtagagtaggtggtccaaaccctgggggacatgtgtcctctacctcaggtgaacctgagttctaatggagggggtgtatgctctgcacttgggcctcagatatttaattgctcagttttcagcatgctaggcggggagtgacgggaagcccggaaagggaaaatggagccactcatgagattttaggctgacacgggctgtgtgtgttaatggggctgggggtgggggtttccaatggggcacgtggtgggtggtgaatgctccctactgataaggagctcaggctcacttggaaccctggcagggaagccacaggaagcatctctgctcatgcagcagccgtctttgctctcatatctccccattcagttcttaacctcatcctcataatttcccctctgtttcttcctctgccctcctgtccagcatatctcccctttgtggctctgagkacccccaagtggtctatgcaatgccctctggccccagtttgatcaagatctctgccttttttcctggggctttagtctgctgctgtgtcctttgcatcaggamaacaaaggcagctctgtttggggatgtgggcgacttggctgtgtcctgttctccattccttttgctccctcctaattgctctttcagaccaccccagctgatgcctctcccacctttgacgtttcctccaaagcttggaaaagaagacccatcacatgaccccagtcctttggccagttgtccctctgatgtctgaccaagctatgaatgtcctctgtctagccagcaggccaggacctgaagctggctctgtccctactctatgcctgtgggaggggaagagcaggtcccagcctttctgtttgaaggtaccattaaagtccatgcctctcaaaattctcttcctcaagtagagaagatagagcagcatagaaacttctcaagaggaagraagtctcattctggaaaataactccaaactgtttctcatttgcagcatgaagaccacaaacccagtgttttttatatccacctccttctagtgtacctggggccctgatgggagcttgagttagagggaggcattatttctttagactgtaggataggtctttagacttcagtgactgagttgatgaaggtcagataaaatctcagtgtgaacctagaaatgcttttgactgttcctttccttgctgttcttaatgactcttgaagaaaaaaaatacttgtctgttttcagtgtcattcagccctgcctttatcttgccatagttatttacatttgaattctctttctttgccttctctagccacccacccactcatctctaacctttgcctgaaagagttaattctcttcttcagccccagccaggaagtttccatgtgccagtaggatcagtccaggatgagcatgattgaaatcactaatttatttctatagcttcagtctctgtcctggaatggaacaatggaccaaaaagtgttccagacacattgtttgtttaacaaaggaacattcttccagctgaactgtatggctattggattttatggtttgattggttagccctcataaggggtttatatttctcctgttggagctggagggagtgatggggggctgggggtccataaacccctttaattgttgtattgtgactcacctgaacctggtctctcacctagtcaaaaaccttgacttcttagcatgatgccttgcatccagaggattggttaaaggctgtaaatctcaaaaatgagcatgctgtatagccccaggagaaattacaatattgccccttctgaatttcaacccctttggctttgagaaggctgttgattttattattgatcattgagtttgatctgatgcatttcacagagacttggctctgtggctgtgcccttggctccaggggcagcagctatactgatgaygagtttttccattcccccagccagaaggcaagaggtggtagggtagatgcacatgtactcctccctttcttctggaaagtctgatttggatgcatgcatatgtgggtttctttagattagatggtgtgtgttaaaaattgctcttgacattctgccacagagagggggatagatggagtgacctttggaaggcccctctcaatagaatagttataaagtgttttcttgcttttctgtagactgcacatttctttttttctgtagacatacgtagaatactagacaacttattctggaagggatgctctgaggtcatctttgtccattgctctggttctggaaagaatcatcataaatccagtccatcatgaggatagtagattcattttggggtagccaatatagttgcgcttccatccatccacccacccattccacccctcaatccactcatccatccatccatccatccatccatccatccatcccccacctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacccatctatccatccatccacccacccatctattcatccatccacctatccatctcttcatccatctgtcctttcatccattcacccatcatttatcaaatatctactaaattctaggaacactcctaatctgctccttrttatttaatttattttggtatttctattaattgagaagatccattcaatccttgcttgacttgatttttctattgcatttgaaacagttgactccttcctcctgcttgacattttccctcccttgggtgtccaggagcccatgattctttcctgaatctcctctgcctctatgggcttcctcttattctctttcatgtgttctttcttccttatctgtcattgaagtatyagtgttctcagagttctgtcttcagatgtttttctctcctttttcctttcctttgctcttcttacacacacttttctgggcaatttcatacatttatgtggcctaagttactatctaactacctacgatgactctcaaatgctcttctttaacctgcacttatcctgcgttccccaggctcttatgtctgtctcctgaacataaatgcctggatttatgttttggaaacatctcaagtttaaggtcttcataaaaaaactcagtatcttctctgtaaaacctgcgacttctttattccttgtcttgctggttgtcttaaccattctccctgtcaactacaacagaatctggaagcctccttagattctctctcctctcgtgttctggtggacaccaggtcatgtcaattccatttcccgtatctgtttctaccttaccttccccattgccacaatctaattccagcactcactatctmccsttgtgtgattgaacttctttctagatttgcccctccaaaccatcttcatgctgtatcagagtgatctttccaaatgcaaatctgattaagccatttcctcattaaaatctttcagtggcttctaagcacctcagagcgagttcacacttcttaagcatgttgtcccaggctttcacaattagtctcttggctacctctttgcttttacttgaccccaaatgcacaccctaggctggagtcaaaccaaaccacttgtcatgctgcttcttgccttcagcccctgcccctgctcctctctccatctgaaatgctctttcttctcttaatatgttggtcttagctcaagcattgtctcttctatgaagtcttctttgaccccttaggtttcctcttccccacttgtattgcaccctgcaaatattgtaataatttgttttcatgtctgtttccstcctagatattgagcttcttgacaatgagaatagtgtcttttgtcctggtaaccctagtgcttcacacaggtcttgtatcgagagagagagcttacttagcacgtgcttatgactataccgttccctaagattatttttcctcttctgatctgtatcygagctataataacttgtttatttagacttttccttttatcttatcatgtcagaagttcaccaagaaactgaagggcttctgaaattggctttgtttcttgggcttgagtwcagtcccttcttatttacctgcctgcggcttcatctgctgattattgatgatttgaagaaaaaattgtttatgtggaatcagcttcacgtggctccttagctctgaccctgcttctgcttcctttcccttttccccatccttatacctggggagcaggaaatgcaracagcttcagtgtcaagccatgttttaagtggagaaggatgaagaacactgtcatgttctcgcaggccttccacacttgtagacgcaccaactgtcccacttttagtgttcctgatggtcaatttctctttytttcttcaaaccaaatgttaagcctgagcaggacatgattagcaatctgcttgaggataaaatgttataaggtatgcgtttgttccctgctccatctcctatggaaaaccacaccctcagtgaaggtactactggacagtgtgtttcttcagggagtctcacatctcagtgctgcctttcctggcatctctaagtcacaacagatcctgtttccagcaagtttgtatggccacataaaatgctgtgtaaatcagtgtgggaatgtgatgttcccagtaatctgttggctcattgagggatcgatgatctctagctttattggtattgggtactatgttatttgtttgtctatgttatttgtctgtgtttgtctatgttgtctatgtttgtctatgttatttgaatccagcttaagagaaaaatcaataatgccaatgtcaggggcatgcatctatcttataattagtgaatcaatgaatttatcaagtgttttggacatacttgttatgacccaggcattgtgccagggctggtaacacagtgggggacagaactggtgcccgcccaagggggcagcgtggtattatggaaaagcacttaagtsctatagacctgagcatgaatctcgattccaccactccttaatgtgtgatcctcaccagatgagtcaacctctctgagcctcagtttcttcatctataaaatgaagattattctacttcccttacagcattatcgtaagaattggagataaaatacatcacgcacaatctggtttgtacagtgcctcacatttaatagacagagagtcataattattattcccattcatagtrgtgattgtagtaaaatggaaaaccagaactttgtgtgccttggcttactgcaatagctgaaatttatagtggtacattccctgataacagacatgactcttagtgctgcataggtattaatgctttaaaccaggggtctccaacccccmggccgtgggccggtagtggaggtgagctgcatgtgaacaagtgaagcttcatctgtatttacagccactccccatcactcacattactgcctgagctccacctcctgtcagatcagcggcggcattcgattctcataggagggtgaaccttattgtgaaatgcacatgctaggaatctaggttgtgcgttccttatgagaatttaactaatgcctgaagatctgaggcggaacagtttcatcctgatccccccaccccaggtccatgcaaaaatggtcttccaagaaactagtccctggtgccaaaaaggttggggaccactgctttaaacaamcatcttatgagctagatacttttattattttgtagcaggggaaactgaggcagaggaaagttaaatagcttgcccaagatcacataattggtaatggttggctggggatgtgagcccagcctgggcccctcatgttatgttcttctagccaccatatcacactgcctcttcatgaaatgctcaacccaatcatatttctaagttgctaactctcttaagactcccagaacaactacctcaaatttcttggcttaaaacaatcaaaatccagaagtccaaaatgaaagtgccagcagggtgggttcctcctggaggctctgagggagaatcgtcacayggccgtctcctcgcttcctatggctactggcagtccttcactccaatctctgcctccatctttacattgccttcttctctctgtgtgtctctgtgtatcctttcctctacttataaggacctcagtcattaggtttagggccaccttaatccactatgacctcatctaaacaaattctatctgcaaaacctcttccataaataaggtcacattatgaggttctgcatggacatgaatttttcrgggtaagggcgctactcaacccacttcaataaccatttgctctttactttaaagtgggaattgatgaaagaatgtttatttactgtcttttttaaaaattatactttaagttctgggatacatgtgcagaatctgcagattcgttacataggtatacatgtgccatggtggtttgctgcacctatcaacccgtcatctacattaggtatttctcctaatgctatccctcccctaaccccctacccctgacaggtcccagagtgtgatgttcccctccctgtgtctatgtgttctcgttgttcagctcccacttatgagtgagaacatgcagtgtttagttttctgttcctgtgttagttggctaagaatgatgtttccagcttcatccatgtctctgcaaacgatattaactcatcttttttatggctgcatagtgttccatggtgtatatgtgccacaatttctttatccagtctatcattgatgggcatttgggttggatccaaatctttgctattgtgaatagtgctgcaataaacataaaagtacatgtgtctttatagtagaatggtttgtaatcctttgcgtttatacccagtaataggattgctgcgtcaaatgatgtttctggttctagatccttgaggaattgccacactgtcttccacaatggttgaactaatttacactcccaccaacagtgtaaaagcattcatatttctccacatctgttggaattatgtcctagaatatgatgcggttctaagaccactattttaattacttcatctgcctttttggaataagacagatgtggagaaatacggtcttataagaagatgtggagaaatactgtcttattccaaaaaggcaggtgaagtaattaaaataatgctctaagaaccccatcatattctaggacttaatttcaatgggtatttgggccatggccagaatagcagactgagggggatgcttccttcctcctcagctgggctggccctgccccttggcaccacagcgactaagtctgcagtggcagtttgaagccagataccatccttcttctctcacatctttgccctggccttctctctacccggtaaaatacctcaagttccttcattcgtttttcattggctatgggcttgagttctttagctttctcatctctcttctctgaatgagctctgattttcctgacctcttgaaatgaaccagtcatagaggggctgttcctctccgtcattctagatgtagcctaggacttatcatctttttctagtggccacgttgtgctgctcactgcagtgattttgaacaattcatagcctctctgagctcagtctgctcttgtgtatactggagatcattgcacttaatcacaagaatactgagagagccaagcggcctgatgtgtttgatggtgaccgtcaccggtgcagcatgatgaatgcgttagtggtagttattaggcatctgctacaggttcaaggttaaagagcctggaagctcccacagatggctgccttctttggttgatcccagtccttggagggccatcagtcggggatggttagtgtgggaggagatggaggaatggatccaggagctggagtgtctggtccaaacttttgatcagttcatgtgccttttgatgtagcaggaaggagtaccctttaagagcagtgctgaggccagcaggccagcttgcgttcccctgcaatctctggcaggtatcatccaaacttgtgtgggtggatcttcttgctgtgcttcttagtatctcatggtctgtcctagtggtgatctccttaggttgtgagacgtgaaacaggtactatcagatcagggcattaagaggacaagcatttattggacacctattatatataaggcacagtatcagacactggggttcaacaggtaaaagacacagagctggccttcaggaagtccagtatagcagacagacatgtaaacaatttcagtgatgagagaggggccaggtgcagatatgtctatcagtaaagcctgtcctagagcaggagttagcaaactgtggcctgcaagccaaatccagcttcccacctacttttgtaartaaaattttaccagaattcacctacacttattcacttatatattgtttatgacttcttttgtgactcaacatcagagttgagtagctgtgacagaaaccacgtggcctgcactttacagaaaaagtgtgctgagtcctgtccttgatgatgggtcggcaggtaagagttccaaataaaaaaagacgtggactctaatccttggaggctctctggatttccatatgtacaactaacacarttcagaggaagatgagctggaggatctggctggggggagctttgcagacatgtgtgaggtttctgattgggaagcggatgccagaaggcacagcaagtcgcatgaggcacggggtgcttggagagagctgagagcccagaggtgcacgctcgcagctgcacagaaaggcagagtggggacagagtcaagcaaggagcaagaggctgtgacaacagagaggcttgtatggatttgaggccctgttgaggtgataaaagtgattgaatatgaagcaccaaagaagcctgcagctctggagttgggaaggccctcagggttcctctaatccaagctcttgcctgcatagggcaagagaagggagaggaagggacgtgacttccccaagctcactcagctagtgaattgggcagattaggtctcagtcctgtcctgacctaagccagggtgctcttccctggttgtgaactgagccctgggactcttaccttgtggcctagctctttaggagaaagagctgggaagctcaagctccatccctcacagcctctcttttgtaaattttctgtagctgtcagcctcctggtcttttttcctagcctcttttatgattccccagtctaaaagctgtttgagggcaaagtctgtgtctggtccagctctttgagttcctccttgttcatactgaggactccacagatgtgtgtaaaagcactgagcattgaggcctctatcctggtctgcccaagtatgcagatgggaggtctgggcttctctgcgcgtctcttggttgggttggggtacatcagctctggctggtgtccctagagctgagaggctcctctaaaggactgcgaggctgccactagccctggaggggctttgcagctcccaggtgcagttgtcacattctttgtggccacctgctgaggctttcctgcaaaacacttcaccacccctgcacaaagagcttctttcaatgctgaatgtctcccaagcagccccattagctcagggaggattcagtcggggtgccatgcatcttcagtgattgacagaaacacctcatttgtcctgacgtgttgacggaaagactgcaagagcagccagagaggactctccagttcagcccatccttaatcgccaggacatgctcctcccagcctctttcaggctttaagcaggctctccttggcttcctctagcctgctggatgggccccagcccaaattcctccagcgaggcagggacgggttggggatgtggacgggtcctggagtgtagtagggcatagagtgtgaagtgagttggatgctatttgcccacagagtcccagattcatttgtcatctgcacagcaacccatgggttgtcctgagtcagtggcttcgccggcctagtgacagtgccagagagcaacatgaggccagagttcaagagcctggggacaccaggtgcagagaaagagagaaagggagagagacagacagagagagagagagagagagagagagagagctgctttaggcaaaagtaacaaagttataattctggtagggcttataaactgctcagccctcactccgtctttatctggttttatttacaacaatatggaaattagtgatttacagtagccttgcaaataaggatggagtgctatctagcccaggttaccaaatgttgaaacaaagagagcccccagtgcaaacagtcccctattgctgaaggaaactaacatatatgtgcacctgccacatgtacaccagggagcagtgtttcccacatctctgcacgctggatcttcacaatggtcccatgaaaggtgttatttttcctttctgtggaccagggctcagcctggttaagtaactctgtaggtgacaaagataggaacttggagggctgacaggttccagagcccattcctttgcattacaccatgtctcctcccggaaccgtgggcatatctttttcctagaaaaaggactatttagaaagattttctagacctctagtagggctggctctcttagtgggctgaaatggaggtccaggtagcatatttaaaaaaaattaagatgtaattttcgatactattaagtgcactcttctaaaacgtagaactgagtggtttgtgcaaacagcatgtaggtagcatgatttgaggctcttcagaaaggcccctagacctcctagtgggcctgatatctgctgttagtcactgatttgaggtgaagccttcgaagcccctgtcacagtagagctgggtggggtcagatattcatcagcctccagtaccttaaaagggttgctcatcatagattgaaaaacagccatgtggtattccctgagtgagggaccctgggttagactatgagctccttggggccatcccaaggacttctttacctggaaaggatgtgggttgaatgacaggtaagccaggatgargatgagtttttggtacttgctctctggatgcccaggacatagactggtcaaagtgagaccagagcaggtgcgcgatcctatggagagctctggggaaaagctgggggtcacgagagggaaaaaggacaatggaaaatacattttgctcctgtcttgtttacctgtccccattaagagctggctgacatcctagagctagtttctggactgcttctctgactctgtgggttgcaggatgagtaaaaagaagttagaagattgtacatttccagttttctctggtctcagaaacattcatgcagctttcctgagcatgtgctgtgggaaggcctgtgaaagattctgagtaggacaagctggactttccagcccaaccacagagggtctctttctgggctatgagtttaggagacatggatggttgcactccccaccagtaggtttctgacataagcaaaaacagcagagtttgtatccattggttttgcttatcccatcaaaccgtttagagtagtggtccccaacctttttggcaccagggactggtttcatggaagacaatttttccatggactggtgggtagggggatggttttgagatgaaacttctacctcagatcatcaggcattaaattctcataaggagcatgcaacctagatcccttgcgtgcacagatcacaatagggtcggtgctcctgtgagttataatactgctgcttatctgacaggaggtggcactcacgtggtgatgcttgcttccctgccatttacctcctgctatgcagcccagttcctgacaggcctcagactggtaccagtttgggaaccccttgtttagagtgcatactctattctaggtatagaatgtcatgtggacacttggacactgtgtgaggtgtccaagtgcttgggacttagtgatgagcaaaataaggacccagtttttaagaaattattcttttatttgaccttcaaaaaatataaatatccccaggagggattctgcttgggcctatgtgtccgatttacaacctatgtagatgacttttgtagattccatttttgactgtaggttttgctttggggcagtagagagaccattaagtgctcccatctctctatggccgttttcctgtgagtcggcatccaggctaacgactggggccgtggagagcccatgtggtgcctttatgccaattagaaaaaggcctcccttcctcaagttgcttttttaataaaaaaatcagtttttttgaaattacttaatatactgattctgttagatcaaaacactttgccatcttccagaaaacgatcatagtaaatatgctattgaatataaactatcttctccatggtagtgcccccctgaaatagcacctttgtgcagtgcatgacctgcgccactgcatgtggccaccttgtttaggatagcaagtaccaaacttcaataaatactggcattcagcagctgggatgtgctgcatttctctttcagcagggaggtacctcatcctgagtaggacctttgatcccttcaagttttagaatatgagaagaagggagggacctttaaggaaagaagacaagaaaagatgcagttctatttagatggtggaaatctctgtgactctgtgttctagctcatttctgggttctcccaggaggctggagctttgcagcccatcaaagtacatttgcagtagaatgattaaggctagttcttcatgctaaggtgctgagagaattcctgccctttgtgaagtcacaggatctttcagcgggagggaaccttcatagttcaatgctgtcattgtatagggaagcagaaggcagagccctggggtgactcaggtgtgacgttgccaaggtgccaaagatgagaagtggcagagctggcaccaggacctggtctccgtgtttcccccactgccctgggctgggggaaagcacctctggaagggcagggatccagatgagcaggaaacactgtggacttcctttctctagaggmctctcagaatggtcagagtcctgttggcttggggtgtaatgaacctgccatgcacagcaggtaccctaaagacaccttcctccccaggcttctctgcagatggattgctctgcacatttgcctttttactttcccctctgttgtccctggtgccatggtgggctgagtgtcaaaacaagtctttggtacttactctcttcatctcctgagacacacacgtttagtgagagtgacagtattcttgggctgatggtgtggggagggctcctgcctttcttcagaggagcttgatttcacagtggttcaaggcagtagttatgtttcttcctagggccaggtaagccttactcaagtttcctgagaacgagttataccttattgtcctgattatttttatcatgattattggttttgaagttatcagctgaaagggggcaggtgtctcagggaagccactctcgtcttgcagaaaacactctcagcaccatggctatgtgaggacagtccccgtcacatgagggacacatccgcctcatcatttcccctctacttgtgatttgtcttctttcccccggcccctcagtgatctctggtttgtgtcctggcctgagtaacggttaaacaagcagttgactgaggggtgccatgcatgaggcatcgggatagggccgaggcctagagataaggacagagagatctcagacagaattttgacccagcaggggttggagagggaaattcttctctttgtcatgttattggagatgatgcccaccctcatttttattgaagatttaccctgggctttgctttgagttggatgcaggaaggagcacagtgagtcacagggcctggatccttgtccccatggagctcagagtctggttgaagctaaaagagtcagatgtggaatgatgcccatggtcaaacatgaccctgccgagcacagaagagtaatgagcagggagactggtagggctcgctgtggaagtccagaaaggcttcttggaggaggtgctactcggactggtgctggagtggaggatggactttggaagcgagccttggagagtgcgaatggccctgctggatgggacccacagtttccatttggacttcctgcaggcttctcgacccctacttcctgttcacctcctgcgcccattctctcatttgccacctgtcttccatcygctccaagccctcatcacctctgcctttttccagcttccccttcccctccagggtctatgtttctgattattccccacagttggagttccttgcattcttctgcattgaatctcattttgtgatttcctgtcccatattttgtaaactccctaggtcccttctcatttatatccctgtcctctctggtgctgtttgcagagccgcccagtttgttatcatctgcagatttaattagcagggctgatgaccccttctcttccagacctgcggtctcaggcaggactggttccatgtggtgtgcatgcagggtcatggctgtggaaaagcatgtttgggctgcatagagaggacacgatccagactgggctttcgcctcatagagggggagaaaatgccccaggagccagctttttctaggaaaaaagggaggatgctggaaactcaattgcacaaacccccttaattcaaattattctggccagaagacaccatctgcagaatctaattattattagcattgagcacctactatgtgccagacattgtgctaggtgtctttcttacattattgctgatattcacaagcactctatgaggtcactattgcttccagattcttatttttctgcttgatcagaaaggaggctgagactcagagagatcatgttacatatcaacgtcacacagggagtaagtggcagagctgggattttcagcagggtctctctgagctcttctttaatgtgccctgcttctagagaccacatgaccttcatcccctggcctccagaacactctaagctaatggattattattattttttattttaaaaacatttttaacttttgtgggtacctagtacatgtatatattaatggtgtacactagataccctgatacaggcatgtaattcgtaataatcacattgtggacaatggggtatctgtcccttcaaacatttatcctttgtgtaacaaacaatccaattgtactcttttagttattttaaaatatacaattaaattattattgactgtagttatccattgtgctattgaatactatgtcttattttttctatttttattttgtactcattaaccattcccacttcctgcccactcccctactgtccttcccaggctctggtaaccayccttttactcttaatggattattttcatagtgctcttgacagctgggttgatctggatatttttggaagctcacgaagtaatcaaatccactggttttttttttttttttttttttcattatagtgctaggtctttttctgtgtccctgattagtttatcaacatcacatccaagatctagattttagctaattcgatagcctttattcataatccaagttctttaagctctaccttaatatctctcaaggctgagtctgctggagccagagccatgggacttgtgtgataattgctaatcctgccttctatgtcaggtcggacagatgtgcggggcagcacagtaattttcaacttcacttacctgagccctagggaagtctcagtggagcactgtatattccaggaaggttaatttttcctaggactttctagtacatcgaagcatgtttggtgtctctcacttcatccattaaatatgagtggtgtttccctgtcattgtgacagtcaaaaacctcatccatttctaaggactacagttcttggggtttgcatacaagtgccacagaaaccacttggagcccaagttggggctgagcaggtggggctgtagttctctggaacacaaccaggtagccccttgaaatatttggagaaagagttctttagctgaagaaagcttgtgatcaatgttgtagaaggttttatagcttctttgtacatgttcaaagtctacactgcctctttgtgtaagatctctgctatgaaggagtaatggctcctagaaggaaggccagagcctgtcttcagaaaactgcctcctccgaaggtcacagcctggatctgtgccacatgggaggcttgttctgtcattctgtttgatcacagcctagaccaacccagaccaacccctagaccaactccctgctatcacttgtatttgttggtctcactggagagtgggaagaagtttctaatttgagctccactgggaaaagaggaaggcattttcttaaaggttccttgactaggcggactctctcatcttttatcttgttgaaaatataacgaacctgggtgaaagtatggggttgatctgtcaaggtcactgttgcaaaatgcactggcagcagcattgtagtgggcagtacagccagcacaggccagtctcagccccctggatccccaggctccattcagtttcaggcyggctggtctctacatgctgcacattcctctctgcacctgtgttcatccacttcttctcttccatgccgctcacaacggcatgtgcaaatctcatcatgtagtggtcaaagtacaactcaaggtccctctcctccacaacatgccctctggctctagcccagagtcagctctttccagtagtttcttatatcagtgagaatgcttgttcatattggcagaacatccaactcaaaccagctcaaacaacaaagggaatttataagctcgtgtgatcaggaagcccataagcagatctggtgaggcttgatccctcagctcccatgatgtccctaaagacaaccaatttctctatctttctgctcaaccatctgcagggtccacttcatcttttrttttctcactgatcccccttgctgacccaggacttccctttatggagtgaatcgatggccactgttatcccccagagtctgacggaaggagaaagctgctttccctagaaatcctggccattatttcctcacatcttattgattttgaccacattacaagcatattccagaagcagtcgttgtggcagagggttggatatgctgattggttcaaactaattgggcataggcttggatttgggatgggatcaattctgctaaaaacatatggctgagctccagtaggggtgtttctctcagagcaaaacttggcaactattggtgagtgaaaggggagatgacaaacaaatgatcgttcattgtcgtcctgtccctttggacgttaattgccctggtcgtgatctgtcccaggtattagatatcatttatctggtttccaaagagaatgaaaatggtgtgactgcatgatggtatggtggcatgatggtgtgaatgaatgattgtgtgaatgcatgatggtgtgaatgcatgatggtgtgattgcatgatggtgtgaatgcataatggtgtgatggcctgatgatatggtggcataatgctgtggtggcatgatagtgtgaatgcacgatagcgtgaatgcatgatggtgtgatggtatgatggtgtgatggcatgatggtgtggtggcatgatggtgtggtggcatgatggtatgaatgcatgatggtgtgaattcttgatggtatgaatgcatgatggtgtgaatgtatgatggtgtgatggcatgctggtgtaaatgtatgatggtgtgaatgcatgatggtgtgatgaaatggtagtgtggtggcatgatggtgtgaattcttgatggtatgaattcatgatggtgtgaatgcatggtgatgtgatggcatgatggtttgaatgcatgatggtgtcatggcatgatggtgtggtggcatgatggtgtgaatgcatggtgatgtgatggcatgatggtgtgatggcatgatggcttagatttctttcatatgccctaactcttagcacattgccaagcacacagtcgttgcccaataaatacttgttgaattgaactttgttaggatgattgaatcataggaaaatagtgtaaagattctttaagggagagatgagtcactgctaagagaaggcaggggcatatccttgtgggggaggggagttaattactgataacataaagggtttagggaggtgtcttgaggttggaagaaaagtagcaaaatcaaggaatcatgcaaattttaagtcaggagagacattagagataatgaagagatagggctttcagagttaatatgaccagcttttaaatgcctgggaatgcttctctctgagtgggatatttttcacatgggccaaataaatgaaagacaggaaggggatactgggcattcttgctcaaaggtttgatggctattaagtgtagtggtgctcacaggttgatcctgtgatttgcttgtctagcctgggacatttttgagaatgctaaaatcctaaacttgatgggatgatgaggcaaggggaataaacagagactgttccaggccagccaggacctactgatcatctgtggtctgagtatttactaatgaccagctagggcacccctttgcccattgctctcttgccttccattcctcaggcactgaagtgctctccgtgtcctggtgggggtgagggagaggcacacccattgctgagagttagcatccacagcatctgattccacttgcaggatggcgactgtccagaacaatttcactgtgatgaataggaaacagcagcattttccttgggtctttcctcacagttcatccaggatcccctgtttgggctggttctgtgtgctggaagcccaggcgccagcctactggcctccctgagttttgggagaggccctgttctttctgccaacatctttggggcttatggattgtcattctctcatttttggtagaaatgttgcatctggctactttcagcctgttatctttgagcatcataaactcccaagagaaatgttcacttttatcttcatcctcacttggtggtgttcagttacatgccaggggctactgcctcggtgggctcagctatgattttttttatgtgggatccaagaaacatggtgggattcccacaggggtcaaggacatgtgtttttttggccctaggaacatgggtatgccctgtgctttgagtaccaaggcagagatttcacagtgcctatccctgcacttgctctttaaaaaatccttttgtagacacttcatagtttacaaaataccttcatatgtacaaccttatttgattctgagataccatgaaatcattattcacttttgaatatttattattaattaaaagctaacgaatatataacatattgttaagtaaataatgtttatttaacataaaacattataattaaaaataatgattttttaaaacaaaaaaagttacaagaagtgttgcattgttttacatttttgcatatcttttccctctagcctttttgaggtataactgatgtataataaactgcacatatttaaagtatccaatctgttgagttttgacatrtgttcaaaaccatcactgtgaaaccatcactgtcttgtaatcaagaaaatgaacatatctaccacccccaaacatttccacaggtccttttgtaaagtctatccttctctcctccaagtggtattattattaattattacaattatttaacattgcctgtcaatccgagagagctttggtggcttgttggaaatggtgcagctggtaagtgacagagctggggcccaaggcctggtcctcaggctccagaacccatggccttcccggggcctatcttacatggtgaggattattccctatttcttccacctgtaggatttctgaagtagaataacaccyagagaagcctgagtcacactctgttgctgactccccataggttaggtctttcaaggtgccgtgctgcctttggggtcctctgcagctcaggggttgagtggggaagaggttctctcacccttgatatgttggagggtgtattagtctgttctcacgctgctaaaaaagacataccagagactgggtaatttataaagaaaaagaggtttaatggactcacagttccacgtgggtgggaaggcctcccaatcacggtggaaggtgaaaggcatgtgtttacatggcagcagacaagagagaattgagaaccaaatgaaaggggtttcccctcaccgtctctactaaaaaaaagaaaaaaatacaaaaaattagctgggtgtggtggtgggtgcctgtaatcccagctactcaggaggctgaggctggaggattgcttgaacctgggaggtggaggttgcagtgagccaagattgcgccattgcactccagcctgggtaacaagagcgaaattttgtctcaaaaaaagaaagaaagaaagaaagaggttttcccttataaaaccatcagatcttgtgagcttattcactaccacgagaacagtatggggkaaaccgcccccrtgattcagttacctcccaccaggtccctcccgcaacatgtgggaattatgggagctacaattcaagatgagatttgggcagggacagagtcagaccctatcagagggttggactcctcagtctccctgggctcccctcactgcttcctcttcacttgggctttgaggagttgttcctgggctgcctctggttggagtgcaatgatgtgtgatacacggagtggagactgtggtgataggtccagagatcacccgttctgcgtgtctgtccaggttggcacccagaaatacgacaaaagtggctgagttttcatgtccataggaccctgggttgtccctggtcgttggttgggaaccaggtgaagtcttttccataagaaggaagggtcttgctgctggtcttagtgggtctctgggatggggcttggtgggcatttggctctgtcttctgcctctgctgattattggccaccttcaccttggcctatgcaggacagggttggagaggagattccagtactctcatccaggagctcccagcagagcagatttccacctttccttccctaggcaggaacttcttccctttgcttaatcccaaatccctgtgtctcaggaggaccaggcagagcctgctccgaatcagaggctgtacattcttgagagccaaaaggaagttaaggctttgatcttcacgatgacacaggtagactatggtgttcctcaaatggagcagatgggaggcctgtctcagatgaattcctgctcttatttcaaaagccctctgtctcaaggctacacctcactctcctccttcgcctgtgacgatggctgccctggccaccatctcagcacccctgtcctccagctgtgtgagcttcaatcttgatgatctgagagtgtggggctcccagcaggtgtggtgggggcgctggtgatgtcttaggggagtccaagggagtctgtctcctctctgctcctccatcatcgacaggctcatccccccacccttccttacagcgccattcccgggcgccgatgtgctgcagctgacgttcttgcctcacagcagggcccgggaccagagtacactcaggccccttgggtcagcatggaggtggcttggcagggctgtggggaaggaggcctgaggagtatcagtttccagtgtttggctggggctgcctcccgctcactattgtctctctagagagaggacgttgtcttgtttatccacatgcaagctttggataacaacaacaagacaaaaacaatgaggataacttcaccaggagcgcgacctccagtccctgctaggggcctggagtgcgggagagaggtggctgggggtacgaaccccttcttccctcactccctagcccattcctccttcccctgcctccctaatttcttgtgaagggaggggctgcaggattgccgtggatggttggcagccctcaggatggaagggtgggatgaatgctggtgccaggagacctggatctgcttgtaattagctgtatgtctatgcttatgcagcacagactcttgggctgcaggtcttcctttgttactggagaaagatatgttaggtgtgcttggaggtgtttccaactctagagtcctatggccaaatcagttcatcattctgaaattcctctgtgtccctaagctggccctgccttgaactgtcagcatggggtgttgactagcatcatggcagtctaatgcttgctgagtgaagacgtcaaagactgacatttgaagccttgtctattttccagagtattcctgattcttctccttaatgctataacacccccagaagcctatgaggcagaaaagtttctgatatatccagttcaggttgtgttttgtgagcacgagtgaggctgtgtcaattcctttggcctctaggaaagggaacggcggtctgcaaatgtggtgagcatctggggctaccaacaggatggagaggccctccacgatctttagatggttcctggtcaggtggaaagtttagtaactttagctgtcaatatgagagacacattcaagaatgacacttaagggtaattgaattattttctcaaaactgaattagatttaaattctgttggccaaaggtcaccaattactttgtgggccatggtagctaatttttagagattggtcacaggatccaaatggaatccactaggaatacagtatatgtgtactgaagttgccagaaatatttactgagcacttactatacgtcaggtactgtggtggctgctgaggacaaagcaaacaacaagacagactcattctttgtcctcatggagctacagatctagcagagaagaagggtatgagatgcttagtgacacaatgattgtgatagtgggtccgtgctgtgaaggagaaagacaaggaattgcacaagcaagaggaagggaccaggcataatccacggctcaggaagaggcttcctgaggaaggaatgtttaagctgagacccaaataggagttggttgggatgggggatgatgagagctttgcaatggagggatagaatgtgaggaggcttgagcgtaggaagctggtggaacagccagatgacagtgagaagggctgggtgctggagcctggggaggagggtgagaggggctggtaccttagaccatgtgcaaattatcgggcttgctgttgagttaactttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtggtgactcacgtctgtaattctagcactttgggaggccaaggcaggtggatcgcttgagttcaagagtttgagaccaggctggggaaaatggcaaaactccatctttaaaaaagtatttaaaaattagctgggtatggtggtgcacacctgtagtccgagcttcttgggaggctgaggtgggaggattgcttgaacctgggaggtggttgcagtgagccaagatggtgccactgcactccagcctgggagacaaagcaagaccccatcttggaaaaaaaaaaagagagagagaccggtgaactcagaagtcaggctctgattgaggagtattcatttcctttggccacagtactcacaccgtcttcttgggtaactctccctgataacaagaactagagaagtagggtttgtagggctttatgaaaatggagtcacagtgaaaggattgcatagtttttttgagacatttcaactaagctagagacatttcctgctctgttatatatttcacattgcttgtccctggaaaaattacctaccttagactgacaggcctgggmcttcctacagaaatatctgtgccctggttctcccttctgtgatgacaaggaccaaattatgtgttacagctcattttacacgaactgaagttttagttgcctgttgagatttgggagcccctccagtcatattgrttacttatttataacatcttctttagggatggattgtatcctctgacggctaatctcttcatgttgtgttaaatttcctgtcgatttcagcaacttatattttctgaccttgtccccaaattctggagatgcactgtattttgaacctgtgatttcctttaggacatgtgggacattttgaaaatcttgtagataattttaaaagtgcaaggcaataaaggaaccaggattactcactcacaattttaatctaacgggaactggttttccccagcraggacctgctgtgtgtgcagtctcgtgctaggtgcttgaagaatacagaagaagtttcagatactgtcccgcagtcaagaagcagtcattttacctgggtagagctaatcgctatagtaatgcctgatgtttattgaacactccacatttcaggcacactagcagggacttcacctacttcatctgcagttctcacaacagccatgcaacatttctcatcctccttattcagataaagaaggtgaggctcatttggttaagtgacttgcctaagctcccacagctgcaaaattctggaggcaaataattttttttttaaataattgaggcataggtctccgtttattttcaggtggtgaagattccagaattagtgggaaatactgattctatttgaatctctaaactatgagggaagctatacacctagatagtctttttccctttctaatcttgttccataattaattttggttgttttcagtattttgctattagaaataatgctgtcacaaacatattttttccttttacttttagttgatgtaactgtacatacttatgggatacagagtgrtattttgatacatatatgcaatgtgtaatgattaaatcagggtagttagcgtatctgtcacccctaatatatcatttctttgtgttgtaaatattcacaatcctctcttctaactttttggaaacatacaataaattatattaatcctattcaccctgcartgctgcagaacactggaaggtattcctcctatctagcttaactttggatccattaaccaacctctccccatcctcccctctccacattttgcccagcctctaataaccacaattctatgctctacttccataagctcaaatattctttagtttccacatatgagggagaacatgtggtatttgtctttctgtgtctggcctatttcacttaacatgatgtcctccaggctcatccatattgctgtgaatagcaggatatcattctttttatggctgagtactattccagtgggcatctatctatctatctatctatctatctatctatctatctatcacatttcttttatccattcctctcttgatggacatttaggttgattcaacaaataatctaattaaaaactgggcaaaggatctaaataaacacttcataaaagaagacatagaaatggacaacaggtatatgaaaaaatgcttaacatcactgatcatcgaggaatgcaaatcaaaatcacaattagatatcatctcaccccagttagaatggctattataaaaaagaccaaaaaaataaaggctggcaaggacgcagtgaaaagggaactctcacatactgctggtaggaatgtaaattggtatagccattatggaaagcagaatggaggtccctcaaaaacgaaaaatgggactggcatatgacctagcaatcccattcttgggtatgtacccaaaggaaaagaaatcaatatatcaaggggatacctgcacccccatgtttattgcaggactattcacaataactaaggattcagatcttgttctgtctaacttggaagctccaagctcttccactcccctactatgcctaaaagaacccacatccacaggcagggcagaatggatgtcggagtggcctgggggacaaggaaaaaattattttaaagtcaatacatgttaaccttcaggtttagattcctgggggatgcattcggtgatggttgtgctccggagctttcaaggagttactttttttctttggagacacaaccagtcacatcagctaatatttcacaatggtgggtatgttttcctttttatgagaaggtaacaatattgcacagcatgaaaggaacatgactagatccacaaaactgcattcctgcttttgttttcattttaaacaagttccttttgaggagagtggagatgcatgctttgctggaggaagttaacaaccccatactgggaaacgattttgcattcgttagtgtaagattaggctgcaatggatagagcctctaaaatcaccgtggataaacaaggtagaattctatctttcacgtaaaaatctaaaggcatcccagggctgctatgacactctctagagccagagccagcttctctcttgacactttgctgtttctggcccggactttaaccttaaggtctaaaatgtctgtgtccatcttccaggcagcgggttaaggggacggaagaaaatgacggggcaaaaagcacctacttgctgtatttgaagaaggttaccagatacttccaccttgcgacattggccagaaatactgtttatggaaacacctcattgcaagggagatgtggtcttaatgctggatggccatgtgctttgttaaaaatgaagaacatgagaacagctgtcgggacagctagcagtctgccaccaagatcttggaatttgacccttgccctcccaaccctacctcaaacttagaacatctgcacccacttaatggacatctgttacacacttgagccaacgaccctaaagaaagttaaaacagcattcatcacagtttgaaaataaagacaaagggtaatgtgttaacattcataatcattgtgatctcctcttagcgagagggatgatgctgtttgccatctttcascaaaaacataatttctggggccgtgatggagagctgggcttgcaggtcagcttcacagatggtttcttttcttaccctttattttcacttagttggaaaagcttaaattacagttagaagtagtagcaagtgattgatgattctatctagcagtcctgcataaccaaagataaaattggggagatttcttgctgaaggccactttcagtattttgtcagaacgatgtcacacttgggattgggaaggtttcattttagggctgccacataggttccttatcaacccttggatttgattttagcctaaacacatgtctttgtgttgtgttacagtccttgggtgtgtttcttaattatcctgagtgaccatgtcatgtctgaacactatctttattgcactatctgtgtaactttgggcaaatcatttacattttccctgccttgctttcctcagctgtggaatagagattgtggtagtactggccttacagcatagttgcaaatattgtgtgagctaatgcacgtgaccacctaactcagttctggcgcataatacacagtcaataaatatgcattgtggtaattgttattttcagatattgtcaaactctagactacccaaggctttcacaccatagtccaatctccttttgaaatcgtggtttattcttcatttttctgccttgtaagtcatgagctttcttcctcaaagtgaggtttggttctggatgtttgaattactgaacatattttggagctgccattgaagaataatagaaatagttttcacttgcattaataagtgccataaaatatctttttattttgttcatcatttcaaaagcacatgtgagcacctcctccatagacagtgttcttcagtkgggggacgtagtcttctatttgccatctatctctctgccaggcacactgaaaatgcagacagtcagagcctgtgagttgaagattttctatatagtcttcaacactaaaccaagatcagagggcggaatgaaggattgtgctatcagctcgttccttctctctgaacacagtgaaggagtttaaacacaatgcttgtgcttaattttgcaggtagttttagaaacttctcaccaataatgagacttctgccagtttttcctacttggttttggtcctctttagttctttagtgacaaaattaattaaattcatatcagaaagtattttttcccctgtgcgtgcttgttttgaaaaaaaaaaaaaaagtgaatgtttatttgaagatgaggtgccttcctctcataatctgacacctatttgtaacagtcatagtgacaagggccagatgaattgctgggtcaatgaaacctgactttcaaatacttatcactgcattttctgtccttatttttcatgttttgagagaaatcaacacacaacacagtcacttatcctgagacatagattcatgttctgtattcatataggagccctgtttatattattctgcattgtaccattgtcattatgatttatagtattacttctaggctctagtagatcacttttgtggtttggggctataacagcatgacagtagaacaaaaatacaaacttgaacaataaacaatgaaaacatgtgaatggagacaagttgcaggctattcactgagtgtgagcagtgcaaaaccaaccacttgttattaagagtgtaatgagatttccgtgaaaatcatgattgcttatatttcaaatctgtgaccaaaattgttttaacttgtttttttttttttttttttttttgctctgaagctaccaaacttccaggggccacactttgggaacactatcctactgttttcgatgagaacatttttggaatagactgatgaactgggtacaggtgggaagggactggtccctggtgaattttaaagagaacgaaaacgagaaactgaagaacaacgggttgggctccttgtgtggaacagttgaagaaccaggagtttaagctatgtccttacaagtgtttccatttgttctttctttgtaccttgcagaataaaagccagggatccatctttgtccggatacacgccccgtggcaggtgctggccagagaggcagaattcttgaagatcaaagttcctaccaagaaagtatgagcatgtttctcctgggttctgggcctcctgagggctggatggatgcaaataatttgggaatagggccaggtgggatgtgggttttgtggaattgaaatcacacttgcttccccagggacccatgatgccggggtggggggtggggnnnnnnnnnnnnnnnnnnnnttggggtggggagggagaatcctcccacctcagagcactggctgggtttgctccatgagaagcaacacattgtccctgtccgtgttcttcatttttctgtttcacctcctttctctcttctcggggtcctagtacagccagacacttctttagtgaatagagtaatgagagaaggctgcaagccacgctgactgtgtcagcagtgggcaggggaaacaacaccaatttgctgtggagaaacctattctggttatgattctgccactaaatattgtgtttggtgggtttcacttatctcttctgtaaatcagaaggttcttaatcaggtgaattgattaagatcacctggtaagtgttttcaaactgttcatgccagtgtcccatctctgggaatttgacctacttggttggtatggaatgacgttctcatcagtgttaggcaaaaaatccccaggatgatgcacatctgggttgacagccacacagtttagatgatgtttgaggtaktttttttttttttaatccaggatagtctatacataatttaaaaatctacccagaggccaggcacggtggctcacacctgtaatcccagcactttgttggggagaagtggaaggatctcttgaagtcagaagtttgagaccagcctgggcaacatagcaaaaccccacctctaccaaaaaaaaaaaaaaaaaatctacccagggaatttctaggtgacatgtctccttgcataacaaaatctagcaaatagctccaaagagaaaggaagcatgtgctcacagatactccattctttattcataggtattttaggggaaaggggtggctattgactttgaccatctgccatgtctcttagggagggtcctgtggcagatggcactctagtttaaccatgggtgaactgtgggtggtctctctttctttccctccaccccctcttctctctctctctctctcatatacaccacacacacacacacacacacacacacacacacacacacacacacacgtccctttccatagtgtagttgtatacatgctaccatggcaaagatcatcttgctgtttgtaactaccatcatcatagttttcatgctgcccactgtgaacagaattccatatttgttgccttctgtaccaccactgtgatcacctgccccctcgttaccatgccgactctcagtgctatcattatagtcagcaacaccattctgatttacattgttggccaacaccattttcactaccaacagatctgctatctccatcaaaaatcactcatcaaataccagcacatgactgataccatcatgaatcctctacttgagaagaataaagtctatgggttctgttcttatagatttattacaatggacaataactccacggcaggtggacaaatgcttattaaacaatgaacaaacacaaacattaatattagctacaaacattttgccaacaaaaggtgatttttggtgtcggggaggggggtcacatgcctgaagtgtcttagtttcacaaggaatacgctgtgtctttccccttcaattgcactgctgcgttttttgtctcctagtttcagtcctctcactcctaataccgcagccctcaaatgcgggtgccatctttgttttggatctctgcttctctttagctcatgttctctggagttcctggcaacatgatactagtttcagctttgggtggaggcttctgcttccttctggtggggtcctgttttggccaaccctatctcctctttcttctgtcttccttctaactccaatatattattctcctttctctctggtttatctgaatgtgtaatgttctcttaacctcattctatttgtgtcttgtttcctatgttttaatctctgctgctgatccttggaaaggaggtgagcaaaactctaatgcccatgttatgatttccatcccccagggtaacccttttaggggaaacctagagacataggaaaagtgtgtcctttttcaacctccgcttgcttattttccctctttgctttccttcccgtctttctactctcattcttttccttctcttctctcttccttccaccccccacctctgatgcctcctcttagcctctctctctgttctttgcacactctatgacacctccacatctctctttttttttttttttttgagatggagtcttgctctgttgcccaggctggagtgcagtggtgtgatctcggctcactgcaatctccgtcccccaggttcaagcaattctcctgcctcaacttcccgattagctgggattacaggtgctcatcaccatgcccagctaatttttgtatttttagtagagacagggtttctccatgttggccagctggtctcgaatttctgatctcatgatctgcccgcctcggcttcccaaagtgttgggattacaagcgtgagccaccacacccagccagacacctctacatctcttgtctttctgccaccttctcctcctcactcccagacttggcttccccagtagtgcttgcctttggtccctctggtatctcctttatcttttcacatgcttatgctttttagagcatagttttgcataaatgacatattggctttcagagtttcagtgcccctatacattaactgtttggaacttacatctgtagtttttaggtggtacctgcatttgaacttgtagatgagttggcgagggtgagaacatagtataaagcagccatctctgggtttctctccccactttgcattttggtagacacagcactagtcgagtcctcagaagaagagacttctaaccttggttctgcagttattcgttgtgtggtttggggacgtcatcccatctctcagagcctcagttgcctcatctatgatatgggcatactcatacctgtcctatttttcttagaaggtttttgtaaggatctgattcttaaccagtgctgtgtaaatgcaggactttgttgtgtctgctttctgagatattttaatgtgtattctcaattcttagtcccccagtcaacttcctttctgaccaaagaagcagccagcactgatagtgctccctctgtaagaaagtccttggagaggcactgagggagcagaaacaacccatgccctcagggtgccgacaatcacagggcagcatagggggagtgcaggtgcccagacatcaatgcagtgatgggatactgtgtcaagtagtaactcattagcccagcaccaattctgtttgtcaatgtggtgggttagggagtagggagaggcaaagcatgtgattgccccccaaggctgcagataaaacagaaagaactttttcccaaagtttcttggtcccagactcgactcagggggactgttttggcttccttttaccacatggccccagatcttccttttctttctttctttttttttttttttttgagatggagtgtccctctgtcacccaggctggagtgcagtggtgcaatctcggctcactgcaacctctgcctcctgggctgaagcgattctcttgcctcagcctcccaagtagctgggactataagtacgcgccaccacgcccggctattttttgtatttttagtagagacagggtttcaacatgttggccaggctggtctcgaactcctgacctcaagtgatccatctgcctcagcctcccaaagtgttgggcttacaggcatgagccactgcacccggccccagatcttctttttatcatagaaggcaatggcttgtagtggagctcacggagggtgttatacacagatgaggggggatataacttggtatgctgggtaggatgctatgtttgtaaaaattaatctgaggctctgatcccaggggtgggggtctgggttaaacccagttcctgagttgagagaggagcatggaaaatggaagacgagactcgctgtctgtggagggctagtgttgaggctggtggcatgctctctttttaaaatgagaaaaaaaccacatttgctgagagccacatcctggcggcgaggggagcgtggaggaagaatgaggcatggcgcgggatcagttaagcatcctccaggcagtggaggtttggatcataactcggtggggtccagagagactgggaagatggggaggaaatcacaaaatcgagatctcaaacctggacaaatccattgtaatgtgtccagggactccaagtcctgagcacagatattaactgggagggggaatcttggaaggaagcatttgttttccaaaaacaacaacagaagagccagcattttgtgagggacactcaagatccatgcacagaagggtgtgggaaggcctggcctttggccccgagcagcctgagaaggtttgaaatggcggtatggaagcaggtgctttcttacgtctgctcattaccaagatggctcttctagagatcgtggtcaacatttctgttgatttctcatttgctttttttgtatatatgaatgaacactccgtttctcatcctttacattctcttattcctcaagcctctagcagagacaaggtcgatgcaggctattagggacgactttcatgtcagtgaaatcatattaatccagccagagtccactaaatttggaagaagtgacatgcctgggatgggtgaaaaatcccttttgtccaatcgtcagagcttttgtagctattgttaatagagtgactgatattgaaggggtctcatttgctgtccctcagagcatgccagaacttcagcttatgtgtcctttgcacgcaagtagatgctgttaacttccagcaagtcatgcctttttaggaaagcaggctcagagctccatgcatctccaaaacgggagtaatacacattgtggagggaagaggtgatgatgttctctgaatgcctggcagagaggcacacacaacacatgagaattgccgttgttactgctgttggtattgttattcatagcaaggtgtgcaggcagcgcaattggtacaagactagggctgtttctgctctttgactctcttctctcttctctgcaatgttgggggaagcaggcccagtccctcaactctgccaaggcagccagaaatccagacatgaaatctgtggagatgcaggaacagatggcctttggactatgtgctggggacttccacttcctagagcgcgggtccttggggcgtctgtaaacacgacggctccacctgtgaggtctgcggtgcagttgctgggaaagccagtgagaagactgctggggccccgtggtgcaggaggcagagcttgaaggcacccattttaagggagagacagcaaacgtgacaagtggtccaccttgagttccactattggctctgccaccattaacctggggttacttgattcatgtcttagtctgtttcctaaaatggacttgagatggatgacaaccaaaagaattttggttgtaaaaggacagataaaaagaatcatgtaactggggagggggggaagtaggggaagtgcaagggaaatgatgatagtggaaactaaaaataagggtgatggatgcaggagagacagagttgcattctgggctttctggtagccaagacagaaaggactgtggctcacagtcgtctataggaatcagcatctgttttgccaaaggaggcaaatttttcctgttgtaaatgacatgaacaatacaagggactatgttttcaataataagttcacacaagcttctgcaatgttcttcatgtgaccattgcttgcactgattctggataaaactgaggatgtaatgttaaagtgtagttgagggagggttgaatacagagtaatgtgtgaaaatttctgaggggctaactgggttcaaagataacggtttgagcagaaatgccactgacactttaattcttttcggttgaacccatgttttgaaatgtttatgtctactaaactgcatttattaaagaataagttatcttcttttcctgaagagaaaacatatgtaattgctattaagcattatttatcagtgtgaaaaaaattggtgtttccacactgagctgatagaattccagttaaaaagcaaagaaacttggcattttagttagcttcagtggccctttaggagggaaaggtaattccatttagctttggaaatgattggaaattgttctcaggtacttgttattgtctctgtagagactctgatttggtagccctggcttttgcaaaagcttcacaggaggacttcttcctggttcatggtgctcgcccggcctgagggactctactcagccaggactgcagcacctcttatttctcagttatccagatttgaggcttgtattagggttctccagagaaacagaaccaacaggacacacacacacacacacacacacacacacacacagaggtgttatgaggaattgattaatacaattatggtggctgggaagtctcaagatctgcagttcatgcgatggagacccaggagagctgatggtgtagttccagtctatgtccaaagacctgagaactaggaaagccaatgaagaagctccagcagcctcaagacccaagaactgatgtttcagttcaagtttgaaggcaggaaaagactgatgtcccagctcatgcagtcaggcagaaagagtttccccttacctgtgggaaggtcagcctttttgttctattccggccttcaactgattggatgaggcccaccacattagggagggtaatctgctctactcagcctactgactcaaatgctcatttcatcccaaaacactctcatagatacacccagaatgtttgaccaaatatctgggcacccaatggtccagtcaagttgacacataaaatgaaccatcacaaggcttgtactttccaagtcaataatcctctttgttagggaatgaatagtggcattcaaaaagatatgtccaagtcctagccctggaacctgtaaatataatcttatttggaaaaaagatctttgcagatataattagttaaggatctcaggatgagatcatcctggatttagaatagaacttaaatccaatgacaggtatccctataagagaaaggcagaaggagatttgagaggggagaagattatgtgaagaaggcagagactggagttatgcaggctcaaagtgaagaacacctggggccatccaaagctggaagagtcaagaaataatttttcccttacagccttcagagggagtgcagccccactgataccttgatttcaggcttgtgaccttcacaactgtgacagaataaatttatgttgtgataatttgttatggcagcactatgaaactaatacactcttcttctgggcaggaagcagtaagcagacaattgaagacctaggtctctggtaggcttgttggctttctctgtattccaagaatccactttgcagattctaagataacttggagtagtcttgtttatttgttgtcattgggtttgggagttttatggaagagacttggtgcatggatcttcctacgtgaccttggcatgtctatgatgactttttcatgttccattcctgtttgatgaaatagaagtagaggctcacsttgttatgaatggtggaaggagacccartgtggctcatgtcaagaagagcttactccactcaagaattattttcctatttatacttctatatccaaatacagtaattggcttaagtaacagcttctgcctcagtaagaggtgtctgcaaagaaggatattagcatsttttaaagcttgtccatatttcataattcttacatttgactttgaggaaaaagattcataaaaccgctttgaattatgccastcaaaacaaattatcttgagatcaaaagtcttataagtataagttgataaataaattaattgagttttaaatatagttaatactgcatcccatgtgctagaccatttcgtaagagccttatgtacgtgatttgttttcaccttcacaacaacgacatgaggtagatatgaccgttagcttcattttatagatgagaaaattgaaactcagagaggttaataaacttatccaagggcacacascttgaaggagatagtcagggactcaaaatcatgtctgtctgactccaaagccacgctcctgctctctcactttactgaaaaatccataactggacttgaggtagtggatagtgtggtctagaatggcatttctcaaagtatattttttagaatgaaagtctttgttcttcttttggatttttttttttttttttttgagatgtagtcttactctgtcgcccaggctggagtgcagtggagcgatctcggctcactgcaagctccgcctcctgagttgatgccattctccggcctcagcctcctgagtagctgggactacaggtgcctgccaccacgcccagctaattttttgtatttttagtagagatggagtttcaccgtgttagacaggatggtctcggtctcctgaccttgtgatccaactgcctcggcctcccaaagttctgggattacaggcgtgagccacagtgccaggccattttttttttcttttttgagacaaagtttcaaaaaagtcttgcccaggctggagtgcagtggtacagtcacggtttattgcaaccttgacttcctgggctcaggtgtttctcccacctcagcctcctgagtagctgggactataggcacacacctccatgcctggctaatttttggtagagacggggtttcccccatgttgcccaggctggtctcgaactcctgggctcaagttatccacccacctctgcctcccaaagtgctgggattacagctgtgaggtgccatgcccagcctagtctttggttttactaaaaaaaaaaaaaaaaatttcatggttgaacaaattcagaaaacactaatgattacaatttaccaggacagtcaaagttttgagaagccttgtagtaaaaacaaacaaacaaacaaacaaacaaacaaacaaacaaacacacaaaaactggttcaatttttttcaggcctttttctgctgaacacttgaacacctatgaatatcctgaggaaccaatgttctgcagaacatactctggggaattccatcctagattaaagaatcctggtctgggagaggcaacagatttcaatggtcatttttaaaaatgatattgtcttgctcagtgagttattccacattcctggatgacagctttctcacccgtacagtaagaagattagctcctgaattatctaccatagctttaaaatgctgtggtctacatgtaaagcaaatgacaatttgtgaatgtattttttcctctgttattgatgttggctgaggggccttaggacagttaccttttggggtcagttacwttctgattgttcacagatatctaagagtaaaagtgtcgtacgtctgtcacctcttcaagctttgctctaaatacagtagtacactttgcctgtggtgcctattctgaaactgccctgtgtccccaagcctggtaatgtcaccgggctttctctgggtttacccatgctggactgctcttctccaaaccacacctctctgtgtagcctagatggagctccctgatttagaytctcgtccaagcagagtactttactctttcctccatgggctggagcctttccaaatgctttaagtatttgtccttagtcctagaatattctgcccattcctgtctgaataaacatatactactcatcctttgctgcccagcctaaatctcacctccttcatagacctttctttattccttcagcccgagctgatattaccttttccggactcttagtcaacagtcagtatttatcttacctgttagtttttcttcagctgcttcaggtcctaactcttgtgtttccaaatatatcataagccccctgagagcaagtactatggtttatatctcttacgtgttccctgcaaactctagtatggtgttcctcaaacaatatttgctcaataaacaccaggttgattaacccattgatgcttcctctgcccagcatcttgtttgggttgtgatccctagcagagtcgctcaggatgataagagatgtttcagctcacagctgtacactggccctatgaaattcggcaacaggaattgccccgcgttccctcctcaccctgaccaactmsttcctttatcggaactgtttttgatagttcagtacatccagaaagaaaaatcaggagaaattctctgagtttgttgttgtttatttattttattttattttattttttttttgagatggaatctcgctctgtcacccaggctggagtgcagtggcgcaatctcggctcactgcaaactctgtcgctcaggttcaagcaattctcataccgcagcctcccaagtagctgggattataggtgtgcgccactatgcctggctcatttttgtatttttactagagacagggtttcaccatgttggccaggctggtctcaaactcctgaccgcaagtgatccgcccaccttggcctcccaaagttctgggattacaggtgtgagccaccgcgcctggcctgagttttattaaggatggagaacttgcagatcctcggtcgtgggaaggaggttcgctgccaactcagtcttcaacatgactttctggacagattcttgttattattattgtcagtaactttttaaatgagctagaactgatgccgtttacatagggttggttggctataggtggggtctttctcttgctgtcattacctgttctctaacatttgttttcaatagagggacagctgggagggtagggtttatatttaatacctttatgggcttttcagtgcatgctctttgattgctttgattgctgtttaaatagactggaaagagtgcagaatgctttttattcattttgttttctgtaatgcttctcactgtcaaaaataagaaaaaataattggtggtacctaagtgctgcagttcctgtgaggaacctgagatggtcacggccgtgtggcggatgtgcgtatgagcctgggaagaccccaggcccggttgactacgtggaggcctttcagtggacaagtgtgactcagggcccagaaacagtgacgttaaaaatatgaaaatgtgttacaatagcaagttaatctaaaccgttttatcagcagcacccacaacagtgcctggtgtacagcaggcactaaataaatgctggtagcgaacgaaagagtgagtcatgcacaccagatctcacccagtggtggtggcgtgctggagggtgatgctgagatggattcggaggctccatccaagggcaataggcaggaatcctgtgctccctgagggctgcctgcgagaaaagggcagggcatcatggtggcacatgtagcattatagctgccctgatctgcgtcctttgctaaaggactccttcagttaatggggacagactgtgtgtaagagatcctgtggaaagttacgttttccatccacccctccgaccatccaatgaatatttattgagtattaccatacaccaggtactttgctgagggctggtgatatagtggtgctaataactgttccctggccccactggtgtggggaggattcagatgttgtatggctagttataaattgggaggcaaggctggccatggtggcttacacctgtaatcccagcactttgggaggcaaaggcaggaggatcacttgaggccaggagttcaagaccaacctggccaacaaagcaagacctcatctctactaaaactaaaaaaaatttaagaagttagctgggtatggtggcatgcacctgtggtcccagcaactcaggaggccgaggtgggaaaatcacttgagcccaggaggttgaggctgcagcgagctataatcatactactgcactccagcctgggtgacagagtgagatcttgtctcaaaaaaataaaaaataaaaagtaaaataaattaggaggcaccaacagaagaaaaagactggggtatgacaagagagccaaccagaggagaatcatttagatgaaagtgggggagaggaagagaagacgccatttaagctgaaatgtgagcactgggtaggagtctgtgggtgggaagatcaggtgagaaccttccagaagagggaaggacatgcccacaggccccaaggtaagaaaaccctggactgcgtgtggaaccaaggggagccagggtgggagcagctcagagagaggggcaggggctgaggctgccgagggaggcagcaggcatggcgcctaagaggccttgtcagccatgtaattttaaaagtttggttttaatcccaacttttataagtcagcaaacattcattcatgtgtagaggacctactracaacagaatcaaaaaccataaamaaatacagaactagacactagagaatgtgcattgtgtaagtgtatcactgtctgtctacactcagtgttgttgctgaggggaaacttacctgtggacacaggtggggtggaggggaatgggcagcccctgttctcgctgttcttggtgtgcacagagaaagtcttcctttggctccaggttgtagctgaccttggctgctcctggcgctgtttcccttttgatcgctgaaaggcttaatgctctcttgcatgcgtgaatgtgcagcaagcgagcagggacagatttcagcagcatggaacccctcaggtcctggctcagcgtgtgcctgtgtgcctctcgcaggcaccacctggcggggagagcagtgggtgaactccatggcatttttggcttctcttgctcctcccttcttcagctccagaatcttccatccttgcccagctggtgacttgcacccctttcctattgttcggcttctctgtgtgtctgagcctttagggtgagtagaaaggtataatgatcgtcttcagcccagccctacctctcaagatgagtgagataccataagtaataactatggaacttcgatgatccagcgactggaggaggagcagaggaaagcatcaataaataaaaagaggcggacgatgggtgttaatttckgtcaacacgtgtgctcccagctgcagcacacgttctgttcttaggtctggtctgcattcctcctgggtgacctttcctgcctgttgctgggagagacactcttaggcctctgcagatattagtgactcatgggtcattaagattatgttgtttttatcttatgctgttagaccttttccttgatcttcggggtcattggatctcccaatgtttgtgcaccttgggcatgttagtaaaactttctgtgcctcagtgttttttaatctgtaaaatggggacagtgccttgtatactgtccaatatatgcagcttcattccccgcaccccaggaaagcacatgattttaatataaaaaggaaacaaatcagccctcagaccacactgctgtgcccctctgcagaggagaggctgagggagacaagaaggaaaaaagaagtaagaaaagacagtaaaccccttagactgtaacagtgaggcccaagtgagcttttatgagaaccacatttgagccctggaataaaaaataacagcaacatattttaaaaattatttatgattttaagcacatgaaaggcgtatcatgtacccagggagggcataatggggaacagctggctaacatgtgtctcgccatttctgaggttgttcataattctctgatatccaagaatracagtaataatgatgccactgctgattgtattaataataataaagaggattggggtgtctttcctgaatcctgccgaagtaaagaggagagcctgggctgctgggtttggccagggtggaaaggggcactacagcctactttcttctcaggggcagtccatggagcccagccaaggatcaaaggatgttaggttgaagtaaagggctccagaaggggaaggcaggaagcctgggctcctggcatgattttaccactgactgtggccattcccagcccctctgagtctcagtgttctcatctataaggtagagatgctaatcctacctggcaggcacacctgacagagtttgtatggaccgtggatgraatgatgctcagggaagtgctgggtacactgcaaaacattccatacatggaagggtttgttatcatccttgtgtttctccagggcttaccacaatcaaccaccaagctcaggactggacatctaggaggtacccagagatgcttgtgccatgaatgaatgtttctttttcattaaatgttcagagccatggagtggtagccttggacaatactttttaaagtatttagtccagttctctcttttataatttgttaggtgagtctggagtagcgctcagtctaaggcagattatcctccattgccgagtcatctgagcacactacccagtgccctgtgaatcagggaattttcctgtacagctggtgggcataagtgctgttccctttcagacagttctctctccagtcttgggtactttcctcacactcatgggctaaatactcacaggggaccttctgtagctctctggggtgctctgtcctgtgaactctagttgtcttgctctccccagacttagagctcagtcttctcaactcagggagtttcttgggctccacctctctcccctcctctcccaaggcagcgagctggactcacagggctccccttgtctgtctcccatctctcagggatcactgcctttcattgcctgatgtccagtatcttgaaaatcattatttcatgtattttgtttgggtgttttggttgttttaggcaggagagtaaatgggtccctgttactccatcatggtaggaagtagagtttcccttgttttcccttcggagatgaagaagctgggagaagggtatgacttgctcaaagctgcacatctcattggtgtcagcaaagaggcagcctcctgtccccactgtgtgccagcacacaggcagggtccctgctctccgtaagtccatggtttgttgggcagacagacaaatcaactgagaatttgagacagatgcttaagtcaaggaaagcaaaccacaatgtattttatgaggcgggtattcatccacagggtaccaaggaagcatggaaggaagtgagagggcaaggaagggctcctgggagggttggcacatgagccttgcggtgaaggagaggcaggagtcatccaggcgggagaggagggaagaagtctcaggaacaggtaacacacacaacagctcggagacaggaagcaggtccctcgcctcaagaccagtgtgtatggtgtgtactacgggggagacctatgtgtgttttattgtggatatgaacctgctccatcccccgacagagtccctgaagtctggaaatttcttccaacacaagtctgctgtggtgtttcagcctggggatgtttgtgtagggtcttgttcagggctatgcagttgatgttaccatgaggtttctggtgggactctggccttccacactcttgaaggcagccaacaatattcctttcagtgatatggagcatcctccatcaagaaacagttgaaacttaccccagtcccactcctggtcccagtaaaaacagcgtgggagcccactccctttagcccgtttctctaggtgagccctagcagatctattgccaaggtgaggctcaggaactgcctggaggttctcagctgaacgtctgccagagccagaccctgaaacaattgatgggttagaaatctgcatcaacttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttctgaatgtgtttgctcttccttttctagttcttttaattgggatgttagggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcataaaacaatagggaacattttggacagtatcctgtcctcatgggattatggtttggtagggatggctggacattcatcaatcactcaaataagtataaaattacaactgtgataagtgttataaaaaaaggaattagggcttatgaaatacagtgaaggtgggacttgccattgtttggaagccaaaaaaggctttttcccaggaagtgacaataacacgagacctcagtgtgaacagagcttggtgagccagcgggtagggggtggtgaggtgggagccataggggcgagatgtgcccagctcagccagtgtctgggtgcagtcagcaggaactacacggaaaggtcaatatggagacttctacaggttccatgggatgtgttaagagttttggtctttttcctaagagcagtgggtgactgttgaaggctttttaatgaggaggcaagaagattagatttttgcttcagaaacctcacttgggctccagtgtagagactgaattggaggtgggcaagagtagaaatgtcagatagaacacaggatgcctagttaaatttcaatttcagataaacaatgcatactttgttagtatatgtcccaaataccacatgggatataattacatttaaaatttattgttttaactgtatttttaaaaagttttaagtaggttgcaaatattgcatgggacctaattatgctaaagattattcattgtttatctgaaattcacatttaatttgacatcttgtatttttatttgttcgatctggcaacccttagcaagagaaaatgtggagagactggttatagaccagttattgttgtaaactactaaaagatgtttaggttaggtagcagaggtggagacggagaggagtggacagaaaaggaatagcctggttggtccaaatctgccattgaaaggcatctggaggacagagtccatcagcttccctcccactctgaaactaattaccgcacacatgccatttaaagacacgtgggtatggtatggtgaactccatagtctcagtgcaggtcaggtgcctggtcagaacctgcactgaatggcctataagaggtgtgctgtgacagtgtgaggtggtcttctttctgtctccatccctccaggccagagacacctgagaggtgagttctgtgcattgcagtgactaatgtgtgtgaaggagaggtttggtagaaaggtcaagaccttacgacaatagaggcaatattgtaagttgtacactgcttttcccatgacaactcacattttacaaatcaaacagtggagtaaagcagtcaagaacacgggctttgccaggggttttaaaccccatcggttattagcttgtctacactatctgtgtgatcttggctgagatacttaactctcttggctttgcaacatattttaagattagcactaaagtacattgaaagccaggcccacaggagatgcttagtaaatcgtatatgctactagaatcaacagtctccttgtttcggaaggcaggcttactcttcgtcttcttacacaactcacttgattatcttcttaattcacagctctggttttgtcactgttcacactgttcagtgtcttccactkccttgtgtagcagatctccatgcactcatctcagtttgccccaactgagtttcatggagatctgctgcacaaggcaacagaagattgttgcacatgaagattgtcactattgcccgtcagaacccctttgtccaagcaaaccagcccgtgtaaacctccttaaacatagcttgaactttccacttttttgtttgcctagaatatcttttcctgtatctgtttaagccttattaatcaaaagtatttataagtgaatgttaacagaaatatgaaccaaaacaagatataaaacttatatataaaatgagataaatgcctgtcactggggaaatggctaaacaaattagtattcatgtctactgtgtaatactacgcatccattacagtagctgtatggaaactgtcctggaaagatatctatgatatgatgctaaatgaaaaaaaagcaaattatagaggaatatgtgaagtagggtcacagttgcttaggaaggaacctagttctatctatatggaaagagtagggattaaatatattccaaacggttaagtgaggttccttttggagaggagggtgggaattgagttggaagtcaaaggaaactcctaacgtttagttaatatactttaatgttttaagcttgttcgtttacctgaactgtgttaattttgtaattgaaattaaatcaaaatgcatagaaaaaggtttagaagaactaaataaactgtggttatgtttcagttgttagactggggaggctcttgccctgtccttacttatcattattttattaaagaacaaaatggtaatggaagaagattacccttctgccaaatccaactgaaatgctactccctcaacgaatatgtttctaattcctcaactgaatgtgctgcctcctttctttgaaccctcaaagtactttatatatcttttgtggcattttctcatcctatcttagtgagtatttcaggtgcccaagtatgaagacaagtatttcataccagtcttactgcccctctgcattgaagtaacgtgaagctatcatggtagagaaggaaataggattttgagtcagagcgtctggatgttgcctcttattctggatgtctattgcagcctgacagattagcccacacttagtagcctaaagcaacagtcatttcattttatctcatgattttttgttcaggaacttgggcagagctgggctgggtgattattctgcttcatgtggtrttgactggggtcacttggtggtagccagcttggaggtgggatggacgggagggttcaggaaggctttagttgtatgcctgctgcttggcagggcagctggaagactgggctcagctgagtgcctttcccttactgggtactctcaggacgcctccgtagacttcttatggtgtgattcagggcttcaagggataaggcggaccaaggctgaggctgcctgtcttctaaagcagtggtccccaacctttttggcaccagggactggtttcacgggaagacaatatttccatggaccaagggtaggggtggtggtggcagggatggtttcaggatgaaactgttccacttcagatcatcggcattagattctcataaataacacgcaacctagatccctcacatgtgcagttcacaatagggttcacgctcctatgagaatctaatgccatcactgatctgacaagaggcagagctcaggcggtaatgcttgctcacccaccacgcacctcctgttgtgtggtccagttcctaacaggccatggaccagtaccggtcagtttgtggccccggggattggggacccctgttctaaaggatggaactggcatagtatcactcctgctatactccactggttaaacatccacagatccaatgcagattcaaggggggtgggaacagagatgctacctcttaaaagaatatgtgtgaaaaatctgtggccatcatcaatttatcacagctttgctatgagaaatacaacttctgtgcctcaatgactccatttgcaggttataaagatccaaagctataatgtgtgcaaagcatgctatgcattataaaaaaaacagtatgcactataaatattaacaattaccttggtactaaatctatgccttactcaaggcaggtactcattaaatgtttaatactttgaaagcaaactcatttaaacacasatatttcctaagaaaaacataaagaacgggatgctggatgatcacatagaagcgtggcgcagttttagagtatagactttggattaggttgacatgagttaaatccaagctctgtcacccagttcctatctatgtggcctttgttaattcgcctcacctctctgagccttaattgcctcatcatatggaaatagtattacctacccagcagggttgctgtaagcattggagttaatttgtgtcaagcacctactagggtcacattgtaggtgtgcagtttttctaagatgatatcgagtcatatagaaagtttgtactcctcacttatttctctacactgctcacctccatgagctcaaaggattgagaggagtcaggagtccaggtccttgtgagagcactggggaaaagggaaaggccctccttcttgtttctcccagtctcttcctctctccaatgttcacctctgggaatctgtgtccatgcagcttttttttgtgaagccattcctctctgctggaagtggcccccttttcagacctgtggctcttcctttcatagatgtacgagatcaaagcaggaggcagcattgcaaagaagttcagcgcggctctgcagaagctgagctcgcacctgcagccccgagttccagaacacagcaacaacaagatgaaaaacctctcctacccattctccagggagaagatgtacctgtgagtattgaagctgctggagcagagatgtgggaagggataggaaggaaaattgaatactgttctatgactcagccctggggctcccaaagtgggtgccccagtgcctgggagagagagtaggaagcatgctctcatggtgacattgtccctgtgcctgctttgtgaaccccctccccatgtgagattgtcccaaacagccaagggtgcttgtccagcaggaaatccaccatttcaccattttgcaggatggagggcaaaccagggagcagccaacaataaactttggaactctgtgagaaagtggtcagacacctgtgtatcttctgtaggaaaaccttctgcccaattgccagtctaatagggtttcaacaggatatgataaaccagaaagaaggtggatgaagcttctgggtttctggattccagctgcctacttgtacactcattgactctcaggggtctttccctgtccctgcaccctgcctaggaagagtgaataaaagctcttcacagagatagccacttggaaacgtttggaagggggagccacagctgggaagtgggagatgcagccgccaagcatcaactttgctctaggagctaaggagaaaataaacaaccatcgagggtgatgagaaaatggagcaagagagggaaaggccggggcatggaagggcagagaggacagaaagaaggaccttctcattttaggaggtggaagttgtggagcagtgtttctgctgtccataagagaccatctcctatccatctctgctgtgtttgatattatcctacacacatgaatatgctgtttcatttgcatatatttaccctctcattgagtcctcatgtccccttgcgaggtggcgggccagatctaactatcttctattatagataccaaagtctaggtccatccagggtcataccgccctaagtggctgagctgggccttgcatggtgactggtggcttgctgctctttctgtgtcctgtggtgcttccctgcatccccttccctgggccttcatttatgctggtgctggcatctgaatggtcacttcacatgcacctccgttcgttttacttctgttgtccttcaagactggttcatcaacaccttccttttgaaggatattctgctcttcccaaccagaagcacgcgcttcaccctctgaactttcatagcaatggtctgcatgttactatgttctactctgtgtcagttacttggagaaatgtaccttccagtgactggggctcctggggtgctgggagcgtatttccttccttcatcagtgcatcctctagcacagcttcctcagcatgacaaacatgccccatgtgctattttctgagtgaaagctcagtatatgaagttaaaaacagacccagcccttgcataattaagatttttctaatggatgagatgacagtgacattaaatcaaattttgaagaatcagagtgataatccaacaccctgaaatgataccctttttgttttgtatttttcactgtctttgttcatgcaccagtatcttttctacatactttccatttggaaccttatcatcatataatatttttctaacatggtgtaatctttttctttacacaaagttttcataattataaatttcaatgactgcatgataccctatcctatagatttgggcattgcatcttattgctataatctttgttataaataccttttcaataagcatttttatttatgttatttttctttccttgtgttgagtttcttccctaagataaatttctagaatacgtttttagaattactgagtcaagaagggcataaacatcgtgtgtgtgtgcacctcataagtcttgctatgttgctttctaaagatttgttgtgggtctggggtggcagtggtctcagggcaagggtaatgaaatgaatttgccatctgctctcttggtgtctccaggtacaacatccaggaaaaggacaccttctttgataatgccacccgcagccgcattgtaagtaaatggatgtactgtgttaggaaagaggatggggaaagggctgagttcctagttggcagggcattctcttaccctccctgccacctcacaccgttatttgcttggagttgcctagcaacagagaagagtatgcaagagcttccccattccccaaaagaaacagcaaataactgccctcactcgtggtttaagaggagcgtcttctctttatgggttctccattaaagttcttcttagaaaaaaaagaaaaacagagaaggtcatagttggtgcgggtgttagttaggtgaaccccttgatttacaattgaggaaactgaggctctgagaagcaatgcattgaaaaaaaattatatagatcgttagcgtcagaacaaggatcgttagcgttagaactagtccttctgattgttgggccactgtgtttgtttatgcattttcccttctttcaactcccatgacagagtcatgtgaatttctataacaaggaatgctagttagccaatttgcgcaagaataatatcaccagcccattcaatagaaagccarcgcttgtgaccgtagctcttcttctacagtcgttttgccttcatgtcaagtgtttgaattttgtaggatgattggttctaataaaaatctgcatatggcctgtgtttctgtggcctctgcatgagctgtagaacatcttcattcaccgatcagtttattctctatcaccctagaggtcacatagcctatgggcagaagagagaaagaggggcccaaggaatgccagaaacttacacatgcccacatgggacgtatggaagtgcatttccattgatccttaccaaagaactgaagtttccacaggaggaatgaggattagatacctagaaggatctcccagctaatagggtggtaagaaaatatatgaataagaagggacaggtgattagaggaggctaggctatttcccaggcacactgcaaacatggcgttaactcttacttgcaggatgggcaaggacatctcagatcccttagcctagtgttttaggcagagttaaaatgggcatagatctctttttttttccaatggaaaaaggcattaacgtcccattttcttggttgatgctattacaaaccaattaaatctcactgtggcttgagtcccacgactgtgggggagttataaggtgttgtggagattactcgataattgcaaagtactcgtaaaataatacaatgccatataagtgctgttcctaattattattgctgttgaattactgcactatattaggagcagaattaaacactcttgggccccgtagttatttatttaccactccctttaggctgtggctggaatatgggaatgtaaataatgatggaataacacttcttctagcattcatctctccttctggaagcatcttcctttcctcagtccaccccacattgagaacaggggaaaagagccttgagttttttcctggggtctattctgccctggactttggttggaggacctcacccacatctgtggatgtctcctctgtgcctscttctttgtgggtgtctgagcacctcagctgtttgttgcaaagcagacttcattgctgggcatctctttatagactggcataggctgggractcaggaggtcactcgttggccagcaggtttacactgacccacctttgtccctccctgattcttttgtgggaagcacccctttcctcccatgtaagaaacacagtcccctgcaggccccataggccaggggattctgtaggctgttttgggcatgtagggcttcaggcaggcaaagccactgagtcggcagctgctgtgtgcctaggactgtgctctaagacatgaatcttcaaggaagtgtatgatatgctctgatcagggaggcaagatgaggacccaggaaaaaaccagagaaataaagacatcaatgaccaacatagaggtagctcctttgctgttgcagagcactttcctgtgcacggtctggctggcgtccccgagcaggtgggcgagatggccccattacagatgcaagctgaccctcttggcgtttgctcaggaccctctgcacctacctccacgttcggagctttctgctaccacactggctctccctgtcagccgggctccaggctgggggagggggcccgcccctccccgggacccgccagacagaaccccgccttccctgcgattccccgacgtgggcggcagacactgtkccctactccacagacccagggcttcctcccagccctcccgaggctatgtggtctggggtgggctcctctgttttccttacttcctgtgactgccgtccatttctagccttttattcatttgtttttctcagggtggggcgaaggggcgggggatgtgtgcgcgggccttacatcccttgtttcctcaaagtcctcaagtctgagtggggttgatgtgcgggccatgagccaggcacatgcttggcttcgtcctggctccaaatgagcccgggcgcctcccgcccctgccaggcagtggtgagggtgacacacggtggagggcgggggggaactaggagctcacagctctgctgtcgtccccttttaggtgcacgagatcctgaagcgcacagcctgctcccgagccaacaacacgatgggtaaggaccccagcccgcgggcagrgtgctgacgggcgctgaggcggctcccgccccgtgctttcaacagctcccttggtcggcagcaaagaacaaaacaagcaaatgccccccacggagaggctgcttagcttgggctgagaagcctgccttggccccaggagcagcgggggtcccatttctcagtggggctgcccccaggctgttgtaacttctcccaggccctcctcccaggtctccgggctttctctttctcttttccctgtaccgcccacacctgccactttatccggataattctgcggctcctctgtttttcaccatttccaatagtttctaataacccaagaaaagcgtcttagaggtcctttagtccagccttctcatattatgtaagaagagatgaacctccagagaggggtcatgactgtcctaagcccacacagcacgtgatagctgagtctgagtgagcctcttctaacttcagcattcttctcaccatatccggctgaatctgtttgccctgtggtttgtttcttaaatattagggtaattgtcttggaagcatttgggaccaagtataaggcaggcagtataaggcaggcagtccagatcctgatggattgtgtggaagacatctgtgatggcccaggtacaatgtgagctgtgyccataaccccatgagactgctttttcgaaaaatgtgccaaaaagtcacgcacaaacaccttttgcacaggagtcattcttgcatgttgaacccttgttcccaaggtgctgccatctccaagtggcatctgacagctttgggagagctgccttcagaatgcgctctgggatggcaaatctttggcttttgaggcagctttaggttgaaaagagttcagagtcatttggagtcctgtctactgaatagaggaggtgatcaggctcaggaataacaatgataatgatgatgttagctagctaatatttgagagtgtgttgtggggcttgtaagctgcctgggtacccagggcacagtgctggagaaggaatcagaatgggttttatgccatgatagtctttttagaatagtgcttaacctctcaacagggcaattatgtttgcttgaatttgctttgctatattcatcttgctacaagattccaaataacaatgcactttttaaaaatcagaccttccatgttatgttatttgtctggaacacggtgctgatgaggcgaggctgagtaagtgggtgagagaattagcttaaaaaacagagaaattttatatatacatatcaaggatatatatatatatatatgagtttattaagcattagcccaccgactcaaatgttaatctcctttggcaacaccctctcagacacacccaggatcaatagtttgcatctttcagtccaatcaagtcgacactcagtattaaccatcacgaatccacccattgtcaacttgaacccatacacatctcctgagatcatacataatcttcaaataaaagcaataataaggtcataattacacctaacgtaatacaactatccttcgtacaaccggaaatgcactcatccccaatccaaatactattacataaagttaacaatacctaaatgctgatatgaggtcaataaatcttatgtcacttgataaaggaaaaaggaaataaaatgaagatatttcttagtgcaagtgtatacatgcacaaacatgtttttaacaaaagaaggaaatactcatgacaattggcagtcctcgtttctgcagctggtcatgtggtcgtagctggtgttgatgactaccttcttcactaaacattctgtattccctttgccttcaggaagcacctcagcaggtcgtggttttcttcctggtggagtgacccaaaccattcctgaggggtctgggccatttgtattcctgcctggattgggctgttgtggtttcccattgaccttaatcacagggcatgataatactaagagatgccctaacgaatctcctgtattgcatgtacactcttccttacctctgttgtggagtagtagactgatttcatcttgatggtctgggtcaatcaccccagccaacactgtaattccctccttagcctgttgacttaaaggtaggaggagcccaaagtgtccaggtggcaatcttaacttccagtttaatggaattgttgttgtgtctcctggtggcagcattcctccctctgaaactaagatctctaggccagcagaacgtaatgctgtgggaacaggaagcaaaaattttgctagtggatcactaggggcgatggtgagtggtgccacttccacttcagtgccttgattcttggacccgtgaatcctggctatgggagaaacagtaccatatattggatggtgattcagagcatacatggccttctggggaactttgtcccagcccagcaaagtattgtcacctagttggtgttgcaattgtgacttcaaaaggccattccaccattctgtcaatccagctgcttcaggatgatggggaacatggtaagaccagtgaattccatgagcatgagtccactgccacacttctttagctgtaaagtgagtgccttggtcagatgcaatgctgtatggaataccatgatagtggataagacattctatgagtccacggatggtagttgatatggtttggctgtgtccccctgccaaaactcaacttgaattgtatctcccagaatttccacatgttgtggcaggtacccagggggaggtaattcaatcatgggggctgttctttcccatgctattcttgtgatagtgaataagtctcacgagatctgatgggtttatcaggggtttccacttttgcttcttcctcattctctcttgctgccaccatgtaagaagtgcctttcccctcccaccatgattctgaggcctcccagccatgtgtaactgtaagtcctttttcttcccagtctcgggtatgtctctatcagcagcatgaaaatggactattacagtaaattggtaccaatagagtggggcattgctgaaaagataccccaaaaatgtggaagcaacattggaactgggtaacaggtggaggttggaacagtttggagggctcagaagaaggaaaatgtgggaaagtttggaacttcctagagacttgttgaatggctttgctcaaaatgctgatagcaatatggacaataaggtccaggctgaggtggtctcagatggaggggaggaacttgttgggaactggtgtgaaggtgactcttgttatgttttagcaaagagactggtagcattttgcccctgccctagatatcagtagaactatgaacttgacaaagatggtttagggtatctggcagaagaaatttctaagcagcaaagcattcaagaggcgacttgggtgctgttaaaagcattcagttttataagggaagcagaacataaaagtttggaaaatttgcagcctgactatatgatagaaaagaaaaacccatttttctggggagaaattcaagctggctgcagaaatttgcrtaagtagcaaggagcctaatgttaatccccaagaccatggggaaaatgtctccaggccatgtcagggaccttcacagcagcttctcccatcacagacccagaggcccaggaggaaaaaatggtttcatgggctgggcccagggtccctgtgttgtgtgcagcctagggacttgctgccctgtgttccagccgctccagctgtggctgaaaggggccaacatacagctcaggctgtggcttcagaggacggaagccccaagccttggcagcttccatgtagtgttgagcctgcaggtgcacagaagtcaagaattgaggtttgggaacctctgcctagatttcagaagatgtatggaaacgcctggatgtgcaggcgaaagtttgctgcaggggtggggccctcatggagaacctctgctagggcagtgtgcaggggaaatgtggggttgaagcttccacacagagtccctactggggcactrcctagtggagctatgagaagagggccaccctcctccagaacccagaatagtagatccactgacagcttgcgctgtgtgcctggaaaagctgcagacactcagtgccagtccatgaaagcagccaggagggaggctgtaccctgcaaagccacaggggtgcagctgcccaagaccatgggaaccaacatcttgcatcagcrtgacccagagtcaaaggagatcattttggagctttaaaattttactgccctgcttgatttcagatgtgcattggccctgtaacccctttgttttggtcaatttctcccatgtggaatggctgtatttaccaaatacctgtacccccattttatcttcggaagtaactagcatgcttttgattttacaggctcataggcagaagggacttgccttatctcagatgagactttggactgtggacttttgggttaattctgaaatgagttaagactttggagggaaggcatgattgtggacttttgggttaattctgaaatgagttaagactctgttgggaaggcatgattggttttgaaatgtgaggacatgagatttggaagagccagaggtggaatgatatggtttggctgtgtccccctgcaaatctcaacttgaattgtatctcccagaattcccatgtgttgtgggagggacacagggtgggtaattgaatcatggggcctgttctttcccatgctattctcatgatagtgaataagtctcatgagatctgatgggtttatcaggggtttctgcttttgcttcttcctctttctctcttgccctcttgccactgccatgtaagaagtgcctccctccatgattcttgggcctccccaaccatgtggaactgtaagtctaattaaacctctttttcttcccagtctgaggtatatctttatcagcagtgtgaaaatggactaatacagtagtcttggcagaagcattgcgtacaggataggaaaacccataccctgagtaagtgtctgttctagtgaggacaaacctctgccctttccatgatggaagaggtccaaaataatcaacctgccatcatgtagctggttgatcacccccaggaatggtgccatatttagggctcagtgttggtctctgctgctggcaaattgggaagtcagcagtggctgtagccaggtcagccttggtgagtggaagtccatgttgctaagcccatgtgtaacctccatccctgccaccatggccactttgttcatgggcccattgagcaatgacaggggtggctggggaaagaggttgagtagtgtccacagaataggtcatcctgtccactccactgctgaggtcacccgctggtgaacactcacatgggatacaaatatcttcacagtytttgaccactcagagaggtccatctacatacctcttccccagatttstttgtcaccaattttccaatcatgcttcttccaagtccctgaccatccaaccaaaccattggctacagcccgtgaatcagtatataattgcayatctggccatttctccttgcttgcaaagtgcacaaccaggtgcactactcgaagtgcccactgggaagatttcccttcactgctgtccttagggatgtcctagaaaggggctgtagtgctgctgcagctgtccacttttgggtggtgcctgcgtattgtgcagacccatctgtgaaccaggcctgagtcttctcttcctctgtcaactgatcatagggagctccccacgagaccattggtgtagactggggaagagacggcagggtggcaggaatgaagaccatgagcatttgagccactttctcatgtaacttacttgtgctttcaggacctgcttgagcccartcacatatataccacttacgtttgatgatggaatgctgctgttcatgacccactttatggttagatgggtcagaaggcacccagttcattataggcagttcaggtgccatggtgactttatgacccatagtcaaacgttcagtttccatcaaagtcctgtaacaggccaagagctgtctctcaaaaggagagcagttatctgcagaagatggcagggccttgctccaatatcctagaggcctgcgctgtgattcacttgccagaggctccaaacagcatccctatctgtgactgacacctcaagcaccattggatctgctgggtcatgtgacccaagtgacagaacagcttgcacagcagcctggacctgttgcagagccttctcctattctggatcccactcaaaactggcagcctttcatatcacttgataaacgggccggagtaacacatccaaatgagaaatgtgttgcctccaaaatccaaataggcccactatgtgttgtgcctctttcttggttgtaaaaggggctaaatgcagcagctgatccttcaccttagaaggaatatcttgacaggccccacaccactggacccctagaaattttactgaggtagaagttccctgaattttagtcagatttttttcccatcccctggcatgcaaatgtctcacccataagtctggtgtgtttgctacttcttgctcactggatccagtcagcataatgtcatcaatgtaatggaccagtgtgatatcttgtggaagcgaaaaacgatcaaggtctctccaaataagattatgacacaaagctggagagttgatataaccctgagggaggacagtaaaagtrtattaatggccttgccagctgaagggaaattgcttctggtgggcctaatggacaggaatggaggaaaaggcatttgccaagtcagtggctgcataccaggtaccaggagatgtgttaatttgctcaagcaatgaaaccacatctggtacagaagctgcaattgaagttaccacttggttaagcttacagtaatcccctgttattctccaagatccatctgtcttctgcacagkccaaatgggagagttgaagagggatgtggtgggaatcaccacccctgtgtctttcagtccttgatggtggcactaatctctgcacaccctccagggatgcgatattgtttctgatttactatttttctaggtagagccagctctaatggcttccatttgwcctttcccaccatagtagctctcacyctaccagtcagggagccgatgtgggggttctgccagctgctaagtatgtctatgctaattatgcattctggcactggggaaatgaccacaggattagtctggggaccctctggacccactgtaagtcagacctgacctgaaactccattaattatctgacctccataagtccttactttaacttgaggatcacaatgacgttttgggtcccctggaatcaacgtcatctcagagccaatgaccagtagtccccaaaaatctgatcatatccctttccccaatgcacagttaccccawtgcacagttaccctgataaaaggctggaggtctccttggggaaggatgggagaaagattaacagcataaattgtcagtagtrtagtggggtccttcctcaaggggacccaacctccccttcaatcaaggggttctgggtctgtaaactggctcaagtccggaaattgattgatgggccatgattctctgtttttataattcaaattagtcttttgtccatttgacctagaagttttctgcttatataaattaagtaggaatgcagtaggcttcctataaatttcacttctaggaacactgtgattaataagccaatgccagagctctacataagtcagattattctgattgctgctttgcctctgctgtccattacagtaggtacacccaccttgcctttgatggttgagttggcccctgccacttcaggatccarttattcccattgtatttaaattttatagttgagtgactgtggttcccactgttagatctgacatacagagaagagtgattayagggcccttcaaagatgcaggtgctgccctcacaaatctgttttacaaggcattggtcaagggtatatcttctggacttcccaactaggatgagtaggtctaaagtgactaatccactccaccatcccaatctccctaaccctttggatctcttcctctacgttaaaccaagggagatcaggcattttcagctyrccacagtgggccatgttttaatccatatttcagctaaccaagcaaataaactattagaaccccttttaactccccaggctgcaacattaaatgcagagtccctacttaatgagcccaaatcaataaatttagcctgatccaactctatgttccttccaccattatcccatatccttaatatccattcccatgcctgttatccagatttctgtttatataaattagaaaactcaagcagttcttttctaatgtagtgcaccttctcgtgggtcatactgtcaacctcacatctaagggcccactggggcttcagtctatttataggtctagaagcaaacaggggtgttgggggtggctcctgaggagaatcaacattattttgcctggcaactgcctcaggggaggccatcactgttgcatctcattcttttgcaatcaatgccctgactttaacagtagatacctggagaggctgtgaatgcacctttcactgcaggtcagccactcgcatgataagagcttgtgtctgtttttccacaatttcagctctttgtcttcaggrgataagactgtcactcagggccatcttagcagatttgatgctcagaatctgcttttgaagttgggagttagaatccctgagttcatcattttctttcatcactttgtccactgaacttaggagcaaccaaccgcttcattatgttccttggttccctgcatatggtcaaaggtattatgtacagagtcactaatctccttgcctgtcatgagcagtgaatcaggagtgtcaaatgcatttattttgcataactctctaaacagttcatgccaaggactatcagtgttctccataytattagaagtagagtccttagcatttcggggtctaatcatattaagcagccaactccagaaaccccaaaaccaatgaaagaactccatccttaatattctgttcctctagaaccactcctggtagaaaatctgtattagtgttctctagagggacagaactaataggatatatatatatatcctattacatatccatatatatatatatatatatatatatatatatatatatatatatataatatgagtttattaagtattaactcacatgatcacaagctcccatgagctgaggagcaaggaaacccagtctgagtcccaaaactgaagaacttggagtccgatgtttgagggcaggaagggtccagcgcaggagaaagatgtaggccagtatagtcttttcatgtttttctgtctgctttatattgtagctgcactggcagctgattagatggtgcccaccagattaaacggtgggtctgcctttcccagcccactgactcaaatgttaatctcctttggcaacaccctcacagacacacccaggattaatactttgcatcctgcgatccaatcaagttgacactcagtattaaccatcacacctcccatagttcatgtttttttcttctcagtcttcatcttccacaacttcctgcatccttccaagccttctttactgcacctccatcttctgatagttgttggaaggtgctgttgacctactcaactgctctccttctgtttctgcctcatgggccacattttccttgatttctcttccttcttccacattttagatgttgtcagcttccaagttcctttggcttttgcactctctattttctctatatagatgacttgcagccatctatttttgctcctgtttctctcaccaattgcagccctgcatttccagttgctggatggataccaccacttagatgttcaccagaacctcaaaatagcatatccacttctctcctctctctctcctgctcctcttcctgttaatatgaccacttttttctctgtctttgctcatgctgtttccttttcctgaatgtcctgcctgtgtttttccccaatctcagtgatgcctatccccacatcaaacatcgctgtcctccagatttttccttaaagccctttccttggagctcttatcaaaccgaatctctttcttgcttgttttctacacccgtggcttagactcctaaggcagtgagtccttgagatatttctgagtcatcttctatgccccagtgcacctcactgcgtgtctcacacattctactcagttgatttgattgaatggattaatttaaaaatgcccagcctgctagtcccacagcagtttctggtcagtttctgactatgtgtgttcatggacaaataacctctctgcatctcagcttacttttatgtaaaatggggataataatatctatcttgcagagtttttgtaaagatgaaataagcggctgttagcttgttttgtaaactggaaagtcctaaaaacaaaagtttattttgggggacaatccccaggttgttggaaggccactagagactagacgccctctgctttaacattgaggttttttattgtgtgtgtgagaatctgagggttttttggtgatgtctcaaagtcaaatgtcaggattttgttgttgtttttgagttgtatttataattttgtctttcctttttgacattcaaaaaacatttaatgagcacctgctatgtgtcaaatgatgttagagaaacggagggatgccaagctgagtttagcataatttctacccttgaggggctcttagtttagccatgcagacagacgtggaaacagattgtgatgaggcaatgtggtaggtgctataatagagatacatacagagtgcagttgggacacaggggaggaggcaattaatgtccatgtgtatgtctctatatgtctaagtatcaatgtaaatcattgctcccaggaaacttacgtatgtcaggagtgatcatctccaattacagatgggcacaaagaggatacgtgacttgcccagggttacatcttgagtcagaaatgagtctagaacttgggtactcttgctctaatcgtatttccaatacctttgggatgctacagagtaggagtggaattaggctgagtctttagagtctgttaacttcacagtagccactgaggacttactagctttgtaacaagagacatgtgactgaactctacttctcagcagaggagaacccaaaggccagatttccagtgggttgacttctgcccatgaagaccaagtgccctctaagctctttggtgaacttaccaatcttatttagaagataaaaaaaaaaatgaggaatgtgataactccatgaggccccaagataatatggaggcctgagccacagggtaaatttagattttattgcctttctttctggcttataaggggtggaagagaagcatgagtgactagaatcggcttatattcctccagaaggttgtttcctcattaaaaaaaaaaragagagagagagaaagggagaacaggactggatttggaatcgtaggtgttttcattgatccttcaccctcagattatcttttgtatggtcatttcttttgcaaccaacttacaaagctaattctctttcccattgtacccaatttaaatattagaaaatagaaaagatactaaagatagtaataacttggaaacactcctgtttatctagtaatgtctcttttttctttgtagacaatacgtttttattgaatgcctacttttacaaagctttaacctatatacaagtagtatgtagtgatatatttatattcctgccttgttccacaaaatttctggggtagcttacaagaaaaacaataagacagcatagtataaaaataaattgaaaaataagaaccagagaaaataaattaaaatagaatgtcaaaactaggaggaagaaaatagaacacatatgcaaaccataatgtcttctagtttctacagttgaactgcaaatttaaccttgaaccaaagtgaaagggggaatatggtcaggggtgtagctcttgctgcctacagcaatatctttctgtacagaaatctttctaaagtctatcacacaatttcctgcttgcttatrtagaacatgtctacatatattctccacataaaggcgtcttatgtagaacatgtctacwtatattctccacataaaggcgtatgacaaattttctggattattcaagatcatcattaagaacataatgattttcatgttctctcaagaattatcaaagcattattaggattgtttgccccacactgctctgatttcttgaattcttgactctggtaacctccctccccgagttttgctatctcagtttyrctttgcagtgtgggagatggaaaaacaagctcattagaattttgggtaaagagagtgtaaaatgcatggcaggaggtctgaaggattctgctgtggaaaagggacatcgcattagaaagtaggttttgtgagatctattttagctgctcatktatttttttcttgtttctgggttttctgttgtgagagctgagataaccagataagaggcctctgataaatgaggtgttactgtcaccaaagtaataaggactccttgcatgcttgcagttgtatgtttttcaaaacaccttaacgctcattatctcatttgatcctttaaactgccagcaaagtagcttcagcagatgttaattaacttcacaacagagagattaactggcatacacacagctagaactttggaaatgggtttagaacttaggtttcttgactctttgtcattgctttttaactaatttaattaggaaatggataaagttattggaaaaagtttcccagaagaggtggaagctgagcccttcccagtataacatccattcactcattcaacacgtatttactgagcacttactatgtgacattcatgttgtggacctggggaatggagtagtgaatccaacagacacaaattcctgcccttaaggggcttactttctagttacggaagacagaaaataaaccaagaagtaaatacaatggataggatgtcgtgtagggataagggtcaggagaaagaatagagcaaataaaggagatgaaaatgaagtgggagtgggaaggtattttaaatagagtagtcggagaaggtsttcctgatgtaatatttgaggaaaacagggagcaagccacatggctgtgagaagacagatacatgcaaggaaagcaaataacacagaagacatggtggtggcaattccagataaccagttagggtcccaataggaacaaatagcacaccccaattagggtaattcaaggtgggcatatgtatagagaaaccatttacaaagggattggcagggagttggggaatgccagggacggcgttgtaacctggaattaacaatagtagagytcttatcatccctagacctgcagaaagatagagaggtcactgcaacgtggaattgggtagaggaggtgaccttgagcaggtgactatttaggcagaaggccaggggtctcaatactgctgatggcagtaggaagccagagagcacagcagcctgttcatgtcagatagaggaccgtagagagtatatctggaaggggaagatggaagataggcacacagctggcaaggctggagaagtgggtgccagttccagctctgggatgaacaagttgtaaaacttcggtcaagccatgttccctgtctgggccagtttctcccctcataaaacaaatggggcctctcagtgctctctaagcttctttctgactctaacatttcccagactctgtgattcaaaggagccacatgatctgtacatatgagccaacgaggcccagggaggggactggctttcctgaaagttcacagagakcaggtaccaggggtgtggccaggacttggggttgcgtgatgtccgcaggcctcagagaggttgagaggagacaattgtagtgaaagggaagatggagaataaggagcatccagagcagttggtgaggatggttggaagaagtttgtactcctatagcaattctttgcatgtgattatgggcgacggtggtcaggtgtggttgcatgyaattggcatcagaatcacctggtgtgcttgctaaaaccctggctgtccaggtcccatgccacatttgctgaatcagaatctgcaggggcaaggtccgaagatctgcatatttaataatctacccagtgattcttasgaactctagagtgaacaaaagaaaaagataaaaataaagatagggtgcactgttgtagtcttcatgacctacttacacttgggaatatgaagtgtattgcaaagtactctgcctcctgcctcctggggatttgaccactggggttctgaccccccaaagataaccaagtctatctgtgaagggcctagtttttatttttctaatattgtatgaacatttggcattcagtcccttttaatgccctagccaccagctaggtctctggaacttcttttcctttccttccttcctctcttccttttttccttcctctttcgtcttccttccttcctctttctttctttgtttcttctctttctttttttctttctctctctttctttcttgcttgtttgcttacccttccttccttcctccctccctctcttccttctttccttccttccttcctctctttctctctctttctttttcttgcttgcttgtttgcttctccttccttccttctttccttctccttccttccttctgtccttctccttccttccttctttccttcctcccttccttccttccttttttcctttctttctttctttttctttctttcacttgcctgccttccctccctcccctcctcccttccctcttgcctccctccctcccttccttcttcttcttttctttctctttctttctttctcttgcctgccttccctccctctcttcctcccttcctccttcccttccttccttcctctttccttccaccttccttcctttttcttcttcctctttctttctctttctttttttctttttctttctttctttcttcgcttgcctgcctgccctccctccctcccttcctccttccctccctccctttcttccttccttccttccttcctcccccttccttcctttcttcctttcttcctttctctctttcttttgcttgcctgcctgccctccctccctccttccttccttcccttctttctttctttctttttctttctctctccttcctccttccttcctccctccttccctccctccctcccttccttccttcctcttctttctttcccctgccctgtgtttccctcccttctccttccctcctttcccctctcttccccttccccttcccccttcccttccctttccttcccttttcttccctcccttccccttctctttcctgctctgccctgcctcccctccactcccctgccctgccctgcactattttccctgcccttccctggcctcgcctcccctcccctcccatcccttcctctcccctcttctcccctcccctcccttacccttcccttccctttctctcttttggggggtggtgtttaaaattagtataaaatggcaaagcaggaggagttgaccttgaaaaagtatggttggactaatgatcaaactttttagaattctttcataacctcaagagaaacaactcaacctttccctcttattttctctcttatttacccctggaagtgggagattatggattaatgcccatcacattcagagactgaaaatatttgtgagtttgggtactgcattgtggtggaagtgtgggagtgatcatgatgcctccttaatcaatatcatctttcctaaggtcaattgtcagggccctgggagttgactttactattgaataactttttagtgcactttgccatggaaagaaactcaagcctcattgaccatatcagaggagggtaaacacctttcttgctccttcatatgaaagttattgttgcttttttatggacagaaaattacaggttgatggaactatattttcgtggacattttggtgtcagagtctttaaacaaaatgtattctttgggaacctcccctccccaatcaggagacgatgtcttaattattttgaccaaagccagaccatgttgtgtgttgtaaacatctggtttatcattcatccagctgaactggtttacattttcttagaagaaaaggcttgggattaaaggcatttaagtaattaagcacacgtcaagacaatttggtgatgggtaaatatagtctctgttaaatgcaccgtctgggagttctggtttagatttacgtccggctggagtgcagggatgaaagcacaatgccgggtggactgggcccttttctggggagaatcaaaaccaaatggattttcaggagtatggcaccattcctctaagtacctgtcccaatggataaaagtttcctttgagtttggcctggagggaatggcactgcagtccctgtcacccagcagcacttgtagatttaatgagactctttgggaggtagaccataaacttctgtgctttggttgttcctttgtgtccaggaaaccagatatgtctatgaagcttaatgctaggtctcaggctttgtatgacaagtatgtgttttcaggtaccaatgctggggcctaagccttccctggtcatgtttcttggccctgcccctgtggatgtgggacagtgttgctaggcctggttgtgtcaggctgcacagatgtgtggtccatgctgggcagggaggaaacatgagycttttcctttggaggtttttagttctaagcactaggcatgaagtacctggtgatttgaaggagacatgggcacgttgacttcgaggatcagtaaggggctcctcaggggctatactttgagctgagacgttgttcctgttaagggagacagggaaaggaaaatgtcctcagcactttcttcttctcactgtctcccatcctgaaagtaacaggacaaaaggttgggtctctctgtctctccctgggtcgagagctgagaggaaagaatatagatgcaatcctgaagaagaaagctttgccattatggccagatggatggcrcatgatggaaccaattagcccattttttgctgaaaagaaagaaaaaaatcagaatttcaattttcaaagcagggactcttttttaaaaacgtttgattattttcttcttgttttaaactgatttccatgcttgtttgggggtagaatcttggtttctgaagtctgggtgaacggggaggccaaagcaaatccctgttgttgggtaaagttgtggatggatgcttacttttcaacatgcctctcctgccccattcctcctcctctaatgtactttctcctcccttcccttatcagccactgattgggatcacccataggataccacctgaaaagtagggagtacacagctagagggaacagagaaacatccagttgcggcattttgggggctctggttatctgagtcaggacaactctggttttataacttgaatctttgctccaaagcaaaggaccttttaccttgactttctgtcttaggaggcagaacaatcagctggagtgtaaaagtttcttcatgagcatagaatgctcaacaaagcagtgaggaaggcgatgaacaagaggagtactgagataactgcagccgtagggccggtgactgttagggctgccatctcttctgtgtttccagctgtgagctaagtgcggtgagacgcacaggtgagaggagtgctctctgacgcaggtcaggcctctggggaacacaaaacaatgagcaaaccttgtcctggaagtgaagcaagctgcccacttccagctgcaccgtgcwcaggaagctttatttaagatgggggatagggcgcatggctttaatgtcccaataatttgaggcatttctgaggatctggcagctgggaccaggagttcaggttgtcggtctaatggtctgatgcttccagacactcggctaccgtgcaaagtccagctgagaattagcagatgagctaagtcggtgaaaacaactgctggacttttccacagagttttgggactgtcttaagggtatatacagctgccacrgcaactgtggggtgtgactgtatggattgggttgggtaggttctggggtgcggtctagctggggccytacccgcctgtgatgcttcaacctctatccatgcctacagcactttgtagctttagcttttaactacaaactcccacaaactcccctcccggcttgggactcctccctttgattatggtagggtggcttcacattgctgtggttatggctcttgaactgagtaatgatgctcagagtgaaattgtagtcttgtgagtcagacaaatctgcagcttagcgaacctccaggcacccttcccccatctgcactccctctccccaccctctgctcctctcaccccacaaagttatttctcatgttttatgtgcatgccaaggaagaaacttaaaatcaggaaaggactggccctttggtgacgcagcagtaccaaaacacttagctttcaactcattggaagagcagccacttctactgggcacacctggcagcctgccgcgggcctctgctcccacgtggggcctggagaatagtctttgtgccatccaatgtcctggaactgtggcaaatgggggcgaggtttgaggaagaggaggctgatggaggggagaggattgtctgagatcctctgcgggtctctgagcatgtgggtggggcattgggtaagagcgggaggtgggaagccatgaattttaatgagtaaatgttgtctagatttgttatccaacctcggcgtttattcagagccatgcaaatgcagatttcttagcatttggacatcatacatctttccctccaaaaccaattatctcctcatctcactacagtctacagtctctttggaaagaatggttcagggcagaaagtaagtgcgagacaagggaaatcattgtgtaccagaaattccccctctcctccccctccatgattaaatgtggatcctcgtatggcgggatccttggtactacgagttggtgagacataatccctcccatctggaagccagcgacctaggacagaccatcccgactcagacagaacacacagaccactttatagtctctgaaaaaaaccaagaatgaaacaagtaaataacgacgactttatgctgcgcagaaggttctctgttgtgagtataatggagttggagggacagagccatttgttcatttcacatttgtttagtagggtctgctatgtgcaagtggtgtgagacactgttggaattaaaacataaatcccttgtatagttttcaaactttttggtctcagggtaacttcacacttttaaaaattattgggaacacccaaagggtgtttgcatgactatgtcgaccaatgtttactgcatgagaagttaaggctgagaaattgtgaaagtgcaagaatacacaaacacacatgccattagccataggkgatgatgtcagcatgtgccacaacaccccactatgtacttgtgaaggaagagtgagaaagcagttagaaaccgttagtgctgttagaaaaatagttttcctccagggaccccygaaagcctcatgaggactcccagggctccccagaccacattttgagaaccactgccctgttgcttcctgcccacctcagggatattatggtccaggcggcagatcagtcacagcgaacgctgccttgtgaaacagcaggaaggagctcaaagtgcagtcggatgctctcatacacttttatagatcatgattaaaatgatccatataaccattcctatgcggtcatggagcacagagattctcacctgatggtggtggaaggttattggaatggaatgactggaatctttgaagacaggaggaatgtgaactttgagacagcatatttgatattaaaacataattttgtatttagagaatgaaacaatattgttcttatactaagaaccagagcttgacaaaaagttctagcctggatgatatagaggaggatgcagtgattctcaactgggggggcatgtgaaagcttatttatcaaaaaacaggggttaagttgagaaacgcttgccccagagttactattttcatctccctttcttccgtaggtattaactctctgatcgcaaacaatatctatgaggctgcctaccctcttcatgacgtaagtactattttcatcagcgtgctctctgtagtcttcaaaactttgaaaaccacaacttttcagtggcagtgagatgggtgaatacctgcagggtgaggcaggagtgaatcatgacattaaaatacyttgactgaccctggaccactcattgctgacaataatccccagtttgatttttgccaatcatctcaaactgtctcggcaatgatttccccagatgacacaataaactgggctttgtttgagcttttcttgtactccctagctttatttttagcaaaagtgtaactatacagatgtggcatgaggtgattaaagggaggagatattgatgagggtggtggatggtggtggaaggagactgaaaggcgtgagtaatccctaacctggactgtcagacgtctccttagctgcctgaaagtgatattttgtatgggagagttttgtgcagatgtgaaattcctccttaacatgcaggtacatattaacgaaagatcattattttaaaaaaaattttttttgaagaaaatctctcagaattccttgtacaatgctttggttaagtaargaaaacagaatgactgtaatgaaatctctccttgactggagataatgttacgaacataccatgatacaatgcaatggtattcttcaagacagtttacgagaatgtaactggtccttgagctaaatgctccatggcttcactattcatcagactggtcaggtcttgggcacgtgccatgcggtagtgccatttgagactgctgaggtggggctccctgactgccagcaggaatttttcggatggcagtcttctaattcctgacatatttgcagtggcatatgcactgctaagttctgcagttacggacagagtgagcatgtcatggcacaggtgcttttcacgtgatgggctaaaccatttaaagtctggagctctgccattgcattgctacgagggggcacaggctgatctctgaagtggatgagggggcacatcttcatgtgagaagttatcccaggaaatgtggcaagtgttgatggctcagaaaatggaatatcagccccttaccatgccatgcttttgaccttccttaaatgggaatgaaaaaaaagcaatgatattagaaaataaaaaagaaaatcctttctcctttggcacctgcttctggtaatttcattggctttatccagcatcactttttctccacagggtgaatacgatagtccagaggacgatatgaatgacaggaaggtaagcctgcctcgtgcagcatcctggactttgggcatgcgagactacgggtgggtgtggaagtggctagaagtgtcttagatgttctctttacctgcttatctactttccaacaattttaccagctcccccctttcccccacccaggtatttggaaatgtgagggtggttgctactgtatttagtgcctggagagccacaatgccaactgttctgaaatatatccaatggccctccacacacagccctcaccccaccctcccatggcaagagagcaccagttgagaaacattggctgtccaaattccttaactgatatatgcagaaatggaggcacagaaacttgagcaccttggcctagatcacacagccacaggaaacagagatggggctcggaacacctctagccctcaaatccagggctcttgcttaaaacatgtgatgatccatgccattatagcttttggagggtcaactttaggtgattcttctttccttttaggcaggcaggtggagtatagccactcccaaattatagatgagcaatctgagtgtgagggaggctcagttgtgctttgtagttcaagaaactaggaattggaggttacagttaggggaaggaaaatggccccacctcttcagtggggatgcaccgatgatccccttatgccatcctcctgctggcttctccccaccttcaacaactctagtgagcagaggagggtgggcgatggtgggagggttgaggagctgaagctcaagcaacttccctcccccactctgttgtctggaaaatcattcatgccccaagttgccttttgagcaggcttctttttatcctgcctattagtccctgttatgaagtgttaagtattaaaaacataaaaggtcttttccagaaatactgtggtgattgcttacacatgtcccctctctgcctgcccagggaatctgctgtagtattgcgatgtcttaacctcatctgttttctatccgatgctaatagtctcggtgtttaatttcctgaaaagtccygcatcagatttaaaggaaaaggaggaagcatgtctcaccacatctcacctctctcgcccaaccattttctgtcctcccactctctaatttttccttccttccctttaaatggtgatcaccatccattgcctgtgtaagaaaacaggtggtgaccccagcctgtctaggatcattacggagaccaggaacacacagcaagtcataggagagatcagtcagccttctgttacctgcactaatggaagaagtaaattgtggactatttacaatatatatgttgtagatataaaaatatgtatttgtctttggaaagatacgaaattactgttaaccacagcaatgccttttaacaaaaaattttcccatcagaaaatgtttctctttggctgatrtaatgaagtcagggtccactccacctggtagaataggtgggaactaggaggcagggagagcccagccaggatggaattgcatctccatggataactcccaaagttgatgtcagaaagatgcttcgtgaaggtgaacaagtctttgaaggacaagatgaccctttcttgtggcctttccttgggcttgctggccagtcttggtgatacctagccaggagagaagactggttttaatgtccctgaatgttcgtgaagtcaggactaaaaccttagtgtccaaatcccagctagtgctgtgtggtcatgttgacacagcttcttctgttaagcaagagagattctcacggcagggctagatttgtttctgtagttttagtggtatgtgggtggtgcctacaacatatcctgaaggagaaagagcaaaaacgcccaagtgtgtgctgcatatttatttgttttcattatattataactgtcaagtgttcttcgaggtggttgcaggaagcattttgcttaggtgcaaggaaggacccctgcatttggagctgaaggacatggagaaggcttgggagccgcagtgtagggtggcctctctggggcctgtagggattatttgccatggtrtcccaacctgcccatcctgccagcacctggatgttctccttcactcttccttaccatctgtggctgttcccatgttctccccaaggcccaggctcattgcaggcagattctaggcaagccaagaggcgctagagaatgtcagtctccctctcctgaagctcacctggtgctattgtgcagcttscgtgactcagccccaggtaggggctggaagtctctttctttcccctcctggagggtcgttaagaagaggcttcctccgtcttgagaacaaggaattcctgccttcctagaagccaggacaaccggaagagggagcagcgtgggggtagatgggtccctcctggcttccagyagctgcctagttccccatttgccaaagctgcctagtgtcctggaaattcccagagaagtggctgtcaccatctgctcagggctgcccggctcccactggctctctgtggcttcttcacccacttacaggggagaacccaaagtagaactttggatgtgacttcctttagcattctggaaacccttagtcctggattttccagcctttgcaggtggrtgtcttccctagtggatagttagtaagtgacccactgaaaactgtggagagagtcactcctgcattttaagacttgccttcctcacaagaaaggcacttttcttcttggttccaactgaggattcattttgccgtgctgcacgactttcatgttactgtgtggagacgctgagacctagagaggtggggttactggctaaaatgttcgaataggtcagtgtggcatctgggagcagaagctaagtctcttccattcaggatgccccgtcccttgaatgcctccaaggtggctatagcatctttctgcctgtctcaggtctagctgctctctgaggagcttgtggcctcagagagggtcatgagtcccacacaccttcatgttatctggcattgcaaagggttgttgcaaagggtttttaacacttgagttccttcatagtctcgtgaaattcttaaattgatgacctctgtcaaatgtgatccctggggagccaaacttgctgcttctatctctgatccatcaggtgggatggttcctgctgtaaaggcttggggcagacagacacatctgggattacatccagggctctggaatcaggcactgtccattaagaaggagcagtagtctctccctggtttatttgctagctttgccagttggtgaagagaggacatggtgaacctgtaagggagaaagtggattcactaagagctgcattagaaggctctagactctgcaagtttaaagggattgttacgtgyctgtgctttactcacaccatgctggtccatatggggcaggactccagagtgtgcctcccttcaccctgagtgctggtcccttctgggaccctgcaagctggagttcagcatgatccacttgctcttaactatgtgtgactaaaccttcttaaagattgggaagggtctacagcactctccacctccctccctgcctcccctgcaggtgacagaaggcgtgtgagctggcctgggcatccaggcgtaattgctgcaccgcctcccagctttggtgctctgtagctccagctgtctgtttcaggggctgcctgatcacggcctcctctgtatgcttctagcttttctgtatcaagcccagatagttctcttrgctcctcctcatctatatccacaagctgtggatacatctttgtgcttagaagagaccatggtgagagagggactttctggaagtctctttcagcagatctgggattcaaccagggaaaaggcttctgaggtcagctctccgttgaggccatacagggttcctgggacatttttcgtttttgccttcagggcagtggcagataggtgttctcaagctcaggttttgcctggacatatgacttggggaggartttgctctggaggtcagagcctatgaggcagacagtgacgtcccatagctctcgagggggtgccctgcctgcatctcctgacgcaagcatatctccctttgggcaacaaatgatgtcactatgacaaccaggtgttggagagcccagggtttgcactcaggggagggagtaaaaactcaggcagtagaagcacccaagatgtgggaggaggagatgtactaataagaataagattaggttagccactgccctggagtgagcaggagcagtgctcatgaattcagatgttcctctgccttcatgcactgagtgaccccttttgtatctgggtttcctccattgcgagtggtggtaaatgctggtacagtttgccctttcagggcctgtgtagtttctgctcctgttttgcagttgctggaagacattgtgacaataaaagtctatcacctttaagcaagaacgctggttctcatttccattttaatatcatgtctttaaagattcttaggtaaacaggatggctctctgtagggctgatgttcagatgggcttccgaagtacctgattaaagtaggttctccttgacagatttcctcgtgaaatgtgtgtgatgtggtaggagaataaataatgtaacaaaatagcagctgtattataaatctgtcaattctagacatataatctaataaaatgccgatattgattcagcatggatacctagatgaggtctaatgatgaccctttactgaatgattttatttactgggattgatacacaggtttagtgagacacgtgttagtcctgctaaagttgctgcagaaatattccaagatggcctggcctgatgtgtttggttttgcccctacccctctcctggagccactcttgtcaaggtgatcagtgacctcaaagccactgagtccagtggtcactgctcatctgacctgacccattagcaacatttgacacagcttgtcatcttcttttgtttgaaatcctttcttcccttagcttcctggatgccacacacttctggttctcctccacatcactgggcctctccttctctctcctttactcattcttcatcaccctcttgacctctaaatggtggcgtgcccagggcccagacctcaggcatcttctatacttactatctcttctttggcaataacatccatcatttaatgactttacaaattgcctcctcttcaataactctcgaatgtactggactcttctttgaacttcagattttcatatctagctgctcaccatgcccctggatacccaaagagcatctcaaaaaatgcatccccaagtgagctcttaatttcacccccactaacctgtccttcccacatttcagtaaaaggcatcaccatgactcagtggctcaggccaagttcttatttattctcatcccacatccaatccagcagtaaatcttacaggctttacctttaaaatctaagcagaatcaactagttcttactgtatctgctgctgcccccatggtgcaagccatcatcatctcttccctggaccattccagtaacttccctatgcctctgatcactctcagtctgttctccacacagcagccagagtgagccttctgcaatctcagtcagattgtttcgccctctactgcaaatctcccagtggcttccttcaaaacccaaatttcatccagtgttgatacaaagattttagcatgacctgcaaatccccaagagatctggccatcctggttctttctgactttgtctcccacgttctccccgtgctcactctgccccagccacactggttccctgttcttcctaggatgtgccatatgcacttgccttggggcatttgcacaagaagactgtcctgcctgggacaccctccccccttcctttgtgtctcagctcaatgtcacctcctcagagaggccttccctggccatcctgtctacaacagcaccctactcctctcccttccttcacattctactccctgaccttgattaatttttcttcattaagatttcaaaatcttatctgtttatatgtttatgtttatctctccacaccagggtgtaagcagactgtggcttactgctgtatccagtgtggggacagtgcctggcacataaggagatgtcaataaatacttgttaaatgagtgaatcatgaacattagggctcattttgctggactaggcaagacgtgggaataaagaagacggggttctgctaatcaggtgyaggactgcctcagagtgtgataaagttcatctctgttgtttgaggaaggagaagccagtttccatagcctcccgattctgaacatctccccctggatgtctcatgagaatttcttagaagctggactttggggataaaaatctgacttgttaggatggacaaaatcaggtgaagtttcccatctctacctctaacctgtttccttattttctttgtttagctgctatatcaagaatgggcgcgctatggagtgttctataagttccaacctattgacctcatcaggtaagaggtggtagggaacttttggaagtatcctggagatgcaagtcctgaaagatgtatcataaaccttttgactctgacagtcctttgctcaagtggagggatcttcttttctagcttctatgatccactcctctgtgtctcatgggtggggaagcagctggggacatgggagggacatggaggctgcgtggggcaaaagatactgtagattgatagaccatgacctgcaccttgaggtcttcaacattggtctctttccctgcctgttctctgggaggggtgcatggagctgtctcatttcttttccttagtcttgtcctagagaagaacctggatgaagctgattgttgggttatgcccaagtgccagtgttgatccaggaaagggtggatttagcaaatcacatgaggaatatgctggttggcctgacagaatgtggactttttatggcttttccaaattagaarggaggagagactaggccctgggtttcctcccttctgtgttgtcacagaatgatgtcctgttttctggcaccttggacatttccccagcttctgttgaacattagtgaaaagtccttggaaataacttactggaatgtcataggtctgactagtttaaaatggcttcagggctctagaaactcaatcttctggctggaatgttgggcggcagcactgtgtgacagcactgggctgagagtctrgagacgtgagttctggtctgggcctggccactaagtgctaccatttctttgggcaagccccaattcctctttgatcttcagggtcctggttgtcctaacttgggaggctgagctgagggatctgtgagttcacatggtagaatgtgctcatttggaaaagatgggccgctggagcctgcaggaggaggctgctccatggtggacatggtggactcactgccctgaagtcacctaatgagctaattcatcagcctgagaatagagcgtgttcctggctggttgccctgggctgggattgtgagaggggcagcggccaggagaatcgagtctagagggaggaattccagcttctgcttggaaagagaaagccgcgtggaggccagagtttgggcagctcacctcctacacagagatgcagcggccctcccagcggacagagcttggttggatgtctcttggaagcaggtgtttgttccagctgaggaccgtgaaccaaggtcttgggtgggggagcagggacatgcggggcctgtgaccaggtgccttcaccctgtctcccgtcccctggctgcctttcatgtggcatgggccacctagactgttctctgggccaccccaaggctgatcattccattcttggtgggctttgatctttctctctggatctcaagtggccacccactctgtcgcctgttttctccaactactcatttgtttttgttttttttaagtacgattaaaaaataaaaattctccctaccagagagccctatcttttcccgcagagacttcaggtgactcgctgccagctaagtggcaaatggctccaatatgcactcggttttggccaccaaagcagcctcacctgcaggggaagtattgcctttggagcggagccctgctctggggcctggcggttcctgaggatggagagctcaaatctgtctagacagggcacggtgtactggagcagggccggaggctgtctacagctcctcacagatcagatggcctggaacactcccacggtccctgggcaaagccaagtcttggtcaggagggagaggaggaaggagcctcaggagaacgggacgctgggcagcatgtgtgtggggagccaaggcagatggtgatggtggttgtcatcccagtggcataaggaactctctgacctcaagaaactgctggaaagagaagtgatggaagggctggtggtggggagcactagggtcagaagtgggcgagtacctggagaacttgtagagagaaatgtgggctggagcatgcagggagcagctacttagactcagtgagcacaccaaactcctcattttacactcttttaccaaatggtcccaacttgctttccctgattctgtccaagtcctctccttcctcttcttcatcatgacacaacccgagacctcagtaatccctgactggcgtcactttcacttcccactccccaatctaactgtgagtcttggggattcttcttcagcaccatttctctcttttgccacttcctctccatcattcctcccacctcctgtcggggcccacctgcctgcagagtccagcctgtggttcccttcctgagccatcacaggccccacaccatgacagttttgctccatgactacttactaccatgcatggcaccctccgkgtgcctcgcggagaagttgccctcatatggtctgtgctggaagagtgacggagcaggggaatctggcacaggcggaaygtgataattcatgcacaggcctggccaaggtctttcccacccgtttctttgggtwttcagctcctcatttttagygccaagcttctgttcctcctctggagccctagtgctcctcctctgtgccaattgtttggaagattctaaaacctctgtgtgagccattgagagctcatggggcaggagacctgtttgtatgtggaaggccccggaactagctctccttccccttccgcaggccttcaggcctcattttgagtcttggggtttgagacaccgttcctggatgttgaaagtccacagaggggaggcaagacacccttccctgcacccctggcccctgcctccacccrgctgcagtgtcgttcgtgcccagcaggctgcactgtgagactgctgatggcctccagccccrcacggctctcctcccgatcctgcctctgctctggagacctggggcctgcaggcctgagtgtgtgtgtgagcctgtatgagagtgtttgtgtgtgttagtgtgtgtgagtgtgagaatgtgttcgtgtgagagtgtgtctctgtgtgttgtgagtttgtgtgtgtgtatgtgcaagagtgggtgtgtgtgtgagtgcatgtgtgtgagtgtaagagtatgagagtgtgtgtgtgtgccagagaatatgtgtgtttgggagagtgtatatgtgagggtgtgtgtgagagtgtgagcgtgcatgagtgtgtgagtgtgagcagggagtgtatgtgtatgagcgtgtgaatgagtgtgtgtgcatgcgtgtgtcggtgtgagtgtatgtgtgtgagtgggtatgagtgtgttcatgtgtgtcagtgtgagagtgtgagtgtatgtgagagagtgtgtgcatgagtgtgtatgaatgagcgattgtgtgactgtgtgtgtgtgagtgtgtgtgtgagagctctctggaaagttccctagagaggtatccagcaggaacctcgatgagtgagtgcaccccaatccagaagacctcctgggcacttccagccagcagcacttgtgccttgtcagaaacatggcttgtggctgataatatgaggaatgactcctaagctagagtgaaatgactcttctagtcctttagggagctggaagagggtcctcacagctggagaaggacatttctgcctgcacttctctggttcaatgctctaaaacccaggaggaaaacagcccttattttctgggaaaacttggggactggaggccttttcgatttgtacaggtctgacccaatactagtcagggccgtaatctgtctttttactaaagttaatatctgctcccaggctgattttcttagcttggacgttttgatatgaatgagacaaaacaataggtcttaagcatcttctgagtttgatttctcttctgactatactctgctgaaactaatgtacaaaaagtttattctaaagcagctgccactgcctgcctgtgacagcatgggaaagagagggttctagaactgtactcagctcagagggattgcagcctgttgacttgtgggagttcaccaaggggataatggatggggagcttcactgtaccaaaccaggcctgcagtctgaagaggggtaatggtccctactcactcccacctgttcctggggtgctcacttcatgagtgaggcttcctgcacttaaagtcaggccctgggcatgaagcccacccatgtggaagctctggagttctcttagaaatgtgccagcttagagccttgagatatggaacagcttccacgaggatctgagagtgatctctatggggttaccatttcaagagcccttgggtggcactgtgccccaacgttgctacacatctctaccagccctctctagcctgacatgccacgaatgggatctccctcctactgcaargcacaggtcaccrtccttgccagggttccccagcactgccaccagagactgtgtggtttgatccatccctccttgtctctgggctctgcttccaccctcctgaactgtgagccatctgagcacccccggagggagaccgaggaagccatgttcttaggaggcttctcagcaggccaggctggggaaggactggccaggccacagctgggttagaggaggaactggagagagaaaaacgttgatcaatctgtgattacttatttccttagccctgctgctttctccttgatttttctttgggattgagaaaggcaattcagctcgacacaatacacattcactgatgcttacagtgagcaagtctctttgcttggcagtatggggaggcacaacaacgatgaagggagagcttatggcctttaagatctaggagttatgtagggagacaaatgtgtgcaagaccggatatagcgagggctctcaggactataataatgttcaaacctatcagtatgggatcacatttgaagagtaattgctgctagaggaataagacaagacttcctggaagaggtggcccttgaatcagaaatgttgctttctgaaggacgactgaggtgaaagagtgtgtctttgtaaccagcctggactgccctgtataaggatttatagtttagcctgatactaatgactgaaaatcacattgactcaaagccagatctttcctcactgttgactgggagtggtgagatcaagaacttggcttgcagaccttgtctgtaaggattccctgccaacctggcccaagtcccttgctctgccccacgaattagcaggcaatccagggttggaaggaaatgaggctggatgcatgaagggaagctaaggagagatgacaygtgggatcagcaccatggcatttgcacgggtcttatcatttgatggttgggtttagctggaaaacattttgcagcctggaaggaaataatacctcataggcctgaagtctattcttcctttacctctgagggtgtgagagaagggtagacagagaaaagcagcaacagctggttgaggtgaggcagaaacaaggatgattatgttccatgccattacattctggtccattttatagatcaggatataagtcatgctgttaatcccatcatgctgtggaaaggctctgccccagtctcctttctctcatttcctccatggagtgccactctcctccagttgtaccctttcggagggaaggctgttggtcttgtggttgaccaatggaaacaggagttggagtacaatgctaccagctccagttcaaaatgctaccagctccagttcaaggtagcagctaatgactgtgttggtcttctgagggtggcctcctagcctcacaacagccttccagagatggtggctcctgttttaaacttttcatcctccttcctgtcttatcagccacatggtatggatggtggatcccaaggcaccaagaggctccacaagttccccatggccacctggaattccagggcagagctggggaaggaaggagctgtctggcatcagctcattgcctccttgatcagcttatgtcatgccccagggaggaaaagctgatattagtctgaaaaatatgacaagctatatgtttgtgctgtcttggccctgttgtacaataagctttcaattatccagaacctctaggaacaaaccatagcctcacagaggcaaatgaagcttagaggccagacagttggatagctgtccctggaaggaaggaatgaagaatttttcttgcggcatattcatctagcaaatgcccagcctctgcttgatttttcttggaatagggagcaccttatctctgggacagtttgtttctgtcttgggcatatctagcccataggaagtcatgaaactagaaggaaaactgctgatttcccttattttggtcttagttctgcttcctggagctgcacagaacaagtataccctgttgtataggtcaaccctttaaatatttgaaaacaacaattgtgtcaacaacagtgctcatatacctaagctttctttcccacaccccaaatactcctaggactttctgcgtttccatatcaacgtgtgttccccacacagccttatcatcgtgattgtccttcttgggactcactggtggggtaacttggaagaggaggagccttacatacacctcactgaagcagttaagccaccacatattttgcattatccagacactggtcctggggatacggagatgatgtaagcatgaccccactctcaaggagcttgagttcaaagtggaatctccatgcttgcagatgaccactgggttttctgggaaataaagggacaggctgatggagaaaatttatagaaagtagctgtgaggctgtaggaaaacaacatatggaaaagatcacgagggaaaattggccttcgactagccatttgtgatgggctcagaggtatcagctatgcatcaggcagagatctttggggatgattgtaactctttctagaaacatcagtgtgatgtgatgcagcaccacagacccctcgaattctcagaatacattttaaaaccaagctaggattgcatcactcagtgatttacygaatcatggtaaaacctcacatgtggctgacttaggtcatcacacctaaagaaaacataaccaggctggaactgtttcacagaaggaaaagtaatgtgatcaaggatttggagaggcgtctttataaagtcggacttaaacaaggaagagttccctattctcagaacaaaatggagaaggagtgaggctgacagtcaaaagatgggtaatgtgcctgtgtatgtgttcatcagaccctgacgcacctgcccggggacattcctttagaccaggagcagtgagttaagagtgaaaagaactcagttttacctccagatttgtttccagttgatgtaatatttgggcaagtcattctctcttgagcctcagttttctcagctatgaaataggggtgatagcacctgtgctacctgcccacagtattactgggaggattcagatgaagagctgtgcaaatactgtgatgatggctgtaggtctaaataaatacaaataaatgtatttatacatttatttatattacaataattatttctattacaatataatacaaataaaataaatggctgtagttaaataaatacgaatttattgactccctgtgggggaaattataacattcattaaagtggtggaatttcatatggttccttagcttaagagctttgacaaatatagtataatcatattgtattactgtaaatcaatccactgtatgcattttctgtctgtgacctctgtgcctcacagcaaccctgtgaagtgggtattcttatcttcatttcacaggcaaggagactgagttcagtgaagtaaaggcttcccagagccacagagcaagctcatctggaattcaaacccaggcctgtctaactctagaaacttttatttttttcacagtactctgtagctgaaggtgccacagagttccattcagtggatgtcaggctagctggggttccagccctctagtgttaatcccttcaattacccatctcccagggaaaaccatggtgtggtcttctggtacgggctgcatgctgaccatagtcgaccttggcttatgatggggccatctttatgaacatccctctttgtgcctagcaggagtaaaatatcactctcagggcctctgttcagcaaccccagaatgccatgtttttgatttttcatttctattttttatgatcttttttttttctgagtccttccatgttgtcagattgtcagctgtcacttcttgcttttgtcaactgagtagcttctgttcccaattctaatttactgctttgtctcagttgcagcttcggcaaccagacacccaagcaagttagcactgtgtgcaaagtaagacgcttccacggttcatcctggagtctggtttctgttgggtgggggagcttgtagagggcctgcttttgtgctggaagtgactgtttttgcttcccagtgagagtgaaatgatgttactgaagttcaaggggcctcagcgatgggactagagtgaggatgctacagcagggggccctcactatgaaaagctgtattttggccctccttgcttgtttggggacgtcatgaaaaatccaccctatcagatattttccttaaaaatagagctctgagtctgttaacagcgcaagagtcagtccctgcatcaggatctgctgaatgcagagctttgtactggrtgtggtgttgaagcctcaaagaagggggaaaatgggagcttgaagggtactgatgggacacaaggtcctcacaaaagaaaacttcttgggtcggtcacagagctatcaagtagcttccagcaggtaactaatgcacaaagctttgtgtggcagtgctgggcaaggtagggagaggcttcgaagggcttagtaactggcttcagggtagcagattacacaaaaatgagacttacgacatagatgagttttaagcaggaagcagagatttgaaggagagaagaaatatagttgggggatttacaagattgggatttaagcattcttggtcaggaaatgttgagagaagagacttgagaaggggctaaggcagatgartggcttgagaagaaagcaccggggctgagctagacaagggacatgatggtgggggaaattcaggagaggatctcaggtggtttctctggaatttaggcaggtggaaaaacctaggcagagggctaaaggaagggtttcaggtctcgtattcccagctgggcaggtaagagtgggcacaaggagtttcagttcttctctcatctctcctggggagtctctgggaaggtcattcagcccctgcagatctgttgaagtttctctccctatagttgcatctcttctacaaaatctctaggctgcatgatggcaggtgcagttctgtctgtgggaatcaagatctcaggtagacctgagggactgatcttgccttagaaggagcaaggggactggcgtcctgtgagttaccagggacacggctcaactgtttgatcccgggagccactgtttgaccacgtgtccctggaacccctgagcacctcagtcctcctaataatattccctggagtgatgttctccacccacaccacatggctatgtaaccaacataaacagaaaacgtcttaacacactgaataacatcagcagaacacacgttacaacaacaaccgcaagatagctaaatttaattagcccggcatgcccaggctttttgtacaggcacatgcctctgttttagaaatggaaaaccacagcattctgtgggtctggaagtcacacacataagaaaggaaaaaaaatacacaaaccttcaagatccctgcctgggagactgctgtcttctagtacctacttgggattatctcaaggtattcaaagatgttgacagttgggtggctgccaggaattactgcctgcctctggcaaattggttggctcagccgtgaagagactggggagctcagccttagtcactcagcctgcggcagggactcgggaaaccctcagagatgtaggctcatccttactggtttctttcatagagtccacattcaactgaacctagtcaagagagacagagaggggattggagaactgggatttttaacttttcatttgagcattttagtctggatgagggcaatggtatgatttccagctgtcatcaactctaacaaaatggcagcaattccttaggctgacattctgcccagtcctcagccctggggcaggaaggcaagctgcatggcagagagaagcgaatcagccatgtactaagggtgtccctgccctactcagaggcactgcatctcctgaaagcccaagctggtgcctcgagtagatctctcttactgtgcttctatccctctccttttgttcatcctgcggtgatctcttctttgtccagtcccgtgagatcacatcccttttagaaaaactagctcttttgacttctgtggattaagaaggttaggtctcggatgctctgacagccggctagcagcatcaggatcatctctatggggatgatgcgaaagaaaaagaaggcagagcccccagactcagacctctcagcatccaggtgggacaaagacttgatgttttaggaaagagatttaagaaatatgtaattcaggctgggcatggtggctcacgcctgtaatcccagcactttgagaggccgaggtgggcggatcacctgaggtcaggagtttgagaccagcctggccaacatggtgaaaccctgtctctactaaaactacaaaaattagctgggtgtggtggcgggtgcctgtaatcccagctactcaggaagctgaggcaagagagttgctcgaaccctggaggcagaggttgcagtgagccgagatcgcaccactgcactccagcctgggtgacrgttagactccgtctccaaaaacaaaaacaaaaacaaaagacaaacatataattcagttcaacttaatccagtctattcatcgagcaccttctctgtgccaggtactgtattaggtgctggagttaaagtgatgaacgagatagatatggactgatggtgggcagttagataatttatcatcctactggggacactttttctagtgaaagtgagagctattaataatgatgttgtgtgtactagttaactgttattacattgatgttgcataacaaaccatccgaaggtcagcagattataacaaaggtcatttctgtattgtgttcatgtgtctttgggttgaatgggaaagctctgtttcaggctgagagttagttggtcctggctctgggctgtggattgtgtttagtttgccccaggygtgcacattttgcttagattcaacagcttctgggacacattctkctcacagagactcagcagagcacaggaaagaaggaaaacatgaagtacttcttgcggtacctgctgacatcacatttgctagcattccattggccaaagcaagtcatgtggccaagcacaaatccatggagctgggaaggctagcataggagttagtatttactgacaaatccaggctgccacagtgcaacgacaggtaaaaggtgggactgtttcgggcacgtctggacctatggtccagctgggtctggcctcacagagcttatgacctagcaggggagacagtgcatagttaaccggaagtgtgacagagatgactagagaggaggacagaagtgtaatgggaatggagatataaggccatccaacctaattggagatctccctgaggaagcgacatttaaactagtatgatttgctggatgggtcaaaacaaaaatgatccaggcaaagatgaggaaaataatgacaacagctaacagttagatgtttgctgtgtggcaggcactgttctaccccttggcatttgctaactcacaacaccccgtcgagatcgatactatcatcctcattatacagaagaggaaattgaagcacaaagacattattaagtggcccaaagtcacaaggttggtgagagaggtaggatctgaactcctgagtctggcttctccaccatgtgtatgccccactgctgggggaaggcactgggatgctggagcttcagctctgtagcggagatgcttgtggggagccaggtcacggaggagcttttgggctggttagggattttggaccgtaccctaaggaaagggtacatcattgaaaggtttggcttatgtgagtgcctgtgtgtgggtggtgctggcatggcccattgtcatcagttgaaggatcaggggttcttctggctggggcactggaaaggaactgggattgtgctttttgtgtctaacaggatggtttcctcctatgtgccctttgtccttctgaaggacttgtgggcagcctggccatcatgactctgagcccagagcctcttttgtcttcctctcctcatccccctgacatcataactaacctatggtctcaccaggttgtgctccagtggacatgaagcatctctccctgctcacctatggtggctgtgttagtgggaatgtgaatgactgctgtgaacatatcactcagcctgcgctcatcaaggaccagtttaccatgccctttgtgtgcatgatctaattgaattgtcatggtgactctatgaacttggcacaatcctggtccccatcattttcaagatgagacacagagtagacaagtcacttgccccaaatcccaggcagtttgacaccagagcctgttatcttaactgctttgctccactttaagggaagagcactgtgttgatgagacatgcagacaactcccggggaggtggtggggaggcggagaatatgatcggatgtgcagcggtgatggcaaagggactctaggaggttttggagcaaaacagccctgtttccttaagtgaggggggcttgccatagatcttgaaggcttaggaattttaggtctgggaggggtcttaaaagccatccaggctcatcctctcactctgtaagggactaaaatcctccaatagagctaaggaggcaaggggacagggatatcatgtctgaggcctctttcaaatgaagggcctttaatgtgtgccactgtaacccactgaagtttaatacagacagtactgacccgggagttagaaggatgtgtggggtcagaggtggtgcatgacactctaggtgggtctacttacacatcaccttcctcacctaaaaatgaagggtaggccaggtgctctagagcattccttccaggactaacttcctatggttcttcagagatagaatctcaatcctaaagctggtctgggggcagggcctaggatctcacaggggggtcaagttgaaccagggattggaatcaaagagtctggacctagttgtagacttcatccattggaagcaccaccccaggggcaccgccccctgtcccctaaccaagtccctggatttctctcacccccagcctctcccccttcctgaacacccccatctctgttttctttcgcctctctggctttgatcacatctggagcattttgtagagttgatgagtatgtgttttcctgttgggacacatggtgtatatcagaggcacttaaggagctctggacgatgaatggaaaagtctgcgtggcatctcaggggctgctggcctggagggtagatggcagctgcatggcaaggggacctggcatgaaggccaggatactctctgggaaggcccgggggaccagcatggggactgctgctccaaatggctttgagttgtcacgtaggggtggtgcatgggaactgtgtctgtgtgcttgtatgtgtgtgtakgtgtgtgtgtgtgtgtgtgtgtacaagaggactggaagggctcccttgtcctgttgccattggatactgccttcaagatttgctcttcatggtaactggggctcttatctgcacaaccagtgacataaaccaatgatgtgtcacctacaggtggacagtgagtgatgaatttaatatggggtgctctgtctatgagaagtgatagtaacctccagcatgggcttgcaggaccagtgagcagtgaagaaggatgagacacaaagtgggcttcctgtggtgaatgagctgggaacatgcccaaccctgtgacccctctttgctgtcccccagtatccccctgaagatttatcctcaggctttgtagctgcgtgtttctccctctaagcctctcgctggtcctyttgaactttttccttctccctcctccaataatcctaagtcttcaccccttttccctctcatcccctgtctttaccaatccatcccagctactctctttccattcacttcaagtgacatcttccagccttggggacaagttaccactgtctgggcctgctggaggtgatcttagaaagtgatagatggtatttataggtccagggtaggggtggagctggggaatgccatgcagagttcagtctggaaggttgtttatgctcttgcaactccaacaaagagcagccctgtctatccatggctcaaattaaattgcagatgcccctgaactcggggttaggaacataaacaactggtgagttgcagacttcaagcaatgagcaaactcggcaggggagaggcctggtgaagggctggttggcaatggatttttccagttgatgtttttccaggaggcttctctgacttcttggattccagggaccagagcacttctcttgaacagcacgtctggggagtgtggctcctccttggttgtaaggcattggtggagacttcccagcccttctttcatttaatttgtcctgctcagggaggaggtttaggaagagggtggagaactcagtgaaaggcccagggagtcacatcagggaagtctctgacatgtagatttttgctttgaggcagagtccaagaggccaagcctgagctcaggatgctctgatggggacttaagtttgcctggcttggcccctccagtgcaggaagtaagcagccacccatgtggtataactggctcagtcattaactcactcatcattcagtctactcaacgattcaacgaatacttacactgtggcaggaaccagctcagacggtgctaacaaaaaatcctggccctcaaggagcttatagtcaagttggaaaaggtgattgataagtcagccaacagcatgatgaatgctgagacacaatatgtagagtggctcttggacagaaacaagaagggcttctgaatccatcagaggaggcctcctggaaggttcagtggctaagctgagttttgaataatgaattgctatgagttgggtatagagagggggatggacattccagataggggggaatagcatgaattaaggcatgaaaggtcgaaaaagcacaattgttgaggggttacaagtagctgactgtagctggaatgaagagtgtgcatgagtttagggtgggatgtaaggcaggaaaggcaggcaaggtcagattgtgagattgtggctactcagctaaagtgatgtagaaggattttaagtagaaaactggtaagataaaactttaaggatgttgtttgagggataggaaaagttgcccctagttacttttcccagaattaggtcgtagccagtgcaaagcagggccttgcggaagtggggcacaggctggagccctagtgggagaaggggttccagagtgggacaagaatgatagcttcttgagaaggaaacctcagatgaggaaggcaaggctcaggaaaggaaactctgtagcccaggaccacatagctaattagcaccagagctgggccttctgagtgacagccaaacagaagtgatgacttcacagccttgctcaagggtggccccatcttctccatttttaacattacctgttacctggtgaaatgagcggcaggagtattcatgggaatgtttatacaaagtgctcatgtagactatacattcaccatcaccctggcaatttgccatgatacttcctaagagctgggttggcttgtttgtgtttcatctctttctgttccccgttcccctaggggtagagattatgaagaacaaaggtgggactgattcatcagtcaagagggctgtgtcatgggctctagtcacttgctctgggtccttgagaataggaggcatacctaccagattttcaactgatgcccatctgggtaaaggttactttgagagataagagaatcaagatttgaagtgtgcttgacaagatgaaaccctgagccaaaaccaacaagataaaatgtaatcatgataaatgtaaagtcagttagcagcatgcgggacagaaaggtctgatttggcaggcatttgtgtgagagatggggagtgttaggtgagttaagcacccctgagcatgagctctcagtgtgttgccaaaacatgaacttgtctcacactgaagtaaagaacttgttgaatgtagattataggtaactgtgggtcatcacctttgagctgtcagtctaccatggaggattgtgctctgttctgggcaccccatttaaagtggtagattggcagtagggaagatacacagatgtggcattctgtgatctcaaggaagatttctgctagtagacatttttaagatttggctcaaaagatgttttaaaaacattaaatgtggatattttccattggagcccatgctctctagctctcttcaactcccaacataccctgttgccttatagccaatccagtggcttacatttccacaattccatttaaacttgtgacctttgggttaaagcaatggctcccagctccagcagcacaccagaatcacccgaaaaacctataaaatgtagatttcctatgtctacatctggccatgatggagtaactggtgcaggactaccttttctgccataaccaactggaaacatggctaaaaaatataataattgttttcagatgttagacaataggcaggtaatccctgaaaaaaacaaggttagttctacagtggctctgaacaagtgcaaaataaaatagcgagataggtaggaaacttaaatccataatgataattacattaagtataaatggtctaaacatcaaaattaaggggtagaaattgccagatttaataaaaatgcaatacccaattatatgctgtttaccagaaacacactttaaatatacaggcacagatatgttaaaaaggttgaaaaaagctctaccatataaacgctaattaaaagaaaactgaagtggctatattaatatcagacagtagggtctgggaaaagaatattatcagacatatggataatatttatattgacaaaggggttaattcattaagaagacataaaaatcctaaatatgtgtgtacctaataacagagcttcaaaatagatggagcagtagttgacaaaacgaaaaggagaaatagacaaatcagttacatattggtgataccatctttttcagtacttgatagaccaagtagatgatcagtaagaatatagtagacttgaacaatattatgaatgaacttgtcctaattgatgtttatagaatactatacccaaactgcagcagaaacattattttcacatgcacatggaccatttaccaagacagaacatattctagcctataaaacaagttccaatgattttaaagaattgagatcatacagcatatatcctcagaccacagtggaattaaattacagatcattaacaaaaaggccaaccaacaggtcatcttgcctgctgccttgcatttatgcagaccgtatacctctttcatctgttgcaagctgacctaaaccattgcatttatgtacaattcttttttgacagacaatagtggtccttgaagaagtattaaaataagttatatttattgactaaacatttattagcaagtatgaaaaagaagtagttcatatgacctttttaagggtgcccaaatttactgttcttttatattctctgatcatctctttgcctaaaagatttactccaggcaaacatctcaatcctagagatagaactttgtcaatcttgtaaccaacatcagagaaacagaatccagagactcagctaggcacagggccatttagtggcttagcctggggcaccacccctgagttcaaagggtacaggcctcatagatattaattagcaagagtgaggagtatgtatggaatatgtctggccagttcatattatttgaatgcgtctgatttctccaaatgagagcccttttctaacattcatgatgctagtcaacaggccattgtcttcacccataaaaatcaatttttgacactttgcatgctaattaaccaagttctggtcattgatagtgatatgagggcagcaatgctcatagcagccacctctgagcttgggctgtctgaacacctggccttgagccttctcgattgctacctgagccatatcttcagttcagtaagacaaaactctcacactttctatgatgaartagttgaaagaaaattttacacattgtaacattttcctagatggctttcttatcttttaaagatgtctagggaaggacgcccgttggcttctccttgtaagccatcccaatatctcacaaagtcatcaaggtttccttttttcccttccaaaagctgtttccaggaacagatttattcttgtattcagggcctccttcaaaatatacacagccccacggcctgcccttccttgtaactttgatttaagactcgcagttcctgagggcagagggggtttggctgagtttcccagctggtgtgtttacaagcgaaggatcctcctgcggccacgtacacggccagtgactctctctctgtggttgttgcactaattgtttcatgctcagataattatttccaactatcactttgtttgcttgtagtctctactgaaatcaaaggaatgactgaatgtgttaagagctaggatgtgctaayggaagtttctctgttttcttctgtgatggcttttggagcctaagaaatcagacgttgctgtttggaggccagggcgcagatcaaatgactactgtaaaaaataaagagatactgtttttatttgtttttttactttttattttgaaacaatttcagatttataagatgtgttaggttggtgcaaaatttcgccattaaaaattaatgatatttcaaaaataatgcaaagaactccctattatcagcactcagattcatcagttgttcacatctgccacatttactcttctgatgcatatgaatatatatgaatctataggaatatatgcatagaggtatattaataataatatggacatgttattattgaaccaattaagagtatgtggcagacatcatgccactttactcttgaagtaatctaatatatgtgtgtattttctaaaaacaaagactttttcttacatctgattttcaaaatcaggaagtttaacattgatacaataccattacctattctacaatccattttgaaatcagttgtcccaattatttcctgttttagcatttacttttttttagtccgagaatcaacctaggctcacatgtcacatttagttgttatgtctctatatagcctccttcaatctggaatcctttcttcgtctttcatgacattgaaatttttgaggactaaaggatcattttatagaaggtctgtcaatttggctttgtctgatgtttcctcatgactgcattcagatgatgcacttttagcaagacacctacataagtcactttggtcctttccaaaacatcctgagaggaggtgcgtgccgttgctatgtctcttttttggtgatgttagctctggtctggattatgacagtctctgccagattcctccactgtgaggctactggtcttcctttgtaattattaagtaatttatgaggagggcccttgggactatgtgaatttcctgttcctccgcagattttcacccatgacttttcgcatggaggaattctttttggatgttacatctattgtgatagggtttagaaagaagagcgtttggaggaagtccttattaaaggctttttgtccctgtttctaaaaccatggcgtattcctgaagaaaataggcattttagattatttaaattgagaatggagaagggagattgatttrtgtttaaatggcagtattagtatgtgttgtggaggttgggagagaagtgatttaaaagtgtagaaatgggagaaagaagcttgagtttgaccaaagaaaagggagtgaaaaaagtcttactgagtgtactcttgattggacactgtgaatgcacactaaattttcacaattaatcagattagcaaccaatcaggtttcacattttaggtatagaatcctggatggatctagaagggttctccagargtcatttgattcaactctttttgcccttgggcagtaataatcagaaatgttggctgggttgggctttccttccttttcaatacttccaggaaggagtgactcccattgtttcttgaataatgcagaactgggaacttgggaaccaaaaaataaatcagacaagatccatacctttaagaaacttacactcttctgagagggatgcctcacataatcattccacacctccatcaaaattctataagcctttaaatttacaattgatcctactgtttttggactgctctggactcaaaatttttttcttctcacttgatctcctatgacacataccttatttggcacttaacatccattgccccatattgttcattacactttcatgtggaactggtcttggtttgagatgaccatatttcattgcttctaagagtctgctgattgtaagatatacatttatttcatgtaatactaacactaaagagcactgccaattacattatgctatgccatctattggaattgcattttgatttcagatatgttagatgtggggaagtgcatatttgcattgaggaaatatggtataaacatcagcagcaagacccatcatttgtacttgttcatttattctttcatttatttattcattcagatgtaaaataatgtgacactttctgcaggatggtacaaagaacccctttagcactgagccaaattacagtgaataaagaaaaaaatggaattagatacacttgagtttgaatcctagttttccattatttcctagctttataatactcatttaacttctctgttttctcagtcctcatctataaaatagggttaataatactcatcttgtagtgctattgtgaagattggaaataatatttgaaaactacttagattagtgtctgacacataacactagtcttattagagtagacactcaataaatattaataaatagattggcttgtaggcatgcaattaatctgctttgttataacagtggattacaactgggcattccttttgatgtctaaattgcattcccttctgtctaatagaagccgttctgttccatttccagaggagatggggaacagctggacaccatccctttgataaagtctgaggacagaggtggagtcaccctcacatgagtcaccttacccatcccagtgtttgacatttgggggctatttcttttttgtccccttgggcagaccaaatgtctgctcccacctccttgcagtcgcttttctggctgtgaacgttcatgacagggctgggtgctgctgccatttggatttgttgaccagctacagtgattttcctagcatgttccaagctctctgaaaaccatactatgcattttggtccctggccgttcttttgtttttttccttttcatttaaaaatctgtatgtgtttttctggcataaggagaggaagatgggggtggggaggtggaatcaaatccatatgtttgtgatgcagttgccctgaaataataagaaagcattgctgggaaagagcctttggatgtctcaggaaccatgtttacaagccccacattggccttttggtcccctcagttcatgctgccacttgccaggctttgaaaggaccaagttcacatggggacactactcttctttcttctcctgattttttgcagcctttgctcccaatgaccttgtctctttctctgtatcatcaacatgaggtgaaggacaaatgcttgaatctttacttctctgcagagctcaatgaggcatactgctttttgccgccctatgacctcactatctgagctaaatatcatttcttcttgtcatctgtaatgctgacaactcttggttaaagctggtgcctcacctacagctaactggaccctgtaaacttcttgtctgttaaaaagtggcttttaaatttcctccaagctcaggctcatatcagtttccacatttaattatttttaagctcattgattttcttgcccctcaatatttattctttgtgtatttgcacatacactgtcatatgtcccaggttctgaaagaacttcaggtaggtttaaatggagggttcgtgacccttccctaagatctagaagctgagttctttggagcctgtcaaatgtagaggctcctctcctcgaactttggagttgtcctccaggttatggcattgttctgcccccatacacctccagagtcaggccaaggttgagaaagtgtgtgaccacggacttaaccctcaagttctgctgaaattctacatgtagattccaatgagaagaagtcagtgagacccagactgtatctaagatcaaaggagcttctcattctctagtccttacgttaaaatatgctaagagaaagctcatggccgagtccaggcaaaggttactcacatttagattcttccgggtaaccaggatcctggtgacagaaactggtaccgtccctgaatggctttcttcctaaatgtctctcatgcacatcagctgatgcattcttccacttgccattacttgacacgtggaagatgctcatgtcacacattcatttgttcatgcattcaataggcatttgtcaagtgcttggaaaggacagggccttgtacaatgcctgtgtgggaataaaaagatgtataagtccttgaggtactttcaatgaagccaagtagacaagacacaaccagttacataacaagagagcaggcaatggtagccgaagacctggtgtaagtctccatattcacctatcacagctgcttggctctgagtcagtcgtcgaacacctgtgaccttcactttcttttacaaagagtggttgggaagattgcatgggatagggtgtgcacaaagtcagtactgtggatagcagtgataaaagagtggtaccatgcatcagaagtargtcctagaatgtgacaggtgaggtatggggacatatgttcgccaacagtgctcattattgatgcgtggtctgaggaaggactgattggtttggagatagagggtggacttttttcattaactctcgtgtaaatagccttggcaggcctagatcttcaccctcaatcatgatacgtgaggatgggttttagctggtgttggtattgacagcttttagagctgcttttgtgtcagtgtttaacccacactcctctgtttactactgccctttactgtcagcacagcaaaaactgtagttggttctgggcaagacttcaggtaggaagggtttctgcaccagtacacagtctcagaggcaaaagaggtctatcatggagaaattagaaggagaaaattgttctgacacacatctaaataaaagattkatgcactttgggaggccgaggcaggtggatcacgaggtcagaagatcgagaccatcctggctaacatggtgaaaccctgtctctattaaaaatacaaaaaattagctgggcgtggtggcagacgcctgtactcccagctactcaggaggctgaggcaggagaatgacgtgaacctgggaggcggagcttgcagtgagccaagatcgcgccactgcactccagcctgggcgacagagcgagactccatctcaaaaaaaaaaaaaaaaaaggattgatggtgctcaggaggatgcatcttgatattcagaaaaatcattgagaagtgtttcatctttattcttgtataatttttaacatgactcatacgggcatatgtgaccttttgggttaagatgagacaatggagattgttcttgttttgtagaatttttctctctctctctctctctgygtgtgtgcacgtaattatttctattctcttatccgttagtaatattctagtggtagaaaagggaggtgaaattagcagtggaaagaaaaagtttggaattggcaaaaagtagggcaatggaatagatcagaggctctcaaaatagactcgagttggaaacccagatgtgtagctaactgcatgtgtgaccttgggcaagggatttagcttctttgaaaatggttttcctgatctgcaaattgggggaataatttctgacgcatagagtggggattaaaccatctacgtatgtaaaaaacagtgtaggtgctcaataaatgttctttttctttccttgcttggtggaggaaagggcgacaaattttggttaaaagaaagtcatcaagaagagatgcaatgcctaggtgcagaactgacagggttatttctaaggtgagaaatgcaccttgaatttgaaagaagtatgaatgagggctcagttgaaatttcacatggatgaacctgggggcaggacctgggctttggaagttcaggatgggcacagcctgtctctgtgaagagcagccctgtccctgggagggctgggtcctgacgcagctctcctagaggttccaacaaggcatcaggtgtccttcggaaacattaacaccaacattgcccgtgagcttttagcaraggatgtgctttgtaccaaggcatttcttcatcaaacttttcccataaaatataactctttccttagcacaattgttacacatcctagtgctcttctttctttccccttgaaaacactgaagaaaaacttttttatttttgagatggtctcacactgtttcccaggctggagtgtggtggtgtgatctcaactcactgcaacctccccatctcaggctcaaggcatcctcccacctcagcctctgagtagctgggactgcaggtgcatgccaccacacctggctaatttttatggatttttttgttgttgttgttgacgtggggttttgcaattttccctaggctggtttcaaactcctgggctcaagcaatccgcccaccttgccctcccaaagtgctgggattataggtgtgagccactgcgtcctgcccaagaacaactttttgtcataaggtggaaaaggtttattattattattttttctgccatgcccacacattatggaatagcaaagtcaaagaattcttcaagctcttctcattctagtctctggctgcttttcagtttggaaggatgtggagcaagaaggccacagtaattcatcttggaatcctctgctttggagtttttaaagcacttttcatatgctgtcttcgtgaatattcacagcaactcaatgagataaggtcattttcatttaacagtgacactaacttgctgggggacctgaaccagggccattgtatgacagttgtgcaggttgtgcactgaacaaggcacctgaccaagggagtgtgaggggttagaaggcatcccatgctcactcaccaagttgtgagccttggtgcctctttctcattcctgctgtagggggcggtggctcagccttggagagaacctttctgggctttggtttctctccatctaccaaataggattactttttgaattcttaagctagaaagattgtgaatttttgatccatttccccttttctaatccataactgaattaggaattagcacgatgataaagatgatgatgatggtagctaacatttctgagtatttccatgtggcaagtgctgtttcaagcacttaattaactcatataaatcttctgatctaagatccagtttctaattgcggctctgtcttgctgttggtggtgattttggacaagtcttgtaatctcccttaggctgagttccccaatccataaaatgaaacaattataacagacaagtagtttctaactcccctgacccctttttagactttagaatcttggattatttagagacttggcaaggaagaggtgacatgctcaaatgggtaattgaggactacaggaaatcaacaaaaaatggggaagcaacaatgggagggctgttaacacctctggcaggaagggacaagagaaggagtgactacagaacccagagagggctgtagccggagctggtgcatgggagaaaagctctgacagaagctgtggcacccactgccaaggcaggacttcatagccagggaactggggaaatcaacaccccactctctttactctcccatccgctgactcctgctcatgcctgctattagccagggagcctggttgttgcagtccacagacatcagcctcctggggcacaggccaggtggagcaaggcagcgaatgggtcagcagctccacacaaacccccttcttgacagcacgtgtttaatcccctggactcccttgggagtggctattaacatccatattatgtggtatatgatgaagaaatgattttcagcaaaaatattttaatttagatctatatattaggggatattgtactgtaaagttcacttgcatacagtcttttataatattcactatacataaaggcgagtctatccttttcttttttgacaagtgtggcacatgctgtttatgctatcacattaaattatgtaagaaaaaaacaagatgttccaacaaatacatttttaaatagcagagtatatcatctttggtttgggtaatgatgtatataaaaacttagattaaaatttatcatcatattacagcgaaaaattagacaaaatctactattttcacatgaaatttgatatgtttgccccttgagttaaacatttaactggtttttaatctaataattatcttttattcccaaaagataagctgaaagagaagatttaggcgactacggcaaggacttctgtgtagattacacttggtaggtggagacaatctttaccaataatgaaaagccagtcggatgtaattgatgtaataactcccttcccttttaacattgggttttcataatggaattctttctctgtcatgtgatacttttsatcagttgtatgcagtttatggatctgtgtgaacatcatctagaggaaaaatttattgatttctttcatgtcatttttttttgctctgcattaatatgatatttttcaccatcagtgttctttatgttttcctctttattaaaaaatctgttgtgggtaaaaagtaaagcaatattcaataatgagaataaaaacaatgaaacccaaaccaccaggctacagatgattgcagggctagctggggcatgaacatgtgtctctaatcactgtttgacatgtacttggaagctctcatgctgtttattaatgaacagatgatgtttaaataatttcttttattgctttttaacaaataaaaactggaacagataccatcgctgtcttttctgttgtgaatccccttttggaggtcacaaggttttataaaccattcaatgaagaattctgttttatttttattttttattttgagacagaatcttgctctggggtgccgtggtgcaatctcagctcactgcaacctctgcctcccaggttcaagccattctcctgcctcagcctcccgagtagctgggattacaggcacccaccaccatgcccagctaatttttgtatttttagtagagaggaggtttcatcttgatggccaggctggtcttgaaatcttgacctcaagtgatccacctgccttggcctcccaaagtgctgggattacaggcataagccacggcgcccagccgagaattctgttttagatgaaccttagggttatcttccatttttttataaaatagaaaataaatgataacactttttaagctgggaggcttaaatctacattatcatctacactgttacttaaaagacacatgtcatgggtaagcataggttgaaattaggtagctttgagtctgaattcttctcattagctgtgtgaccttacataatttactcaatctctctgagctgtgcttgcctcatgcacagaacagggataggctttataacccaccttatggggttttgatgaggatttagtcatccgttgaacaaatgcttattaagccactgctatgcaccaagcacattctaggcactaagaatacaacagtgaacagggcagaacaagtctctgctctcatggagcttacattctagcagtggagagggacaaaaacacaaatttagaaagcaatgttaggtagtgatcattgtcatgaggaaagacgaagcaggaagagaggttggggccatttgggatggggtgatcacagaaggcctctctgaggaggtgacattggagcagatggaggaggtaggggagtgagcatgagaagagggcacaaccatggcagaggcatggaagtgggagcaggtgtggtgtgtctgaggaatggtaaggtgcctcatgtagctggagcagagccaaagaggggccagatgcaacaggaccttgtagatcctgaaaagtattttgggttttcttctacctgtgatataaagtcagaaaatcatcctgagcagaggaagaaagaatctgacagaagtgtagtgaaaagattgcatggggcaagggtagaagcagggaggtctttgcagggaccgtgtttggccagggtattggtggtggagatggtgacacatggttggatttggtgtatttttgaaagtagcgtctataggatttactgatgaattggaagtggaatttgattttttaaaaaagccaaagatgattacttccatgtttttgtcctgagcaactagatgtggttctgtatgctgaaatatgaaagactggggagaagaggaattgttccagtgcaacaaggaaaccaagagttccactttgatcttgttaaccttgggacccttgttagccactcacggggaaatgtcaagtagactggtgggttcatgagattggaaaccaatgagctggaagaatatgattcactttgcttttctgtggttcccatcccrtgaactggggcaaatcatataactggcaaatggggtttcttggctattttagggtcattgggaatctatttccagtgctatgaactcctgtaaggcatttctctctgcttctgtcatgtggcctagtagttaagagcaggggcttttctccctcaacagattagagtttgaatattgggtctgcaacctaagggctttgtcaacttgggcaagatgtttcacctttaagcttccattctctcatctattaaatgtagacagtatctctccttctcgggctgccacacaggcttgtgaattttgtacattgcccataggtgcccagccgaggggttagtggaggctcaaacatagaccacactgctctccacgctttctgcccttaggtggggctgtgtataatacccagggaaaggacccttcacaagccatttgtttgcaaacacctgtatccacttagattcttgtgaggatcctaagggatcatgcgtgcaaaacattcagcagagtacctagaatgaagggtgcacgcagaaatggagcgattttattttactctgagatcttcctctccttctggatggggaggtgtggctgttaatggaggtccatccaccacccacggataggaatgtacaggtaggtagggagacctggaatcaggacttgcctttaccgtttctcttggattcagatgaggattctgccaatgctgtgactcggtttctgcctgctttgtttttcttgctgtaatttactttcctagctctcatctcttgtatgccttacttacttacctaagtgtcacttgcacctcatttctctggttcatcctgaactcagtgtttgctcgtctggcccctggctctctttcttggtctttgggcctgtttgctcctctgaatgcgtctgctgcttgcagagccagtgacaggccacgccaggccagccagtcctggttcctggtcccacctgtaccccatcagcctggctctgcagcctcccttgctccatacgatggctctttatttggaaaccttcttaaagagaggattggttggagagagggaacctcttcttaaaagtggcacagcacaggagagtgtcgtaaatctagggtcctctccttgcaaatggtgtgttttcttcctctgcctttctggaatttttgagcagttctcatcccatttgctgtgttgtttccagctgtcaggacataagctaagcccagcttccacagcgctgccatcccgagcccagccctcttgttactgtactttctgaactagctccatagcagcaaaatgtgctttttagcaagaggccttttcttgtccttcctgggaggatcaagaactcagagcccttgtgagttctcaagaattccccagttcttaagaactcctcagcccactgttgatctgaggagtggctactgtgtctgctggcccgtacccagctcaggggcagacagccagggtcctgctgttggttttggcagagtggtgacaatccagctgctgtcgttccacagccagtcaggagacctaccgtacaggcatgggtcagtccctcggtggccaggctggtgatgagaaggcaagagctggtagtagagggctgaggagaggggcccaggtctgaggggctgtggctgtgagtcctccgtgcacgtctgtgctcactggagagaagggccatgattcctgaattgtgggtcttgagaaaggagactgactagtggcattgtttaatgaatatgaaatrtctctgctcacaaaaattttgaaatcccttttgatatagactctcttctcttccaacaacacttctgctctttttccttttgcccctagggaaaggaagagaagacaaacactccctgggaatggggtggcgggaatatgacctggkgaaattcccaccagccaggaagggagaacaagcctttccaatgagggaagatcctcagaaggagaggaagagaaggggagggttgaggactgattattcttgcccttgggktgaaaccatgcggctgtgagaatgggtttggaagcaaggggaggtaggaacaaagatattttggggtgaatcctagggcacagtgtttgcaagagaacacccttagaaaattacaggtcctttagaaaagcccagtgtctggcacgatgttagggtgccttggcactgcccagatagtaggtcaggaagggtgagggacacatctcggtacacagacatgacatagtagctgcaccccctacagtccacatatggcgtctggaggatcctgaggttctcatgaacaagtggactggaaggggctggggtggaacaaggaagggacaccccagctcagcttcagagcagcagagacaagcttagcctccagggtctagacaagaaaattcccagccacagcctgtgggccagagaggccctccacttttccatcagaaggataaaatttcagttccacctgcacctagctgctaccttataaagcagatgggggggaagggcccatgcggacaagtagctcgagtcttgaattcacagaatatttatcccaaagagtttgtttttaaagactgagataccatcaactgtttcaccatctgaatctaatcctaattctaacttttaacttgccttagaaagtttgggaagcattagatgagatactgtgtataaagcatttcgcttaaggcttggcacatatagatgctgaataaatgtttcatttcctttctttctctccaatactcactccttattcaccatagtccatttatagtatcttggaggttgagggtggaggacaggaacatttgtgattttgcatgcagaaaccacgttggccctgtctcttaggttcaccaaggagagacttttgctgtcttgcctggcttcttctgtcattgggattttccaggctgtcttccagagaagcaagcactgtgagctttaattaaagcctcggaactttctctctggcatccctgcacctgcccatgacactactaagaacacccacatttgtttgcctttcatccgtctcctgagggaccaggaaagcctgacatctttctctaagtccagggaggaaggggcagggccagtggtcagcttggcagagttgagagcagaaattagccctccagctgacagggctggctctctaggtacacgccttgttggcaacctgctccatggtaatcatctcctgctcaactctgctcttctgatctcctgagaattgtgcagccattgttaggcctccatcctgccttgggctgtgctgccgaatgccagccttgcttttcaaggcttactgccttgttttttggaagccttgtcttttgttagcttggcctcctgtgcttccttcagatgagaactcacctcgcagsttagtctccgactgagccagagtgttacatatgcttgacctgaactgaatgtagtctggcctgagagcagagggacaaacaagatgacctgcagggaatctgctggtgtgcgtattatgtgactatgctgcctcttttaaaacttttaaaaccaaagtataatatacagatagaaaggtgtgtgtgccataaatatacagcttcctgcatcttccatgcaaccaatacccagatgaaggaaaaacattatcagcaccccaggaaactccagtccccatgctctccattagtgcctccctagggttggccatgatccaacttctaacgcaagaattattttatttttgaacttaatataaatagaagaatacaatacatatatactctggtatctggcttccattttcaacattatatttgtgggattcacttgtgtggtcatgtgtagttgtagtttgttcattctcattgctatataatattccattgggtgactataccaaaatgcatttatccattttattgcttataatcacttgggcagcttccagttgaggctgttataaatagtgttgctctgaacctccctgtatgtgtcttttggtgcacatatgtgtgtttctgttgggcatagacttgggagtagagttgctgggtcataccggatacctatgctcagctctagcagatgccacaagcagtttttccaaaatacctgtacctgtttatagcttaccagaactatgtgggagttctggtttctccacattttggccaatgcttggcattttccatcttttttcatttttgccactttgatgggtgtgtagagatactgcattatggtttaatttgtatttccctgatgattaagggagttgagcactttggctatttattgattacttggatgttgtttttcttgaagtattctagtcttctgttcatttttctactggattatctatttcttagcaacatgtagaagttctttatgtattctgggtacaaatcccttattggatatatgtatgcaaatatctgttcccattatgtggcctgtttttgtcactcacaacagtggtgtttgataaacaaaagttccattttcatggattttcagaatgagataaccagaagtgaacacttattacttgcttattgtgtccttgtataccttgctcattcaattttcacattaacgtggttttaaatgggaaaaataaagctgagagaacttgaggagagactttccaaagttaggaaacagcagaggcaagattcatgcccaggttttcccacaccagagcttgtgttctgtgatctctgttataccacaaaagataccaataccgactaatatctcatagacaatatccagttatacaattttttttttcaattgaattagttgctaatgtttaaaaattagaagtaaagatttctaacttttcttagcaaattgtaggatgtggcaacgctggtctcattttcccacaagtcaccccggactgctggagctgagtagttactgttcccgggtacctgggtttcagctttccaatcgagagatgctatgtacagttggttatgcctggtcggcttcaatcattttgttatctkcctggctcctgtgggcattggaatttttaaccttgctactgtttctcttaaatggtataattctttttctttctttgtttcttgcattcttactttaatgcattctgccctttcttccttccttttccaggtctctagactctgtgctcaggctcctggactgcctctctggctgatagcatttttatgggtagacagaatagtcaactgtttatatggatagttagaagagtctctcacaatatcctactccttcctttaagggatgaggcattgtatctctgtaaatgtaaatgttttcctgaaggaagtgactaagtactccagtaagctttaatttatcatatgggctccttaagcacaggcctaagaggcaaagggagaattttgtaaattgtgtgagtggagagagtgccgttagggaaatctgtctctgaacgatcgaatgcctcagatgagatgctgtggtggtacagcttcagagttggaaaaaagcaggagaacaggggagggcggggctgggggcgaatggtgatggcagtggtggtgttggtaatggatgggtagccatatgtagtcctgtccaattaacaaatttgccatgggcatgtctcatgcccaacattttcttttcttctctaaatccttcctggaattcattataatgtggaggttgaaagctggaatctcattagacttgttggatttgaatctcgtctctgcatcttaccagctrtgcaaccttgggttagtgaatgtttttgtacatcagtttcctcatctgtaatttaaggataatagcatactaccttgtagggctgtgagaactaaaaagtaagagaatatttgcaatttccttagaacacagcttggcaattagtcctcaatacacctcagttactattgctgctattactgtattgacatggaagggtcagatgaaaagataaaattgttgctctgccacgtactagctgtgtgactttggacaagtcgatttgaccagggatcttcagttgtctcatctcgaaaagatgttgtgagaattagaagtgaggttaagcaagatgatcaagatgaaagcattagggaagtttgtgtttgttacctcttatgtctctcctaccttttctcatcatttttcctcttccagagttagataatgtggaatagtggagaacataagatgagcccatgaaaagataactagcattagcacatcataatgaataaacaagaactgtactgatgtcccttctttcattcccagtactggtaatttctatcttatcttttattttcttgattagttttactgatcctttcaaacaaccagtttttagtttcattgacttttttctattaatttcattgatttatgctctaatctttattatttctttctttctgcttgctttgggttgaattttcacctcttccctaaagtacaaactttgattactgtttcaaaactttcttgttttttaatactacaaatatctctctacgcatagctttaacagtatcctacaaatcttgataygctgttttgttattttcgctgaattgaaaatatttkctgattttctttgtgatttcttctttgatccataggttatttagaaggatgttgtttaatttccaaatatttagggattgtttccagactctttctggtactaattattagtgttggggggaaatacaatttttcctcaaccctcatacatttgtagttgagacagatcaggtaacaggasacaaattaagaagagaaaagcaaggcatgattgataagaaaatttgcttatttctatagtayataccattttaatataataaccaaaattatgactaatagcattatgcgaagacatatcatatttttaggaatttcatacaatttctggaacacatgttaatatgctcacataattcaaagaaggttaaacatcatttcttatttgacagtactttccatgtaatttaacgtattaaataagcctattttaatagttattttttatagatcttttgagagttcttggtccctgtgggatgtcccaaagttggttcaaggtcaaaaatatttaattttgaatttgattttagaaaatgtttgtcaatataacaaaagtttaaaacacttgagtaaatagtatcaaaagttactatatcattcatttaaccagagtgacaattaaaagacttcaaggcaaatgcagaaattgacatagttgtatgaaaaaccttagctcttttcatattgaaaagactcagttttcttaattaaagacctaataaaagacaatatgaagcacaataaattattttggtaagacacaagtttttgtttracttaaaaggygaagaaaaaattttcgctatctcttatcaatactccaagaaagtcttgacagtttaaaggagaagatcaaattctagttttgtttcagtatacttttgatattaaggctcattttaatacctttataataaattcattcaattatagtcagtttgagcataagattttctttcactttctatctcttcccacctttctatcatcattaagttttatctatatcctttcttccttcattctgaaacaacctttaagtaatctctaaactagacaaaattactcttctttaacaaaaaactccacatgttcataccatttaacatcttactttccttttatatttgcatatagtgttgtttctcttatcattttatatacttagttagaaattttaactcttagtaaccttattttctagtgaaaacctaagaggtaaatagtttcaaattgttatgtaacattttataaatacacttttcataatttctagaaacatatgcttcctcttagaacaatttttcagtgtcaaacaggaaatatttactaacagacccaggtattttagttcctttgtaataagaagccaaaagtaggtaaagttaaaccttatgttcagcgattaatgtttcagtattttacttcacttggaaatgatctagatatgcaacgaatacccatcatttaatttaacttagcaacaccctaagaatgtagttaccgaagagatttgagaaacatctaaagtaaacatatcataaaacaaaattcttatttaaaaatacagttatacaattttattctacttacatctatttaatttacttgttcttaacaattatgcttggattactcatgaaaatttcataaaacatcaaagctagtcattatctcaaattattttcctgttaactatttttgcagcacatacatgtgagacaattattgccaaagcaagaactctgaagttaaatacatatttttgttttgttttgtttgctgctaactcagaagacagagctgttttcattaatctaacaatgttaaagtaatcttatttaccaaagagcacacaagtcatgtaaacttgaaaaacatttgggttagtttctatagttctagcaattttaggagtatttggtttatatgagtactgatttatcgctatgcccaactttaaaataactttttaaaaggagttttataccatgtaaacatagatgtacacatggataaacatatgtgaacatatagacagacacaaataaatcttatagctttcatttaaaaattttaacgataagacaggtacaataatataaagctcactagtttataaaagggcagttggatccaaattatgtttttgcacatgggataagttaaggttacctgcttagatggccaatttttttttacccatatctgtggagaatacattaaaaattgccatttgcycttgctaagtaatcttatgggggatgtggactaaatttggggtataggactttttatagcagttgatatttaaaataaagagcctttttccccctttcttcttttttttagtctcatatgggtgtagacattgttttagttaactccttagatatttacatttcagagacgtagtaagatttacaattccaagggactggaagaaaatgtaggttttctctaagaaggagttttggatgagtatttgcttattagagatctagggtaacttttaaagctttttttctctttaagtgtaggacagtctayggaattttttttttttttttttttgctgtgggggtccaaaatttgggacgtcctggagctgatgaagttttactacagagccccacggaagtaagaggagttgtaaggtagagcagagcctgccaggctgcaagtcccctgaatccgtgttcgactgatttcctggctgtcaacttttacacaagtaacctgtatgcctggagatcaggcaagagtgctttttgtaaatcttgcagggaagttaaagcgagcagttgaacgtttaaaggattttctgggaaagttggaggagttttaggtgttaaaggaatctgttgaggggatgggaccagattttgaggagagggttaagtttaagctaggggtccagatatccagaagaccttctggagggccagggacagggaattggagataaagggaggttagaagtaggtggagaaggaggaattatagtggatgtgtaatttggcttttgttctaatttctattctttacatcttttttaaggaaacccctaaaagctagcagttacactcttctgtgtcctcttttcaattagatcttaccataggtaccattaagatagttgtttgggatgagagctctctaaaaaaatttctttttaaaatataaaagttgaaataagattctattcactgttcttactctttagtccttccattaaggtggacagagctctcatttccctcttgtgttttatctcacaggcttttgagaaatgaaatatattgctccttggtagattgcatttttctcctcagacatccataattaatattatctaaggggaaattgctttttagaggcttaactggtaatttacaaactttataaacttggaataaaaaatataatgaattggtaaattttgttttcaaaagaaatcgattttaattttaaaagtgatttattaacaaagtagaaacatttaaaatacagaaagaaatgcagaaataatggtgatggtgtttcagaaatggtgattgagaaagcatactttargtagtgaattgccttttaaaggaattaatagcaaaaatatctcttacytgtcattgttttcaccatttccggtactctctatttcattgtgtagatccaaatttctactgagattatattccttttgcccaaagatctttctttaacatttcttacagttcacatttgctggtaataaattctcttggcttttactccctaaaatagacattgttttgccttcatttttgaaagatatttaatttatatatagtactctaagttaatagttttttttctttccatactttaaggcagcagtccgcaacctttttggcaccagggatcagtttcgtggaagataatttttccacaggctggggacagtgggagaatagttttgggatgaaattgttctacctcagatcatcaggcattagattctcataagaagtgtgcatcctagatccctcccatgcgcagttcacaatagggttcatgctcctttgagaatctaatgctgctgctgatctgataggaagcagagctcaggcagtaatgatggttcactctgctgctcacctcctgctgtgtggcctggttcctaactggacatggacaggtaccagtctgtggtctgggggttggggacccctgctctaaggtgtcactttattaacttttggcttgcatagtttctgccaaaaaattggttataaatcctatataatgactttgatcttctgttgtatctgatttccttcccccacaagcttaattaaaatttttctctttcaatctttggttttcggaaatttgactatgacgtatctaagtatgtggggtttcatttttgtttttgtatttattcttcatgggttctctgaacattgttgatttgtgttttgttgttttttttttttttgtaacttttggaaaattcttagccataacatatttaaatattcttctctgttctttcttttatccttttggaactctaattacatgtgtgatagatcctttgatattgtcctgcagctctcgaatgctagatttgtttttcctcactcttttttccctttgtattttcttttgatacatcttttgtagtagattctgctttaatctattaattagagttatttaaaaatccctattgcatcattctgacatctgaatcaagcttagcttcattgattgccttatttcctgacaatgggattttattttattttatttgtttattgaatgccatacattgtgtataaaatgacagtggaaactgaggtaagtagtattatgcctacatgcctcttccattccatcaggtcagtagtgaggagagttgagtcaatctagttgagtgaggttttgttgttgcaagagtcacmttcagtgcactgcactacaaacttcagattccttcagtgatagtacgctattaccttatgctttgtgtgagccctggagtgctgaattggtcctcattgtttctttaccactctcagatttcagcagtccctgcatgcctgtgccacaatggggtatttctccatgcccctcccgctcccctagaatcaggctgttgatgtttgttgctcagtgataaatggagcttatcacttgtttactataagtggggctgtggagggaaatagggcagttttgttctcatgcctatctcagtcttaggcaggctctgtgcactcaagcctcagaaatgacggtttcttagaattcatgtcctccctctgcccctcacaattaaactctgtcctttactggtacagattcttgggtgggagacagtttcctgcccttcctcagcagtaacagacttctaatttgtaattttgcagaatctcgggcctaggagagtttccaccctttccaccaagtaccatcggctgtatgtgcaacccatctcgggcttcagaagcagtgggtctttgcctaggtccttgggtcaggtcccttcttccgtttaaggctttcgatttgaataagagaagattccaggaagtgcatggtttttcatacctgtgtgcaacttaaggggactgactctctttggtctcttaccttacccattatcttccttatgaggtctatggaaatgaccttgtgcataagggcaaactgctcttgtgtttgaagcttccagttattacactctgtcatgctaacttatactcatctttctgaatttttaaaattttagctatttcttcttacttttacagggactatcgcatcctcccattctctgtcaaatgtaaaactattcacatatcccagttttccctggacggacttggcatttaaaaaaaattcagttstcctggttaccttacaacttcagctctctgatgagctcaagcaaagttataatttcacagattatccagatttctcttgttgttaggctgggaactatattctcttgcaattgtctgcatcataagtggaagcagaacctgtggtggtgggtaaatagatcctattcactgttcttcttaccctttagttcttctatcaatgtgtggacagagctctcatttccctcttgtgttttacgtcacaggcttttgggaaattaaatatattgctccttggtagattgtacttttctcatcaggcatccatagtcaatatttatctaaggggaaattgtattttagaggcttaactggtaatttacaaactttataaacttgtaataaaaatatatgagttggtaaattttctttttacaagaaatcacttttcattctaaaagtaatttattaacaaagtagaaaaattttaagtgcagaaagatagaaataaagaaatacagtgacatcagcaagatggcaaaatagaaagtccccaggcctcacccttctactgaaacacctgtttagcaaccatctatatacaaaatagacctttatgagagctctggttttcaggtaagaggttgcagaaccctggtggagctcaagacctagaaaaacttcactgagaatgcaggctcatgctttctggcagcagaaccaccagccatgggcctggaagcagccttgctcacttgaacacctagtgacagcactgcctgttcactgctcataaggaactctgcccatatacagaccctacaggaagctggcttcccatgtccccaatggcatgaccacttccacagagcaggggacttggtgacagacccacccactttcccacagacccaggggcagccctgctcatctgcccgtggacccatcagcaaacttgactgctcatggaaaccaaatgcagccctactctcatgcagatctcaacagaatctctgtctgtggcgcagcagcccagtcctctagtggaccttggaagcaggcccacctgcccacatacccagcagcaggccagcccacccacagactctggcaacaggcccacccacggaccatggcagcagatccacccttggaccccacccagcttaagtctgcccgcaggcactgcctgcttactctggcagctgatccacccataatctctgaccagcatgactgatgaaggtctttgcctgctgaaagcagtcagtaagaactggaagaggtgactacttctcaaatacacagacaccactctaaggctacaaggatcacaaagaatcaggaattctcgatactaccttattaggagctgaaaaagactccagtaacttaccctaaataaattgatatccataatctgcttgacaaagaactcaaaataattgtcttaaatgagctgcaagagaacagacagctaaacacaattaggagtataacatgtcaacaaaatcagaagttcaacaaacatatagaaataataaaaaagagccaaagtgaaatcctagaactgaagaatacaatgactgaactaaaaaacttaatacagaacttcagtagcatacttggtcaagcagaagaaagaatcattgtacttaaagacaagtcatttgaaattatccagtcggaagaacagaaaaaacagaaaggttgaaaagtgaagaaagcctaagatcttatgggacaccatagagtgaaccaatatatgcattctgggagactcagaaggagactaaagaaagaaaaagaggaagaaagcttattaagggaataattgctaaaaactttccaaatctaggaagagaaatgaacatccaaattcatgaagtctcaatgtacccaagtacattgaacccaaagaggttaacactgagtcaccttaaaattgaatttgatggactggattaagaaaatgtggcacatatacaccatggaatactatgcagccatacaaaatgatgagttcatgtcctttgtagggacatggatgaagctggaaaccatcattctcagcaacctatcagaaggacaaaaaaccaaacaccgcatgttctcactcattggtgggaattgaacaatgagaacacatgaacacaggaaggggaacatcacacaccagggcctgttgtggggtggggagaggggggagggatagcattaagagatatacctaatgtaaatgacgagttaatgggtgcagcacacgaacatggcacatgtatacatacgtaacaaacctgcacgttgtgcacatgtaccctagaacttaaagtataataaaaatataaataaataaataaataaataaaataaataaaaataaataaatgtaaaaaagaaaaaaattgaattctcaaaagtcaagtagagaattttgaaagcaacaagaaaaaagtgacttatcacaaacaagggaaccattataaggctactagtggacttctcagcagaaaccttgcaggtgaggagagagtaggatgatatattcaaagtattgaaatttawaaaacctgccaaycaagagtactatatctaggtcaaagaataaatcaaaaaaggaaattagaaaatatctcaagacaaatgaaaatgaaagcacaacatattaaaacttatgagaggcagcaaaagcaatactaaaaggaagtttatagtggtaaatggctacatttaagaagaagaaagatctcaaataattaattttacatctcaagtaactacaaaagaagaaaaaactaagcccaaaattagcaggagggaagaaataatmtagattaggggataaataaatataagacaggatatgaaaacagaaaaacaaaaaattgatgaagctaagagtttgttgacgaatccttagttagactaatgaaaaggaaagaagttgcaaataaataaaattagaaatgaaggatgagactttgcacctgatgttacagaaataaaaaggaattattatgaacaattatacaccaacaaattggacaatctagaataaatggataaatgcttagaaccatataatcaacaagattgaatcaaggataaataggaagcctgtacagaccaatgacaaataagtagattcaagcaataattgaaaacaaacaaacaaaatgaaacaaaacaaaactctcagcaaagaaaagcccaggaacagatagtttcatggatgaatccttccaaacattcaaagaaaaattaataccaatacttcttaaagtcttccaaaaaacaggaaaagaggagagacttacaaattcttcctgaggcaagcaccaccctgataccaaatccagacagagacactacaagaagagaactataggtcaacatccctgatgaacgtagatgcaaaactattcaacaaaatagtagtaaatcaaactcagcagcactttaaaaggatcagacaccatgaccaagaagggtttttttccttgggatacaaggatggttcaacatatgcaaatcaataaatgaagataaaaatcacatgaacatctcaatagatggagaaaaaaaatggacaaaagtcagcactgtttcacgatttaaaattctcaacaaattaaaaatagaaagaacttacagctcaacaagttaggaatggaaggaacatgactgtcaatgaattaggaatagaaggaactaacatcaacacaatagaagtcattcatgaaaatctcatggctaacatcatattcaatagtaaaaaaagttttttttctaagatctggaataaggcaaaaatgcccattcttacctctcacattcaacgtggtatttctagcaagagcaattagtcaagaaaaagaaataaaagctatcaaattggaaaggaagaagtaaaattgccttagtttccagatgacatgatctcatatgcagaaaaccctaaagactctaccaaaaaacttttagaaataataaattcagtatagttgcaggatactaaatcaacmtgcaaaaatcattttcatttctgtgcactaacaacctatctaaaaagaaaactaagaagaaaagtaccattcacaatagcaccaaaaagaataaaatacctaggaataagtttaaytaagagggtgaaagatttgcacattgaaaactataaaaygttgataaaagaaattaaagaggatataaataaaaggaaggtgtgaaaggaaaataaaaacttgggaccccaattcactctgccaaaatgaaaaaattaagctgaaagctgagtgatgcaagaagctgccctcccttttgttcctaagcagacagctacagataaaaggctaaatatctccacaggcagctgctctatgttcaccttatattaagtgccgatttgctgagcacaagatgaatacttaattgactattctgctacctgctcattttctcctgcaacatgtggatgaccataccataccctccctctttcccctccagcccactagcccaatatttcccctttaaatattgaagcccttaaattcatctttggagaaaggcaccgatgaatattgaaacccttaaattcatctttggaggaaggcacagaccacagactgtttctgtgactctgtgtttttttcttccaggcatgtccttaaccttagcaaaataaacttctaaattgattgagacctgtctcagaataagttttggtttacaaagtataccttgtgttcatggagctgaagaatcaatattgttaaactgttcatactacttactcttcaataaatgatattgggaaaactggatatccacatgcatgagaatgaagttggacccttattttataccatacaaaaacccaacttaaaatggattaaagacttaaatgtaaaacctgaaacaatagaactcttaaaagaaaacaggggaaaaaagcttctacacattggacttggatatggcacagaaagcacaagcaacaaaagcaaaaatagacaaatgggaatatatcaaactaaaatgcttctacacagcaaaggaaacaatcaacagagtgaaagtcaatatgsagaatgggagaaaatatttgcaaaccatatatctggtaagggattaatatccaacatgtataaggaacttctacaattcagtggcaaaacaaagaaacacacaaaaaaccaaatagcctgataaaaaaattaagtaaaggacctaaatagacatttcaccaaagaagacatacaaatgaccaacaggtataggagaaagtgtttaatgtcacaattcatcagggaaatgcaaatcaaaaccacagtgagatatcacttcacacttattagaatgctattgtccaacaacaaaagataaaaagtgttggtgcagatgtggagaaaagggaacccttgttcactgttggtggcaatgcggtcactgtggaaaacagtatggaggttcctcaaaaaattaaaatataattaccatttgattcaacagtctcccttttggatgtatatcttaaggaattaaagtcaacatcctgaggagatgtctgcactcctatattcatagcagcattattcacaattgccagaaggtataagccacccaagcatccattgacagatgcatggataaagaaaatgtggacacacaatggatattattcagccttaaaaataaggaaatcctgccatttgctgcaacatggatggacctggaggacgttatgctaagtgaaataagccaggcacagaagcacaaatactgcatgatcccacctctatgaggaatctaaaaccgtcaaactcatagatccaaagaatagaatagtggttaacaggggctgcagagaggggaaaatgaggagatattggtcaaaaggtacaaaatttcagttacacaatacatatatgcccggagatctactgtataatatagagcctatagttaatgatactgtattgtatacttaaaaatctgctaacagggtagatctcacattaattgctcttaacacaagagaaaataattttttaattaaacaaaacaagggtgagagcaaaaggaaacttggaggtactggataactttatggagtgattggtgatgttctcatgggtgtatacttatctgcaaactcatcaagttgtatatgttcaacacgtacagctctttgtatgccaacatacctcagtaaactggcttaaaaataaagaaataaaaaccacccataagcccatcatccaaagaaaccattactaatattttattggatttcttctagtcgtttttcartaagtgtgtgtatgttggtttgcatacccaagtatacatgcccaaatatatgatctgtgtgttttgtttaaataagctagttccaaaaaggtgtgttttcttatgggttgagtgctatggcacttatgaaatgatgatgtgttattcatgtttggtaaaggtgccaaaatgtgtggcatatttttagtttgctgttggggctggattctttctcttggctagctatttcacatgaacagccaagacaggtgtgtgaatgtgattccaatggaatgcacgtcattccagaaaagctcagttgttgattctttgtactgaagcctccccttccccgtgcaacctccatccctttgttttcgtcacaagaggaatgaatatctatgttgacccacccttaggcatagaacaaacagaaataaggaaagtatatgrtgttcttaatatgtgtttcattttcttttctttcttttccagaaagtattttggagaaaaaattggactgtattttgcctggctgggattatatacatcattcctcatcccatcttctgtaattggagtgattgtgtttctttatggatgtgcaacaattgaagaagatattcccaggtaaatcagttttaaagaaaagggctcagttgccatatgttaataatttggagtttcatcccagtacaagtacatttcacatgcctctttccaaagccctcaccctctatcattctccttcgctatgacacatgtagctttcctccagagacagatctaggagctacagattctgggaatggcttcagagccatgctaggcgaggcctacttcctcttctagtcaagctcttctccagggcagggggatgtgtctgatgtgggcaggcagataattcctggtaagaaaaatcatgccagagaaatacttttttcctctctctctccacttcatcacttcttttacctctggtttcccataagacccaaggcaaggtgtggggagtgacactgagtagaaatcacatctgtgtggtcagatgatgctagaataaagcaagctgagaaagcaagcagctctaatgctgaggaaggcacagcctctgtttcaggaagtcagaaactgcagggaggaatagccccaaggcgggactcttggagcgccaagagatagaatcaaagctagtttttatgaggaagagagaacccacaaaggaaatatgggatgagtatggtggctcacacctgtaatcccagtgctttgggaggccaaggagggagtattgttggagcccaggaatttgagaccagcctgggcaacacagtgagacctcatctctaaaaaaaaaaaaaatttagctgggcttggtttggtggcatgtacctgtagtcccagctaattgggaggctgaggcaggagaactgcttgagcccaggagcttgagcttgcagtgagctgtgattgattgtgccactgcactctagcctgggcgaaagagcaagacccctctgaaaaaaaaaaaaaggaaaaggaaagaagcacttagactgacaatgttatatattagccatgtgactggacagtttactccctgaagcttagtattcttggctgtaaaatggtaatcgcgacgcctaagtcatagtgttgtaaggattaaaggagactgtgtctggaacatagcagaagattaataaataattgttgaataaatcaaaatatgtggaaataaagtacaaggaacaaaagagacacttagctaatatttagaatttaaacactcttgccatcttcagaattgtctttgcaaactgaagcatggttagtatgttttaatattcttttggatgcaagtgatagaaatgcagcttgaactagattaagtgaaaaagaaaatttattataagcattcaaggagcactggaatagggactccatttatctcctgcctctgactctttctagcatttgttggttacactacatattttctccatttggattaaacattgctgctagtagctcatgggtgttacaccttagagctttatactcgattggtctcaagtgaaaaagtactatgactctgtttgacttaggtggaggccccgggccaattcattgtggctagggggcaggatagctttgtaccaacttgatgttccctccataggcaggtggatgaggacactgggcggatcattagagttgggggtggtaatggggaaagtagtggccattctgaagaaaaaaccagaaactgtgcattttaggaagggtatgcgtgcatcagtgggcagaaacctgcttcctggctcacctgcttcctgcctactggtgcatactctatagaaatggtctcacaaatcagatcacctggagatgatgttgtcaatatctagaataaaactaaatcaatgtcaatctatgcaaatggtttgcaaatcaaatcaactgaagattatattgtcaatatctagaataaagctaaatcacttgatgtaagagacaagagtttggattttttggtataaaactctagtatcaattgtcaagtgttttgttttgttttttttttttttttttggagggtgaagggaaaaaggaagggggagaggggagggagggaggccgagggcaagtgctcttgattgggagttctgggtcctttatcacaggagatgggttattagggctgtgttttccccagtgcatctagcatgaggcatgagggaagagctaatacttatgaactatctaccttgtggggggcataatgctaggtgattgttataaactagtttctttgatcctgtaagagatcaatgttatacacgccgtaaacaggcattattatttccactgaacagagattgagaaacttatgctacatgaggtcacataaattgtccaatatcaacaactaatagttgtcagtgctgggagttgaactctgttgcctcctgttccaaagtctttgctttttctaataagcagagaagttttccggagggctcatatcctccttcacaactcagtagcttcacgtgggcttgcctgggtgtgttctaagaaaacatggcttttgggtttcccttgccagttgtgatccctagacatctggcctcaggttgaccaagggtggaaaaccccataccgtgccagtgcagtgggtggggcaccagtgggctggtttatatcaggatttagaacttgtgccccgggtccccacatggtaatacacgtggcagcaaccactacagctggaaaggacgtggtctgcacatgctgcaacgatagacgtctatgcacagatgcacacagcccacgttcacacacactcatgcacgcgcacacagatgtctacacacagacgcacacacccacattcacacacactcatgcacgtgcagatagatgtctgcacacagatgcacgcagccacattcacacacactcatgcacgtgcacatagatgtctgcacacagatgcacacagccacattcacacacattcttgcatgtgcagggatattcaagtgtaaaatgcagtcgttactgcggatgtgtcacattgcctgtcagagtggatggtgttctacaactgtggatatgacaacaaccactggtgggttgtggaatcaatttaatgggctttcaagtggactaaaacaagatggggtaagataagctagaatgcaataaatattagtattcattataagaaggatgggtaagtgttgcttcattagattttgtttcatttttrtaagtgtgtttgtgagagtgagggtatgtatttgcatactgaaatctgatgtaacagattgttttaactgtaggtcacagtcaaaaacgtttaaaattactacaaaattgaagttttggatgttgttttttcagactcaggatggggcctggcaagtcaggaaggtgtaaatactagaaaaaagtaaacattttaatagatttctttaaaaacagaggaactgttttttaaacataattgtaaattcatcagaagtccaacttctgtgggtctgatggaaactcagaaaatgccactccttataaacaaagggatattctctaaaaaccaatattgaatctaaagaaatgcatactctaagggtttgtgtctttcagccactcataactgtgattaaaaacttacagtattcctgggattattttagaggttgctaattttgtcatcaagcctkaaattcactctgtctcactttttaaaacctttttattttgaaaaattttagattcacagcgcaggaacttgcaaagatagtacagaggggcccagcgtgcacttcttctagcttcctcccgtggtttcgtcttatgtaactacggcacaacatcaaaaccagaaaactgacattgatgaggtggagctttaaatgataccttttattcccagtaatttaactttgatatgtgagatataagcataagcctgtaagtaatacttccatgcgtgcatgatacctctatagaacttccctgtctctactcaccaagggattgatttcatttgttaagcacttacatgaacagagaacactaggacattttttaaaaagctgattaatctaaaccatattgaaaaaagattggttactttaggtctgagaccttaatagcagctgtttagtctgaatttcctgaatgattgcctctttgtaccttctcccgttgtgctaacagggctctgaatcacctaatccatgagcaatgatttaccctgaagaacattgctcactttagggtcttggttcaatggactgtcaagccgtttatcaagcttcttaggctttctggagaaaataataaatcaaaggaatacagcattggatttatagccacagttacttctcactagaaacctgtgtattgtacagcttagtgaataccctagacctgatttccattctgggcaggcttccctcatctttcagcttgtctagaggcagcctctctcacaaaatacaaagtcatttcgatgtcattcttagccagaattcctctagaattctgttaaaattgattacatcaaaaaccccccaatacatatataaagcattctgacttcacatttaaatgatttgaggagaatccataccatggtggctgccatcttgtacaaatgatggatagttgcctgcactctaatttaaagaccagcaatttacacagcacttaggtttcaaagtgctttgcacccgcttggctgctaatacgtttttcattcctgaccttttagcattgactagttccaactaggattcagttgactaggtttctgtctctcctcagtccatgcttaaaagaaaaaaccgctaagttaaatgaagtccctaacacatatacttgaagagcagcattgaggaactcatatgttcttggacgtgacttaaaagcgaacgtcttttactagaatttatacagacaagtgattttctgtgtaaatctgttttttaagggggtactttcctctctgaaaatagcaattccttctcaactacatagcaaacacaggtctgacccagaagacataaactgggctctctagtcacccagcagaacatgcccaggtgaaactagcacagctgaatgtattattaagatatgactatttaatattttcgacgtggatgagtcatttttattgacctttgccagcgagtcagtggaggaactggggtttatcctcagggaccgacaatttccattctctcacacaggaggcctttccttcctgtggacttagtagctcattaaaaacagaagcctagaaactggggcttgacagcaagtggcagccctcagtaaatctgccacccttcaacttcttaatgaagggggaaagagacccaggcatcctttggctttggaggtttcctctgagcactggctttagcacacagggcaccagcttgctctccctagcagtggctcccacttgtgagccatgctctctagcgccctctgctgcttctttctgttggaaacagctgtggttctcagtgctggatcccctgcctccccatcattgtctccagctgccctgtaagaacagccagtgctttgctttcgtgaaatcttaagttctccaccctttccccctgaaccatgagcttaaccatcctcccatctccctgggagaatattacacaacagagggatgagttcattcatttttcctatcagtgtatggtatagagggttattgggaaagtcagtcagggctgattctttggttcttatttccaagcattcatatgagcctaaatctgttggatacagctagtcagctaacgaatgaatggaatttcaaatatattcctcagtccattaaatggaaatacactaagaataggttggaatacaggccattagagattatttggttcatgctccaagtatcaaagaatctagatcttggaagaatttgccttgctctttcattctccctaatcttatttcatggttataataattcttattaggttgaggttattaatctccattctacaagtggctctccagctcatgctcttagaaaagggctttccacccagatctactccgttcttccccatgtagaacttctccttctggaggtgagagcatgcacaggtctagccacacactmgtgtttgtttctacttgggaccagtatcacctgtttgtgagacagccagtaggctttacaaaaacagcctagactgaagaatggatgatgaaatccagcttcaggctgtgatttattcacaactgtggatgcatcccattccaccaacctcatggaccccagatgttctgaagggactttatgaggcatcatttaatgctcaatgtctctgacagatctcactaactttccagggcacttgtagtgacagggagctccatatcccatcttttcattgttgtttttgaacaaagtatgagtaacactctccaggtgaagaatacaatgctaacttctttaacattccttacttatggagttgaaaaactcaaccatagatttggaaatgggagctatttgggggatgtatttttcttggagtggaccatgcttgagctccacctgacccaacaacctccatctattgcagcagagagatgtgtgaccagcagaatgccttcaccatgtgtcccctgtgtgacaagtcctgtgattactggaacctcagctcagcctgtgggaccgcgcaggccagccacctgtttgacaaccctgccaccgtcttcttctctatcttcatggctctgtggggtatgtggccatcaccaggcttgcttatatgggtggttcctttacatgggcacagtgaccaagctgtaaagctcatccccttcaggttacttactttcgcattttttcttcccatcacaagaagtattttaaggatgacacttttcttttctttactcatatgtgtgaatagaaacaggaatatccttcatgtctttatctgttttctctcagatgtagtcatgctaaccatgtactagccccatgtgtgatttattcagaatttgaaccaatgcctgttttgaaaactcctagcacacctgtaagactcctgcaggtgcactgacttaggtaagattgtagatatcgtgcagcacaatacttagaatggtggagtgactgccgtggtcacagagttagctcatgggaaaggtgggctgagatttggtctcctgactcctgttcagtgcgattgttagggcatcaygagtgtagactgtactgtccctgcactgtttaatttaatatttaatgccagggtaatgctttcagtattcccaccaaagggattagtggaggaaaaaataattccttcatttttctcctcctcccttcctcccagagtatggggtaataaacttgttctgagccataggtagctgactgtaaacacacacagatmcacacacacacacacacacacacacacgcctattctcacaaactggaataacgcgggataaccaccccatggtaactgagcatttctaagaagacacacccatgagtattagaaaasggaccaagtcaacctgtgtcagcccatctgagtagccacctgctcctttactcatcaccgaatgtgcaggcccttggtttgcacattggatcacagaccagcaggaccacagtcctgctgcagaggctgtttgatttatcactgactccatggcgcccagaggatatgccaggatgggccctgagtcacacgtccctgagcgtatgaggagaaggaggagagggagaggcctgttctcggtggttcttaggagaactagaacacaaccttcctccattccctgtggggaccttcacttgggtggagacagaacttgattggaaagattcccatattgctaggccaccaataaaaatttccagggcacactctattctctattatcagggagagcagctgcgtcccgggagcacacgggcagtgttcagcccatcgagagctggagcagggagcaggaggaaatggaattgtgaccatagactcctggractgttcacaggcagggttggtagaacacactgaagttggggcttgttgcctgggaagtcactggcagctctgtgtctccttatcaaacaggagcattgtggaattaccccaagatccacctgaactgatttggaacccagaatacgtattcattttttgctatattacaactctaatgcccataatttgtcttgcagatattaccaccattgagttgctgaagcctaataactccaggtctataatccttcaagaactttcttgggacacataatcccctgttgtagagaaacttggttttcaattgtacttcctagtttcaagtttcaacaactgcctcttctcttcctttgatagctgtaatgaacagctacctcccaccccttccgagatcctcagtcatttcctaccctacccctggacccactgtcttcctttcacatcacagtgcagggaaagtactcaggggtgagattgcgccagagcttcctggcatagggtaggatttggttttgttttttgacagtcttgctgtgctttatgtgattgtgtattcagttacagcagccaagagcctttaggccagattgtctacaaattacaattaaaaataatagtaatgcctctcattaccatgattattatgattagtggtgctgtgctgggtgggcctggktcagggcccaggtctgctgggaataaggctgggaagaaatggctgtacatagagagagacttgggctgctggtggcagcggaaggggcggtgtggagtcaggaggtcttgggggatactagtcagcaggacccaagtctgttggctcmcctgtaggtcggacttcaaactccagggtatgttgggaaagagagtgaagtcctactgaaaagggaaggaaagagacagggtttcagaactcttttccgaatagaggttaaggacactgacctaggcagacctaatgtgtgtctcagttctgctccttaccagctagggatcccatggcaggtaaatgtgaacctaactctgtgtcactaaagtcaatactcttgaccaaggtgccctgttaccttgggcagattacttaatctttgagcatcgttgtcctcatctgtaaattgagcgaaataatacctaccccacagtgctcttgtgacatgtgattgagtgtgcatgcagagcatgtagcatagtgcctggcacagatgagcacccagaactgggagctgctctccatcagtatggtggtcctcccttgccctcacgactcatctatccakgactcttttgcccctctcatcattccttcagtctgacttcctcccttcatggagacaccagtcggtcagcactctgggcactgttgtgtgcacagccctcctcgggaaccaaggaaggagyggtaggaagaggagggacttactaccattcttagtatccccagaccaaagccagtgttaggagggaatacacccactcgagaaaggcctcaaatccaagggagaaaaacatgcaaatcagtgtatgcaaaatgtcatgtcagawgaaaacatgcacatcagtgcaccataatgtagctgcaagtaaaacaaatgcagctttaagtaactgtgtattcaaccagtgcataggtgtttgatattctcagttctgtgctgtgaccgaggtagacataggcagctaagagccaggaaaagtttacagtcctgttattacatcacaaacatgaagtgtcggccaatagtcaggcatggcatgtagtgaagtgtgctcaggctcctgctagaggtggggtggatctgtagggatggcctcagggaatgtcatgtccctccctttccagggtgccatgaacatagggcagtaggagtgaggaggacagggtgccatggggactgatgttatggaagaggggracttgagctgggtcaggataggatgagggtagaagctggaggatagcacaggagagagggacaacgtgcgcaagtcgagtatggagatgacggtgaggggatgacccagctgtaatgtgggcatgggatatatgttgtcaaatggcaggatgagcgattcagatagatagttcgggctcgacatacatagtcctggaatccagagagaagaacttagactgtaaggagccattgaacatgtaggcaggtagtgttggcacccttcctctgcccactccttcaatgcccaaatgccattgtccttcaaaaatcagctcggatgcctcctctggcaggtagcacttctcttcgcaggcccacagctttttcatctgtgtcattcttaaggccctgatcactttatgtcttgtattgtagttgtttacaatcccttctcacagattgtaaacaacttgagaagaaaaatccacatgaagttcacccaatctccctgacaatgcctagaatggtgttttgtacattgcagataccttagttgggactggtgcttttgcaggattagaaattcactccarcttactcaaataacaagagatttattttaagaaagcaagagacaagctcctgggtgtaggaaatgaaatataaccaggcctcttgggaactggagctagagatgctgtgggaaacgaaggccttccctcctttcaggtgctgcgtggtctctcccatccctgctcctctttgtgtcttttagtttcagttttcaaaggagggaatctgagtgctctatcagcaggccctgcatcagatgttcagccctggtataacaaaccatggctgtagggttgtgctcgtgggggtatcaggttcttcctagagcatgctgagaaaggcgtgctggtccttcaaagggccgtgggtggggcaggcaaactgatggatgtgtaggtgtggcaggcattctacaactatttgctaagcaaatggaagaatgaatgcatactactttacagagattattctatcagctacatgcaggatgggttggaaggctgaaagtctggagtcaggtagaactgttaggagactgttatgtaacctcagaatgagatgattagggcccaaatgaggcaagtggcgctggggacagaaagaaagaaatgtagggaaaaagtgacagtgctgatgaaggtgaaggaggaaagaatgtatgcgtaggcaagatgaggcttgtcaaaaaatcctgcagacccctccctttttattttcttcatcccgccatccttactttacttctccagatcagtgtttaccctcctctcataacttagaagtggagaaaggagcgtgtgtgtgtgtgtgtgtgtgtgtgtgtgtgtgtgtaacatatctattggctctcaaggatgtggagtatttctagcagtttcacctagaagtgggaaaaagaggctaaatgcattaaagagagctcctaaatttaaaatagcttatcccccacctccactggtgagcccaaagggtacagaatccactcttcaaaaataatcaaggtttttgttcttgttgttctttttaagctaccatgttcctggaaaactggaagaggctacagatgcgactgggctacttttgggacctgactggcatagaagaggaagaagtgagttctctcacgtatttctcacatacttctgtgggcttttgctttgttttgaccctggaaatggactctcttgagtgagataaccatgtatgtttgctgtcactggctggatctcacagtggctgcctgtgtagcttggctccatggacttgggccatggttgacctactctgaggccaagagttcaagtaccccctcttcccttgagctggagggcattgagcctggtgtttgggcagatgtcccagtgccctcctctggggaaagaggtggcagaagatgcaagaacaagaggcaagacgtaatcttgagatcataaagccagagagtcagggatatgtcagaatgccctgggggcctcctgagggccaaaggagaggcagggtgtcaggtgctggttgtctttgawgtctgtgaatgaagaaagaaacactaaacctctgtggtataagccagtgcactatgtgtgaaactgaggagttggggaggcgtgagctaagggaaaggataggttcttctagagcagtgttctggacagatgatctttaaataatgcaaataaatcagccttcccttatagctcttctgaggactagccccccattcccgatgctggtgagccgatgatgggcagtgtgtcgtgcttgctcccatgatctatycccaccataattcctgctcctccaaaagcaaccccactgtcactcagccctcctcccctcttctttcacttccaagctcagcaagcccctctgttctgaccattaaaaccttcaaggcctcctgacaccaggtgccaccatggatgggatgtcaagcagggactctcaatagtgtggatatcgtgggtgaggggctgagggccgtctagaagggccaggaggcactttcagttgcctgagtccacttgcaaggactggccacagcagtaaggtggctgcatggaacacaagcctgctcattactctcctacagtgattgccttggactagggacctggggccttgtggccctgacactttatgagaaagaagtggaatccctaatttagtctcttcctaagcctgtatgtccccacatctgtggcatgtcaccatttcttctccttaatgctctaagtagtctacttgcctttgagcaggtgggctgaagaatggcaggacccgcagggcagcagcttggaatggaatctaccagtgcagggtgtgctgcctgaaagtgctggaaggagagatgtaatgatatagcctttctccacctcccatgggttctcacttaattgcatccccatcccactccaccccactgcattaccatatattgggtacmcactctactctagtcctaggtatttcgcatataccctgaggctaatactatcatgaactctgtggtgaaagagagaatatacatatgcattctgccttcagagaggattcaaattatttaggaagataagcaacagagaatagtaaagacagttgcatttcttgcgggaaaattcccaaactggtccttccaatagaaagaactctagaagtttgaatgtgggtgatctagtggggaaatgtttgtattatttgtcccatttgatttagctgaaataygtctcatatatatgagagagacagagagagaggaggctgggggaggtgggtagggtagagtgcctactccgctaatgccgtagaatgtttccaaaaaagagaagaagatgcattttggcctccaagcctgtgtggggccagagacaagttaagtgtgtctgctaagtagagttgaggaagccctcacgtcttgctgttagagagcaagtgtaaacatagtctctccatcagaaaagcctcagttataactcaatacccttgaaatctctgtaacaagtccctggcaggagtgagattataatccatttttctttctgtagccaggtttcctgtttatctgtttaacccaatgagccatggtaacttcctgggaggtacatgatttgaggagctcatgtgctggctgagaggggcctggccaagactgggtttacccagggcctaaggagactttccggatgggatctccgtgtgaggttgctgcaaggctggttggttctgtaacgtgactggcgtgccccacatgtgcacaggccagcctcaacttttcctttaatgcatttctagtttggattagcacacatcaatttcagttcaattctgaacatggccattaagcatctattacatactaggtttttgtatggaatatggaattatctcaggtgtagtgtctgatctccaaagggctgcatccagcagggtgctctttggtctataaatatttagaatagaatggagagtgtgtgagagaaattgctctggctaatgtagagaggaaattcttaaaaaatcagggttttgaagactggttggcttttaatgggcagcaaagggaagaaggggtgcccaygagaaagaaacagcagcagccttgacctgggaaagcgaggcaacaacaagatatcttgaaagccaagttggcttcaggggacagggctcagtatgcagtggtgacaaggaaaaagtatagtctggtgaccgggtcagggagggtcctgattgctaatctgtatctcccaggccatgggaaggcatgaagatcaggataacaaggtacgaatgacttgaacaagggtcctaggacttatatgaagcatttaacccacattcaaaacgaggagtgagtggaaggcagatgttacttgggcactggagggagggaggcaggggtccttgaaagccatgattagaagttttttctattttaaccagacacctcccagtatcaggaatgcttgcgagtctagctttctataaccttaagacttctttcttccccatggtatccactaggaaacacttgcttcccaggggaaaggagggtgccaactgacatacaccaaagcttgtgcaccctctagtcctcccacctgggtgccttcagcaggtgggtcaccccaggaggggtagaacaagcagtagggcttaagtccggcttggaaaccagagacaagccagaagaagactggagactgctttcttctgagggtggggaaggaaggaagcaaccaagcccaacggcccacccccctgggccagtgcaggtctgcctgtgggtgtccctgtggacatcatcatgggacttattgaaggactcctctgatcctgtttgtcctttttgcagggagatctgtcagacctccagagttttatactctaaaatgggataatcttcagctcagtgggccactcttgcccattaccttctgtcacatcaggaataccctgggcctcttagagagtgtggccttatctgaacacagatatcctgcccacccatctctctcccacccctcgtgtataacatcaaagcttagatatcctcagtgacttctttctggtttcacaggaaaccaaatcctctgcctacctttctaacctcagcttgtgtcattctcctccttgcttagaccttccagctacccaggccttcattctgtctcgagctcattccagcctttgccctggttattcctgttgcacagactgcttttcccccagactctgcaaggcctgtcttctcggcttttgtgtctcagtgaaaacattgccgtcttcagattggcctcccccaactccccaatctgaagcagccattctgctttatttcttctgctattcttatcctcatctgctagtttctcattcgtgtgctggtttactcactgtaccttttctctacttggagaaaagttccagggaaggagggatcttgtgtctaggactggcagtatagcctcagtgcctggaaagagctcagagtwtagcaggtgcttgatgactcctggttgaagacatttgttggatgtatctctggacttacctctttacatcagacaaatgtggtcctgagcaggcttgggttcttcctcccagctggctcctggggagactgaccacgtggaaacagttcccagagtctcgatgggaggggtgatgatctgtgatgacttggtatcagataacccatccagtgctgttgtgtttggggaacatcaggagtatcaggctgatctgcccgtggctgggtgtgtcaaagcagccctcccgggggctggattctgctctggccaggagctcagttgtccaatttgagggattccataacctcaccccacttgcttggctgcaaagagggaggtccttgtcaggcctgcttcagctgagtgcagcgcagcctgtctcttctttgagtttcggattcttgtctgagtgcttaggaagctaggcttgctttaaaaagttaagggttatggccgggtgcagtggttcacgcctgtaatcccagcactttgggaggccgaggsgggtggatcacctgaggttaggagttcaagaccagcttggtcaacatggtgaaaccccatctctactaaaagtacaaaaaaatcagctgggcctggtggcatgtgcctgcagtcccagctactccggaggctgaggcaggagaattgcttgagcctggaaggcagaggtttcggtgagccgagatcatgccacagcactccagcctgggcgacagagtgagactctgtctcaaaaaaaaaaraaagaaagaaaaaaaagatgagggagctttgaactggggcccagcatggggggaggtgagccacagccacacctagagggattcaagcaaactcctytgtgtgctgccacatcatgtcctggaaagccagagataatcagaaacatcctgtcggtcagctgagggtgcctcccttagcccctgtgcagggtctggaaggggagaggctcctctggcttgaagagatgtagaacccatgttctggaactcactgaaagatactgctaagtttttaattaaaatctcccattggaataatgtagaagaaaagcaaccaaatttcagaggccatgggggagaacctcaaaccatacttctctaagtattcctgcaggttattaattgttacaggcaaaagttgctctgcgggaaatgatgtgcttaggaaaattaagcaagcttcttgacagtagtacttttcagagttttgaatgtgctcactgtgactctcagaaagtcgatacgttctagtgttttccagtcttttagaccttggaatccttttttagctgaaattctcttggcacacacattaggaaatgctgtgttggagaacggatgaaggtgagagacaaaatcaagtgcactttacaagcgttcagagatttctgtgtgttctgcatggtgccaagtactgtgcaaaacatagaataatacagagcaggtagctgatctttatgttaggataagaagactctcacatgcaaaacagcgaggaaaaaataaaagaaaaatatgtaatgaagatctacagtgtgtggtataagctataaaagtttcrgaattcagagagggaggagaccccacctggtaggtatgttgcaacagttggagaagtcctcctggaaggggtgggactgacgtcccctcggagaatgggtgaggatagaatggcaccgcctgcagttgttttagttatgcttgttagtcacttacatggtctgtcctctcctgcatcatggygtgtcttgggaaagccagagacaggtcaaaagcctggcccgttgacctttggaatctctgacatatggacagggataaggacatgtgtgttccctgaatggcagagcccattgtgagccagtacctgaatccctgcccaggagttatcgataaacgatgcaggaacatgaagtcctcacacctgtagatgtttgttcttgagctggaaaccgtaaggaagacctgccaatgaggccaggtgtacacagttaaattttctttgaagtgagttatgcattttcctaccccggcatctgcactgatttgaccatggtcctctggattagttaggtgctctttcccatgcctggtgactcacaactcaggtttgtgttgctgaatggcccagtgaggtctcttgagcattgctgttacttgccaatgagttactcaccgaggctgcacaggaaacaggtccaggcaagtgagttttaagattccctatggccacccttgactttgatgtttattggtcgccattttagctcagagaataatggagcagggaaggagttttgttgttgccctcactcccagctgtggggcacatctgtttctccagctgggagttggcttgttgaaagttaaagtttgaggtctgacgatagttggtgggatgaccagggatatccctctgcctctggtgaaactgctctgcaaagcactgggcccctcttcgtatcagccatccagttaacatttcctctctttttctcaacaccggcgctatccccaggaacgtgcccaggtttggttttcagtgtgataacgagtgttgtgtgtcccttgtctcttcctcacgttgtgttcttatgttaggatgtgatgtctagatgccttgtgattgtgtgtggtggggcagttcatatccaatagcatccaatcctaaacgctgacgttaatgtacatgtgtctggttataaccctaaggccaaggtsattcttccttttgtttactaaccactcactgctctttggtttaggaacattccaggcctgagtatgaaaccaaagttcgagagaaaatgctaaaggagagcaaccagkctgctgtccagaaattggaaacaaacacgacggagtgtggcgatgaggtatgaagctggacttgctgctcacggtcctctttacttgttgagatcctgttgtcattttgtttggcacgccttagtgaagggagactgggcttgagaaggggttgatgtggggcaggatgagatgagagcatgacatctcgcattgtcctgcagccagagatcatgggcaatgggctttctctatgacttgacctctctttccagatagcggtgctatctggtcaaaatgggagggcaggttagaggagaaacagtttcaggcctgattcctaccatcatctaaatattgaataataataacattcaataccccaccagaccaaccaccaccacggctaatccttatcgaacgcttgctctatgttagacactgttctaagtgtattacattatctcacaataagtctgtgaggctggtactattgctatgtaaatgaaggctcatgaaaaaagttatgtccacagattaagtcatttgccagaggtcacacagccagtaaatggtaggtggatctgggattccactgcaggtctattagtctgtgcctctaaccgctatgccatacagccttcaactgcaatgggaaaatcaaaggatagaacaagaaatggctcttagggcctgcagtggcaaatacatgcctgtatttgctcaagctacttgtgcaatgttccttacatttcattttatcttggtggacctccaaacgtggaaacatgatggtgaccatgtcctctgagtcatgtctctcagtttcatggtggcatgcagtcattaaaacagagcttcagaatttgtgctgtggttcgtaaaaaaactcagagtatgtatgttggggggacatggggatgctctttgggatacctgtctctgtgtgccaccygtctttgaaagcgaggaggggtggggagagagagagagagaggagagtttatgtctttcttaatctggttcttgaaaaaaaattccactagattgaaaatctgttgcttttagatgtgtcttttctccatcttggatttgaattcaaatttcatttcatttcacattctttaagttggaaccattcatgttaacatgcaaatttatgcaagcatcaaaacagaagaatgtggtgttttcgagcccaaaatgctggcatttttttttttttaagaaaacagaacttaaacagaacagagagggtggccctctgagttattttttttcctagacgaagaccaagtccaagaccaccaattattcagggaaataatgaattcattcttaggaaagactaatcatcaccgccaccctcatcagaaagcaagcattctgtgttctgtcagcttcggcaacgccgtgcaaacttctttctccaccccatagcaatatacaatggataattttatggaaatcacatgtaacttttattgaccactgactcattgaattttaattccatagacgggaatgccraggaaccggaattgtgtacactgaggctgtggttctaatataaacattgcttgggtatatatgcatgattggtcaaataactttcaggaaccatgaataattaaaaaacatctgaatgcattatgaatgatacatatgtttatgttttagcattcaacatctattttcattacactgttgagaatgcaaagctcaaagcatctaatgccttatgggcactggggggaaatgaccttctcaaatgagtagtgtaagataaaaatggtctagaatttgattgtcaggatccttcttgtgtttcctcagtttctttaacattgttaatgcttctgttcttgccaaatccagccataggtgggagataaaggtggatgctgctcttgtctgcaggaagagttgtagtcaatacccaccgcatagcattgctgcaggggcatcattgcatgtggaatgtttaggaaaggcacctgcttctgaggaatagacagggactaaagaatcaaattctagctggtggtcttggatgtgcttgtctcaccccagaagatcaccttggttctgccttcactgtaatcctgatgctgcatatcctcacctctccttactttccttcctgttgaatggtaaaaagctaccatttactgaggcccagagtggtgcgcgaatttgcttaagaccacgtagctggttgtggggaagctggtaatcaaacccagctctgcctgatccccaaggcctgtttgcttttctttttcctttttaattttaaagataccaagtccgtttactttttaaacatgtttattgagatttaattttatacactaaaattcacccatttaaagtgcacaattcaatatgcatatttttatatatgcacaattcaatatgcatatttttatatatgcacaattcaatatgcatatttttatatatgcacaattcaatatgcatatatatgaataatttttagcttattcacagatgtgtgcaattatctacacaatttatatttaaaacatttttattatccgaaaaagaaaccctgtacccaatagttgccaagccgtgggtaacaactaatctactttctgtctctatagatttgcctattctggactttcacgtaaatggtattatagaatatgcggtccttagcttctttcacttcgcaacatttttttaggattcattcatattgtagcatatatcagtacttcgttcttttatattgccaaataatattctatattgtggatctgcttcattttatttatcgatgcagttgatggtcatttgggtggtctctacttttgggctattaggaataatgctgcaatggacatttgggtacaagttttttttttttgccgtatgctttcatttttcttgggtatatacgtaggagtagaattgctgggtcatatggtaactctatgtttaacattttaaagaactgccatgctatttttccaaagtggctatattgttttacattccaaccagctatttaggaggtttccagcatctccacatcctcaccaacacttagtatctgttttttacattttatccatcccagtggtgtgaagtgatatttcattgtagttttaacttgcatttccctaatgattaatgatgtgaacttcattagtggtcattaatggtcatttgcatgtcttctttggaaaaatatctattcaaatcctttgcctcttaaaaatattgggttaattggcttttggttatcaggttgtaagagttgtttttatatttggaatatatgaagttctttatatatttgggatataagaaattctttatatatttggattaccagtcttatcaaataatatgatgtagaaatagtttctttaattctgtagattgtcttttcactttattgaaattttgaattttgaaatagttcaatttatctaattttgttacttatgcttttgtgttatatctaagaaaccattgcctaatccaatgtcattaagatatttctaatttttcttctaagaattttatagttttaacacttgcagttaggcctatgatccattttgagttaatttttgtgtatgatttaaggagggtattcaaatgtatttttctgcatgtagatattcagttgtcccagcaacatttgttgaacagactgtttcctcactgaattatcttgacacccttatcaaaagtcaattgaccataaatgtaagagtttatttctggacatcaattagattccattgatctatatgtctgttcttatgtagtaccaccctatcttgactgctgtgcctatatagtaagttttgaaattgggggtatgagtcctctgactttgtacttttttttcaaaattgttttgaccattctgggtgttttgcatttccatatgaacttcatgactaacttgtcaatgtctataagaaagcaagctgggattttgctagggattgagttgaatctatagactaattttggaagaattgccatcttagcaatagtaagtcttctatgaatgtggtatatctttctatttacgtagaccttttattttttcaacaatgttttatagttttcagtgtacaagtcttgtacatattttgttaaatttattgataattattttatttttttgatgctattgaaaatatagttttcttgattttatttttggactgttcactgccagtatatagaaatataattgatttttctatattgatctggtatcccataacttttctgaactcatttattagttctaataakttttaatggattccttaggattttctatttgtgagatcatgttatctgtgaatagtgatagttttacttcttttttccaatctggatatattttatccctgcttgctccacccatttcctaattgccctgattggaatctcctgtacaatgctgaatagaagtggtgaggccgggtgcggtggctcacgcctgtaatcccagcaccttgagaggccgaggtgggcggatcatgaggtcaagagatggagaccatcctggctaacatggtgaaaccccatctctactaaaaatacaaaaaattagctgggcgtggtggcgggcgcctgtagtcccagctgtttgggaggctgaggcaggagaatggcgtgaacccgggaggcagagcttgcagtgagccgagattgcacgactgcactccagcctgggggacasagcaagactctgtctcgaaaaaaaaaaaagaaaaaagtagccgggcgtggtggcaagcacctgtagtcccagctactggggaggctgaggcaggagaatgacatgaacctgggaggcagagctggcagtgagccgagactgcgccactgcactccagcctgggtggcagagtgagactccgtctcaaaaaaaaaaaaaaaaaarggaagtggtgagaatggacttccttgctttgtttttgaccataggagaaaaaaatttagtttttcaccattaagtcactgtaagtctcatgttagctgtaggccattgcttttttttttttttggtttgtttaaaactctctctataaggtttccctctaaggccattcttgcattgctataaatacccgagactgagtaatttattaaaaaagagaggtttaattggctcatggttctgtagggtttagaaaaggcatggtgctggtatcttcttgacttctaaggaggcctcaggaagtttataatcattgtggaaggcgaagggggagcaggcacgtcacatactgaaagcaggagagagaaaaaggagtgagttataggggaggtggtgccacacacttttaaatgaccagatctcacaggaactcactcacttttgcaaagacagcaccaagccatgagggatccacccccatgatccaaacacctcccgccagtctccacctccagcaccgaggattacaattcaacatgagatttgggtgggaacaaatatccaaactgtatcagcttccctgaaaacaattcacatctcatgtacatgacactgatctgtaatgaaatgctctgtactgtaatgaggtgataaccatatataaggaccccggggtaggagttatggtaccattaccaggcagctgagccttctgggtctcttccacctcagctgtcatgcaggtagattagattacacagcctctccagttctgagagtcagtctttgctgatgtgcagagatgatgttggtcatcaacccattggtttgggggattggactgtctcttatttatttatatggtagtaacttagctcttataccttctcttattgattttcaaggatgtgggcataggaggatgttaataatgataaaattataagtaacatttatggagtgcttattgtatgtaatgtgcaaagctttacaggtattatttcctttattatttccattatgatccccaactcacagatgagaagactgaggtctataggggaacataagttgatcaatgataatacatggcagagccagagtcgaagccaggcagtctgactcaaaagcaatgcttttaaccycttgctcctgtgtctgctgaaagttttccttcaatagatcctcaaacactcctaaaaagtcatgtttgattcttctttcctaaactaaaggcagaaaggactgtggtattcactggaaagatgggtgagagacaaattcgctaccccacattagtggttttgtgtaaattttagtggggtgatgttctatttccactgaggacaacagtggggagaattagctcagtttactgctagagttcaacagacagtagggaaaattcaggaatataaatataggtatagattgtgttttcaagaaagaatactgagtccggaacttttaataaaagaatagcgtggattttttttttttttcctaaatcagtttgaatcttttctagactgctgtatcccggacacgtttggaggttttcttaagtttccctgcaggtcaccaattctctctgttcctacaagatggtaaagctctaagttgagtgcagatggcaaggtgctggagctggcaggttgaggagcagtgctgttctttgcctctcatccctgtaaccattcactcagcactttctcagctcatgcctcctttgmttccaataaactttctattagagtacagtaagaagacaaaactcattctacgtgggtcagcagagacaatacgaagagctaattctaaaggtgttagaagaagggatgttgaggcaagcaggacagtgaggcagtagagagattagcatggcaggaagtgggcaccaccttagggctgcaaggacaggagcagagctggccttaccagagcccaggagccaggaccacccagtgggagctggaatcccagaggagatgccatctgaagcagatagaagaagtaaaggagaaataccctggatttcccttttctgccccccaggctcccatcattacttcccattggccagacctaaccaaaagtcagttgatgagttattcaaggaaatatagtttttggggtcagcacagagcagaggaaaggaacagcagaatctatctgaaagcaaccggcaaagcgctggcacgaaagtccaggcaataagtctatgtaactttagaacccactagccacaaatcatttacaartggggtccttggttggaggttggagaggctatcggggaagagaaataaaaatttgacaagaagcacaggaatgctcacccctgacataatgaataaatacaccaatggtcagtttttcagaccatccctgaactgttgagagtgtttgagcgggtgtgtgagagtgagtcagtggcatgagcatgtgtgagattgtgttagtatgtatgtgtgtggatgggtgagtgtgccagtggtgtgagattgtgtttgctgtgtgtgtgtgtgtgtgtgtgtgtgtgagagggagacaaggagagggaccatgtctgagtgatggtgtcattggagtgacacagatgggctcagataacagaaagcttcaaagaggagcaaagatayatttttgtgtcaagatgcaaagaacatgaacaagtagagatggggggctaatggcaaatgtaggtttcatacttctatgaaacatatcactgaaaggactttaaaacaaaatcctatttaactagtcctgggagattcttcatggaacttgtcacctacatattgatttagccagtgcgcaggccccggggcccccatccctacctaagccacctgcagtgctcatttaatgaatgttttatgttgagcactgcagctagaaggggacaggagcctagaggaggccgtggatagaggggtgttaatttactgctcagttcatcaccctggggacaattatttcaaaagaaaactcatctaaagttaaagcactgaaacatttacgacagacgcctctggcaggcacaataaacaaacacgtggaataaattatgcataattgttgggcctttgcggaggctgtgacaacagcaacaggaagctgggacattgttggagcatgcgcgtgggtggagaagggagtcccattgagcaggggatgagggtccctcttgcctcttactctgggcccagggagacatggtccaggctttccacgcaggcttcgggtggtttatcagttctttgagtagakgaagttccctcgtgccctcttttgaggcactaaatgaccgaataaccacttgagggtcaaaaacataaagaatcaaaataattatcgcagcctcttcttagggtttctcgttggcaaagggaaacactgaggcacagaaagagccttattttgccagagattcttgtagtaaaagagaagctgaggtgagatgtgagcctggttatgtttctgaaatctgtttatggcctggtggttaagggccctaagcatccttattatatgggcatttcatggactctggctattaagggctgaattaggatacctgggacctttgttctctcctgtacgcctgcatgagctgaggaagaattggcagaaaatggcctgggttctgtcccaagctgaagggcggttggggagtcaagcccctgtgctctcagaccagtccctgagccggtctgataagggctgagaagctgcgggttggttcagctctgcagtcctgtgcttcagaggatctgtgcacactgccccttggccttctcatatttggtaataaggacacttcatttcaggggacatgtagctccctggaacctgtgtcacaaaagtggaattgttgctgaaggctgccccctgacaattttatgtactattttttaaactttagctttaattttttatttttgacagtgcatggtttctgtctctggctcctctctctctctttctttctctacccgcgcccccgccccccacccgccctgccccttctctgtaatttctcatggagtggcctcctttttcacctctggtcccagtcacatccccagtcactccctggggcaccccagccaagagaaatgggtgagtaggagaagagaaatggatgtagcaaggaaatgtatgggtagagatgtgggcagtctaggatgtggatctccttaggggtactttaggacttcaatttagaactggatcctgcctcccttcccctcattggcggaaaccagccacaaggctccacctggatgagcagaaggcagggaaatacagtccttgcctagcagcctccaagcagcagctccaaaccaccaaagggagagccagccttcacggccaccacatcacaccgcaatgtgagtggactgtgagcagctggactctggggaggtggtagcagaggcagttagggaatggctactggtgattctgattgactaccacctccggagaattgctgccttgggaaatgagaaaggaagaaaggctcttgaaaaaaatgccgtaaggaatttcagtgagtgagccagaagcgctcatccacagtgtacccacagtgtgttggagtttgggactgaccctttctaaacagaatttagcactctcttacatggcaaggttgtttgttgttgtcgttgttgttgtttataattacacaagttatacatgaaagcatcttcagaaaaattctgacaaacgcctccctggacctacctcttttcctcccaatgttgtctccttaaaagcagccggagctagcagtttggtttgtgcccttccaggtcttttctcatgcatttttattcacgtataaattcatatttgttctgggctctggttgtgggtttatttacgygtgcacacacacacacatacgaaagtcatggacaaatgatttcatcagatcgtggttcccaataacccgagacaccccagggtgccataggaaactcacagaagtgacatggaattactaaacatttcttagggaagcccagcaatgcttgacatccgtacaccgccacacagtattacctcagcagtgtcaatgttctatagtactgtttttagtttttattttttatttttttgagagagtctcgttctgtcgcccaggctggagtgcagtggcgcgatctcagctcactgcaagttctgcctcccaggttcacgccattctcctgcctcagcctcctgagtagctgggactacaggcgcccgccactgcgcccggctaatttttttgtatttttaatagagacggggtttcacygtgttagccaggatggtctcaatctcctgacctcgtgatccacccgtctcagcctcccaaagtgctgggattacaggcgtgagcccccgtgcccggccagtactttgttttttaatgtcatcatgttttagtgaagctgacttttctgtggttgcagccagtgagaactgcacaaaatcattgtggaacaggaagcatgagtgttgctgttcaatctgataccaagattagaaaagttggaagttctctaacaggtgcacacatcctgttagctagtaattaggtttaagaatgaaataaattattattgtttatttcaatttaygcatattttccccaatggctattaatttgttaggacataaatatttattaagttatttggacttaactacttaacacatggaactgttaagtatttcttttagcctaagagcattgcataaaagttgctgggaccttaagggtactgtgaaccaagaaagtttgggaacagctgcataacgaacttcctaagttgggcgcagtggctcacgcctgtaatcccagcactttgggaggctgaggcgggcagactgcttgagctcaggagtttgagaccagcgtgggcaacgtagtaagaccgtgtctctacaaaataattwaaaaatatagctatgcatggtggcatgggcctgtagttccagctactcgggagcctgaggcaggaggatggctygagcccaggagttagaggcagcagttagctgtgattgtgccactgcactraaacctgggtgacaaagcgagtctctgcctcttaaaaaaaaacaaaaaaaaaaaacccaaaaccaaaaaccaaaaaaacttttatgttcaacagagatttaagagtaaagcagacagccaagagcagaaagcttaaaaagataaatagtgagttttaaagttgcaggaatttatttggggatggcaacagcctgtggaaactgtgggctaggaaagtgccaggtgggctggcttcctccacacttgctctttgggcctcccacggacttctctcttgggccttacagtgcatctgccccagtgtgtatattctctctctcttattgccgtctctgcatgtttgtgcacacgtgtgtatgtgagtgtgcatggtaggagggcactgagggtttctcatcatgggcacccttgtaaatccttggtatttaaaaataaaccctacaacttctaatccaggagacgttgctttacttacaatctccagcgtggttcgggcttcatggagaaggatgccagagatgtgtagaatgcgtccataaacatctccctgcacggagcctgtgaattacgcatcccaagtagactcctcgggtggcccaggccatcagatggggggccctggtccacttcaactgagagttgattcttagcatcaggagttctggctaaaataagaccttctsctctgctcactgtatacatttctactggccagggtctaaattaggaagttacaaataaggagagccctgaggcctgggttatggaagcaaagctatagagagagacagggcagcctgtgaaatgagagagcagtgggggaggagaagctgtggatccagcctcggagctaaggctgggcagattcaggatggtatttcagaccagaccctcatggcttctgggaaaacacaagacccaaatatgtgcaatgattgggaatgttggaatagcgtagttgctaggagaggccagcacataccattgggatgtgagatgttaggcacaattgacttgtagtttggacttttctttttttggtttaaatgatttttccatatatggccagaagcacgtaaattaaatttgtcttttgctgtctgggccaaggtcgttatttcacttccttagaattcactggaaacacacacatgccctccaggttcccttgctctttctcccttaatgtgccagaaactcaaaagtgctggtttaaaaaattcctccagggtcaaaatgtgttctggctccctgcgattcttttgatatgatggtcaaaaggagctttcaaagaaaactgacgggattgcccttttgtggatggagacacagaggctttgagactatgcgcttctgacaatcattgcccagctagaggttgcaaaaacctccttctccatccaccaccacagcctgctcagccatgctctakctggtgagaaggggcttactgtccaaatcattgcagtcctgtcactgaatggaccccacattatttccaagcattactttaactttcataaagaataaagaactagcttgaaaaaaaaaatgtccttactttggattctcccagatgcagaccctgagccagtgattcaastgcaaaattctgggggaggtagactctccagtagtggagtgagcaagtgagagagacaagggaaggcagcccagaaggggtgcttggtcaatcaggttaccaccgtggacaactcaaccggagcttagttctcctgggaattctgggagctgattcagaacgtgcactttagagtggtattgcatgaggggtgagtgtctcagttggtttctgctgctacagtgaaataccttagactgggtaatttctagacaacagaaacttatttctcacagttctggaggctgggaaggctaagatcaagacactggcagattcaatatttgataagggctgttgtctgcttccaagatggtgccttgttgctgcattctcacatggcagaagaccaaacagcaaaaggacactagagtgcttccttcttttttcagatcatgaatccattcatgagggcagagctcctcaggacttaagcacttcttaaagacccwgtctcttaacaccatcaccttggggtttaagttccaacatatgaattcttcagggactcatatattcaaaccagaacagtgagagagctgagtttatgtgaggtcctgtcagtcactgttatgggcagctccaactgtgagtgtgtgagtgtgtgagtgtgtgtgtcttaattctcctgcacttctagtctgccttgaacgtgcacatgggaagagaaggctcaggccaccaaaaagaaacctttaggcaaagaagtgaaggcgctggcagttggaagttggactcaaaattatcctggtaagcttttagggaatttggagcagacactaacggtatcagggtctcctaagtcctaaagtgcatgagttaagatctagtcagacaatcagcaatcctggagttcagtggagggaatttaatacacggagctagctaggaaggtgtcagaagggctgacaagctaaataaggatgggcaagcaacccagagacagcatcagcaggaagctgcggtacctcccatcagtaggaggtggcccagcgccaggtcctctagtgggaactggaaccatgcaggaaactgcacggtggaaattggggccgccaagggaagggcagtccagcaagtaatggaagtatgaagagttacagccactgcatgaagcacatagagagaggagagggaagctctgggttccccttccatctatctacctgccaatctggcaccagtaccttccattgactgaatctagccggaagccagttggcaagggattctgagaagtgtcccttcggagatccactctgcttacattatgtattagaccaggaaatggcagatgtgggggtaaacaggaaaatgattggcactaattttaatcctttacctcgcataaacatgtgctttcctccccccacctcctttgttctttctactactcgactgttggctttgtcatctccaaagcagactccaggaatttctatggaygttgggtgaactacgtttttgggaagtgacagatgatagaatggggaacatgctccaaacccttgttcacccctgttctgaagtatcccaggggctgttcctgtgccttgggcacttctgttcagcagcagaaggaccataaacttcctgycttgatcatgtggggtctttgaggaggcaccacatctaaaagatgccctttggcagtttcccccttacttaggcttgctaacgtttgatgtttttgctctgtttcagtgagggacatgtccttacattctgaagaatatgtttcagaacgtggagcacatttgtgttctttccctctcgagctattgccatttagacatgttggctttttatttattccataaacccaaatgccaagatgacaagaaatagcaatctgaatctgtgctaacattcagctcccccatcccggacttccatgtgtttagtggtttccttactgattctccmaaccttactggaaagaaagaagcctgcccatgtggtccgctcttctttcagatggggcagcccaagtgagattgtcatgaataattgggaacaaagtccagaggaaagctgatgtaagtcaacagttccctgggttacttctttagagttggctccatttgggagccaacttaatccgtaatattccccaagaacacaggatctgtatttccacttttgtttttttgaacatccaagatcagatcaatggatgtatttaatattcctaggctcctgcctacagtgagaatgatgcgctgtcattccatccaggccagatctggagtacaaggtgaaatacacactgaaaatagggtcagtggaggtgctaactctggaggcaagaggattgggtgctttcatgggaagggtaagctcaggatgttaagttacttacgtatcttacagagccttcaagtttrgggaactggatcagggtgttgcagggagggaggtgatctgtaatttaactaggcttctacatctctaatctctttagaacaaacctctgagacaagatgtccaaaaccaactcccttggggtcttccttatttctgttaccttggctttcaggggaaatccctgaggtacgattagaagagaacctctgctatgcaattccataccctctgggtcaatttgggcattccattttctctgacaaatgcgcaccagcttgtccccagcttgtcctccaactggtaggaggtgtgggaaggaagagcaatccaagggcttgctctgtgctgggcttctgcacagttcccacatactcttcatgcctgttgtttctccctgtcagaagctggctgcagcacagcctgagctgaatgctggcctttgcggtgggatggtttgctttaccagtcattctttatccacagattgtycaaagtcaattccacatctgggagctgatgctggtgcttttcctaaaaaatacttctcaggtttttccagcattctgatgccacattcatgcttttctgcatcatggtttcatttatgcttggtctagggycgtgggcctgtattgatttccacagcacctttgggccatttatgcaactgtggtgggagatattttacataagcttggaagagttactgcccaaccagggccaagaaattcttctgcccatcaatggcccagagtttgtccacctctgggcctgttggatacagcttcgtgattctccaggaaggctagacatggtagtgttcagttgcctgtagacatttgacatccaattcatttttattataatggtgcatggtctatcggccagcttacataaattttctcctgaatttgggcatctgcactgagtttagagaatttgtggcaggaaatttgccctggaaatgtactcagctgaatacttgcacttctyagcatggaaagactcccatccaagaatctcagcatgcttrtctataaacatgaatgaattaatcctcctagcaccactgtgtgctctttgccagctgggttattttaagggaagtgaccaacccagcagcctgtagtgagtcatgaaacagcgtgctgacaaccagagagactggactgcaggatggaaagagccaggggccacactgcagcctcccacctccastgcttgagtgtgaggaaggggtcaatgattaacacaataactctgggatctggccaccttytggctcagcacatcctccttcaaggagtttatyacctgccccctagaccatggcttagtcaaattaaatagcttttattttttggagtataaaaataatatgtgctaagtgtggaaaacctaagaagggaagtaaagaataaagaagaaaagtaaatcagctattatttcatctcctaggcagaccactataacccttttttaatgtaaattgtaatattgttgaatacttaactttgtatcatgattttaaaaattagtctcagaacataggaagttgtcaatcttattaaatatggtttattaatattatttcaatagttgcccaatattttatcatgtggatttattagtccttacccaatggttaaacatgtcacgaacatacttgtgcttatgtttttctcctgaattctgggctatttcaggagcattatatcaggtggatagattaccagaagctcaagatctttattcggtttctgggttcctctttgcccatgcttttgtgctgtctgcaggaattacacagatatgaccctcaacacatcaccagcatagaggggcagctttcgtagaattgcctttttgtcaccgcttaatcacgagtgaagtcaggtcacttaatccatgtccaagagctctcccattgacagttgcctttcctggacagcaggaggctgttgctcttcttgcatgtgtcactgagagaacagatgtcctggagcatagatgggtcatcatcttagatgttggggtccaattctggctagggagaaatttatctcatcctgggaatgggtgggttacttgtatcaaatcctggaactgtccacatcttctgaacccatcactaatgaagaaagagaattctggggcaatggatggatcaagagctcttcaatgaaggtattttatcagttggactaaggccaggttttggcaggggagtcaatgggacaaagggtgagctgtggctttatggctttagctccaagaagaaatgtgtcccggttggtaaatgattgaccgaaaaatgtatgaaactcccttcagtaactttaacttctggaaacaatttagaggacaagtagggtcagtctgacttccgagaaagggaacatttttcttattgtttggatgccgattttttttttcaactttacaacatgtacacacaaacagtgttgacctatggaaaatattattaatccacagaagagcacttaatacatgctttaatatgatgttctttactttagtaccattcttcatttgacagtgaactcccatcgatagtcactttatctccccacagaacctagggtatgccttcacacccttttgttgaatcatgaaaatgcagcataaacccccaaacaaatctgatagggctctttgaatttggaatgtgttttatgcttttccttacctgctttcccggttgtatatagtttaggacggtggctctgcacattcttaactatcgcacgttgtgaatccaaactgggcacctttgaaattctgaaaatgtaaattcttaatcgtgtctaaaataagtagatcttattaaaagggaagaagaggaggaagaagaaggaggaggagaagaataaagagaaagaataggaggagaaagaggagcagaaggagcagcaataactactattacaacaatagcaataactatggaccacagcgagcaccatattgaaacccagttgtgcatattttttagcctttatcccataactggagtgttccatgctatttctagctctctggagacacaggcaggaaacaaaggtggcagtggcacccagcttgtcagtcgtggtgcttggctggtgtttcttgtgcgtggtgtataacctgccacggccttagttccagctagagatgctggggccagtctccctgctttctctgttctaatttaatccatgtttggaggataggaaggggaacgcattccatctgagtttcctccttgaccttcctttagactcagagactcggacacataagcagagattgaggtctaatgtgaatttggctaaaatgattctgtgtccttcaagcctttgccagacaaagttaactctggagtgatccggtagagtggcagataatctacttgtaggaaagtgaaaagaatgggccagaactttagacaattggcagtgtaagagaatataggcaggccgaggagaagcggggaagttactcagagtcacaggctttgggccagatcccgatactggattttgtttcttccagttttaacatctctccttctgtctcctttctctggcagaagtggagacctggcagatagagggagggcctgaggtggatcaccagaaaaatgaggttagcatctttgggccagctgagtcctgaggggaagggtggagatgggaacactcgttcccctcagtcctttcagcctattgggtagacagaggattcaagattaactgagtttcccttgttttggattcagcagaaaggtctggcaacttgaaatctggaaggtggttggactgccagtktgagtcttggtaacaacagttctataaacaagccaggagttcccagttccccagagcccaccgtgtgtcatcgtccagctttcttccaggaaggtctataaactttctgtttttacactgacccctcttggctatttaattcctgtgttgtcacaatgccgatgacaatgttggcacccagggtaggggggatttagcattgcccttagccacctgccaaagttcctccaaacaggaaccatcacttagccctctgctttctggaagggaatgtttaaagaacttcgagacccacagagaactttaaacactaaagtttatctcatatctatatacgtggagtaaaaataatgttaaagaagtaaaacaagaataaatgcatgtggttcattcttgttaaatgacaccacttttgaacaacccagttgtctacaccagaaactttggagctgttttgaattgctcctttcctcttacttgccacacccgacgagcmccatggcagggttgaaccactcaccatctctggtatttaccccttcctgctcatcccctgagttcagggcctcatcaccacttgcctggcctacttcagtgaccctctaactggtctctcctcctttgtcaggcccccttccagtccattctccacactgtgtcagaggtatccatccagaatgcagatctgattatgtgactcccttgattaaaatcctctcatgctctccagagtttaggagattattttcaaatttcttggctttacccacaaggctctatgtggcccacctctccaacttcacctcccactccctgacatgagcctcttctgccgaacatttcccagctcctggcagctctctgagcgtctcttggtgtgtcatgcgttggtggctgtgcacatgcaaaagcctctttgcttggaacctgctttccctctctctatccagcacactccttcttgtcctagaaaacttagggctaatgacatctgctctgggaggtcatctctcactctctgggcaggcttagctcttggctcttgtattcatctcccatggctgctgcaacaagtgactgcaaacgggagggcttaaaacaacacaagttcattctctcatagttctggaggccagaagtccaaggtcaaggtgtcatcaggcccacgttccctctgaagtctctaggagagaatccatctttgcctcttccagcccttggtggctccaggcatttcttaaattgtggctaaaccactccaatcgctgcttccatctttacatggctctctcctgtatctgtctcttctcccctctgtcacttacaaggacactgggaagtagactcagggcctaccctaaatccatgatgatctcatcttgagatccttaacttggttacatttgcaaagactttttttttttttccaagtcaggtcgtattcacaggttcctggggttagaacccgggcctatcatttagtgggtggagcacaattcaactgcttactaccctgtagcaacctgtatattccttttaggagaaattttactatagatgttttaaagcattaattgatactcctatctttccttcaagatgaactatctttgagagcttctgtttgaccttgtttctttggcttctagcacagggcctcactgcagctcggcacaacattttggttaaatgtaagaaataactacctaagggccgttagtaggtccttatcattaacttgggctgatatacgtgtgyttggagataggatttggacaccatgacctctgaaaagcctgttcagtcaagaagtctgtttctgcagttttgtttgcttcagaagtacatttttaggctaattgatttcaaggaatatccaaaggagggccttggaatattacaaatcatggggaggaacccaaactcgttaatctacattctagtctgtattgtctaatgtatgatgattgcgtgcacattatttttaaagttcccaagtggctgaaagggagcagtttcacatttttgagcatgtacaggcactgtctggattccccatatttcaaatgagagcttggatttcaaaaagaggagcaggtcttggggaactggtcagtaaattaaagtgtcttacgtatatgagacctgcaatttttattctctgggcctctgtatgaattagttttgcattgccatacagraatatctgagaccgggtaatttataaagaaaagagattcatgtggcttatggttctgcaggctgtacaagcatggcaccagcatctgcttggccgctggggaggcctcaggaagctttcatggtggaaggtgaagagggagcgggcttgttacatggcaagagaggaagcaagagagggcagagggaggtcccagtctctttaaccagctctcacatgaactaatagagtgagaacttgctgatcaccatgagaatggcaccaagacattcctgagggatctgccyctatgacttatacacctcccaccaggctctacctccaacattagggatcaatttttttttttttttttgagacagagtctcgctctgtcgcccaggctggagtacagtggcgcgatctctgctcactgcaagctctgcctcccaggttcatgccattctcctgcctcagcctcctgagtagctgggactacaggcacatgccaccacgcccggctaattttttgtatttttagtagagacggggtttcaccgtgttagccaggatggtctcgatctcctgacctcgtgatcccgcctcggcctcccaaagtgctgggattacaggtgtgagccaccgcrcccggcccagggatcaatttcaaaatgagatttggaggagacaaacattcatactctatcagcctcagtttattttttttctttaaacagaattgatargaacatgactcccaacttcttgattctctctctctacttgtggttagcattttccctagaagtcagaactcccatgtaccagtcagtctccaaatgattcatgtggccctactgtgtgctatttccttatccataggcctggataaataaagccgtcctttgaagatctcatagtactttggaacatgaagtttacattactcagagggttttcatctttgtttacagaaggcaaatgtgaaaagcatttggcaagagacttccagctcctgtttaaccactgcctccattctttgaggtctccccatcccaactgacattaacaagcctgtttatatgaaacaatctattaaatcaaatattcttttggaaatgtgggggtgggggatgcaaactaattctcagtgcttggtaaactatttacaagaggcttaagtgttcttggtcatctctgccctgcatcactgacaagagggagaccttagtgtcaggcctcaggcctctttctctttgtagatctgaatacaccattagtgtctctgagctgctcttgcagcagccagggcctgtcccctctctccacagcaatcacctcttaccaattggcccagctttctggaagcaaagtctctacattcttgggctttcacaggggtcttcccatctgcaggaataacttgtaattacactaatctcacttttaagttctcgtcacttcttaacacttttcttcactcacgagcctcctggctagcatttctcctctcctattgaatcctcaactccaactacctaactcagctcactcacccaaagcgtgttcaaggccctgccctctcactccattttcactttcattttgtattttttctatttcccaccactgtcctggatccctgggccatctcccagcgcctatccgtttcctcttgcagtttcatctatgaccmcaagaccttctggcctaagatgctctgtccttacagaacagctgatgaggagaaggtaaggagaggagagcaggagtgaggctaatggacacactcatttgtcctaaaagtgtcgcttgtagaaaatatgaatagactctcaaagggattgaccagactgcgaatgaacacagagctgggtatggtaacctaaagagctggggaagcctaaggggcgaggatgccaaggaggaagattcctgcttcccgtggcttacctggaaggcctctggttggtaccaagcccaggggcaaatggaacctgagtccagtccaggatttgatttctttctgattgtagtagagatgaggtttaagtacttagaaggarttgagctagaaatattttgggaaaaaatacactgaggagaagggagatcattgaaggggagggcacactccttcctctcaaaggcatgatctggaatttgcacatctcgtgttccatagcccagaacttaggcaatggccgctcctaacaggaagaaaggctggagagtatagtggagagtatagtttttcttctggacagctatggaccctgttaaaaccaggagctctaacaccatgagggaggaaactggatagaggggaacaactatcgagctctgtgggacagcacatttagttgatcgtgtactcggtgtagtacataaggggcggcttttggaaaagtgaacctgaagggaatttgcaaatggtctcaggtgatgttttatttaataatgtatttaaaaagtgcttattgagcacctactatgtgccagccactgtgctagcagctgtggatgcgaaagtgaataagacagatatgttttcaccktcatgaagcttacagtccatgggaaagactggcattaaacaaggaagtaattatttatatcatcattttattcagtgacacaaatggtgtgggactgtgtaacaggagaagctaggctagtctaaagggttgaggaaggctgtgctgatgaactgacatttaactaagacttagtaggagctggcaaggcagaagagaggacttgagaggacctagcatatgctgcatgtcttaccamgtgctgggccctgtttgaagcagttttaatctttataacatggggcttatgaggtaggtgcctttattatccctatcttgcagataaggaaattgattaaacaatggctctaaggtcacagggcattaggtggtagagcctggcttggcaccaaggcagctccactttgaggcacattccctgaaccactttgctgtgtcactcttaacagagagtgcatttagcaggtggaggaggtgagagaatgccttcatggtagaaggaagtgttgggagagttcctccagatgaggttgaaggtcaaagaggagctagatcatgcagagatgcagagcttggtagccctgactaagaatttgacctttttcttaaggccagtggaaagttactggaggattttagcaacaggggcactacgtaatcagatttgcattgtaaaatgttctgtggagagtgttgggggatataacaccatattcagagacattagtggggagtccatcagcagatgatgacagtgtcttctaggataagaaggaggtgtagatacgactgaagattactcaggagagcgttcactgggtttggtgaagggaaaagaaccacgtgtaggtgtctagtttgaacaactggtaggtagtgattttatttactaaggcgtgggaagactggaaaagaagcagcctgggggaaagataatgagttcaattttggatgtgttgaatccaggtgtttataaaatatccatgtggagaagtcatttaggmagttgggtccagagctcagaagagaagtctgggccagaaatagaaatttggcattcagatggcactggacacatgggagtggacaatattgggatgtcttgtctgtcaacaaatattgtttagaacatatcatttagaaaaaatgaacacaagacagtttaccaacgtcagatagactggtgcaaattccacatacaccatctgttcagaggaaggagagaccaggggaaagctgagccggcttcaaatgttggaaatgtttcaaagataaactcggaaggtatgtttaacttggagaattggattgatgttctagaaagttgattgggtatcctctgggggtggggaaagctgggaacacattagatctggagaggacttcagagtcctgaattgggtcagaaaacttgcttctgatgctttctaaatgcaccaccttgagtcctctgaacttctcctctctataaaggatactatggacccatcctacctaactcaccgagtggtaatgactataaagaacagacatgatatagacctaaaggaattatgtaaattgtaaagctgtgcacatttgaaaagctatattgtattagtttgttttcacactactataaagaactgcccgaaactgagtagtttataaaggaaagggatttagttggctcagttccacatggctggggaggcctcaggaaacttacaatcatggcagaaggtgaaagggaggcaaagcacatcttatatggcggcaggagagagagagtgcaggggagactgtcaattttcaattatcaaatctcatgagaactcctcactgtcatgagaacaacatgggggaaaccgtccccatgattcagtcaccttccaccaggtccctccctcgacatgtggggattacaattcgaatgagatttgggtggggacacagagacaaaccatatcatatattgttaaatacaattcaagattcagagtgatgtcattgtcccaaggtcacctggctggcaagtgcagaagttgggagtagaatcccggtcttacaagtttcagtgagaagcatgagcattggctgtgaattagtagctctatgtccttgggaaagttatttaacctccatgactcccaatttattcacatataacttaggaggtaacaccattaactcaaatgtcacaactatttgttgagtatttactatataccaggtgctgctctagaccatggggttatagcagtgagcaaagccaagtgcctattctcaaggagcttatattccagtggcaggaggacagacagtgacagagataaagaaatgaatacataatgtatcaggatgtgataagtactctgaggaaagatgaagcaaagtaaggggacagagagaaatggggcagtggctggagggaaaggcaatactttttagtaaggtggacagggaagatctctctgataagggcatgtttgagcagacagcatcacaaagtatgcatatctggggaaagagtgcacagacagagagatagcaagtgcaaaggccccggggcaggtatattcctgatgtgttagaggagcagtcaggcgtccagtgtgacaggatgggaaagagcaaaagggagyggggaggggatgagatctgagaggcagctggagacagggtcatgtagggcctcatcagcctccgtcagaactttggattttagtctgagcgagatggacagctacttcagagttttatacagaaacataagtgattgtatttgttctgttggtggaggttttgcgaggagaaaataaggtaatgtgcatgaaattgctttgtgaagcgggaagttaggttaaagaatattgccacggtcatataacaggccaggcagttgcaaagccagcgtacaatgcactttctctgaccctcggccacccttctttccayggcatcccgaatctcccccagaagggcaccrtgtcaacctagaaagagcttgaacccttaagcaaggtcaaagactcttcctcattcccaagccacagggctttgtgaaccttgtcgacctggcagcatttggcttttggaaagaaccacgggagcttgtgatcttaaatgggtagaaagaagggagttggaacagtctgaggcagtttgaagctgggtagaggagattgtcataaattaaatacagaccttgtctgctgaaggctggactagagaagcaaaaacatcaggatttaagaggcaaaaccaacagttatgatatgttttggagaactccattaatgtctagttaggaagccatagtgtggccaaaagcaatagtattggggtttgtaagaattcatagttgtttgtatagtattagacgtggattaaggagatgtaatagtgcatgcattgaggtacccagaagtgaccttgtattgcattccctttggaggaccagctcctatggatgagtacatctggcagagggtgcagcctggccttccctgtgtgtggatagattcacgtgatcctggtgggtgacgaggggaagtgtacctgtgattcttggcctgagagcccatggacagaagtctgctgcccttgtatctttgctgtttgtttaaagtrgrtagcattcatgctcttccccccttttctttctctccttttttcttctttctctttcaattttttcttcttttttctcctctcttgccatgagcagatgagcaatgtttgatttgctctctattagatttgtaattgtttataagttaactacccacatagctaacacccagcataaaccccctaaaagacaatgttatcatggaatctccattccccataaaacatatcctatatgccgactaagcggtcttcataaattatcagctcttaagaaaataaagtgtcataatttttttcagtgaaaccttgttggattccaactatatagataaaccataataatgtacaatctgttagtgaaattatgtttctgaccctaaggtacaattttcccagaagtgacagacaattgatatatcagttttaattacttaaagtaggttatgtttttaaaaatataaccaccttaaggtctatgtatttttcagataattcttgttataatctgtgatttctttgcatgcagttccttcatatctgaatcttggcaggctcagaaattaaaacatttcgtcagaaagcttagaaaatatggggcacaattgggaatatgtataggatgtctgtgttttggatacacacacacacacacacacacacacatacacacaccaagcacttactcttgctaaagaagctcacggtggggacttccaagggcagaatcaggtccaaatgccttcagggaagacagatttcagattctttggggaagaacttttttaactgtcaaatctgcccaccaacagaattgctgcattacaaagttcagtaaaaggctattctccctctccccaccgccatctccccaggattttgagaataccagaagcttccaatgacaggattgttataaaaacagcattcttttatgcccacccatttaaaagctatgctattataaaaagtaaagaacgagytgctctcaccagkgcgcatggtgggtatgtgacctgttgagctgtgaatgactggttggtgatgctgcagaagccacatgggcggggtggatgcagattctaatagatattatggcagccttcataatgcaggagtcgtgagggktcccatacatttctccattttgtcaagtagctaaggctttgaaatatttaattgcaattctacaaatgtattatatgctgaagagtccctcttccccacccccacacccaatctttttgttcttttgatctaagcgtgaaaaacctcaaaaatagcaytcatccttttcagatcagatcctggacattctgaataagtaatcttctattgtagtgagctccccaattctggaaatgatcaaatagaccactatttgtcacacaggtgaatggatattgtcagaaacattaagtgaggaatttctgcattgggtggttagaggaaactgatactatttttttttaagttgggaaatattttgtatacacagaaaagtctaaggaataagctgccaggcacggtggctcacacctgtaatcccagcattttgggaggttgaagggctgatggcctgagcctgggattttgagaccagcctgggcaacataaggagaccctgtctctacaaaaaaattttaaaaactagccaggtgttgtggtgcacacctgtagtcccagctactcgggaggctgagttgggaggatcacttgagcctagggcctaggagttagaggctgcagtgagccatgattgtgccactgcactccagcctgggtgacagtagagtgagaccctgtctcaaaaaaaataaaaataaaaatgctaatgaatacccatggaaccatgacacagctttgcccataaaatacattttatcctattagcttcagatcatttataaagaaaaatgccgttacaaatataattgaagcatgtgggcgccccttactttctcaccctgttccttcccttccttgacgttaccactgctcttaacgttgtgtttaccattttcatatttttgtacttatattgtgcatacatacastaaatactgtatgatatttttgcagtttgtaaacttcatctaaattgtattatactatacatattatttagcattttgctctttttcttaatgttgtttcttagatgtatccactttgatatatgtaggcctcctgcattcatctcaactgaattaccatattctatggattaatatgccatcatttatttacccagtttcctgtttaagggcattgaggttgattccttattttctactaccagggatgcagttatgaatcctcttacatatgtgttttggaggcgtctatgttagaatttctctaggaatggaattactcatggagtacacacatatttacaggatataatcaaattattctctaaaataattgagcaaatttataaccccatcagcactgtctgaaaattcttcttattctatatccctaccagttcttgctgatagtagattttaattttttgtcaattgatgattatgaagtgatatttcattttaacttaaatgcagtcaaatatactgatcttttctcttcgatttgtatgtttttgtgtcttaagaaatgtctctctatccagcaagatcataaagctattctattattttcctaaaatgttggaagattgcttttccacatgaatcttggaaatacttggaatttatttttgtgtatagagtgcggaagagatcaatttcattgttttcggtatgatggtcttttttttttttgcattttttgggttgccagtaagaatgagcattttctccatgtttgttggccatgtgagttgttgttctcttttgctcattttgctgttgcatcatttgcttattggtttataggagctctttatatattatggatattatccattgttaatcatatgaatggcaaatattttctcccagtctgtggcttgtttttactatgactgtggtatcatatgttgaatcaaattgatattcttttgatttttttaatggaatttacttgtaaaamatgggcttgatatgcattctgcagcagtcagtgtagtgttattggttttttagatcaagtttgctaattgtggtttcacatcttctgtatacctgctgattttttgtcttcttacattatcaattactgaatgtgttgtgctgaaatctcccctatgagggaacatttatgaaagttgaccatacaccaagccagaagttctgaacatgtttcacagaatttacgttataaaaatcacattctttaacctccaattctattatttttttattttttatttttttctgtctttaggaatattttaattcggttggaaattaaaacaaacaatgctttgaaaaattaagaaggaataatcaattatccataatcgagttttagctgctgttgtatttgggtgagaagaaagttgaacagagacttgagatgctagagaaagctctaaataggtggaattttagttggtccttgaaaaatgtgcatctttgggaaaaaagaggaagagaccgttttagtttgaggaattagcatgaataaaggcttagaagctggagtttaggtacatgtgacttcaatgacacccgtttcaatgcagtttaagtgctaaggagtggtgagaaagctggagagatcagtcacatggagtcatggagggtcttaaactagccagagatactggaattgctttagtagatagcacagaattaaataagaatgctcttaagtggatgtgacaatttttattagattttcatgaataatctagaagtggtgtatcagaggacttgaatgaaggaggggacaggaagcaggaaagcctgtctggacacctttcaaggaatctaagtctaaacttattaggtccaggactaagggaaaaccaaggaaatggataaaatggggtaaatttgagagacatttcaataagaaaaatggcaaaatttggcatcagattaggaatcagcacacaaaaatagaaataagtcaaagataagcctagaataatagtgatatcctggacaaatagctaatgtcaagaagagtcaataattcatgaattcatagaaatttagaaacagcttggaaatgatatctgtagaccccgcttttcagagatgaggaaattaacagagagcttgagtgactagttcctggtcaccctgcccgggcgacagagtgagacttcgtctcaaaaaaaaaaaaaaaaaaaaaaaattgaaaatgactagaatcctagaggatttaccctgtaagaagttggtttaatgctacatcagtgttggacggatggatttgggagcatctgaaaggcaattggagccatgggagtggctgtgctcttccagtgagagattatatagggaagaaaaacgaggagcaaagataaagtcacaggaaatatctataattagggattcaaactagaaggaagatggttcctaagtaagtcaggtaaggatcaaacagacrtgaggagtcctcgtgcagtggttacaggcactttgtggggttgagtgggtggatcacttgaggccagcagtctgataacccctttatcattttttattgcttctatttgattcttctctcttttcttctttattagtcttgctggtgctctatcaattttgttgatcttttcaaaaaccagctcctggattcattgctttttgaaggtttttttgtatctctatctccttcagttctgctctgatattagttatttctggccttctgctagcttttgaatttgtttgctcttgcttctctagttcttttaattgtgatgttagggtattgattttagatctttcctgctttctcttgtgggcatttagtgctataaatttccctttacatactgctttaaatgtctcccagagattctggtatgttgtgtctttgttctcattggtttcaaagaacatctttatttctgccttcatttcgttttgtacccagtagtcattcaggagcaggttgttcagtttccatgtagttgagcagttttgagtgaatttcttaatcctgagttctagtttgattgcactgtggtctgagagacagtttgttataatttctgttcttttacatttgttgaggagtgctttacttccaactatgtggtcaattttggaataagtacaatgtggtgctgagaagaatgtatattctgttgatttggggtggagagttctgtagatgtctattaggtccgcttggtgcagagctgagttcaattcctggatatccttgttaattttctgtctcattgatctgtctaatgttgacagtggggtgttaaagtctcccattatgactgtgtgggagtctaagtctttttgtaggtctttaaggacttgctttatgaatctgagtgctcctgtattgggtgcatatatatttaggatagttagctcttcttgttgaattgatccctttaccattaggtaatggccttctttgtctcttttgatctttgttggtttaaagtctgttttatccgagactaggattgcaacccctgcctttttttgttttccatttgcttggtagatcttcctccatccctttattttgagcctaggtgtgtctctgcatgtgagatgggtctcctgaatacagcacactgatgggtcttgactctatccaatttgccagtctgtgtcttttaactggagcatttagcctatttacatttaagattaatatgttacgtgtgaatttgatcctgtcattatgatgttagctggttattttgctcgttagttgatgcagtttcttcctagtctcgatggtctttacagtttggcatgtctttgcagtggctggtatgggttgttcctttccatgtttagtgcttccttcaggagctcttgtaaggcaggcctggtggtgacaaaatctctcagcatttgcttgtttgtaaaggattttatgtctccttcccttatgaagcttagtttggctggatatgaaattctgggttgaaaattcttttctttaagaatgttraatattggcccccactctcttctggcttgtagagtttctgctgagagatctgctgttagtctgatgggcttccctttgtgggtaacccaacctttctctctggctgtccttaacattttttccttcacttcaactttggtgaatctgacaattatgtgtcttggagttgctcttctcgaggagtacctttgtggcattctctgtatttcctgaatttgaatgttggcttgccttgctaggttggggaagttctcctggataatatcctgaagagtgttttccagcttggttccattctccccgtcactttcaggtacaccaatcagatgtagatttggtcttttcacatagtcccatatttcttggaggctttgtttctttttactcttttttctctaaacttctcttctyacttcatttcattcatttgatcttcaatcactgataccctgtcttccagttgatcgaatcagctactgaagcttgtgcatgtgtcacatagttctcgtgccatggttttcagctccatcaggtcatttaaggacttctctacactggttattctagttagccattcgtctagtcttttttcaaggtttttagcttctttgcgacgggttcgaacatcctcctttagctcggagaaatttgattgtctgaagccttcttctctcaactcgtcaaagtcattctccatccagcttttttccattgctggcaaggagctgcgttcctttggaggagaagaggtactctgatttttagaattttcagcttttctggtctggtttctcctcatctttgtggttttatctacctttggtctttgatgayggtgacgtacagatggggttttggtgtggatgtcctttctgtttgttagttttccttctaacagtcagaaccctcagctgcaggtctgttggactttgctggaggtccactccagaccctgtttgcctgggtatcaccagcggagcctgcagaacagcgaatattgcagaatagcaaatgttgctgcctgatcgttcctctggaagcttcatctcagagggggacccagccatgtgaggtgtcagtcggcccctactgggaggtgcctcccagttaggctactcgggagtccgggacccacttgaggaggcagtctgtctgttctcagatctcaaactctgtgttgagagaaccactactctcttcaaagctgtcagacagggacatttaagtctgcagaaatttctgctgcctctatgccctgcccccagaggtggagtctacagaggcaggcaggcctccttgagctgtggtgagctccacccagtttgagcttcctggctgctttgtttacctactcaagcctcagcaatggtgggggcccctcccccagccttgctgccaccttgcagttcaatctcagactgctgtgctagcaatgagcgaggctccatgggcgtgggaccctccgagccaggtgcgggatataatctcctggtgtgccatttgctaggaccgttggataaagcgcagtattagggtgagagtgacccgattttccaggtgctgtctgtctcagcttcccttggctaggaaagggaattccctgaccccttgcgtttcccrggtgaggggatgcctcgccctgctttggctcatgcttggtgcgctgcacccaytgtcctgcacccactgtctgacaagccccagtgagatgaacccggtacctcagttggaaatgcagaaatcatccgtcttctgcatcgctcatgctgggagctgtagactggagctgttcctattcagccatcttggaacctctattttttttaattttttaattttatttatttattttttttgagactgagtcttgctctgttgcccaggctggagtgcagtggtgggatctcggctcactgcaagttccacctcctgggttcatgccattctcctgcttcagcctcctgagtagctgggactacagactcccaccaccacgcccggctaatttttcgtattttcagtagagacaggtttcaccatgttggccaggatggtcttgatctcctgatcttgtgatctgcctgcctcggcctcccagagtgctgggattacaggtgtgagccaccatgcccagcctccttttcaattcttacattttgtttccttttctagttctactgtatgaccagtggctttagtacagtgttgaataaaaatgtaggtgctaggtatctttattttattcctgtttttaaatggactgcttttagtattttactggtacataggatatttactatagtttttctgttgataccatttatcagattacagaaagtttccatctgttcctattttgctagcataatttaaattaaactaaactatgaaatgctttttctgcatcaatttaaataatcatgtagcttttctcctttaacctgcaaaggtactgaacttcactaatgcaaatcttaaactcttcatgtactcctgacagaagccaacttggtcgttatgtacttattttaatatattgctatgtttggtatgcttatatttcatttaggatttttgcatctctctttattagtgatgttgagctagagtttttctttcttacattttgtgtctggtttaagggccaagattgtacaagccacacagtatgagtttggagygctccttctttttctgttctctggaatacattatagaaaggcagggttatgtgttgcttgagagtttgataaaactcatttaaaaaaaatgtgtgccaacttctgggttttgtgagcagatttttaatttcaggcttttttttagtggttttgttatattcatgttttcattttcttcttgattccatattgktatattttcctatttatgtattttcaagttattggtatgaaatttttcatagaattgtcttttgaagaattgctacatctttgctgcatctgcaattatgttgcctttgtgattttaaatgttgtttgcgtttctttttaaaggtctgatcaatgtgttagatatttatctattttctctcttttgtcagtcttttcaagaagccagtgtttggttttgttcattcttcctattgtttgtcttctatttccttcattcaggctcttctatttattatgtccttcctttttctttctttggactgaactctgtttttctttgttgttggatgtttaactcattaatttgcagacactaaaaaaaaagcatgtaaactttttatcatttagttttttcatttactattttttccccctgtaactcaacacatatttatgtgccaggcactgttttaggttctgtggattcatcagtgagcaaaatagtcaaaaagcctgccctcatatcttaaaaattcaattatgaattctttattctatgggttattttattaattaattaatttatttattagagatggagtcttgctctgtcacccaggctgaagtgcaatggtgagatctcggctcaacaaaacctccgcctcccaggttcaagcgatgctcctacctcagcctcccaagtagctggggttacaggcacgcgccaccaggcccaactaatttttgtatttttagtagagacggggttttgccatgtaggccaggctggtttcgaactcctgacctcaggtgatctgcctgcctcagcctcccaaagtgctgggattgcaggcatgagccactgggcccagccctctgtgagttatttagaagtgtgttttgcatttctattgatgtaggggtggataggtttgtatcctggctatttctaatttacttgcattttgtttggagaatgtggcatgtatgatgttgatttttttggtacttttgagatttgctttgtgacctggaatgtgcttttttttttttttttaagttccatgtgtacttgaaaagaatgctgaccaatgatcttaagattcttttcaacttggtgagtcagtcgttccatatcaatgtcaaataaccctgcctgatctggcatgttgttcaaagtcgtagttaaaagggcctaattcctgttgaggccaattcggtattgagtcaggagtggtgcttggagtgctctctactctaacacaaaaatttaatgaggaccatttcctttttcttctagggagcagtagggcagagaatcatggaatatcagaaaaatctgttgaaagttgtccacagccagcagcaaactagcggcttgaggaactattcagcagacacttatgtagcacttaagtatgcaccagacayggttctgagtggttttacaagtkccaactcacttcatcttcataccaggtcttgacagagttagttactatccctgtttctctaatgaggaaactggaccacagagaggttagggactaagggctcacaaacggtaagtggcatcatcagcactgaattcaggccatctctgacccagggccatgctctcagccctgccaccaatgctgcctcccacatgaaaattaatgctagttaaaaaacaaacaaacaaacaaacaaacaaaacaaagaaaaccagaaacctactcctttgctccactgcaaacttccagaattaaattctttccaggggcaaaattttgaaatcgatattctgatgaatagccagattttagaactactctcaggctaccctcttcattttatacatggggaaactgaggccgagagggggaagggatttgttcactagttagtggcatatgaaggaaaaatctggttccttgaaacttgcttctctgtaaactctttgtggggacactcgggagctggtgatcctagcgtgggtcttaggaggcctggctcaccactcgctagtgggtctgaactgctcatccttccccaaagaggacccatgttggctgcctgtatctgacactctttctctctcctgtggctttctccttctctctcctctagctttctccttctgtccctatttgtgtctgttttatctctctctctctctctctctctctctctctctctgtctctggtaaacccttctgctaaggaactgaagcagagatcctcgaagctttggggactggcgcaggttggtggtgcacatttttttrtagtggagagttttggaatcaaacagagctggtaaattggccaccttctagttttgctatgttgatggaggcctcactctgttgcaggcacaaactctggggctgcagcattgaaaacaaatccctgctctcaaggggtttgcagtctagtaagaagatacagaccacaaatgaatagataaataccagataatatgttcactagcaatatgtaccatgaaggaaaacaaagcagagtgaagcagtagaaagtgaagaggctggtagggctgctccgggaatggtctctctggcacatggcagctgagcaaacccagatgcaagtggaggagctggtcatgtggcagtgaggggaaaggaatccgggcagaggaagcagcaaatgcaaaggtcctgatgtagagyaaactcgtgcaaggaacagcaaagaggtcagtgtggccggaccagccttgagagaggcagtggctggagaagaaggaaggagagggtctgggccagggtattgagggggtctctggatattttgaggactttggattgactccgaatgagatgggaagtcaccagggctctgagcagaagaccacaggatgagtctaatatttctgaatgctcactctggttgcttagtggagactagaccgtgggggcggggacagagtggggagccagtggaggcagttgcagtggtccaaggggaggtgacagtggcgcaaactagggtaggagccacggagatggtgagacaggttcaggtgctgactacgtttcaaaggcaaatcattcaatatttgttcatggagtgagtgtgaggcatgaaagaaagaggtcaaggatgacgccaagattttgatatgaacttgaagaatatcggtgagggaagacatcaggtatttacttatgaacatgtgacrtttgtgacagctgctgcatatccatgtagaaacgtgcaacattcaagggaatctcttagctggagagtcactgacatttagatgatttttcagccatgagaccttgtcagctcacccaatgggtagatgcagataaagaagagagatgtccctaaatgaaccctatgtctgtttgaagtttagagatgggatgatgatggatgcgccgaagtaactgagcagaagcggctagtgagataagaagaaaaccaacaaaaagtggagtcccagggggtcatgcgaggaacatgtctcaggatgaarggagttattaacgtctcccattattgttaataaacaaggatttttacaacaaggtgattggccctcggaaacaatacttttcaatcttctttgttctcagtctctcttttcctttgcctggcggaagcgttccctcacactgtctgcctcatgaacttcaggccctactacrgggcgcaggggacagcttcgtgccatcacacctccagaccacctaggctactgacatctcactacaaaatcaggctgtttcttgaygcaggggtttcacaggaaaactgcatggcaggtacatggcagcccacacttgggcactgtgaattgccgccaggacctgaacttagattcttgccattttctgagcctgaatatggcctaagacaagacctggatgtaggatctttaagcccttggccataggggaagggcttaggtgaagccaagaatttgtggcaacaaattcaggagtatatacatattcttgaatttaacattcactaacatcctgacatcaaccaacgaagaagtcagtggcttaaagaacttaagtatcttacttaagttcatccaaatctccagcttaaacatagatcttccttgaatatcttacataaagaaaatgaggaggacgaaaacgtaggagtcatcctagattctctgtgttccctcaaaccccatagttaatccactggtaagtgcctttractctactactaaaatctatccttgctctgaacatctttcactctgttcatactgcraacctagtccagatccccagcagttcttgccaggggtattgcatcatccgcctgcctgctgtatctggagcctcattcccttagagtctagtctccatacgttagctgaagtgagctttctggactgtaaatcagatcacatcactcgcccacataaaacccaccagagactttccccattatagcccaccaggcctcacaagatctggctgccatctttcttcccttccatgcttcaccttattcaccactcttgaactacattcacttttttttttttaagatagtctcgctctgtcacccaggctggagtgcagtggcacatgatctcggcccaccgcaggctctgctcctgggttcaagggattctcctgcctcagcctcccaagtagctgaaattacaggcatgcaccaccatgcctggctaattttgtatttttagtagagacggggttttgccatgttgcccaggctggtcttgaactcctgggctcaagggatctgcctgtctcagcctcccaaaatgccagaattataggtgtgagccactgtgcctggcctgcattcactcttctttctgttcctcccacacaccagtgcatatccaccccagggtctttgastggctcttccttcttctggaaggctcttactcaatgatggctttggctacctgctcctcactctgccctctcctcatcaccatctcagccctggctgcagtgatctgtcttcctgycttcatctgtggaatttgctttattccacctaycaggacctgcaatggtctttttcatttgcttatttctttttttctttttcttcttcttcttcttttttttttttttttttttgagatggagtcttgctctgttgcccaggctggagtgcaatggtgcgatctcggctcactgcaacctccgcctcccaagttcaagtgattctcatgcctcagcctcctgagtagctgggattacaagcatgtgccaccacgcctggctaatttttgtatttgtagtagagacgaggtttcaccacgttggtcaggctggtctcaagctcctgacctcgtgatctgcctgcctcagcctcccaaagtgctgggattacaggcgtgagccaccgcacctggccttatttgcttatttctttgccggccgtctctccattttaatatgtaagctcctgtgagatgggggctctgttggacttgtcattgtcatatgctccctatatgtgtcagtgcatagcacttagtaggtgttcaataaatgcctgatgactgacaatctgaaattgaaaaattattttaggcgtaattcctgatttttattagatttctgtttttgttggtgttcatttttatgctcaggatggggtgacattctaaatgtgatgaaaggaggtgattcttcctgagcttaggagttagctgagacctagatcgtgagactgtctttctcaagggaagagtcataggctgcacccaccctccactcccagcctatgtgttcttgccaacccatgccgcattacgaggtgatacttgggatgcttaaggtgcccctgggaagccttggacaatcactctttggaactcttgccccagggtgacttggctgatgccttagctggaatcagaagagcccaggcccagagcaaaggaggcattcactgtgctgaggatgctgactttcaggaatccatagctggccaagttgtgttaacgtgaagctggccaagagctttggttgcctcatttcctcctgaagatccaaagtcagtagcagctgtggctcccccagtgtcagggcacccaatcttatttggctttgtttttttaagagtatgtttcttcaggggaatccagagtgagaaaatattgaggctcagaggagggaaatttcaaagccagatgttttggtgctgactttgggactggattctgagttttcttttgagamctttgccactttccctgtagtgtgttggtgtccgccttcaatcccataagctcggttgagaatgcctgtattagggagtgacttcatcattaactccagccagtcaactgtttctcagcaccaaaatctgcttgaatcactggagaattgactttgccctgctgtgcctrcttgtacagggtctgtggagagccagtttctgcaagtggtctgagacttacacatgtcactgctgctctcacactgcccacatggggcagtcactataggagtttgtcttatgtcagcatcttgcataagaaacattttatccaccttgctttgggaaacatcctttcccattagaagactcaaagaagggaagtcaaatgcaactatttcttgagtgcttrctrtgtgccagacacttggctggggactcaataaggccacatcttaagctgagccacagggaagatcaaagactgtgggagggcagatgtcacttcttaagcctatccagtgctgtaggcttcccctacaggagtccgtgtccacctacttgtgtgttatgctgggatggaagaaaagcacaccaaattcagagawcctaggtgagtttggaaggaaagatagaacccgtcacagcggtgagccagtgtcagtgagagcttggaagcaggatctcgttcaccaggttaccatcaatgaaccaggaaacctgtcctggatgtcacatctaggaggagctgagaggccaggcccacatttagaatagcagatcctagatttcaccaagaaggcactgaaatgaagccaatttatgcctcccataaaaagcctgtctctgtgctaacaacctcatctctccttgtctactcctgggcttttactctaaaatgatctcttttcttttgcattgatgatctctaactcctcgtatctcctgttctctaaccaaaattaggtcaaagattctgccctcctaattaaactctccctcagatatgtacctgcctcaagttcccttgcttttggtaccaacctctcccttttctcaagaccrttcttcttgaaattcccactttggtttccttacattcctttggcttctttagtaacctcacaatttgtttttttcctcaaatctcctgaaactggtctctctagtgatcactagttaccttcttaattaataattagttatcttcctaatcaatacatcctgtggctttcaccttctctttcctcattcctccatgcctctccatttcacacctagtgagatcataagacttgcacttcttgtgcacaacagcaggaaaaggacataggaggcaggtgtgctgatcctcctgtgttaggtaggagacatagagtcttccttggcacttgagaagctccgaccaaaaaaaaaaaaaaaaaaaaggatactcccatgggtcagggttttgtctttaacaaagtgaaggaacaggaaggcctgagttagaggcaccctagacttggatgaactggatgctgcccaggccctattacattttgacctgttttcagagtaataggcaaatttggattaaactgtgtgccattgtttctaggtttagataaagcagcatgcctaattgagattttcaccttttgggtctcagctcattatatctaggttcccaaggatttgagtagatgcagataggattagtcaatattttaagcctccctcataagggagtacaagagtcaaacctttgtttggagacagctggggctttaaggattgactggaagaaaatcctttgtgagggttatagctggggctttggattaattaagaaagccctctgattagagtagagaggggtgaccagtcctgctggtgatgggttgtccttgcttcggcctcttgtagcactcarccagcctttgcctcccgttctccagttcaggccaggcttccttccctttgctaatttcccaaagcactgcacattccaaagccatcyccattccccaagagaatgggtgagctcagccccactgctcaggtcccgatttggagtacggttttggcatattttccatcacagttgttgtttctaggtttcattttattctttgtttctgttccccccacaaggtcttaaagactgaactaggaacctgtaagaagaagagagcgtggggtgatgattaatacaatttttcaatggtcttgtcagattttacaggatgttcatgatgctaattcagcagtccttataatatatacctttctttaatgcttttaaatctcaacacaaggtyaaggcaaagtcaggagagggaaccagtgtgggacattggacctgacctcctggtgttgttgttgttgttgttttggcagtcctgtatttgctgtgtaaccttgagaaactttctttccatctctgggccttgttcccccacatactgaacagaagtaatcatgctggtcccctccctgcctcagagggaatgagaggatgaatgagatcatgtctgtaagcatgttgaattccttggagaaaggtgttgtggaaatgcacagatgttgggtatttgtgcagcactccaagttcttggaaacagggcctcatgcagaggacaccttgcacgctgctagcatctggcctagagccaaatcatccataacgtgcaagagggactgggtgtccccaagcctccatcaggaccccacctgaccagcccagactgatggatgccaactctatccatagagtttcttaagcaaggaaattgcacatgcttcattggaagtatatccagggtttcaagaatcctccctttagggaagtcttctcagtgtggagttgcactcactttcacttcgttttgtcctgtatgcagtggggtgaaagaactgcagggcgttcattcgtatttacttacttttctcaccaggcacaggacgaggtggtgaacagtgcaatccttatggagttgtggggctggtggaaaataactcaagagagtagaacaggaaatgtgtgtaattctaataagtggaggcagcgccttgtccgatcatttggtaacctagcttaactcagttggttaaaacactgttcctcaactattctcagtccaagatgtgccaagtgcttaactcagttggttaaaatgattttctrtatttcctagatggcatccctctttctctttcatccagggggtgtctgtcaccctttccctccatccagatwagggcatgtgcatgcacacccatatgtcctctgctagggctgagatctttcacctttgctgtcaagtctgttttgcaaaacctacccaggtttccagaagcactaagtgggacttgrtggatgcacttgaggcttaagtgacaaggtgggctcatagtgtttccattgtctgtgtgaggaaggaactaagggcattgatggaactggtgttgygagtcctcaggacagcacrgctcccaccactgctgtgatccagcctgtgaacgtcagcgcagctggtgtccttgggtgggcgcttgctgcctgctttggtgccacatgcccgcttcccagaggggcccatggaggggatggtggcctctagagtaaaggccccyccagccttctcttaacatgtccccacactttcactgggattaatcgctcccctgtgtgcttctgtggtccttaaatrtacctctattttatgatgagtgacagccaactatggtttgtggcactccttaacagtaggagtctgtttcccctcattgagggagggaattgagtcagctttatctttgtctccctattaacccagcacatagtatgtgcttaataaatatttgggagggaaagaggaatataggaattttatacactgaggttcatctaaggggagctctggaaattcctgtccatggtatctagttagcaccacagaaaataggggttwaagaaagatgctgatgatgygggtagtggtcctgcagggttgacaggtttggctgacagcctgtaagagcacaagtatgcttttcatgttgtgggggtgcagagggaagtggagagagtggggaggggaaggggactttactgttctcgagagctacccgggacttgcycctgggkgagtttcccacctgcttgctaggtggaggttatcccccttgcctgggggctggcttgtctctgctgcctgataccaaagctgatccttttcaggatgggaagcagccagctggttttaagagaatgctctcttctgcccttgaggggagtgctgctccagcggtrggactggggaaatggccagccctctgtgggcagatcagctatttccagaagccaggcaggcaggagaagcctacgtcaccattctgttggacgagccaggcagtcgacaggcagtcgtcccggttttgtgttttttgtgttttttgttttgttttgttgttgttgttgagacagggtctcactttgttgcccaggctggagtgcagtggcatgatcacagctcattgcagcctcaacctcctagactcaagtgactcagctccccacatagctggactgtgggtggcatgcaccaccatgcccagctactttttgtattttttgtagaggcagcatttcgccatgttgcccgggctggtcttaaactcctgggctcaactgatctaccagcctctgcctcccaaatgttgggattayaggcctgagccactgtgcccagccccaggctcttcctgtggcttctcttctctgttccagttgggcagaggtggcatggtgarggcagtgctgggagtgaaggaaaggacttgatctgactgggagggccaagctgtcttgggaccttgcccctcccatccttccccaccatggagactcgtggagacccctggggccatgccaagagtcttattgctaccctgtaagcccccacttccctagcactcttccccagtcctctgagaatggccaggttcagagacagcccattgagcctgatgacctgaggaccargcccttctccaagtggctgagcaaatacttggagctttcttggcctttcctgccactcaccagcccaggagtggacaggactcgtgcctcatacctgagccaaggtgggcataggatgttgctgggtcacatgagtctctgctgtgtctggaacaaaargaactctgacttcttgagaacctactatgtgcctaggaactagaccatttacctacattaggtcattacagtaggttaatgacatacattgcatagaggaaaaacagcagctcaccaaaacaggtcatgtgcttgagtctcccaggctaataagcagtagagccagaatttgcacccaggacccctgactccaacacctgygctgtgaaccactgttttagcaccagcttctctctgggatctctatagggaagatgaaaacaagtaaacaatgtgggctgcattctcaagggagtcgtgatcagaatgggagtcaatatagcacataggaaagaggcaccagcaacatctgcagaggggtgtggcatgccgtgtcccatatgctcagaggtttagagtggaatatggctagttggggtgggtttcctaggtgaagtgatgtttttgagcaagactttgaaggctcgctcaaagacaagtagagttgctgagaagaagttgtackctgtggaggactgacatttctagatggacagcyrctcactttcagccaagaccacttgtcctcccactgcccccagagaagggcagctccccacagagtgtccraggtccatgcactgacttcttgtactcrtctgtttccccyactgcatgatcgacttctccatggcagagaccttctcctgctcattagtagattgcctgtgtcaagcccatggcagggactcaatgaatatttttgaattggagccctgatccctatccctctgaggagcagcagtcctggtgttagctgtgacccaggctgtgaaaaaccagagagcagctggcatttctggtggggctgcttgctgacagatcttggtgccacatggygagcagaggagccccagggcttggtggaggtgtgggagggacacctggcatgaagggtcccagggcatatacttggcctgcctatgccttgcctgtgactgcagtggtggtagggagggaagtggattacagtcacccctgcactccctcctgtccctgcacacatctgccatggtgaattatagatgttgggacactgtgctacccaggaaggacccaaatggagtaaactcaagagagagatgaaagtaggaggggagacaagacagcttggaggctgagccttggaagagccaggctacctggtcagcccagtgtgctcactgctccatccttcaagccctgccctgcctcctccaggaagccctccctaccctgccctgtcctcactgagttctctctcctccctcctctaaagttctcttacaccgatcatctgtttgactttttggtgactctgtagtctaccacggtttcagcaccaggtttcctctaagatttctttaaaaaattaaaataagtaaacggtatggcgactctgttttctgaactgaaaattaggacatggacawgtgatgtggcatgagactggatgtgaaagttgatgctgttcagaaaaatacggtgtatgtggccaacacagagatgactccatggccctcctccaaggtctgatttgcctatttaaatctgttgtttgcttgtctgttttttaactcacttgtctaagccttgtctcttcatttggattaaagttccttgggggctttttgtgtatcaaagggtgtacattgcatttccttgatatttttgaatctcctaaagacctctgccacttcatccctgcttttgatggtgggagagagacacgtcaatctttttcctgtttcttgatttttctttttccctaaaataagataatttaggctcttacctgagctcttattttctacctttaattgtggagttaaatagagagaaggagatggaagacttatgatgataatagggggcagagctggaggtaggttgtcttacaatccaggattggcatctacttcagagtgcacagggtacacagagtgcacagtatacagtctctactgggtcaagggtgtggcagagaagaggcaggcttggggttttggtgacatcatcacagtccccagtactcaaggggtccacggtccccagtactcatggtcaccaccactcctctgtgctttctcttgagtgtggaaaagaacaactcagcatcatcttgtccttccgtctgcttccaaataagatcaarctttacmcattccacccagatgagcatctgttttgaatgctcatagatatctgctagatggttagctccttaaaggttcagatccacagtttatcccttcatttctcactttagttggcatggcggtagacatgtagcagcagctcaaaatatccttaacacatagggaaagagatggctgagttcttctctgtcacttgtttctgagcttaactgtcttcacatacagggctcttccaatgcctaacgtggtatttcttggcttgcagggcatgacctgagctggggggcagaaagttcccaggacattggaactgaacagcatgaactgcaggagctcttagccttgcctscagcccgaacccttgactgccataakcacagttctttttatctcagacccattactacccaggcctccagccccaktgtcaccactgacctcccatattccccaccctttgcctagccctccagcctgagagagctggggtggaggagtargagagagagacagasagagagagagagagagagagagaragagaaagagagagatagatagatcagagaatatagtttataactcatcaagagtctataattcaatctagtagaaatgctcatttatctcttaaaatctcaaaagaccagaattcttggcctactttttgtttttgataaatataggagttgggaaaatttaagaatgccaaactgtgggataggaagcatagaatgagagaaacagatcttaggataaagaattcaagagccactgatctacatggatctctatgcattcatttttttccttcttccttggctaaagggaaacttgattaaagagaagaaactggtaccatttttaaagtaagttgaaagggaaagaaatggacctcttttttccatgattttccccaattatcccttccacccgtctgttttccagcagaatctgttcttatcctctggacccatgaaaggaacttccaagagaccgtctgctttcttgggagcctagtgaaagggaaatatagatttgtgggtcaaatagggtaatgagagaaaagtagggccttcaaggaaaagatgtaagagcttaatagcttgttgactcaaaaaacaaccacaggggtctatgagtagtaatggactccagggaataagaagaggatatgaaactgaataaggaaggaaaaggttagaggaagagagtacatttcctccagggtggaagtgacccagagaacagtagggcatttgttcattaacttttaatgcgacttgcacttttagcattattcccagggatgtgagtgggaaaatgaatggggtcaggatttctcagccatcaagtctcctccacgcctggccccaactccaaaaactccttaaggaccttgtctcctgggacactctgctttggcctcatcctggtgggatattgrctgcaccttgggcactctgcccttccccaaatcttctgtccagtgaccttgatgtcactgagacaaaagtgaaattcatgattcataaaaaatgtgagtggtagagggaccaaccttacatttcaccaatcctgccttcactttacagaagataacactgagaccacatagcggaagtgacttccttgaaatcagatggcgggcaagctgttttcggcccagactttcacctgaaatgctgcctgttgctctgggtttacctggagtctctttcctgcttagcaatcacctccccacatggagcagaaggcagtgctctgtgcaaatccctktgtgcaggttgtgtggcaggaaccaatgtcgggaggagagaggacactgctattaccagggcctggarctagtacccrtgttcccctttattctgcttttgtctcgctttgagcttggggcagaggaactcttctgctcttccytgtacarcaggtctgtcatgcagaggctggttcttataaaagattaaccttgtctccctcctatagcctaagaccacctgtgagtcacctcccattaatccacctctgaccagaattccagcaggtgcctagctgccacttatcccctatctgattcttattgttccctgggatcgtttctttcatcattgcatgaccctgaatttatagagtcccagttggaagggacaatttaggggctttcagtaatgtttctacatatttctggcaggtgctcatttagtgtctgtttgaatacttctagggatgtcgaattcactactttataatgcagcttgttcccccttttgatcagggagcccacaatttccatgtctcctaaggcagctctctgagcccacacagaggaggcagagccagctccacacggccgttcttcagatgtttgaaggcagccgttctgccttgcttgagtatcttccattcctaccaaagcacttgcatttattttagccgttccttacttaacaatgtttccagaccctctcctagtctggcccctctttcctttttttcaatatccctcttaattgtaggtcccagatagaaactccaaaagtgggtgcaggtggattctttttcttttcattaacttttattttaagttctggggcacatgtgcagaatatacaggtttgttacacaggtaaaagtgtgtcatggtggtttgctgcacagatcatcccatcagctaggaatgaagcccagcatccattagctattcttcctgatgctcttcctcccaccataaccaccaccaacaggccccagtgtgtgttgttcccccartgtgtccatgtgttctcatcattcagcttccacttataagtgagaacatgyggtgtttggtttctgtttctgtgttagtttgccgagaataatggcttccaactccatccatgtccatgcaaaggacatgatctcattcctttttatggctgcatagtgttctatggcgtatctgtaccacattttctttatctagtctatcattgatgggcatttaggttaattccatgtctttgctattgtgaatagtgctgcaatgaatatatgtgtgcatgtgtctttataatagaatgatttatattccttgcattatacatcccataatgggattgctgggtcaaatggtatttctggttctaggtctttgaggaatcgccacgctgtcttccacaacggytgaagtaatttacattcccatcaaaagtgtaaagcattcctatttcttcctaacctcaccaacatctgttgttttttgactttttaatgatagccattctgacgggcatgtgatggtatctcattgtggtttttgatttgcatttttataatgatcagtgatattgagcttttttcatatatttgttggctgcatgtatgtcttcttttgagaagtgtctgtttatgtcctctgcccactttttaatggggttgtttgttttcttcttgtaaatttgcttaagttccttgyagattctggatattagacctttgtcagatggataggttgcaaaaattttctcccattctgcgggtcatctattcactctgatgatagtttcttttgctgtgcagaagctctttagcttaattagatcttatttgtcaatttttgcttttgttgcgattgcttttgacattttcatcgtgaaatctttgtttgtgtctgtgttctgaattgtattgcctagattttcttttagggtttttatagttgggattttacatttaagtatttaatccatcttgagttaatttttgtacaaagtgtaaggaaggactcttacttaatttgctccaaatgttacacatatgtcaatgctgtctgagttttagaggtcgtgtcayacttttggcttatgccgagttcagattcaactggctccctgaatgcttgtccacctgagctggcattgatgtgagctatacccactcgcrtgcttttctgaacctaaatgtagakccttacagttgaccmgttcaaatgtcccttgttaagttcagccaaccttgctaggcacctgagatcttcacggatatacctgctgccaagcagtgttttatctgctttccaacctagtgatatctgcaaattttaagctggatttttctttatccaaatcactgataaaaaatgttgatcaggagaaggtgaaagagagtggcaggagaaggagaaagaaagtcaaggattttctttcatcatttcattaatcaatactctttagatatgtttacttcaccaattgcaagcccttctaattccacgtagcacagaagacagcattcagtccccctcagaaatgcgttccagtaaatcccttggaaaattttgaactcagtccycagtctttgcctttatatatctttttacataaaaactgtggccccaaatgtgtccatctttcctctggcaaagagaaggccgaraatttggcttcctaacccagagcctggagataccccygccacccagttggcgccctgaggatctyggctcaagtgtgggcaggcttggagccagtgtccaggcacttgtccagatctctggttggacagcccttcagaattcctaatgtaaatgatgctgtcacatctggtggagggtagagatatagccatcaagcrtatgcagcccatgttccaaactaagtctttctcaatcagcgtcaggacatctttaaggccaccccaggaacctacatgtaaaaatctgccagcatcaattatctagcgaccactacctctgaatcaggactgaaaagtagtgcttctcacaaagaagcgagcttggtccacatcagacctgaggggtttgatggcttaagggtgggaagctgggtgccctcattctcactcttccctgggtacatttcttccctacctctctgatcttccctcctgcttatcwtgtccaaactgcaggtttgttttcacaaccttccattcattgaaatgccactctgctgctcgtccctttcwaagatgctaagaggatgtggcctatgggagaaggggagccrtctarggaaattgcccccatgctggaagtgggaayggcagggaagagggccctattttccattgaagaaaagccgggacaaatgcttcttttctctttcccaggaatgaagcaccttttgaaaggtgtaaatcctcactggtagtcatttcctttgggtatggtagctgagccttcctctctcccaatgcttgacctccagtaggcatgggtggtgcagtggtatggtcagggatggaggtgggtgggattctcatgctcctctccactctgctcctcagagtggagaacagcatagagaagtttcccaactcatcagaggcacttacccagaggtctcagcggaatcagaacrtctgttgctcccctttctgcaagtttgtttcttcctaagatgggagaagaatagggatagagaggggatttgggtgctgtgaactttctttttccttgaaggaggacatcagctccacatggatggtaacaccactttacctttttgggtctctagattttagggacagaataatttcttgcttatattctgaaatagtaagtggcttgacactgtggcctttggggacataatggtttgcatttcctgtttgtgacagcaatttatgcttcatgctaccttctccttccccatgggtgccaaaggcctccccagcaccaccccactgttccagatgtgaatcatggagcctcttcctttttctgcatcattctcccccccaatcctgagacccccgtctcttctcttatgcctgaagctcctatgtttccttcttctttatttttttattttttgagacagagtcttactctgtcacccaggctggagtgtagtgatatgatcttggcttactgcaacctccacctgccaggttcaagtgattctcctgtctcagcctcccaagtagctgggattacaggtgtgcaccaccacgcctggttaatttttgtacttttagtagagacagggtttcaccgtgttggccaggctggtcttgaaatcccgacctcaagtgatctgcctggctcggcctcccaaagtgctgggattataggaatgagccaccgggcccagcctgtttccttctttttgattgtatgtcatctttacagtacagttgtaaagagacaaaccttttatttttagtattctactttcaaaaacttaggatgaggggcatttaaaaataagttactatattttttctctttacaaaataatctttgtttactgcaggaaaaaaaaatggaaactcacataagttctttagaaaaaaagcaaagaacaattattctgaatttgaccaccgttaacattttggtatagtttmtcctaatccttgcatgcatgtgtgtgcttgtgggtgtaaataaaacgagatgtactgtacattttgtgacctgagttttctactcaataattattgtgaacagggagccatacttagcctggcgttttggcacgatgcttctaaaaccaaacagaggggcatctttttgttgttcatcccctgcctgttcaagtgactgyccagcatgtttgccttttatctaagccatggctgagtgttcttttcatttctctccatatgtccatgagatcttgtttctgtggcttgacgcctttctaaacgcatatttcttgctttggtatctgggtkcccagagaacatcttcccctccaggagaggccatcagtgacttttgctgcaactttgtctgctcttgatcctgtgactgggaaggtcagcatatctcatccctggtgaggagcagaaacccagatgaggaaggggaacaaagtggtgcccagaattgtcagcctggaagatgtgatgtggctccgagtccagagccctgtgtccaggagaggcctggagagaaataagtgtggaaactcgtggaaggaggaggctagggtgggaccaagacaggcctcccagtctcagaagggccgtacaactggaagtacatgtgtcccactctccgtggccctgagactggggcaagcacatgagttgcacraatggccacagcagatgagaatgcacagatcattgagatctttattttacagatgaaaaaactgaatcccagaaggagaacattcctatagcaagtaatgacagagctgggtcttrgaagcacatctcctgtctgtcaggacagagttatcctrtatcccaaccttagggcagatctgagaactgacgacagcaaggcaagggaatgggttacgaggccaaggacaagtgtggctcctcagcgaaaaatgtcaaacgtaaagttgagttcccttcctctttcctataagaaaggctagggtttggaaatacgagggtctggaggaggtgacaattggctccctttcccccwaaagaagccagccaaccagaaagtgcttcttaagagcctgatttaagctgagactgagactaagaagtccagtggctcagaagtggtctctgcccccagagagtttgaggtctaataaattgttatattgtgtggcagagactgtgtgtatcatggaagcacgatgggaagagatgggtatgatgagctgcagctggcagaaaactcttggaagatgctggttttacaaggacaaataggatatgtgtgtatatgtgtgtgtgtctgtggaaacggagcaggaagagtgtagcatctgaccatggagtcacactgacctaggctcaaattccatcttctcagttacattcattcatccatccatctattcattcattcagcttgtattgatggarggtcaggaactgttgtaggtttggggaacacaacaggcaacccccctattctatggagctttcattccagtaaggctgcagagtgaccttgggcaactcgactgcccatcccttagctttcaagctgcagtactgcctcccacctcacaggctgtgggttcctaagagccgtaatgatgatgataaaataagtactatttactcagcactaacaacctaccaatactctgctaagcattttgcaaggataatttcctctactcttcacaacttccccaggggacagggttttacagatgtggaaactgaggcttagagaattgaaataatgatycagaatcaagtgacagagacaggattcaaacccagcaatcataaccactgcagtcaaggtggcccacctgaagtgtgttgggagtggctggaactgacacctgaggagctctgtgacccagcagaattctgtgcttttcctggggagagcttcttctaagaagaggtggccacgacagcygatagaaggctgtgacctgagtgcaagccacgtgccagccactttctgtatgtgagaccgtgctgcttgccaaaagctgttagttccttccattctggctggctgggagagatttctcatggttgtgcgtggggagagttgacatgtttatgtggaggtaatgactgtgttggctccttaaggaagaattaggatgagagcccagttccctgtttggggacttgaacttagattctctggtggcctggaaaaggtggataccttgcaggttaatgtaggaagttaccatcccatgacaattttattttactcttctttcctttgcccattagctactgcaaacttaaaattacctatagtggagagtggtaatagtctacttcaaaaacagcaaattcccagggatttgccctcacttttggaatcttagctaaatatttttttctctatgggatcaccctcttttgcatgtgactgaggcaagccttaaagatcaagctgatgttagagcagaggaactgctggttggtaaggatgcctcagagatgaaaaggagaggagggtggtctcagagaaccagaagaggagtgggwaagttggtcctggaagaggacttctcactccttccccaagccttgccctgtctcttgacctcccttgactccctgctcttccagctcagctttgtccatgggctggactgaatattgccagcaggtagtcataaggacccatgcgatcccctaaatcaatactgaatacaaaggaagctgttgtttctgcttctctggcaggagaataggaagtgaccactggcttgagaagggctgtgctaccaaagtaaaccatcaygggactggttctgaaatgatccaattccctgtctctttaggatgaatctctttaatccaagtaccattaaaatggaatgtagtgatcattcagattcaactaatgtttattttatgaagtggctactatgaaccaagcactgggataaagctttagtacagttaggccattttattcacttaaagagcaaagggctcaaagtttacctttccgtgatctatgagaaaaaaggtttaccaagcaaatgagtgctatatgcaagattgccaaggggagattttaaaccacttacaaggacaaactgcttcccagaggcctgccaatgcttcttaagtactcccttgtgtgggcaaacacagacccaggagacaagcgggaaggacctaggacaaaaagtcagcaggctagattccacttctggttctgcactgagctagccacatgcctgctactgcatggtgtcatctagtccccatttcttgtccacaaaactagcatgagccctccacaaaagccttgctgagcaaggggttcagtgtgccccttttgcataaaaaagggagaaaataagaatgaacatgcacacacatttgtatttgcttccatgttcacaatgacatccataagcttattcaagaaattaataatcatggttacctatggggagtggagaggtaggagtgagacctgggcagatggagacatagatgggaggaagattcctccccatggatatattgggttttgttgaaccgtaggaatacattacctatttaaaaatttaattcgtgggaagggcctcctaaaatccagacataagactatgtagaacttccaaacaaaaagaaagtcgtgttggcattacctgttctattatactgatgttggctcttcctaatcattaattttttttctaagtgctcccaaactatccttaaattgttcatttctagactcttgcctggggtggatgatattcctcagtgccaggtcactgggcagagatttttcactgtattggatctcttctgctttgtctactttcttatttgtgaaaatatgtgtgcatacacacagagacatacacacatgtgcacacacacatgcatgtgcacacacacacacacacacgagctgactsccttaaaccaggtagctgacctccatgggtccacactctrggtccaaactcaactgaaggaaagtgaactgaaggagacatttgtgaatttgattctccaacctaaggactttgcttttcaaaccaagagtgttcagaagggcacagactgcagaacatgaagacttctgttaccattaacatagttccccggctccatgagacatgaacagcctctctgagaatgcaccgacaactcagcatgccttgtaaacagaccayaattatagagcttggttttgactttttttccagggccttaaagttgatatatttttacatttcctggattggagggtagggagcatggctttgrgtttagcttttgctctgctgattatctcttggctctgtgaaaaaccttggcagtgctgtggggaattggtgcggtggggaatggaggcttgaagagtcagttgacctgcagaccgagatagagcttaaggtggaaacttggatgaaacctttaggctgtcccttccagtcctcagcgagamcctagggatcaccatgtgcaatgctatgtggatgtggcgtgtgacaccacaggcaccagagggagtttctgaggttgcagaggtgactgagcaatatcttccaagctccctggtgtattctggtttggccaagcaatgtgttgctgcaagagctcawggaaaagttaacacatgggaagggaaagaaatccattaggtgactgcattaatggatggggagagacttccaggacacagactttggcaaaatatggtcatcataaagaaaatggctragtatatctctaggctttcgagtattgtcatttgcactgtgttatttttccctccaaggggttatttggggaaaattgtatacatcccaggattgaacttccaaacaaatgcaagctgcagccagccccagagctgcagatgggcatgtccctagggtggctttagaaaaatgtagttctctctgtgctcagctcaacctgccccctctgccctgagatgcacacacacacactcacacacacacgccactcccccccgccaccccccacacagttccttcctttgcagaagagatgagaaaacctctctttctttgtactgtagagcarttcctttggaggacaaagactgttgcaatgagctttttgtctcggcagagtttgctaatacactttaaaatatttattgtgaatgggttggaggaggttgctgtgggaagccctgtgtgttatgtatacctttgcatgcttcagcaatgcctgcccagtgctttggggactcagcagatgtccacagatgatgatagtgactttgaggaacccccatatttcttgaatttttcataatgagtgtagaaagaggtcccagcactggaaaggaaggtggggagctgttcccctcattgcttacagtggtctrcctcttgtagacacaaacctctaccttgaggagcccctttctgagggcaagtgtgcttctgagagggcagatgccagccatgcatcacaatctagggaggtgggaagtgtgaagttgcatggaggcagggaacctgggctctagacacgactctgcctctaacattctgtggaaacctcaggcttctgtcgctttgagccttggttttccatgggtaaagtgagaccatggagacccaccttacataattgttgagaggattgtttaaaatacatattttggccaggtgtggtggctcacaccrgtaatcccagcgctctgggaggctgaagcaggaggatcacttgagaccaggagttcgagatcaacgtgggcaacatgaagagacctcatctctataacattttttaaaaaaaaattagccaggaatggtggtacaagcctctagtcccaactacttgggagggtgtggtgggaggattaactggctccaaaagttcaaggctgcagtgagctatgattgtgccactgtactccagcctgggcaatagagtgagaccccatctctaaaataaataaatttaaaaaattaatacatgtggaacatttcaaaaacatgaaataatagggaaaacaatgtagtgaaacttcactttctttcatccaacttcagtaattgtcagctcccagttttgtgtcatctctattcccactcccagccccttcccattatttccccttaatgccagaatatgaggacttcatggcatggaacagtggcatggaagtgccctccagagtatctaacacatagcagatgcttagaaaatgtttgtggaatctgaactatttaatagtacatgctttataattattacctactgtaacatggccagagggtacaatatttctcactgccttatggatgagatgacctagtctcaggtcaagtgacttgcctaagatcatgcagccacataggaatatggtgctatcctagaaccatggtttccaaatcccacacgtgtgctcttggcrgtatgctctgctgcctctgtgttgatttttccttttgaatatcttcttagagaggaayaggagacttgtaaagttttatgtgggctcacagtttaaagagaacctgtttatggggttgtaataaccatgtattcayggacacaactgcttatgtctgtgaaggatcagcaattcatcagacacttwgtgagttaytttcttctctgattgtcagagtgaaaggtgagtaagatcacttctctcagggagctcacagtcatatgcactgagtcacatgacayagagtggagagtgatgagcgtaatggcaacagcatgaaccaagtactgagggtgcatggaggaaggttgtttaactcctagcttctgtcttcattaagaattaccaatacttccagccatttatgacaaacccacagccaatatcatcctgaatgggcaaaagctggaagcattccccttgaaaaccaacacaaggcaaggatgccctctttcaccgctcctattcaacatagtattggaagttctggctaggacaatcaggtaagagaaataaacaaagatattcaaataggaagagaggaaattgaattgtctttgcagatgacatgctcctatatctagaaaaccccatcatctcagccccaaaacttcttaagctgataagcaacttcagcaaagtctcaggatacacaatcaatgtgcaaaagtcacaaacattcctatacaccaacaacagacaagcagaaagccaaatcatgaatgaactcccattcacgattgctacaaagagaataaaatacctaggaatacagctaacaaagggaagtgaaggacctcttcaaggagaaccacaaaccattgctcaagggaataagagaggacacaaacaaatggaaaaacattccattctcatggataggaagaatcaatattgtgaaaatggcccacagtaatttgtagactcaatgctattctcattaagctaccattgaaattcttcacagaattagaagaaacgattttaaaattcatatggtactaaaaaaagagcttgtataaccaagacaatcctaagcaaaaagagcaaagctggaggcatcacgctacccaacttcaaactgtactacaaggctacagtaaccaaaacgccatggtgctggtacaaaaaaaggcacacagaccaatggaacaggatagagaactcagaaataagaccatacgtctacaaccatctgatcttcgagaaatctggcaaaaacaagcaatggggaaaggattccctatttaataaatggtgctgggagatctggctagccgtatgcagaaaattgaaactggacccctttcttacaccttataccaaaagtaattcaagatggatcaaatagttaaatgtaaaacccaaaactataaaaccatagaagaaaatctaggcaataccgttcaggacataggcacgggcaaagatttcatgacaaaattgctaacagcaatttcaacaaaagcgaaaattgacaaacaagatctaattaaaccaaagagcttctgcacatggtaagaaactattgcagagtgagcaggcagcctacagagtgggagaaaatttttgcaatttatccatctgataaaggtttaatatccagaatctgcaaggagcttaaacaagtttataagaaaaaaaaaacattaaaaagtggggaraggacaggaatggacacttctcaaaagaagamattcgtgcagccaacaaacatatgaataaaagctcaacatcactgatcattagagaaatgcaaatcaaaaaccacaatgagatgctatcttacaccagtcagaatagctactattaaaaagtcaaaaaacaacagatgctggtgaggttgcagagaaacaggaacgctttacactgttggtgggaatgtcaattagttaaactattgtggaagatagtgtggaaattccttaaagatctagaaccagaaataccatttgacccagcaatcacattactgagtatatacccgaaggaatataaatcattctattacaaagatacatgcacatgtatgttcattgtagcactattcacaatagcaaacacatggaatcaacccaaatgtccatcaatgatagagtggataaagataatgtggtacatatataccatggaatactatgcagccatagaaaggaatgttattatgttctttgcagggacatggatggagctggaagtcattgtcctcagcaaactaatccaggaatggaaaacccaaacaccgcatgttctcacttataagtgggagctgaacaaatgagaacacatggacacagggaggggagcaacacacactggggcctgtyrggagatggaarggggtagggagagcattaggcaaaatatctaatggatgctgggcttaatacctaggtgatgggttgataggtgcagcaaaataccatggcacacgtttacctatgtaacaaacctgcaygtcctccacatgtaccctggaacttgaaataaaaataaacattttttaaaaagagctatcaatacttccaaaagttgtgaccctggaaccatggcaatttgtactcacacttatacaatcctagaagctgactactaggtttaatcttttcatgaactaggagtcttcatkaggtcaatgtaccagattaggaatgaccacaccaggagaggtgccatctayttatctattaatcaatattaacactgaagttttaggccaactgtaaagagctaaccaactgtgaagtgtgggaacttgatctacacttctgacagcaattgcaaattcaagggtcccgataatttgttagaaggactcatagaactcactaaagtctgttgtacttaaggttatggtttattacagggaagggatgcaggtcccttcttcaaccaagggaagaaatgcatagggtggggtcccagaaagcagcaaacgcagagcttccgggtgtcctccttccatcaagccaggacagtgtttctttctcagcatcggcatgtgacagtaagttcagagtattgccagccagggacactcatgcaagccttgtgtccagagtttttactgaggcttgagcacattccacctgcatggttgaccttcagtcaccagcccttctgggggtagacctgatacaatgtggctcaaaacccccttcatagatctcgttagaagattgtccaacggccaaagccccaaggcaaacaaagacactcccatcaggcagggcattctatggagatcacttcccagaagctggggtgggtgggggggccagctgctgcaaaggcgctctttggttgaggttaattctttgccccacagccaccraagagtcttcatctgagaacatctaaatggccaacttttggagatcagggggaaaaaaggggtgractaagtaatgagcatagttctgaaaactgttttattttttcaaggtaaaatttggtaacgaggagcttaaacaatttttttttccttctgggtcatgaaacgtcacacagcagataaataatggcagagctcaggtygctgtgcrtttcatgagtgcttgtcaaccagtggtgatggtgagccctgactcgggcagtcctgggatacctgcccaaatgaataaggggtgaaagaagaggacacaagggtggcyccctttgggaagagcagaagttgaggctctcgttccttcccttctgtcttcactccttccctaccatcaatgtttctctactgcatgatgaacaaagatgggtgggaaagagagaaagactctcttcatttctgttatgtattcattgtcctggtagctttttccaggytgcctactcttttcagtgaggtaggtttctcttctctttcccagcctcaaccttcactattctgtttctgtatcagaagacaatcaaaacctaacacatcatccacaaattctgacctggcatgtccaggattccagagrgccctggttaccctttgtccagggcctgcagttgggtgatgatgatgagaccaaggagagggcaagctcttacattaagctgtgcattttgttcactaagtaaagagttgccttgtgcgtgttctggaggccaactccagccacttctgtgcgttaatcatttgttaygatttgagctcatwggaaaaaaatcccccagccagtggcacaggggggtggctctgtaccctgtggtacagagtaggaagcctggctggatcagctgaggctgtggattccctggccgtcactccccaaccatgcagtgagtcagggcctggagtgcaaagagatgatgtgttgactccctgggtgggggtgggggtggggggtggygggaccagrgtgggaccagggacyggaatgtggggcaggmtgcagagtggagaggctcgctcagrtgaaggcactactgtgtcaccattggctcctgggtcctggctccaggtggggagaagcagtttctctttctggggcaacaaataaaatccctccgrgcacaggagtgctcattgctggttggttatgccagtstgtctctatttttagaaagarcyacaagarggaggaaaagaatctagagaaataagtacagwtggattcctccctgrggcagaagctgggktctgtgggwtgaagcacagayrcaaagccattgtcctgccacccagcagtgsagtcggagatrgatggcatgaatctagaataccatgggaatgggtccttgccctgggccagtaaacatttgagactcagagccaggagataggatgaraagattgcagtgatgagacccacaragggcagcagccatctcttaaggggtcaacttggagaccaaatccatcacttcttggaggtccagtagcccctgcaccctctgcgctttgcagagacatcctgcagttcagggaagaaacggagctgaagggcatgtgraagaagaatgtcacggagatgcaaggggttggrttattggttggcttaaggtcaaatcaytatttgctgcctgaagaaaaaaaaaagaccttgcttagggacagaagtccttgtcctggtcttaggtcagatgagggggtaaagraactcttccaactgtcaaggaattgggtattttgccaccaaaaagtttcatgatcaaataatgatgatcataatcagtgaaagctggattaaactgaaaatagtacaggacttctccaagcctttcctatgaatttgcccattaaattycctaaaagagagagagaggctatgcgtattgaatatctgttagtacctggaaaatccagttttctgtttttcagtatgggggagaacagaaccctgcttgagtgttgaaacaaattcctctgaacacagtatggggaattcagaagagattaaaagaacatacgattggaattattcagatctggatgagaagcctgggtcagctgtttactagtgtactagtgtaaccctggtcaagcaaccaaacttcttgggtcttaattttcttatgtataagatgagactaataattcatatctcataaagttattgagaggaataaatgaaatcagataagtaaagaatccttaaaagagcctgtaacatagtaagcatataagaaatggatggatgcatgtatggatggatggatagatgggtatatgaatggatggatggatggatggatgcctggatggatggttagatgggtgggtggatagatggaaagatgggtagatagatgggtagaatgatggatgcctggatggataggtagatgggtgggtggatgggtggaaggatgggtagatagatggatggaatgattaatcttggcccactaccttagctagatagggtcattgttctagcacatacccagaccaccaagcatgagtttgygtgtatgcacatgcatgcgtgygcacatatgtgcataagtatatgtaagcactcatgtatgaattttcctgaatcttttccaaagacagaaaatttagaagctcttmcaccatgcttccataatatcctggccatggctatatcacaactactccactgcactgtaactgtttcatagcccatctatctctgttagaacactaagcatmctggaccacaaaggtcatagcccagtccccacaacaccatgaatgcttataaaatcattgtaaaatgattcttctcaattgtctaggcaagtagggccactgcaccagtgacatcttagaggcctgacccgaccagcctatcagtgtatcttaacccctcttgagggtcagaacaaattcctctgaactcagcactcactagggagttggagggggctgatgacagggctggtgtctagagtaggatgagatgagttctgggagccatagcagtgcagaggttcctgccatcagcatttcagggtatgggctgagcatttcagcatttcagggacctgggcctgggtctcaggtgttcccttccttgccacatgggatggtgagtgggtgatcatgtgcaggagctgagtcttagttggatttgtggagttcattcagtctgctctccaatgctaagacctgcacatactgctgtattcagcagtcccctgcacacagggcctagtcctgggccctgtgggtgagagtgagaaaggaggaaagagactctacctgctcattcacccacagtgtaaccattccctgcttcatttcctccgcttaatggatttttcttcctctgtttggctccgcttttcctctctgcaccaaggcttgttgagttgaggcccatgcccagctgaagcccctcgtgccaaggacacagacttgcttctgccactgagctgtgactctgtccaggatgccttcagcctagcaggacagggcagrctsctggacacggagagcactgggcccagagaagaggcaggcatgtgtggggcatggtctctsctcgcctgcaggccacgcaggaaggaggaatccttcttaacgggtcatttcacttactcatttcagaactggttactgagcagtatgtgttatagtggctctgagtgtgtctgcaggaagtgtcagggcccagctttggaaatgattctgttcccctgaaacataatggacaacttgtctctcagggtgttcccaggtttggagaaggtctaggaagtgcttccccatgtcctacccaactwgccttttttggggtcctatcccatttattctggccccttgattttaataaagaagaagaactaaccaccattctctgttagttaacaaaatttgaaaccaaaccaacaaacattgcgtgctaggggagttcagtgttatcaaataccatgatgagggccaattgcagcgtctttttttggccagtttattattgttgcaagttcctgaaaatggtttcttctgccatcctagttaaaaaacaaacactattttagatgtatgttgtctgcatcctggcataagagcgatgactgtccataggtggrggctagaactgattgatgttgctaacaaaacaatgaacaatgtttctttacttttctgaccagagcacatggctgttggcaagactcattattgtgcatgtgaaattgatttcaaagggcacaatctttaaataaaaattaccaacacatttcaaaatgtcattttttttttcacactaagaagcctggcacctctgctttgaatggaggacaccaaccatctcttaagttgtaggatctaaggtacttgttaaagtgctttgtgtgtagtgaggaattttaaaacccaataaattcacaaaatgcaaggtagctgcataggtctaggtcttctctggtgtgtcaagcagatgctttgaaaatcaaaacaagctttggctgcaggcctggcggcacgcccaccttcagttcttgcccttcttactccctgaacaactgcgagagtgcagtgggtctgaagttcatccctggactgagtgtcatcagcatctgccccagccctgtaatcagcttgagggtgggggagaagggaggggcgccatgggagccagttggcgagttggcggggctgcctgacagctgacatggcggatcctgtgttgacaccatgcatgagggaattgtctccaagcttgtttccaccctgtgagctcctctcagagaatctgttcacagaggaacaagccacaggartacaggccctggagcaaaamcagcgagggaggggtagttaaaaaacagcatttcccagcattgcccgtgaagcattttcaaaaacagattcctggccctcccccaggttctgagttggcagatctagggaagggccaggaatcggggtatttttaaaagccccccatgtgattccatggattagctaaagtgggacccagtggcatcgccctcatgtcccatcccagcctctgcctgtcacagtggtggcctgtcttccccatggcctgagcgtcactgagtgccaagccccagctctcctcttcccatcctcctgggctgaaggcctgtgtttcaagtccccacccacccccagcacagtaagctataggcaccccttagagctccatcaaggcacagaagggagttgatacagacaggaacaaaggattctgattcccttccatgtttatgtagtaggaaaactaatggtaggaactaggagtattgagcctgaagaaaataagaataagaggagatttcatcaagaactttaaacaaatgctctaaggttccrttctccagtctgtgggctagaacataaagaaaaggacccaaattaagctgcaggcctggagttcagactaagaaattctatgtgacccaaagggacaggaagcactaggcagaggagstgagtgtggctgcaggatggccgttgtagacgtctttgtgatgagcacaggaggctcatggcctgctcgctagaggcaggagggtagatcagatcatagctgggtgtcacttaacactccttgctgcaatgcatatgagaaaagctgctcttcaggtctgtggrccacgcaattgactatttttctcaaactgttgagaggttgctatgaaccttttgcatttttccttcggttttcctcagatccatgagagattggcactggtgtgtcacctgaagcagtggcacaaaattgctttgtggggttcttcctatgcaaaactagatttgaccaacacagcgactgaatactcattcccaatattatgagcatggagcaccaccaaaatgagcccggctattgtttccaaactgatatccactctctgagtcatccatgcaaatgaattctgtgatcagcgtgacccaagtgctggatccatgttgaatgagatttgragttccttgcttttatggagctgatgttttccttaaaaagccagttaggagatgaataaataaacaagatcactttggatagcaataagtgctgtggtagagaataacatggaccagggatggacaaggggcgtgggaaagttctcattgtgggagtgatgctggaatcgagaattgaaggctgagctgagggaggagctgggtggagagtgaggagaggagtcatgctaaggttttgctatggaagccggcttggcgtgttctaagaamaggaaggaagccagtgtggctgagatggagtayacaaaagattgcatggyaagagatraagttggagaggagtcaaagcccggatcatggtaagcattggaggccacagcacagggtttagatgtattcaaagttcatagtcatttggcttaagatgttcgtatgatggtatagaaaaggctgtatatcaaggattcatatstcaggatgctccttgacttacagtggggttatggtggataaacctgtcataagtcagaaatattaaaagtagaaaatgcatttaatggcctgataaacctgttgtaaagtsgaaaaattgtaagtcgaaccatcattaagtcagggaccttctgcagtactaatggaggttgctgatagctttaggctggcctctctattttgcagacaagraggctcagagagggatgacgacttgcttgccccaggccttcccacctcattaggagcaacccatcaaagactcattgtaccactatcacaaaataaaagggcctcccttgagagtgactggggagaggcgtctccaatcccaatccaggcagggcacacagcagaacagctgggatttagggaatgaccacagagaagctcagcccagtactggaacccagggaggacgaggcagcgagctgagaaaaagaaagtggagctgcaagctctctggggagccagaaagagcagagcaagtgagctggaccccaggaggggagaaggggagccagagtgttttctgtgtctgctaggaaaaccaagcagtgggaggaagaaaraatgttttccattttagccacaaattacactgcgttctgtcctgggctttaggcatgcctgcagacttaggtgctgtgccacatgactgccttatgcccttttgccaagattcccctcctagactgaggccctgtccctgaagtctttctctactgctggaaggcttcgagggtcagtcataggtgagtccacggggctgaggggtgggacctggaggctcagctccagagaggctgggtgtgcttgggctgtggggagcaagaccattttgcaggctgacattatggtgacaggagctatgggaggctaatgctcagtgaaaggaaagatgtgcattcaaatactggccttactcctctggtcaggccatgaaggcttcctggaggaggaagtattttaagagggagacctaaagagagaaagaagatgatgaagttggtgggggaacctctgctgctatagtaggtgctgtttgtgagaggccttgaaagctcacccagcagagagagagagcatcgagcagcttgggtctgaggggacagtgggaccaggtggtggaatgagttcacacaaggcagttgtgagattttgggataagaagagcagcccctgggtttgtgctgtagaaaacattgcccatmattaactgggtttccttatcagttggggccacagggtccctggtggataaagcaatgatgrtgatgatgctgctgttgctgatgatgattttaatgatgataatgatgttgatgatgatgatgatattgatgacaaggataatattgatgctgctgatgatttaatgatgatgttgatgatgatgatattgatgacaatgataatattgatgctgatgatgatttaatgatgataatgatgttgatgatgatgatgatgatattgatgacaatgataatattgatgctgatgatgatttaatgatgataatgatgttgatgatgatgatgatgatattgatgacaatgataatattgatgctgatgatgatttaatgatgataatgatgttgatgatgatgatgatgatattgatgacaatgataatattgatgttgatgatgatttaatgatgataatgatgatgatgatgatattgatgacaatgataatattgatgttggtgattatattgattttgatacgatgatattgatgttgatgattatattgattttgatacgatgatattgatgatgatgatgatagtgatgatatgatgatgatgttgatgattatgttaattttgatggtatggttatgatgatgataacaatgacgatgatgatgttgttgatgatgatgataggcaacaagtattgggttctaactatgtgccagggacagttctatgtatattccatgcattacctcatttcatctccatagcagcaatctcataccgttggcactattttcaatctctttgttatgggtgaggaagtggaggtatagagmagttggtaacatgcctgaagtcacacgttcaattagcgtgcaagctgggaattgaacccaggcagccacctccaggctagaccatactgcagtattcccaggacatggtgagatgccctccagcaaggaagaagaaaagggggatgaggagagggagagaaagacaaatgagcaaataatatwttttctcaaatgtaactttatggtcccrtttcacagattgctggccytgaacctcactatctctttctcctttgtttcagtcyacatatatgtggagggctaaggtggcctgaagtcacaagccaggagatcacagcataactcctctcagtgtatggcttgcatttattttgtgaaagcagtcagagtcccctctctgcccttgaacakgccattctgtgagaggctaaatttatagcattggctgccagattattaatctccacctgaaattgcactggggaatcccccacactcagggcaactgatgcacacagtgggctggctcataaaaatgcataaagctcattaaccagagaccttcagccatgtgagaccagatggccacttgtacatcctccctgagcccaggagcacctgggttttccttgattctcatctctgacaatgtcccaagggccctcaaatggaaaagcatactgcactccaacctgggtgacagagcaagatcctatttcaaaaaagcataacaaaaaaaaaaaaatggaaaagtatattgcacttcttcacatttttcctctctttctggagtttcgctgtttctcagccttccctcccctaagcgctccacatattcatgtctcctcaagccagccatatcaaatcacaatgtgtcatggaggcacccagtacgggaatctcataagtggtgcttgatcaactttaggagcttgtgttcttgatgaggactttggaacaaactactgctatttgactctttctcagacatagttgaacctgggctttagccttccactgccacctccaccccccatcaagtcaatctctaaatcccactctgccatgagtccttttgtctgggaccagctcctatctgtcatgcaatttaagctgccctggtttactgaagtcattcgtggaaacaggctcccccaagtgacttccytcagaaaccctgtcctggccctgccaaccytctccatccacagttccctgtggtgtctctgaccacaggcrtttggcttcagtcacctcccaatccgtagatgacctcggcctgctgcaatgtctgggtcccctgtcctgggaaatcaaggcagacaaagtgtccrtgaagacagggatgagaaactgtccattttatttctacctgccactggcctcagtgaattctaatagtgtctaggccatgccctgcatgcctccttacatagagagggatctaagtgaggctggttaaatgctrccaagatkgttttcagaactgaggtcctgatagcacctgataggagacacactggttgaacaaacaattaaagagcttgcactatgtatctgacactatggttagacaccagctatatggcctctgctctcctggaactgacagttcatgaagaggaaagacaagaaaatcaataggtacagtgggtggggaatgagtcagctgtgcagggcctgaactaagccatcagaagtacgaatggacaggagaggaagatcaggaggtttaagaagtagaccccatgacamctggggctgatcaaatgtgagtgtgtgggaggaaataacccaagggaatgcctctgtttcaggtgttgcccgctcaaagggtcatggttcagttcacgtggttgagttaggataaaaaakaaggtttaaggaacaagatgatccattctttttgtgacatttgagcttaggacattccactgaagatgctcactaggcagttggacaaatgagtttggagcttaacagagagatctgggctggtgataagaatttgagggtcctcaacaggtgggtggtcacttttagctaggaaaagagtatggggaagtgctggtattaaactcactgcaaccctgtgttccctctaacttcttaagaaagcaaactatagctgckctcccctcaccttccatccacttccttatcatctgcagtgttggttttactcccactattcccttgaaatttcctcacaarggttgcagatgatcttaatggcaaattctaatggacgccttgctgctcttaacttacttgawctctctgtcaagaagagctgtgcctctatgtcccttcctgagttttggtcacactrttctcttcttactccttccaatattttggctacttcatggtccatgtattttttagatgacagagcattgcacgacatgagaggctgtggagtacaaggaaggcactggactcacacacattggattccagagctgccacttattcacttgtgaaygagttccataaccttctggaaccttcaggtcctacggctatagaatgggaataataatcacacctcacgagttattgcagtaattaaatgggatatgtctaaggcacatagccaattgtcagtcacattgcmaacaatttaaaaatggtggctcttattttttggtgcgtctgcaggctgggtggccacacccagcagaaggaaatggtttaagagagttaatacagttccctgactagcagcaatacagcagcagcagcactcactgtacctgaaaacttattaaaaatgcaaattctcaggccccattccagagccactgaattagaatctttgggaatggagcccagaaatctgttttaacaagtcctgcgggtgatttttaaggtacctgcaaaagtctgaaaacagttttaagataaaggagaacaaagtcctagaggagaggctgagatttaaaggaaaggcggaaagactggcagtcaacaagagggagggacatctctccaaatgagacagaaaggtcagatgtgaaaaaacgaagataaaattgtaggtggcaaaaggagaagttgagattctcacatgatgatcttgagtttttttttcccaataaaaaagtgaggttatgtaatgagtgggagaaaagggatagaagaataggggacttgcgtagagagaggggcaatttggacacaaccgatgggtrtataggagaatgagaaaagtatggccaggcagcaacgggggcacacctgatgttgccagttgtgactgcatagtgacatcaatccatgcagttgtgtaattttttaagtggcactcaggatcccttatcttattgagaagtgggatggctgctctgattcaatatgaggcactgttatgtggctctgttggaagaactcaggcacagaagcatgtgtgtgatgtttagtgtgactggagtgatgggccagactgtaaataagagactaagagtagtggaagaataggaagtgaagagttccaaatatcaacattacttggactgtggtgaggagctgctggccaaagtgaagtagggttgacattaggacattgaagagcaagtcagtttctggatctcagttgcttgtgatgatggcaggattggggaagatartgatgcaratgataawcacaaagtacaagtccttatggctgaatggtgtgccccccaaaggagaggctctcatagacagaagagtaaaggcttggaagtgataggcagacagcacctcagctccgctcctcagacagtacacagaactgaatgcaagtaagcaattgctttcaatattttccaccatcagaataaatcaactactatggcattaaaacataattcatgttttaaaggcccctgaatattatttagaattaaaaatctagaagcaaccattccttataaaggaaccagttagcaacagccttctaaacaactgaacagaaatatcagaggccctgttctggtgttgcctggaatgaagtcactcactagccatgggtgtgtcacctctcctcctgtacttcaggactgatctgatcagtaagggactggattatttgtcctctatgacccctgccagcctactatcagatgacttgctatctgctagttagaagtctcattctgttctgatttttgatccttcatgtcataatgaaagatgcactgtagattaccagatagtcaggaatctgagttaaccttatctacctaaaaccctgctgctgtgtataatactaacttctcattacacggagccatttgatcatactctgtgttatggtatctccatgcttttgcatatggtgctttctctggaataccctcatcccccttttcatcccgggaaactctaatcattctttaatcacagttgaaatgtctcctagtcattgaagtctctcyttaatcctctgggctggaagtcactccctcctctatgtttccatgacactttgtatgtcacatcatgtcataatttgcgttcatctttctcagtttctgctactacctagggccaagaatttgagctgttctyctatgtatgcctagtgcctggtgctagcatgatgcttggtacatatttgatgttcaatgtatgcytcctgtatagaaacaagagtaatacaactcacaattatacagaacttataattttccaagtactgtcacatatgtggtatactcattgagtgctcagtaaggaaagttaccagttgtcccattagaccccattagagatgctgatttgaggrcacagataatttgaacaatatgccctaggttgctcagcttataaagaggtggagacggaatgaagcccacatcctgtatttccaaatccattgtatttctcttctctttgccactgcccccaaaatatttgccagaacatagggtcaatgtatgaacattttgatagaagccagtctgacctattcctggccctcttgttattatctggagggttgaggcagatgatrawaatgaagtggccagtgacgatggcaaggtttggcttcctgtcctttgtgggcttcccaaagaatgaggaccacagcctgcttcttttgaagcccaaayccagttccactccagtcctggccacttggcatttatcgtcttcattctctttttagggttgggagtaacctgcactggtttcacattggtatgactgagtatctcttctttacagtcctgctttaagcaaattcaaaatataaaaatctggattaaaaacctaggagaatctgtagatactgccccttcagagaggtggagtgtaattcccmcaccttaaatgtgggcactttgtgactttcttctgaagagtaaagtatggaaaggagaaaaaaagaaactttgcaatagaaaaatctgacagatatgatctccaccaggagatcaaggttgacatcatcagtgatcagtcatattctagcctgtacccttgatatgatgtgatgaaaatggccccttccctctgtggtcttcctcccccaaatgcataacttcagtctaatcatgggaaaaacttcagacaagcctgtgttgagggacattctacaaaatacttgaccagtacacctcaaaactaacaaagtcaccaccaccaagaaaagtctgagaaactatcacagcttcgaggagtctaaggggacatgacaactaaatataaggtgttttcttggaggggaccttggaacaggaaatggatattaggtaaaaactaatataaatggtacattattaaatttaagtaatattagattttatgttatatttataagaaaatatggataaagtatgaactttaataatactgtacaatatcggttcattggttgtgaaaaatgtacttaactaatgtaataggggaaactgggtgcagggtatatgggaactcctttgaagcttttctgtaagtctaaaactattctaaattaaaaatttatttaataaaagaaagaaaatagaggaaggaaataccatatcttattaatggaaattcaaaatggtacacccactttgggaaattgtctggcagtttcttataaagtcaaacatatacttaccctatgacttggtaattccatttcttggtaattatccaagggaaatgaaaacctatgttcacaccaaaaacagtgcacagccacttttacaatggctttattcataattgccaaaaactggaaacaattcaaacatccctcagatagtgaaaggataaatgaactgyggtacatccacacagtggaatattattcagcaataaaaaygaacaaactaccaagacatgcaaccacatggacaacatgaatttcaaatgcactatgctaagtcagagaagccagactcaacagcctgcatactctatgaatccacttatatgacattttggaaaagataaaaccagaggggcataaaacagatcttgtcaggttctggggattgggggaggtgatagactacaaagggacatgggagaataatgggaagtgatggtattgttctatgtcttgattgtggtcgtggttatatgactatatatttatcaaaacttacagaagtaaacactaatgaaggtgaaatttactgtgtgtaaattatatcttaattaaaaatgaagccagctgtggtgtcctatgcctgtaatttcagctaatctggaggctgaggcaggaggatcacttgagcccaggagttggaggttgcagtgagctatgattgtgcaaytgcactccagcctgggtggcagagtgagactttgtctctaaaaaaagaaaaagagaaaaaaaaaagaaaagaagaaaacaactcaaggatgattgccactttacaaaattattcttcaagggatttgtttaaatagcactctcacctattgccttttcagtgatttcatttccaaatgtttagcttgccaaaagggcacttatgtggttttattactgtgctacttgctgtctggaggctcagaatgggagccatcatcaagggacatagacacaaagagctgagamaaagaagctagcacagaggacagctaggctcctgtcttaacaacgattgcattagctaagtgctttatagtcacctgcttttgatataatcatgaagctggttagaccttacttttatgagccttccagtttacaaagctctctcatatgcatgcactcatgtgatcccacaatacctgggccacttaggtgggacaagtgttatttccattttaaaaggagagagaggtgctaagagttctcatacctctgtgtgcctgcactctcttgacctgcttcataggttgggtaattttaaatgcatggcaatttggtgtgatagatctaactatattttrcagatagggcacataaattattttacagataaggaagctgatgatctgggaatttcccaaggtcactcacctaagaagtaccagagccaagagttcagaacttggatgtcctggttccaagcctacttctctttgtactgtcttatatgctggctataggatttttaagcagagtatatttaaattaaggatattttgctgcaagtcttcgtattgttaatgtatccrtgaayggagagttttaattggcttccattattagagccagattattataagtaaagactactttactcactgtcatctttactagtgactttggcagcttggaagacagtggtgcaatctttgtgtttctcttggcttcttatgttgggagtgtctgaatgcatgagcactgtgtgtgtgytgggagctgtgacttccagaaaaaagagatcaccaatgtaaacatgagaaggggtgatttttcaacatccactagaatgttatatcaaaatgagcattttttctttaagttgctttgagaggacatttaatttggttgctttttagttatgtctcatttttatgcaaaatagtaatgccaccttcctamtctggtttagcttagaagtgcttttccttgtttccttggtggtctctgagctcctcctgggcagagctgaaccttctcctcagcgtgtcctyagtatctagcacagagcctggcccattggcactgttcagactgtgtctgttgagtgggactgaaccaagactccagggggrctcaggaaaagtccctccctggcccctcaaatttctcttcagaatccctattgagtgttatcattcgtcagcccatcctcagttttccttgtcaacagcttaaagaaaaatcttttaaaaatacccttaggtggctgggtgcagtggctcacrcctgtaatcccatcattttgggaggccaaggcaggcggatcagatcamgaggtcaggagatcgagaccatcctggctaatatggtgaaatcccgtctttactaaaaaaatacmcacacacacacacacacacacatgcacacatgcacaaacttagctgggggcatcgtggcatgtgcctgtagtcccagctagtcgggaggctgagacaggagaatcactcgaacctgggaggyggaggttgcagtgagccaagatcataccactgcactctagcctgggcaacagagtgagactccatccccaccccmcaaaaaaatacccttaaggaaaactttagtgtgtgagtgaaactaagaattaatactgaaggaaaatgaaagaagctctactccctcttgatgtttggccttatctggaagaatatgaaygagtcttgttctaatcccatcagaaataggttcatatgttcytatttcttcaggatggccacaagatgtagttaccttgttctcattgtgtgatggaaagcctgttgggctaagagtctagcaaccggattctatcactaagtctgtgcaaacctgaatctattgcttgtktacataatctgtaaatgcaagtgctaattaccaagtgaattcagctataacactcatttctaccacaatttagtaagccaactcgacccatcgctcagttccaggcatgcactgagaattttcctcttctcagctcccttcaggctcgctcccaagataaccctcactcccaaactgaccagggattcttaaacctttcggtgtgtgggtgtcatctctgtttccttagcctgtgagctccccaggagtagtgatcatgtcaattttcttctgtctcccactgtgcgtggcaccaagatcaatgcacagtgggccccagagggatttttagaaagaaatcttttagtataagaatgtccttcacttacagtacaagctttcaaaggctagatggcactgttgctagcaccaaatcaggtgtgttctgagtatcagtggtgaggaggggagaggagagagagcaggggccctggagcgctcaccgctgagccccattcagacaccttgcagaagtactcctggattcttgccttactggcagggagtgctctgccatattctcggcaccttcccaaacacggcttcagatggtcttcccagctaccttgtgtagtaggcaggacagctgtatcaattctaattttatagaactgcagctcagagaaatcaagtgcctgaactaaatttatacagcagagctgtttaattagcagagctgtttaccattcatagctgttggcagcccctcccctgtcccccaccaaatgacggtcctcagagcacgctgaaggaggactctggttactgataacgattgtcgcaggataatggcctgggtgaactggacccagtccgaggggaaaagggtaggattctcagccaagttgattgaatggatcagcttaacctgtgcctcaaaatgtttggatttgtgacgagggggagcacataatactacatgtagcctctttgaggaacaaaattgtgggtaatttgcacaacgattaggctctgagatcagtggttggtattttatttagcagataatctatttataggatgctgccctgtggttgggtcgtatctgtcatttgtccactgctttactatattcacatggttctcactcaaacaaaacaaagaaaactgtcctgtgtagyaggcagggcaggtatcactaccgtgcccaatttacagatgaaaaaataaatgtcagaaatgttaataagagacatatctaggatcacacagctgataagtggttgaactagaaattcagccccrtgtgaggctgaaatcaartcttgttttttcactgtagtttttccaggctatgccaacttatctagaaattacaaaattagaagggcagttgttgatatggagagtaaggcatcagtgactagaaatatatctatatagagtgataatgatcaatcgcatgcaaatatatgcaaatgaragcaaattaatatctgttatttgtgcctcctgattgtctctactctccygtttctccccaggatgatgaagataaactgacctggaaggatcgtttcccaggttacctgatgaactttgcctccatcttattcatggtaatttccttgagggaccacttgcctgtgactgcatgcatgtagatgctgttatgtgactactgtggrtattatattctgctatggaaataatgagmggctggtaaagsggaagccacagtcctgtgtagaggggcaggatcttgtctgatagtgaggccattgaccacccatgctagaatttggaacttccagggagtgggttgcgagatggtgcttctgcatggagacagaccaaaaacttggagaaggaatcaggtaagatggctgcaattgcagcagcctgtttgggctgtggggyggccctctctgacgtttgtggatagaccagrgtctggaagccacaggagatagccagcttgggctcggtaagtgtgatccttccgctttcctgtagttgctgggtttatttccttgcgctttaccttagagtttggtacagcccttctgcaagacccagacggtctcagctgcgtcagggaaagctcagggaaaaccctgtgattcgtatttgacttagatcaataaagtggtagcagttcattcttcgttgccagcatgggcaagacmgcagtatctgaagctagaggaccttggggaaggcaaaaatcagaggactaagttagggttactaataccccatatctctttatggaaatcttccttacagtattcaagattggaggttctgctttacaaaggagtgtgtgtactcacagctcagagcatttctaagtagggctacacattagttgcagggtggaagagggatcacttattccaaaaattggtctggaaattgttgtaactctgactctggcctgaggttaccactaccattatttttgccatcgtgaccgttaactacaggaattgtgttttcgtctcagaaatttaaaaggtgaaggaaacttagatatcaccaattcaactcctcatttttcagatgaagtacagagttgatgggtgccttgccaaagtttagaagtctaaatttgttttcttctcattgcttaacaagtgcaagccatgtggaatttattcaagaggatgtggtgagttgccgtgtgttaagctgcaatgatagaaagtttaatttagcacttcaaagccccccgcaatatgcatattattgttaaagagtttattcattcattcaatatttaatgagtcaaacgatgtgcttgacaccatgcttagacactggggatacagcagaaaacaaaacaaaataatccctctcttaaaaaatttgcagacaataaatgagtaaataaataataaaaaataggtaaaaataaacttctatctccagtagtagtaggttaggatatttgtaacatcccattttgctaaaatttattttwaaaaattggataaatgtatttttcaatcttctcaaagcctcgaagggctgacaggataggaagtaataccaggctaaaatctaaaggaaaatgggaaccaaagaaacaaatacctgggcactagagctgcttttaccttgagaacattttcccatctcggcaaacctaggctttggttttggtggttttatgggagcarggaggatagaaattagggttgatggatggccccaaatggggattgtaacaggatgtcctcaccaaattaaatcagaactccaaagggctatgttcagagtaaagatgaaactgaactatacacaccctttcccacttatgagactgcagaaaaaacttgttatggatctaagcagaaaagggagaaaaggggaaacaaaatcctgtgcttaagaagtggccaggggcaatccctactgtggctttctatcctgggtcaccacataagaggatcagggaacctcaggttgtgaacttaacctaacactagtagggctcccaggtgctcagcagaagcaaatacaacctctctctgtagggaagcatatttatgccaggcctcaaaaaatcacccaaaagaatttttcaagggcaataaagagaacacagtcaaaaacaactaattactcaagaagttgaagcaccatatgaaagaaccagtgggaacagacagcaaagaccagagatattgaaaatatcagtcacaggttaaaacagcaaccttaaaaatatacacaaagaataagaaactattttgaaaattatctagcagataatgaaaactaaccaataaacctctatctgctagaaataaatatatatagaaattaacaaaaatattattgktatatatatgatttttatatgccatgtatatatgtgtatatatrtgtgtacacacacacacacacacattcacacacacacgaccatggatagatttkttttttcttgagacggagtctgattctgtcacccaggctggagtgcagtggtacaatcttggctcactgcaacctccgccccccgggttcaagcgattctcctgcctcaaccatggatagacttaacaacaaattagacaaagctgaagagagaatttgtaaactgcaatacaggctggaataaattatccgtaatacagcatagcgataaaaaagattggcaatatggaaaacaggttgaaagagaacaggtaatgagggagatataaggactggtggtttcctaatttgatgcagtacaccaatccatagattgaagaatcctagtgaaacccaggcagaaaaagtaaaaataaatctgcatctagatgcatcatagtgaaattatagagtatataaggcacaagaaaagtctcaaaagcagccttaaatccaaaggcaaattaccttcaatggaaagacacctggacttacaactgatattttatagcacattggaagtcagaatacaatgaaatgccctcttcacgtgctgaaaacaaaacaatttctaactaagaattctatgcccaagaaaaatatcatgtagtgataaggataaaataaagatatttatagacaaatagaaactgagagtttgctaycaaccgaatctctcattaaaagaaattctaagaatgtaccttggatgtgatcccatatggaagaccatggttttagaaaggaatgaagaacttttaaagtggtaaatatgtgagaaaacctatatgaaccttgactgtgaaaataataatgccaattctcatgaggttaaaaaagatagaactaaaatatatgcaacaayactatgtaagttgggtggacaataaatagaacaataatgttctaaggtctttagattgtccagtcgataaactgattttaagatttatgtggaagcacaaaggctaagaatagtcaagaaactcttgaaggatggatatgttactctaattataaaactacaatgagtaagataatgttacattcttgtgagaagagatgatgagaccaatggaacaaaatagaaaaccaagaaccagattaatgcaagtggcactgcatataagtggggaaaagaatgaacttctcagtaagtgcttctgggacagctgggtgtccaaacagaagaaaataaaactgggccttgttcacaccactcaaaaacatcaattttaggtgtattttaaagagggactgtgaaaggcaaaacaatcgagtttttaaatatataagaaaaaaatattttcatgaccttggggtagggaagaatttcttgagcaagatacaaaaagcacaaccataataaaatgctggtaaatttgactatattagaattaagaatttaagttcataaaatacctaataaactctgtgagaagacaaattatcagaatgggataatatatttgcaacaactataactctcaaagaatttttcttaacatatataaagaattaaaaaacatggaaaacagtaattcagtacaaaataggaaaaagatgaatatgtasttcacaaaagagggaatccaaatggccaatgagcctataaaatggtacccaatctcattagtaatcctggaaattctaatttaaaccacaatgagataccatatatgcccaaaagtctgtcagtaacaagtgttggaaaagatatagatcaaaagagcatcttaaactctactatagggagtataagttgaaaaaacaaaaacactttggatatagtttggcattatctagtgaaactgaaagtacatatatcctggggcccagaaattctactcctggatatcygtcttagaaaaacttgtgtacatgagcagcaaaatacgtgtacaagaacgtctatggaagccctgcttataataactcaacctggaaacagtccaaatgcctgtcaccaccagaatggatacataaattgaggcatattcatacaattaaatactacacagtcatgaaaatgagcaaactaatagctatgtataacatcaagggtgaaaaaaacaagatgaaagaatatayacagtttgattctactcatagagagttcagagacaatactcaactatattgtttaaggatgcatacctctgtgttaaaactatcaaatgagcaagagaatgattatcataaaattctgcacagtggttggatccaaaggagcagcagggatgggagatcatgtatgtgtacgggggagaagggaattcagagctgctggcagtgctggtctgggctatattggtgtttgttttattcattgkgtgtgtgtgtgtgtgtgtgtgtaaaatggatttttctgcrtgttcacaataaaatttaaaaagacacaaaatacatatattaaataggttggtcaggtaagttctcattaagatgacattttatcaaggatctggaggaggtggaggagccagccacatggatattctaggggaaacattctgggcagaggaaacagcaagagaaaaagcccaaggggagcaatgcctggcatcaggagggacagcaggaaagagccacagtgtggctggagctgagcactctgcagcggggagtgcacagggagacacagtgagagaagtaacgaggagccctgtaggtagggccctggagaccacagtaaggacatgggctaattctatgtgagatgagaacacctaataggaggtcttgcaaggagtgacatgacctgacatacatttcaaaaggatcattctggctgctggggtgagaaaatgctggtagaaaggcaagggtgggaagagggacatcaagtaggaatctgttgtgataatgcaagaagtgcggtggcctgggcagggtgagattgaagagtgttcagatgctagttctattttgaaggtggactgaaagaatttgatcatgtggtacaaaactgaaaagaaatcaagaatgactctaaggcttttatcctgagcagcccaaaatctgccagttattccttaactcagttgccctcctgatgcatatgagtctggagttcagggaagacgtccaggctggagacctaatcactatagaaggcatttaaagctataagattgcatgagatcaccaagagaatgagagtagatagagaaaatttccaaggaccaagtcccgggacactgctatgctgaagtttgggagcatgaggaggagacagaaaaragaattgaaaagggataggggagaatagagagtcccagaagtcaagaaagcatttcaaaggggcaggacaatcaattgtattagatgccactgataagtcaggcaaggagaggactgaaactaggagcttgtctgctgcctgagagaaaaatctgtgtcatcatcaatgtcatcatcatcatcatcaacaacaaatagatcactggaccaccattcaacaaatactaaaaactgggtcaatggtgggtcatcttgccaaagttctaagttttttctttttttaaaattccattgatacctcctaaagctagactggaaagtgggaatatttttattgttcacaaataatacataattatctctcctttgtaaaatcttccctttcccagccccacccaactccaaatcttgatataaatgcaagattctgtatcagaaccaataastaattgagaatctcactatgcctggggtcccacaactgccaccagcaagttccgggaactgaaccatgtgggcaggagctgggagcagagtggtgggaatggggrgagccccctttacacatcacccttcacagtcaggtgctcaagctcgtccaggcttaagcttccagaccagggagaattattaatagcacttcttctttactctcaaaagtattccagattggacaatacattatattgtttcctgcctatttgattttttaaaatccttatttggcactaacttgtccccgtttctttttcccacttaaaaaaaagcccagttttctttattttttaatttttaattttttgttatgcattaagttctagggtacatgtgcacaatgtgcaggtttgctacctaggtatacatgtgccatgttgctttgctgcacccattaacttgtcatttacattaggtatttctcctaatgctatccctccccctgccccccaccccctgacaggccccaatgtgtgatgttcctcgcccygtgtccaagtgttctcattgttcagttccaacctatgagtgagaacatgtggtgtttggttttctgcccttgtgatagtttgctcagaatgatggtttccagctgcatccgtgtccctgcaaagaacatgaactcatccatttttatggctgcatagtattccatggtgtatatgtgccacattttcttaatccagtctatcactgatggacatttgggttggttccaagtctttgctgttgtgaatagtgctgcaataaacatatgtgtgcatgtgtctttatagtagattgatttataatcctttgggtatgtacccagtagtgggatcactaggtcaaatggtatttctagttctagatccttgaggaatcgccacactgtcttccacaatcgttgaactagttcacgctcccaccaacagygtaaaagtgttcctatttctccgcatcctctccagcatctgttgtttcctgacttttaatgatygccattctaactggtgtgggatggtayctcattgtggttttgatttgcatttctctgatgaccagtgatgatgagcattttttcatgtgtctgttggctgcataaatgtcttcttttgagaagtgtctgttcatatcctttgcaccctttttgatggggttgtttttttcttgtaaatttgtttaagttctttgtagattcaggatattagccctttgtcagatgggcagattgcaaaaatttcctcccattctgtaggttgcctgttcactctgatgttttctaaagaaaaaggacttagcattaccctagaacaaggtgtggagcatgagatgaaggggtcagggtggtgcttagaaggaagtaactttctgtgataaagttcgggtaagccaaagacacctaccgtatctctcatctcattcctttcttcacccctgtgcttgaacctaggcagaagatgccaggaccatgggcattaggaaggtttcaggcatgccaatctaccgagtcagttgggaatgcttttcatggggtgatgagagcaaagaaatgccccagtgctatttcatctgcctccttgtgtwagaaaccagcatggacaaagacgaatttcctctccgccaatcctgtgtgttcagctaaagtttcctttttgaatggtccctcctgttttcttcttgtaaggggggaattgtcggaggcgatgtccctcctctagagctaggtgcctgagctttcctcctgtgccccagatactcattttcttacacttggatattgggagtccaccatcagaaatcctcctccacagcctggaytctcatcatagccccttcactgatctccctatttgcacactgcccctgacagatcatcagcatgctaacttttaaaacctaaaccaactcacatcactcctctgctcagaactctctgatggcttcccrtctcctgaggtgtggaagcccacatcctcacactacagggccccctcctggctgcctgcccatctcccactccwcctgtccccttgctcactcagtgtcagccactgcctgcctgaaacacccttcccttaaatccttcctttaggtatttggtaaaaggtcactttctcagctgtctctttcccaaccaccctattttaaattgcaaccgatccctataccctgtttgccttctttgtctccacggtatttctcgtgctgraggtactacttattttacctatttattagtttattgtctatgttttcccactagaagatccactctgtgagggtagtgctttctgtttcctttttccactggaacctagaactgagactggcacaaggaggagcttaagacacattttatgaatgactgaatgggtaaataaactaggtggaggtcataggcagcgtactatgtcgatgatgaagttgctagtgtgtgcgcgtgcctgtatttttatacttgagctactatcgtrtgccatgctggggatcagcagaggttacttgtgccttgtgcattgctacttgcccctcttcccttttctggaaagttcttccttcttattctttcctctaagtctttcccataggaaactgtcccaaaacttttttctgtggagttttctctgactaatccccctgctctctgctaagagcataccagaagctcgtgaacggaggcctgtgactccatccagctgctactaggatcatctttgttgtatgtgtgcaatgattttctcaactttgcttcagaatgcaagttccggagggtggcgaagaggtcttctctcttacctgtctctctcttggcgtcaagtaggactctggactctgtagcctggcttatgttgcattttgtttatgtcccagaagtaaagttatgatattaaaacaccaaaagcaacaggaaccataataaaatgaccatgtgccaggcagccagatcccctagagctgctgaccagcgaatctttaccaaaccagttctacgggaggcgctgctgtgaagtggcttaaggcacagaatgtggtaaaagacaarcctccttttgacctagttggaagagattgaccacaaacatggaatatacccagtgcagtgggtcgcacaataagcggccagaaaatacgtattgaacttaataaagaaaatcaataatgtgggccggccatggtggctcacgcctgtaatcccagcactttgggaggccgaggtgggcagatcgtgaggtcaggagatcgagaccatcctggctaacatgatgaaaccctgtctctactaaaaatacaaaaaattagccaggagtggtggcaggtgcctgtagccccagctacttgggaggctgaagcaggagaatggcgtgaacccaggaggcggagcttgcagtgagcccagatcgcaccactgcactccaacctgggtgacggagtgagactccgtctcaaaaaaaaaaaaaaaaggaaaagaaacagtgctagtgaagatatgcatcgaataaagacatctagaaggcacaaatggttcagctggtattgatgatgttatcaccattaacatctcagctctaccgtataccctccagaccttggatcaatcacattgttgcctcttgggcttcagtttccttatgtatgagactaaagactgtacatagatgattcctaaatgctaagattttaaaatttctaccatgatccagaagagtagcattgtagtccacaccttgtggacttcagcaaattgcatcacttttccatgcccgtttcttcatctccaaaatggtcacgtgactgggttggtrctctgcaagttcctgcagctcgaaagctctgtgaatcttgagatgctctgggaaacaccaaacgagaggttcagagcttgatttctatagtgggataggaaattaagaccagagaaggtaaacctgcaaagaaccagagagctgaagtgaggtgtgccaggggtggggctagggaggaaaggagggtgggaaagaaggcttttctagataaggagaacagtgctccttgaatttgaaaaagaattctgttamaatgcaggttccaggtcagtaggtctggagttgtgcttgagattccgcatttcaatcaagcttccagctgatgcagctggtccttggaccacatttttgagtagcaaagagtgttcttccttctctagtttagcagctgggcctcttagagaagaacagaagctgatctccccacgtcttccttcatgtccctcccacaagaccctaaacaaaggatgtttttgccattgttttttttcccctagtccgtctcccaatcccaaccccaaatacacacacacrtmcacacacacacacacacacattcactcactcctcaataccctcacctccccagcctcatcaatactttcatcactggtcttcactgcaaaagtgatttttggggaaaagaatctcacaccacattttctaggcccttactatctggcagtgacaatcccagagaaatgggaagtgaaaatgtctacattgttggagaggggtgatgtcatgtccaggttttcccagttacacgatagtagtccctacttagtcctggaggctggtgtttctgccgctccccacccccaccctgcagcagaagaggggcctcacacagagtgtttttcccatctaacctctcctctccccacacccacacacacccaaacacacacagccttcctctacccagagaacgccacctttctcccttccttaccaagggcttctttttcacaacacggcccatagggcaattactggtattttttgaagcctaccaggataaagagctgagtctgccaccagcacaccccaggtaccccccagaggtctgaaaacatccatacctggacacatctgccacccattagcaagccactggagtgtcattcacactgcttgcaaagcactgcccaagccagaggcccccacttcccctcccctttcctcctgtgcctctcctcccctcctcttaccccctccttcctgcctccctccctgtgcatgcktgtgtgtgtgtgtgtgtgtgtgtgtgtgtgtgtgtgtgtgtgtagtccagcacagcttattttttcagggagccttccacctgcygttttctctccctacgttttctatttagtccttcatagccagtgcccattctctgtcctgcggaggaaataggacctgaacagcttcctttacagaaagagtcctaagaaggaagtcttctttcttgaagaagtcttgacttgactgaagcaaattagaatttgctctgagtggggcatgcacctagcagttgtctctccttcttctatcccctctaagaggctttactcagggcacttgcttctcatagcatccttgtgcttcctggaaatgatccttccttggttgsgatggggacaggaggggacgtggggacagaagaaggaagaggggctgttgggcagatctaggtctaagagagtcccttcttattcttaggttctagagagaggaaatgaggggaacccttagaggtcacgtggctataaccctccttttggagcacagcagctagacatttctctaccaaatgaggaatctgagtcctccatttcaagtcacctagtagagaaatcttacagtgatattttgttcatcttgaggactgagattcctaaaatctcactcctgatgtattccctcttttctcctttgagcaaccttcttgcctctacttatcaagctgtaactcatcccttctcagctcaggtaccttcaatggctttctatttcttctcatgaaaactccattttaaatcccactgtctccacaaactattccctgaccactcaaatttactttctcccgtgtacttggagttccttcagcaattatactcctcatttagcacttaataccttcttgggcattatttactatggtttatttaaaaggagttcatgttatctctttagaagatcaaaagctccctaatgaaagaaattgcgtcatgtgtgttgaacactccacagggtccagcatgttcatccttattgtgtgtgtgtgtgtgtgtgtgtgtgtgtgataaatcatttggaatctgacaaaaattaagacattctcccctggaaaatgcacctccactcagaactctgcctaaaaatttgttacccacccaaatattccagactaataatatctggaatcccttgttacccaacaaaagattccagattaataatatctgataacagcaaatggtactgttggcagagcaaatagtaggtgctcggtaattgccggctgatgtgtacttctctctgttttcccaaacagattgccctgacattctcaatcgtctttggggtgatagtgtatcgaataacaactgcagccgctctgtctctcaataaggctacacgctccaatgtccgggtgacagtgacagcaacagcagtcatcatcaacctcgtggtcatcctcatcctggacgagatctacggcgctgtggccaagtggctcaccaaaattggtactgtgtcaccgagacttctggctgtcctaggccctctttaagtcaatgcgtgcaaggcttttggtgataaaataaaaaaaatgggacagggacaggatgctttgtacagtgcattttaattagagaaatggggaagtgcaacgtgtgtgtatttgtagggctgtcaaagggctttctctaaaggcgggaatccttcctgtaatgttcttgatcaagtcctctggcctgtgttgattgcctcatgtgacagggcactcactatcccctaagggtaaaccgtggggtctgttctttttagcctaacctgggaagcaaggcagactcaagacttcctgttaaaaattacagagctttagctctcattttcccagcagcatctataaagttgaggaaagccttttgacacttgagcccaagagggtcttactggtcttatctatccccgtattgtcagaggccccagaaaatccacacattccccaggcactgagtagacttcaaagaggcatatcagacttcccacgcttcaagccagtgagaaaaatgcaacggcctcaatattcaggtgtgtcatttgagctgcaagtcgctgttgcccgagcaccacatcttggcatttggcattcatgcttattgggtgggggaggctgacagtcaagaccctgtcccattgtatttactctgggtggcctggattcatcccttccctctctgaatgtagggatttccctctctgaccctagtaacgaggagccccagcttcttgttaacctcatacggaggttgcattcatagtacgtatgatgcctttaattcatggacccttgataggataaccacctcctcaagagccttctcctaatgactggagaattccggaaagttgctctgtctgtgcctttcccttgcttggcctctactgtaacactacccacggtgagcactttgctttgacttctgtgttgctatcggcagcttaccatcctcaggggcagctctgctctttccaggcatgtgcatatttgtgaacgttatctgtgtttcttcataagcatcttgagaaaaataagcagagaattttaattcagcatatttaatgayagacaggattctatggaagcacttcggaagaacatccaacactcctggggactcaggaggctttggagggagaggcgtttgactggagagcccagagataagtgagagtcagacaggcatgcatatagggaggaggggatgggcaggaggagaggaagattcctggcaaaggaaaccaagtgagaaacacggcactgaagggagtgatcagatccctggggtcaggaaaggcatgcaggaaagtggcaaatgagccacttgggtggttgggagagtcttggtcaagctaaacaccagtggaacrggagctgagctcagcgtacgggagaaagaaagcatgaagtgtrcgcaggatgccaggggagcccggtgccggggctctacgtccagggcacatccagggcacgatggagtgggaaactgkgctgacggagttgaccagaacgtgttttttkttttgttttgttttgctttttgatggaaaatctaaaatgccaggctgaggactccgatttttttcatagacaatggaaaagtgtttgctggagttcccaggggcattcagccataaacagtaccatcttcctggcctgattactgaaccagctgagaaattagatcaaggcaagagtrgacaaagccaaaatatcagctgtaaaactgagagcggctacatgggaggtagtagcttaggaagagagccaaacagacattctctctccatggcaggcagtggcggatgggccagccctgtgaacttagaacttggagaggcatagaagaacacctgcttcctgcaggccctttgctcccctccaaggaagggcagaaaaagaggctaggcaaggaatgccagcgtcctcttctagacttaacaataagataagctactcctccttctctcacccaagaggagaaatggttgagctgggggaagacaagctgagccattacaactaattacactcccaccgcatggaggaaacaccaggagtagaaataaatgtcccctacccgctccatgtggtcctgatctagcaccactgaagattttttttaagagcgtggcatgacgggagctgtctgcaaaattacttagcagggaaataggatgtgacagaatagggagaggtaggagatccaatgtaaagggtattgctgagtgtgcgggcaggaagtagggaaaagagggacagaaagtcaatggtgatgtagacctttctccttcctgttcatttgtgtcacattatctcacttttcttgcattgctctagatagtgataaagatgaaagacaaatagagttggcaacaatagaaaactcattaataagtatttagtgagtacttcccatatgcaaggcggggccttaactcttctgtttgaagccataaataaaatgggctgtaacagagctttcacatcatgaagctatgttcactgtttctactggcacaccctccttgcccagaccaaagcggctaccctgggctgttagatcaatgtccaggactccataagaaagtctgtgccctggaaaggagataaaatcctaacaagcacattttgttctctctgagagtgatactcataaagtatttttaaacttaaaataaaatttgtaactccatttcatcttcacaaaaactgcatggccagcaagggmagtgttatacgctcactttactaaggttcagactcagattctacctctaaaatgtgaatctcttttgtgtgactttgatgtcagtttctcaccatctgtactgaagtggtgtgttgggtctccatcaggaaccccagtgagcattgttctggggcattgctcttgtctaccttatactgggtactccagagagctcagagagggactgctgaatttgagaatccagtggaaagaagctttgagctctagacttggctccttctgctccctgagctgtgtggcagtgggtatcggggaagttttttggacaaagatttcctgatccttccttcttcatattcctcctgtcctctggtcatcccctctgtctggatggttttcacagcctaacgcctgtgccattgtcctcagcctctttcaatgggcctctagcttggaaatccccatccagccaacctttcccgaacagtgggtttggggacattgctcccagtcagcaccctcagacagcttcccttggtcctagagcacctatagttagcatttcaagctctcagctactttcttcccactgtgctcctccaccccaactgacccactcagctcatggtcaccctagcctccctgtgttgtcccaccccggccttgctcatgctgctgtgactgccaaaacgacctcagtgaccctccttcaaagggcttctcctttgtaaatcctcttctggcctctcggctgtcagtggtcatcctcccacttccagactcccctggcacacaccctctgtttctgrgttcatccatcagctgttgatggagtgcttgctccgtgccaggcacagttctggaaacacagcaaagacaagcgacaaggtccctgctctcattttgctttcactgtgaccagggaaagatggacagcaagcagggccattccacagaatctgaggaaggtgtgatgagatagacagtggtctggggctgtgcactctgggggagttggtcaggaaaggtatttcaaggtggtagctttatagctgagacccagatggcaggagggagcaacccacaaaaagatctagaaggagaactyttaggaagatggaacagtaaaggcaaagcctgcagaccaaggctaagcttggagactcttatccacactattcattggatgctgatcaggtactgtctgatcttaccgcatcrcacatatatgtgtgttcccagtgttagaatagactaggctctgctggggtaataaattcatctcaatatcttggttgcatcacataaagtcatctgtgttcttgctcagcccacatatctagtgcgatcaggcaggggtctctgctgcacacaattgctcagggacccagactgatgggggctgccgtggacaccatgtcaggggaagacagctggagagttgactggggctgttaaatgcttcagcctccaagtgtcatcattcatcccatctgctcacagatcactggctagaatcggcctaattatgaagaacttggaaaatttgttaaagtacatggtcattctgtaagcaggaaaagtctctgtcacttgctcccaaccaggctgcaaggctcttgagaacagtgaccctgtctttcatttatttttatttcctgcgcagtgcctggcccatggcagatcttagcacatttttgtcaatgcagttattggtgaaatacgtctctctcttcattcatgcatgtaaaaagacatttttcaaggaatgcccataggctaggtatcttttaagtcacagtagaggctacagtgagcatttatgtattccttatttcaactctgtctgcctacagaaggatgtgatcttattgagatgaataaggccaaggcaaagctgacacaatgggatagtgactgaaagaggcaccaagagtatcaggagacttgaagtttccttaatggcaaagaatacccacactaacagagatggtctcacaaagtaggtcccagcagtatccccacaggcagagatacggttacagggttcccccaggctccatggggacataaagctatggataatgccacctaatggaatgagaagtctgccaggcttaagacttcgtttgccattctcacgctgggtttaacacccgcttggcttcctgccccagatctcttgatagttgaggaggctgtgagtatacgctttgctcaccaggtgcaaacagctggtgtcaataaccccagtaagtccccaagtgtttcccacagggctgagtaatggaagaccagtttcctgggagcatccctcaagaggctgaggtgtcaggcctatctgaggtccattcttgctgcaaatatgtatcacagaaggcaagatttgttaatttccttgagaatgatatctaccgctagcagcagtggcggataaaaacagtgattgtcctcctggctgccataacaatactcaggagcgtagatgcaaggcatgctggaatctggaggcaacgcagcactggtgaggcaggactgagctgaaccctggggtggtgggaagggggctttctagggaatgcatttggagctgtgtcctagagggagcctggctggccaagacacagtgtacagagtgtgttgccagtgtcagcaagcatcagtattggagtttgagtgctgcgggggtaggattccagtggatgggtgggacaaagtctcttagtccccagtgatccattcactccaggaggggatacaggtggtggctgtagagaaagggtccgggtcctaggggaggaagcaggcaaaatctgggcaggtcactgggcctctggacatacagcaaatagggctgcagcatggtaggaggataaggcaggaggcaagaagaaagagcaatggagctgactggtgcaaggtgtgcttcctcctcaggtcaggacccagtggggtattgtgcctttgagccatacatctgggagcaggaaaactataggatcttagcataaccaacataggcaatggtcaggcttggcctggaaaggcggtctgtctctactctagctttggagaattcttcaaataagaggcagtatggaggaggcacagctgatggcaggcttctaggctgaatactcaaaatgctgttggcttgctgcctccttttccttcttgtcttttctttcaaaactctttgcagaatgctggctggtgtacggggtggtgcacttcatccctccctcgccrtccaacctctccaagtcacagggttgggttcattgtagttgcttgaaaaaagagtattagtcaagtcaaggtttttaggaaaatggctgtgcttgggaggtgctyagacattactgacagcccactcctgagtgtcactgccccagatgctcctgaagcggggccagggatgagagtgaaaggagkgatggggaaaggccgtgagttccattgagggcccacctcataccaacactggtttgcatactttgccccacattatgacagtaacactgggaatgggtcatttctttcattttacttatgagaaggctgaagaggtttagaaacttgaccgaagcatacagttagtagtgtgcatgagtgtgcattgatgcacaccctgcttaccctatatctcacacacatgcacacacttgtacacatgcatgcatgcacatgtgcacgcacgcgtgcgcgcgcgcrcacrcacacacacacacactctctgcttaccctgtaccaaacactgttctaagcactttacatatatcagtatgtttaatccttaaaacagccccaggagggtaggtaatcttaatactcccatttagagacaggaagactgaagacacagagaagaagatcagaggcccaaggtcatggaactgataagtggtgagtctgacctcattgtccttgctaaaaccatgacactctagtgccttttaatatgtagctgtccttgttccccagaaaagtttaaatttattgggagagcaacaggaaacaccacaaaggttccagaagatttagaatgcagtgcactcacatatgtgaatgacaagaggtcgagtatttctggggatggggacaaccgtgtgggtcagatgacccaggcagggaggacagcagggaggcaagctgtgagtgcagccgcctgtcccacatgcacagagagagaggagctccacaggctttggggtcctgcgagctttataagttttaacaaagaaagaatttttttttaaatttgaaaggccaccaggaatctctctctcttttttcaaaaatagacagggtctcactctgttgccccgactggggtgcagcggcatggtcataactcacaacagccttgagctcatgagctcaagggatcctcccacgtcagcctcctgagtagctgggactactggtgtgtgccacagcatctggctaattttttttttttaactttttgtagagaaggggatctcattttgtttcccaggctggtcttgaactcctgggctcaagtgattctcctgcctcagcctctccaaatgctgggactactggtgtgagccagcgtgcctggcccctaccaggaagtcttgagtctaaacttttcctccaattctaagctactctagcaaaaggcaatatattattactgaggagagaagagcaggaggaaaggaaaaggatgggggaaaaatcagtgtcacmggtacaaatggctgccggggcaccaaacattctttaaagaagaatattttgagcatatatgaatctaatcttctaaatgtggacagtgtttgtttttggagcatggggtgaaagtgttggctttattggatgcagtgctctgggatggggggtctgctctctgcagcggagcctgatcagggacagagtccagcayaggacatgggtgggcctggccggcgtgggctgcagaggggaatggggcctatgcctctctgcrgggacgccacagtgctggtcatttgcaatctggcctgaaagttgggtctgctggcttgtattctcttcctgctttgcaccaggatcctggctctctggggctcccggctctctgggtggcctcaggcagtgggggagaaagaacctcccagggtctggccaggggggattctatgcttgttgggggaccccctccatgatgttggcttaaattattctaaatgttgtctgggaaacagagaggatggcaggaggctgtgactactaataaaacgatgtgagtacggttataggccaagtatgtggagcacccctaccagttatgtaagactatggtcagtaattctactgtttagaacacagtgtaactggtaagaattccttcccagacatgagctgtgaccatgaacacatctctcatttccctrcaragtccttgcagcaytcatctcttctgttagcaagaagtccaatatcttcctgtctttctctttggattttctaggagcccagggactaaagcatccagaagagaaggaagggctgtggtgctcctcctttgtttgcaccttttctccctcactagggaattggggtgttttcctctgcttctccctgatgctcccacatctctggagaaaattcatctcttcataactgcagctcttgcaggatgaattctccctcttggttcttcctgggcatcagccatgccatttcctctccttgtctcttcactgctgtgagtaagggcttcattagagtcgcttcctttgaaccrtccaaggggaattgtttcctgctgcaatcctcagtggtagaggggtcaggccaacatccgaagttaaacatggagatgcctgggtagaacctgcccttcgctccttgggtctcactcctatggaacattgctgctggacactagccccacccctctgatgggagaggctggactgcggctgaggtggcccctccgtactccaggcctggacagcatgggctcttccagggaggacagtcttctcctttaggctgggctcagtctaggggctgcagctgtcagggtttcctgtttctaggacacatatgttacctccacccgcatctccaggatgccatccgacaccctgacccatagcaagggcccctgctctccctgggaactcaccctgggagcacacagcttgccaccttcaatcttcaaaacgcaacagatcctgtgattgcctatttcacctccctggccctcagcgagattcctagggacctcaccaccccaagtgatgccaaaatgcactccccaaccttctaagagagctctgtaggggatttttagctaacttgctaacacttcttttactaaggaagtggaaacaaatgtgcaaatctctgcagtgccttgctgtgccatcaaaataagagcaaatctttgagcccttacaccatgcttgatgctttccatgctttatttcccaacaaatgttgaaggaaggtaccattttatgaattaggacactgaggctcagaaagataaattcccttatctggggactcttagacagaaaggtcttctgacttccagcccagagtccccctctagtcttccgtcaaagcctcgtgaatcatattgtagagcacagaagaccagaagcaggaagaacctgggaaatcacccagtccaaccttgacgttgaggcttggatttgcttgaggtgctgactcctccaggctggctggctacttcgaaggatgattctcggttcaaacaatattctaatggccttgggtcatgagctggggtttgggggttttgggttttggggagcagaatcacaggggccaaggagaagcataggggccaagaatttaatgtgtccaactttgagaacttaatttttcctccaaacctggtgcctttcaccgattcttcccatctcaggagatggcaccagcagccacccaaatgctcacttcaaagtccaagtgctatcctggctctctctttctctctctccctggcactctcactccctggagctctctctctctctctctcacccctaggatccagtctgctggtaagtattgttctttctaccttcaaacatatcccagatctgaccatttttcacaagtttcatcctcatattgactggtttgtgcctggacaacaacacactcacaatttgtctgtctgcttccacttctgtctctgtgccgcactcccccccacaccattcactttctgtgattttttaaaaatttaatttygtcacatccttcccctgttcagaaatctacaacagcttcccgttgtacttcctgtggctcacagagccacacatttactctccggccttcctctccaattccccctcccagtayttccaccaggctcaggaygcttcgcttgtgtggactggccagttccttgcacagccttggggctctccatcaagactttgcccaggctgatgcgtccccctagagctctccccagcccctggggctggttcctccttaccctgcaggtctcagcttagaggtcacctcctcagaggcctttcctgaccactctgaccaaaacagccttcccatcgccctttccttctgcttctcatttcactacatattccttcaacactcaccgctctctaaatctaaaacggttgcagttgtcgccctcacccttctagactgggagctccacacggcgggagctgattggattgtccaccactgcacagctggggcccaacaccaggcacatgatcatcctcagtagatatttgtcgaatgagaaaagataatggtgggaaaggcaggagaatttcctgtgggttgttttcctctgggaagacatgaggggtgggctgagaatggactgaccgtatgcctcctccctcaggttttagaccagtgtgtgcatttgccagatgacccaggggtgttgggggtgtctgtgatcagggacagggcacaccttcctgctctctcctcactcctgtccttgtcacagggagaaaaatcttagggaagttgtcaagtgcttgtatggtgcttggcacatagtaggtgctggatataggaggattctcatgattggcctataacagaatacgcctctgtctgtctgtctctctgtctgtctgtctgtctgtttctctctctctctctctctccagtgctcccttcctgtttaggtcccttttttcttaaaaggagatgtgctgggggtgctgtcaccctggcctaggctgctagccagctcagtaggtctcatgctcctttgcataggggcaagagttacctttctgactctgagggataggccccctgtgctaggaagctctctgggccacaggagtatctcaggcacaccctctagatccccagttcaggggctttcagctccctcaggtcatgcgctggctgccttgttacccagctggctggcttctcctagggtgatttccaccctacccatggcactaccagggcaacagcatgacaccaggtacccagacagtccctccacccaccccccattcccaaatgaagggcagcccagwtggttgtgctgtcagcaaacattgctgtttgcaaaggcatgacctgccttagggagaggtaaggggaagagcaggcacttttgcttgggcatcttcttgttcttttttgctgccatcgttatgcatttgccagctgggctgtcgaagacaccagtcaggaggagctgcttttccaagattcagagcctgcagctggcgtcctctcctggccatgctgtttccataggattaagatggagctctggggactttcagtcctgagctggccccctgggatgaagctgggctttcatactaattgttttccaaggcagtttacagctgggtcatttgcactcatattttttcatgacacgatgcagcagaggattaacacgtaaaagaaaagggctgatggtgggaatggctctgcacagaaattcccgattgtcctttctggcgggaagtggagtctgccctctttgttgggatcctgctccacagtttggaagcaggtgaaactttcagatggcctctaatcaacctggggtgcttccyggcggaggtgctatgttagggggcacgtgaataatagagagggttgcctatctcctcaccctctctccattagattcccctccatcgtatccccatagccatgcaatctgaaggtactttatttggagttgttcaaagcacaaggctggaccattttttcatggggttgagattcagacccctccagaagtctgtcttatgaggaatcctgcctagtggcctgagatgcagacagcccttcctgaacctcagatgtcaccccaccccacctggcctctggaaacacttgctccattccatttcttcatttctttccttcctttcttttcgtttctttttttttttttttttgagacagagccttgcatcgttgtccaggctggagtgcggtggcacgatctcagctcactgcaacctctgcctcctgagttcaagagattttcacgcctcagcctcccgagtagctgggattgtagctgcataccaccacgcccagctaatttttgtatttgtagtagagacagagttttgccatgtttgccaggctggtctcaaactcttggcctcaagtgatctgccctcctcagcctcccaaagtgctgggatgagccactgcacctgcccacttgctccatttcttcagccatgtagtctctgtcctaggcaggtgaggccctctgtgttggcttgtgagagagatccaaaagtcaaagtggcactccaggctgtggcatccctccttgcctcaaaccttcatttgttccctcactgggaggtgcttccctgaggcccctttcccagaagtctcggccaagcacacactgtgactcagagctgctccaagctggggcaccgagctgattttgtggcctgtcacatggatttggatcgtttattggaaatgctccttgtttatggtggctcatggccctaaagcacaggcacaggctgttttttagaagtaaaactcataaataatagccaggcctatgatttatcagtatggaggaagggaatcactcatttccagttggaggaaaggcctctgaaatgactagatcctctttgcagggaacttggagggaattgctgtagggactgggagatctgaggacacacagttcaaaggggatgataaaataaaattaaagacatatgccactccacatctcatcctgatcaccttctagatatgttttcaagatatgttttccaaattttcggaccctcagatctgattacttatttttttaggtgacatgggcttaaattttcttgcccccaaaatatttaagagagatgagatgtgattgtgttgttgttaaattggatgcctcaggcaccctggacagaggctcaaattcctattgaaaaaaggaaaaagaaaaagaaaaaacatcctattgaaaagttctccctttcttccttccctttcctttcatccctcctccctcttcctccttctttttcccccttcccttctctttcttcttcctcttctcctcctctgccttccacggtgtctgcctgtttccctaatctctctcgttggttacccagatcagtctctgctccttccccatgctcatctggaagtagaacccagtccttcagcagtcccccaagagtgaatccagaacaatttcaaggaatcatgattgaagattctgtggagaggcacacgaagaggtcacactgcaaacctcacagcagcacttaatgaaaattcccagcgggccctccccgcacctgtcagtccatttcctctctgcccttcccctcccatcgcactggccctcacccttccgggtcctgcctccaactccagcacccccgcctcttatgttaggtcggtgagtttgagtcttctggctgctcctgtcatatggttacacctgtcatctgctcagaaaaagacgtccctccttagaatttgtcctccttggaatacgacagggaatttttaatatgggacaaaattttttttcattcttccaaacacatttttcctgtcattcattcactcattcatttattcaatgcatgttcatagtagagcacatctggcaatagctggggtctgcytggaagatgtctctctgggactttgcttatggagagaagccctccaaactgtatgcgggggtggggcaagagtgggagtgtggcgagcgcgagggttcagagtcacatgagggtgcagagtgatgagatctcgaaaccgaaagtgacctttcaatggcagacacttccactgggcctcagaattgtctcctgtagttaaggggwatgagaatcaggccaaagatggggatgtggcacgttcaggctggtgaggacctgatatgcacaaatcaggcagggaggacctggcctcttggtggcagagaggggaaaggcctaagaagctaaagatcttatggggcatttgctaacatacataactatagaagaaatgacagaagcggcagcgctagctgtaaatggtgagcacagatcattatccagatgatyatttggtgaagcagtgcaggatcacccaggtcttttatctcggggggccatacccacccaggcaggaccggaaggagaaaaccacaaagctttccaccagcagaggaatatcacggaaggcttttcctactcctatagaattctagttcaactcctatagaattccaattcaacgcctgctatagaattccaattcaactcctgtagaattccaattcaactcctgctatagaattccaattcaactcctatagaattccaatttagcccctatagaattccaattcaactcctgtagaattccagttcaacccctgtagaattccaattcaacccctgtagatttacactgctgtctccagattccctagcgggcaatgctctttgcaaagtagcgccaaaggatcgcttagctttcccactctcaagtcccttcccagggctgtgggtcctagggtctcacccctgcctgtctctttaataggtctctgatcaagcttggactatgacagatgctgttggtcccctggctctgctgcctttctccactaatactgttttactactgtatctacagcttagaaatttcctctctgaattactgcaggtctttcttagaactccaaaatgttgtttaacttgctcagttttggaggatgtgctgtttggataatgttggcatcaattcccagtgatttatactagacggtattagagtgtcacactcaaacactgtttctctcaaacacatttctcctcacctacaactgaccactggttcaacaggcatataggccttggactttggccctagccaccctcagtgacctctgggcctgctcagaaacagtgtccatactttacgaggccttgagttggggcaagtctttctcttcacttaggaaagttacaagtggtacctcaggacctgcctgtcccagtttccctcgccagctgcagtagttcagtttcagcacgtctaaatgttggagcacattcaggagaaatgttgtaaacctccaatatttagttcttgcttctattgtagttaagccagacgtttggaggacagcgttccacatggcaattcaggaatctgggcttcctctttccagtggtactattgacattttccacaggagatgagggaagagagatagagagagcagaggacctcacaggaaaaattaaggcccaggcttggaagcagcatacgccacctccactcatgtctgtctggccacagctccttcatattgcccccatctagctgtgtatccaggaggagggaatgcgtgtgatgagcccctggccaatctctgcctccctatctcacccaggaggctggggaggcctcacacaagtaggactcttgtgggtctgctcttgtcctccagcgttattcttcctgcaataacccttgctatagatgaatttttaatattaaaatctgtacgtgtctacctatatttctattaaatcttttacaacatttttaccaaatayggtatttcctaaacaatgcattatgcggttgaagatgctcggcaaagtaatcctattcactacagttctcaatcccattgagttttctctggcagcttagtccccatacagagacccctacattggtggtcttcaagccttggacacattagaggctctccaagactcaggggaggcctacatgctttgatcttcctctaaagggccatctttacacatgcagttgtgcagtgtgagagggttgttggtaatgcaccagtaagagcagtcatcactgccagcagcatcatctcctaatattgaagacagtgttgtaggattggcagtgaattaagggctcactgtgctgtgtgggaaactggaacatggcaatgcagcctttccctaagactctttctgccatgagacgggagatgatactctgctgctgacaggtcaatctgggagagacttggcagtgagcaaaagcctctccacagagaccttgctcagtgaagctccttgaaggaaggggaaaacttcattcattttggcctggcacctgacacacagctggtgcttgatgaatgtgacctgccaagtacaaatatttcttaggcgcatcaggttagactgggagtggaaagtggggaggtgaaagagagtgtttgatgaaaacaataatgggtcagacattctgattgcaaaaagtggtgttgttaaaaactagtttttttgaggcaggcagatctgggttcacatcttacacctgtcacttatctgctgtgtgatcttgagcaaggctgtaacctctctgggcctcaattcccttcatccacagaagtgaaatgtaatacctcgctcacccagggaggtgaggattaagtgagataatgacagtgcacacctacgtatgatgccttctgtcatacacagaggatgggagcagacgcttttgtgcagcacccacctcccattggcccacgctggaggtgaccttcagatggttcctctttgcaccaatggcttcctcccactctctgtctatgggcgttctctgattgtgggagcaggttcacctgtgcataggacaggctggaagagccagggagttagccccaaaggtgaccttcaggcagggaggggctcctgtttggtctcccctttcagtgtgcaaatttggaggtgtgcttcacacagtttcttaggaggtctccagtgggactgaaccccagttgatgcagcattaacctgttcatgagcacatttatcttaggtttccactttcctcattctcaccatcctactccttcacaaagctttctgggagcccctctcaaataaaccacttcctcctaaatcctcgccttagggagaatccaaacacatggactgaggaatcagtgataatgactattgtcaattttcaaagggcgtgggtgtgggtagttaacacagggacatataaagcataacggaagaaaacaaaaaaataactacctgctgaaggcatgtagtaacgcttccggaaagagagcgtggcactgtgtgatctggagagtgtggcacactgtgatccggagagtgtggtacagtgtgatcttgaggttgtgatacagtgttatctggagagtgcggtacgacgtaatctggagaaggtggcacactgtgatctggagagtttggtatgctgtgaattggagagtgtggtacatcrtgatcttgagggtgtggtacagtgtggtctggagagtgtgacacactgtgatccagaaggtgtggtacggtgtgatcttgaggttgtgatacagtgttatctggagagtgcggtacgacgtaatctggagaaggtggcacactgtgatctggagagtttggtatggtgtgaattggagagtgtggtacattgtgatcttgagggtgtggtacagtgtgatctgcagagtgtggcacactgtgatccagaaggtgtggtacggtgtgagcttgaggttgtgatacagtgttatctggagagtgtggtacgatgtaatctggagagggtggtacactgtgatctggagagtttggtatggtgtgaattggagagtgtggtacattgtgatcttgagggtgtggtacagtgtgatctggagagtgcagtatggtgcaatctggagaggttggtacactgtggtctggagagtgtggtacagtgtgatcttgagggtgtggtacagtgtgatctggagagtgcggtacggtgtaatctggagaaggtggtacactgtgatctggagagtgctatggcgtgaattggagagtgtggtactatgtggtctggaggatgcggtactgtgtgatctggagagtgtgttatggtgtgatctggagagtgtggcactgtgtgatctggagagtttggtatggtgtgaattggagattgtggtactgtgtggtctggaggatgtggtactgtgtgatctggagagtgttgtacagtctgatctggagagtgtggtagtaactcacctatatattaaaggatataaaggatttctgtataaggtgatgggtgagggaagggtattccttggaagaaacaaagttttgtgtccatttcttcagcgattcctacaaaagctatatgtgaatttgtggagcaggcaagttagggggcccatacactagtctcatctggacgcagaactcctcagctggcatggccctgttgtcatgtatctgtgcttagtccactttcaggctgtgcttcttggtccatatgatgtagtattagtgcttttcttctacctctgaagactgtggccctgtgctataagcctaatayttgtgttccccaaaattcctatgttgaaattctaactgccaaggtgatggtattaggaggtgtggtgtatgggaggtgatgaggccatgagggcagagcacacatacatgggaaagagtcctatgtaagaggcctgagagagatgcctttcccyttgaccatgagaggacagtgagaaggtgctgtctataagccaaaagacaggccctcaccagacaccaaatctaccttgatctcagacttgcaaacctccagaatttgagaagtaaatgccaggttttcttgaacactcagtttatggtagcttgttatagcatcccaaatggactaagatcaccctgtcacctcttgtccttgtcatgccatttgtcactgtctgtggagtcccttggaagtgtcctgaaccattgtccactggttcctgtgtctctagtcttctgaaggcacctctgaggtttctgctcagtgtctctgagtccttctgggaatgccagctgactcctctgcttggayctgatagaacacccagggcccgtgacctatgagtcaaaccttaggctcaagctgtttgtttcactcatcttgtctatgacaagcctttatcatttgagtgtatgactgggaagtgtcttaggttccccacaggacaygcagatgaatgctttcctgcattcatccaaattaatgctcaaattcattcagcattttttctgctaaaaatgaaggagagaaagaggaatcaagtcatggtacccttgtaactctagttcagtggctaataagctttttgaccagggaccttggttcaagtaaaatctcatggaagtggaaatgacacaggtgaaaactgaattccccttggtgcagaaaagggggtggttgcaagctctgcatgctcatggccctctttgaggagggcggtgtgaaaccactccttgagtagacaagaggaggaaggtggacggagaaagacagtgatcctatattttttatccttctgtaacttcgtattacctggcagaccacctggggcctcccagatgasttcagttctaatgtgccagagagatgggtctcgtgatttttgctgtgaaggagtcagctgagagatagtagctcatgtctaggtcaaaactctggagaggtgagaaatctcaccccaatctcatcagcctcgctcttctcttacagaggttccgaaaacagaacagacttttgaagagcgcctgatcctcaaagctttcttgctcaagtttgtcaatgcctactcccccatcttctatgtggcctttttcaaagggaggtgagtataatggtgtcatgtgtagaaaggcaatttgccactaagactgggttctctactgtcaggacaatagggtcagcctgtccccattgtccactcagcgtcagccccttctccgccccactttcacctgccttcccatggagaaggaatgttagcaggcaatcattttgaattagcatcttcagactctgatgaccctggcactttacagggatttggctgtggtccctgaagagagagttttgaaagaatttgtgtctctcaactttgaggatgaggcaggagggaatttcatgtctagccagtggctcctggatcttgtaatgcaattctgatgccaactacctgtagttaatacagatttcataggttaagggcacggcccctcacaagacttccctcatttcagacaccagtggcaagctctgggattctcaggccaccggcagttatgacccactggctataattccagagctctcattactccatcagattcaataattcactagaatgactcacagaactcagaaatgtgctatacttacaactgaagttttatagtagtagagggatgtaaatccaaatcagcaaatggaagagacatatagagccaggtttaggaggttcttaatcatgaagcttccatgtcctcaggatgtgtcaccctcctggcacactggattgtgattctatcagtcatttgtgattgatggaatcatttgccatgtgagtgaactcgatctccaatgcccttcccttgccctgagattgggctagtatcacatgactcagagcctcaaccaacatggttgatctttctggcatggcctgcccccatcctgagtaatctcattagcctaaatttaggtatagtcctaggggtctgccaggaataacaaagayactcctatggagggaaattccaaggatttagatgttcatgcaggaatcggggacaaaggccagtgaaattctttattttacagtcagtctggatgtaaaatcactttgataaatattttttatgatcaagccagttggctacttacaaggaaatttcccaataggcgtcaaccaacaacatcaggaaagcttccctagaactaaaagttcattaagcaggcactaatagcacgagctgtcatcatccacacttgataatttcttacagaggtgtttgtcatccaaaccacagcccccttctcaggacctctccccttggctgtcatgaaattatggaagcagagagactgtccatattaagaagtatacacttcattggtgctttcaatgtcgatttcgtggcagtagcaaattacatgcatatgacgttttaggcaagaaaaaaggatcctgaggcttagaagaactgtgctatactagaagagatagccttagcaacagcacactatcatctccagtaagtgattctatccagtaagtgatctaataagaggtataaataaagtgttgggggaacagttatgaacggagacaacaagaagacttcagcaaaggaaaggcttacacagccttaaatggatgagtaggatttcarcaggtgaacacagggatgaccctgcaagtaagtaggattattctgattgtctgtctggttccatggtgggcttttactgttttgcttccccgacctgcacagtcttattgtcccccaataaaatagactctacttagaagaggaatgagacaagcttcttttattcctttgaatattttcagcaagaagtcaagatttttcttttctgaccccaggaatctctattcgcaactttagtccatctcaccctcgctttcctgggaatcagaaactcttactaaggagttgcaaccagagctgtgttcttgacaccagctagggaagaaggtgtgacgacagtgcacttagagataatccaaactgcatggtgtttaggctcacacacacacacatacacgcacacacaccaggcccagcttcatcctctgcccagcttattcctatcgtctgacatttgactgggttaagaagtgaaccccaggtgttataggggattacttgctgataacagtgtgcactcctatccctgagtgatctagcactcgccctgaccagtgctttcgaagaggacagtggtggtggtattcccctcagaagacatgtcctygagccaccctgcatgctttctcttcccctaactcttcccacactgtttgatttcaggtttgtgggcaggcctggaagctacgtctatgtattcgatggttaccgcatggaagaggcaagtacagccactggtgtttcatgcctggcaccccaacccagccccattcttatctccagcacagcatggcttcattcgcgcccctgcttctcagagctcccstttgttctaaccggtcctttccttatcttctccctgcagtgtgctccagggggctgtctcatggagctctgcattcagctcagcatcatcatgttggggaagcagttgatccagaacaacatctttgagattggagtcccgtatgtaatgaactcctctaacctctctccttgctgccaggggttagcccagaagtgccagcctttcagcaggttttctatggcctttcctcttcttagacagcttggtgatttaattctctgtcaatttgccaataactttccccatggggcaaactttgcttgccaatctgatttgagatgttggaggctcagaaggatttaccctttgcttaagtacacataactagtaagtagcagagccaggagtcagatgtcttggcccccagagtgcataatatcttaatgctatttgtcctctcagtgagtaagtaaaagagatgttcagtatggtggatagatgaatgtgaattattgaaatgtaatggaatcatttaggacaatctatacgaagaaaatgtggaatacataatcttaggaggggagggtggaatagttggtgaatgagttattatcatgtggattcccccctatgctccccagggttttatgaaaatgtcataggacttctttcaatcaggttttgcatttagatagtcatgaaaataaacacggactcactttatactggacctaaaagaaagaaagatggagcaagttaaaatatgcttacaggtcaaagaaaaatgtaaccccctctgcttttccttcctattgcctggtggctttgaagaagaatctgtttcaggggatgcttttaggcagcccagcatcagaaagctagggaatgatagagatgcccaggggtaactgagaggctgggccagttctgcttaggaggataggatggacagcttgttccaggcccagggttcttcgaaaatcactttaaagatgaccattctgggatgggtgtaatcgtcagacaggacccataagattctgtgacacatttttcatcctcttagagatacattaattgttttgagaagtcctccaataatgaaccttttaaaatcactttctttccaaatatatttcctcatgtttgcccagggttcttagctgcagcagttggaattcagggtggctactttaagcaacaaaggcatttgtttcagaataaagtggctgacagagaatactgtattctttaaaggccagagagtaggccctgagctacataaccaggaataacactgtttacactgtagggggacttgcaggggacaccactgcctctatctcatggctcatatggctaagacagtaaaagaaaaatgtagatgaaacggcccttgtcttctcagagcttaactttttagtctgggagacaaaatagactgcatataaccgcatattctatgtatgaattcagaattcagaataagtaaaggtcaggagtttgggagcagtcaaagaagtcttcaaaagcagagaggtttctggccaggtgtggtggctcaccgctgtaatcccagcactttgggaagctgaggtgggcggatcacgaggtcaggaatttgagaccagcctggccaatatggtgacaccccatctctcttaaaaaatacaaaattagccgggtgtggttgtgtgcgcctgtagtcccagctacttgggaggctgaggcaggagaattgcttgaaccctggaggtggagggtrcagtgagcagagaccatgccactgcactccagcctggcaacagagcaagactctgtctcaaaaaaaaaaaaaaaaagcagagaagtttgttccaggatgtgtctgtgtcttgaaagaagactaccaccatcatatgttacaagatggactgccatcattttctttatagaaataatttcccttagggttgtgtgtgtgtgtgtgtgtgtgtgtgtgtgtgtgtgtgtgtgtatggacaactctgatgggctgggccagctgggccatgaacatgataggctgggccttttccatgttatttattttcatatatatatatatatatatatatgtatatatgtgtacacatacatgtatttgcccttgccaggttcctgacatgccccaagaccctggtcagagatttatatataratatatacatatatataaatatatacatatataaatataaatatatttataaatataaatataaatatatttgttttatatatattttataaaacataaaatatgttttatacatataaaaatttgtatataaatttatatctatatgaaatatagatatattttataaaatgtatatatatttatgtataaatatatgcatttatatatttatgtataaatatatgcatttatatatttatgtataaatatatgcatttatatatttatgtataaatatatgcatttatatatttatgtataaatatatgcatttatatatttatgtataaatatatgcatttatatatttatgtataaatatatgcatttatatatttatgtataaatatatgcatttatatatttatataagtatatatttatataagtatttatataagtatatatttatataagtatttatataagtaatataaatttgtatatataaatatatttatataagtatgtgtaatatatacttaaaaaataaaatataatatamatatatatatttatattatatataacataaatatttatatataatatatttatatttatctataatataaatatattatagataaatatacttatatataaatatataaatgcatatatttatacataaatgtatgtatacattttataaaatatatctatatttcatatagatataaatttatatacaaatttttatatgtataaaacatatatatatatatacattttctaaacaagcaatagactaattctggtttatcacaaacacctatgacccagttggtgctacaggtagagaaggtaaggcccaatgagctggcagttctttgaccagggtcttggggtgtgtcagggacctggtaagggcaaaagcccagaatctctctaaatctatcgaaagattgtggagtcctaggttgcttgggctgaatggaaccactaaaggatgtatatcccaatcccccattccatgtaaaattatactgcagccacctgctcccttggtcctcagagaaggctcccttttggtcttcctcaaaaatatatttgtagagctaaagttataatggagacagtttaatttacctggaaataatatcatttttaatgagagccctgcttcaaggaatgagaatccacaacattcccttctaacactgggtcatctaagcatgcagggtgcttttctgaccttgtactgggacaacctcagagggcacttgggcatgtattttctttggggaggattggcgggatcattggtgtctggttgcctcactccacctccctgcctaagccagcctctagtcatcagtcaggaagtcagcaaccttgagaaattcagcctttgaagctgtgccccccgttccctgctttctgacagaaagtcactcagtgataaagtcaagcaaagctagatgatgcttgttcttgttccatgcagatgacacttgttctctaggagcttaccatcttagagagacatcatttgttatggaaaaacaaccagagaatatgcagatggtaccaaagccacatctggcccctttgaaaccatgaggccagctcctccacaactgctataaagaaaagtcttcatcctaattaaacatctgggaaaaacaccagccttcccagtacattgttattttgctgtgagtagaattatttacagctttcatccctggtcatctgatctacagcttagcccattctctctggacccagaaggcttttgtagaatacaagagaggcaagaactcgggcatgtgtttggacaacacgttggcatgtctccacccctcaactccatccaccccataacaggtgaaaatagcacatggcgtatgccttgaaggctaaattttcttgtttatgactgatgtgtgcttaatactttgtatgttttaaaatatgccaccctttaaacaatggcaattgcacagtaactcataaagccatgggcaagctgcttctcagagtctaactgtcctcatctcttgatgaatatggtggcattaaaatcatatgtaaggtgtcttcaarctctaacaccctatgaatttctctcgaatgagcaaagctggtcactgctgmttccaaatacaagccacccctctttcaaaagatgtttcctttcaatttctactctgccagaggatgtgtacaacataattatgtagttaaattcaaggatgtagaacaaaaattcttttgccaaatcctaggatcttttatccccaaagttctttataatttgtacaattataaaggttgtattttgagtttggtcatacgagatcactatgattatgattactggatcttcgactctcaataaatcagaccccttcaactcagagttgaagtacctggcatggatgacacagatgaaacataaacaagaaaaagaaagtctttcatagtcagaagagaaatgatgattgagcctgccagtgaggaaggagtcatgtaaattataaaaattagacccagtagttttcaacacatctgtagggcaaagatttggtggcctaacacagtggtccccagtctttttggcacaggggacaggtttcctggaagacagtttttccgtggaccgggggagtggggtgtgattttgggatgattcaactgcattacatttattgtacactttatttctattattattaaattgcaatatataatgaaataattttacaacttaccataatgtagaatcagtgggagacctgagcttatttttctgcaactagacagtcccatctgggggtgacgggagacagtaacagatcatcaggcattggattctcataaggascacacaacctagatccctcgcatgcacagttcacgtagggttcacrctcctgtgagaatctgatgccgccaccggcctgacaagaggcagagctcaggtgttaatgaggatggagagtggctataaatacagatgaagcttcactcactcacctgctgctcacctgctgctgtgtggcccggttcttaacagaccaaggacgggtactggtctgtggcccagggattggggatccctggcctaccagatctgggtttaaatccaggctttacaatatactcactgtgtgaccttggcaaagttattctagaaatattgccatctaacttaaaaaaaaaaaaggtttttacgttaaaacaaaactaaactaaaaaccagcttggataaatgcttagctatccagaaaacataaaatgtggacatcggaggaaaaaagaaccattcttggggtttccaggtggccaacattttactgtgtggcataggcttttgtgtttaacggtgatgctttggaagtgttgggactccagggagtgaaaccggagagaacaactcagggacagtcgttttctcttctgttcctggctcagtggcttttagtgggcagtacagctcttatgtaccttcagagcctacatggaattctttccccaagggaggtacatattcattttaaaggccagatttgttttttttttttttaaatagaggcaagtctggggggttagatgggtgattgtgctggataagaatgtttgggaataaaaatgtaataagaatttacaattaaaagatttatcatctttagttgattctttacttctaaaagcaattttctaagattcttccaaagaaaatttttaaatgtttaagagtgtctaattgacccttattagtaggccaggtagtcagctataatttatctctttctctgagggtgcaacattctcattagattctgtatgtgcgtgtgcacaaacatgcatgtgtgtgtgtgcatgtatgtgtattgaaaaaaataacataattttgatggccttgagaatcttacaatctagcaggcttcttgaattagaacattgcttcccactcttcagtcattttttaatcaacttttaaatttccccccattacctatgcaaacagctatttgcatattagtttcctccaaaccaacttgctttttaattaaaatcctcacatttctgaaattggaaaactaacaccatcagtttccataaataggaaatgatgtgaaaagaaatacaacaaaaacaaaccattattattaaacaatcaatgacattatttcctctccaaggctttctgactaagatctgccttctctttgtaaaaaatgagagtgcaagccctggcagttgtcaaaggcataccagtagcaagccaaagatgttttttcttgatggtaatgagagagactgaacaagagcagcaaaggaaataactaaataactccttcccaagggcctctaatgagatgcaaggccaagtgcaggatcttccaaagggtcmcatgaactgccacctctacttctggaaggtgccccagacaggaccactgtggaagccccactctctgtccaggcatcttccatcaggcagcagccgcccccatcattgctaggcctggcttagagaccctggagatgggaaacaaaatgcttcaaagggaggcagtaaaatggggtcaccgagcacttgaaaggcagctctgtgactaatgccatgataatagataaaacttggttgcgtgatctggctttgaatggtccccactcacacaaccccaggctcttggggcctgacacagttgtggccgatgcttcccagagaggatcggatggttttaaacattttgggccccaggatgatgttcatacgcatctccttctgagattacttcatacatggcgagcagcgtggctgaatctgrkcttgtggtatttattatctgaatccatggatgggaatttccctcctcccctccctgcaccttgcctttcccatatatgttcatgcaaaatagactttggatccagactgcatagtgcccccgaaacacatgccacaccacagcccaactctttgctataattccatctcaaatttagctccggtccacatcgaagcaaaattggaaatgggctcttctcatatggagaggtgggtttttggtgaaagggtaaatgccacctttttcacgtaccacattgtttcctgggcatgctttgagacagacagagcagatagacagatcaatactgccacggtcaaaatgtctcgccatctctattctaactaaaagctccagatcatatccaaaaatagctgttaaatgtacccctggacacagctagtaagatttcataaactttctgctttctttttgtaaatgtgataaatgttatatttccagacataaaacaggctctctttaaagccaacacgggagggaggtctgtgttctcctcaaatacagtggaatctggccataaatcagaagtttaaggaacaaatttgaaccttgtcaggtatcaggaaaaggaataggaatacatagcttagaagtggatgtgttcctcatctttggtcatttagggctaggttctgccttctttatttaatgaggctaaagatctgtggagccacgtctgtagggacctgtctagggcccagattcctgctgcagggaggcccaaggtgtgatggacactcaccatggtcctggggtgaccctgtggggcacaggcagagggaatgctctgagccttccggaaagagtttctgagacttgtcattaaaaagggacggaaaaatagcaaattaaaaaaaaaaaagaaaagcaaggggggtaacatcaaaggagttactttaatgagtgagtgcatcatacggtcggaatcgtaatctgaaggtttccaaaagcccatctgtatgttatacaacttccaggattcctgttaaattctgctctggagggacttcctttattattattttttttaatggtcactgggatatccaggaggaaatctgggaatgataaattcacaggactatttgtggatattttcccctgcatttgttttgacctacccacactggatgggactttgatcacaaagcccctcccgtagcccctgtgtcttcccttgcctttgccacacagtcttacagttgccttctgttcccatgactctccttctttgtcctttgaaggctcctttccctctatcccatcccataacttttctgacgcacgctctatccatagttggcattgctcattcctagggcttccgccgctctttccacgatgattctcagatctccatcagtcccagatygttccagggctctaggcacagatatgcagttgcctactggacatctctacttagttgtctcgtgggtttccccacttagacatggcaagaacaactcctcctcctcctcctcctyatcctcatcaaaactgcctcttacgttgtattctctatcgtagccatcggcaccaccaaccacacacatgccctaagaccatgagaatcatcgctgattcctcattgtccttcccttctgtgtacgatccaccatccactttttaattctacctcttatgcatgtctcaaatatatctacttcccttcatgtccgttgctatcaccccagactctgctaccataatctctcgcctgaaccactgcataatatggtgtacaaggtctttgatgccatgagcctacactacctttcaagacttacctttcatcattttcttttttttttttttttttttttttgagacggaatctcgctctttcacccaggacggactgcagtggcgctatctcagctcactgcaacctccgcctcccgggttcatgccattctcctgcctcagcckcccgagtagctgggactacaggcgcccaccaccgtgccctgctaattttttgtatttttagtagaggcggggtttcaccgtgttagccaggatggtcttgatctcctgacctcgtgatcygcccgcctcggcttcccaaagtgctggaattacaggcgtgagccactgcgcccggcctcatcattttcttgattgtactctatgctgcaagcattttgaattcccttcagtcctttctatgagccattttcacatttgccttaggctgttgcataaataactctccctgcctagaataacctctttgcccctcacactctctccacctttctctttcttcttctaccrtctttcattatttagtcttaaatagtaagagtaaattatttatttagtaaattaagttagtttacacatctcttcctcaaagagaacttcgctgccttaggccaggttaggacttttrtgttctcataatcactaaacttctccctttataacactcttatattggtcactcttgttttaytggtcgttattggtcacttttgtttaaatgtccccattgccagtgagattatttcatcaaacacatcacatgtcttattagtcacatttttttttcctggagatgatttctaggaatcctctgttctcccgggcaaaccagaactgctcatttgctaaaccttctatagagctatcaagctgagttgcttcaataccttctttcttttgtggggtttctgtttgctggattctgtatgttttcttccttgctttatatccttggttggtgaaattcatcctccaggagcttcatgagaatggatgcatgcataraaagttcatttttttgaaaccttgcatacttaaaagtgtctttagtctgtctttgactttcgtctatactttggctgggtataggagtctatgctgaaaattatttgccttctgaatgtaaatacatttctgcagagtcttctagtgtcaagggctgatctggagaattgtaacctatttttgattcccaattatttgtagaggatctatatgtttgtttctctggatctagaagcttttagaatcctttccatcattcctaaagttctgaaatctcatgacgatatgttttgctggaggcttttttttcaccattatgctgagtgggtccttccaatcagaaaatgcatgtccttcacctctgggacattttcttttatttcttttgcactttcttccccaccattgtctctgtcttctctttctgattaagtgttggagtttcaggccgggtgtggtggttcgtgcttgtaatccttgwactttgggaggcctaagtgggtggatcatctgagcccaggagtttaagaccagcatgggcaatatggtgaaaccctgtctttactaaaaatacaaaaaatattagctgggcctggtggtgcatgcctgtagtcctagctacttgggaggctgaggtgggatgatagcttgagcctgggagacagaggttgaagtgagcygaaatcacaccactgcaccccatcctgggctatgcagcaagactcttgtctcaaaaaaaaaaagagttcctagatcaattaattttttaatgttttctttcctattgtccatttctatgtctgttctactttttttccgagagatagtattgattttaatctttctgtcattttattgaattcatttcagatctagatttttcctggctcatttttctcttcagaataaacttcttgcycctgttggtattgggaagtgctagtcacctaggcaacatgcgtacagagccattggcgtctactgttccttaagcagagctttgaccagtcaccaccccctgccttggggatacctggtgcctccaactcctgagcctttctgagatttacagcatgagttggcttgtttctctctaccatcttccactgtgaacagttgataccagtcacacagctttgctgactccctcgtacactgtccgtcttccaagatattcatcaacattcctcacacactactatattcatgactattttcattaatttgtggttttatactttttaaaattcattcattggtattttagtggcatttcagaagtggataaatatatgtttatattcaattttctatgtataatcaaaaccactaattttttactaaagatttgaacacgtcgtctgattactgttcatggaggagaagtctcactttgaattctggttctagacttccctcactttcctttcttcttttcttctctctctctttgatttttcctgcatcttctccttctgttctgactcacagacaggatcacaaccagctcacatatttagcttcagaatctgtaggctccatctagttttttttcaattttttattatcacagaattattgcttacttttttcttagaaattttttactatgaaatttttcttatgaaattctaaagaatttcagctcactctttaaatccttctgtgataaagatgataataggaacaatgatatatttgtctatctttatttatcttgataaatgtctatcagagcatgtatcttggtacatgctcttaacatgtatcaagccctaaatgaagcatgctgtatagattatgtcttttaactcaccctatgggcaagttaatatttatttctccattttaaagataagaaaactaaagcttatagagttgtaataacttgcccatggacatatagttggtgatttgtgaaatctggttttatacaatttctggcaccaaagatgagacttttatccactatactacatcctcttgataggaaataggaatattagaccagaaactgatcaaaacattattttgaactattagattttcattagctgttagaggcactttcaaacaaggatgggatgcctaatcataccagaagtgctcctctggaaatatctacacaggggttgggtggtcttgggtgaagaatgttgggggacatggggaggttcctacatccagatgaagcatggacttcaaaatcccgtttaaacacttcaagtctttgattcttaccattttactgtctcccaactattaggttgctgcttaaagtaattgcagtttttgccattaaaaagtaattgcaaaaactgcaattccattccctgtacattgtgcatcaatgggaagtatgaaataactccaccctaaggtgtattttagcattcggtattaaaaataataacaggtatcatctattcaatgcttactgtgtccagatattgtgctaaggactgtataaacattgtttcacttaattcttatttcaaccctgagaaattgggccattattatcattctasaccaaaaaagtcctgaatgtagttgtcttagtctgctcaggctgctgtaacaaaatgccataggcttaaytgacagaaatttattttctcatagttctagaggctgaaaggttcaagatcaaagtcgaaaagggttgaatttctgatgagggctcttcttacaggtagctgccttttctctgtgtcctcagatggtcttgagatatccctttctctcttcctctactcataaagccaccaatcctattgaataggaccccacctttttgacctcatttaatctaaattacctcctaaaagtcatatctcccaatacagtcacattggggattagagcttcaacaaatgaatttcagcagacatcattcagtccatagtagtggtgggcaatgtttagcttggttttaatggaaagatgatgctattaatgttattgagacctgaaaaatgtttcacctaggaggagaacagccctgtgttcccccatgaagagggtggatagatcacctgttggacaataggactggtgccgtctcagcattggcaggaagggccaactctcttgttgcttgtcagacagcaggaagaattcaaaagtattttggggtttgaagaaacctcatcctttgtggagggagtctgcacgatctttataaaggacttcctcaggttgcctttaggagaaaagtagtctctttagtgtctctctatctctacttgtttttggatcagagatggctttagtgtcaaaacttttgtgttctttttcttttttctgtctgcaaaaccaaccctgttctccagaggctttttgtaacttaatccatttcttttccaggaagctaaagaaactatttcgaaagctgaaagatgagaccgaagctggagaaactgactctgcccattcgaaacatccagagcagtgggacctagactacagcttggaaccatacacaggactgactccggagtacatggaaatgagtgagaacccatggtcctgccttccactgggggcaggttcagacaaggggtctgtggggttgaagggggaaggtaggggattggggaaaatgactgggacagcctctgcttcttcatgagcttcatggctattcagtgttcccttcagtgccacatgaaagttgagaagaatggggcagaaagagacctgggaggagaacctggagcagctcagtcaacagtttggtggataattctaggatgatgttctcttttccttgtgattcctctcctcatctataaactaaagtttgatctctcaggcccctttccatggtttctattattgataaagctgaaagggaaatagtacaatctgaaatttaagaatatagtttccatgaaagtcttccttcatggaaagtatccgatgacacttgggtcaaggatatctacattttgacttggagaatatataagagcatcccctactttgatcagataaggctggataagatgaaagctttttaacaaaaagttgggtctatttcggtagggagtgagaggtgtatttctagttgcagagcctctagttgttttcgataaggcttgaaggcaggagcacatgtagtacaggctgatggaacacaatcattttagatgtggcttggaagccatgagttctttattatgagaagggtcccaacttaggccagctgcctttgcactgttggctacttgactataatcctgatcttctattgggatggatgtttgagaagtctctttccaagacttggggctaatgaattaaaagcataggataccaaagatcaagagcttaggtataagaygagcgcagtggctcatgcctgtcatcccagcactttgggaagcagaggcaggtggatcacctgaggtcaggagtttgagatcagtctggccaacatggtgaaactccacctctactaaaaatacaaaaattagccaggaatggtggcaggcacctgtaatcccagctacttgggaggctgaggcacgagaattgcttgagcctgggagacacagcttgcactgagctgagattgtgtcactctactccagcctggccaacagagtgagagtctgtctcaaaaataaataaataaagatcttagctataatgtctaaacattctaaacatttactcaatggggaaccatcaataagatccatcaaaaaaatcactcaatgtttaattcagtgcttagtatcattgcacctatcactgtgtttgcatatgactcctgctcccttcacctmgtcacttgtagcagagggccgtcagtacctttttgtgcacaggctacctcactcatcatttctaatgggcattcctcctattctgttataggaaattgcatgtgtttgttagcagtggagtaatgggcagggtctagatcagacggccatggaaatattgtcctagccctgggatgtctacaattctagggaaagcctcaactttgtaatctgaaacaactcaccagagaacaaacaatcattaagtctgcttcagaaacaatatgtaaagaaaatatcaagacctggtttaaggaaacgtgtagcccctttatgcctttcatgtttggctaagagctacctctaatccctctctgatgctgtatttacacaaaggatattgctcatatttcagacgccattctacatctgccattctctcacccagaatgaaagaaagtgctgccagagattgggacttccatttggggaagggcctacattaggaacccctgagatctgtttgtctgcctccaccctctgacgccagtggtcccacttccgtcgccaccaattagctgtgtgggtttcacatgcttgtcaaccttgtctgttcagctatttcaaagcttcctcttttgrgtgattagagcagagaccccaaagttttctagtttatgtatatagacgtgttcataatagcaaagaatacattccacctaaatgctcatcaatgataggctgggtaaagaaaacrtagtacactgtggactaccatgcagccgtgaaaaagaatgagttcatgttctttgaaggaacatggatggagatggaggccattatctttagcatactaatgcaggaacagaaaaccaaatactggatgttttcacttataagtgggagctaaaccatgagaacacatggacacacagagaggaacaacacacactggggcccatcagagggtggggatgagaagagggagaggatcaggaaaaagaactaatgggtactaggcttaatacctgggtgatgaaataatctgtacaacaaacccccatgacacaagtttacctgtgtgacaaacctgcacttgcacccctaaacttaaaagttaaaaaaagagaaataaaacattaaaatacaacaaagaggagcagagacccttgaaccatacttcctgggctcaaatcccagcttttgaccaactagctgggtaaccctgtgtaagttacccacttgcccttatcaagactcctatgygtcttgatttgcttgcctattaaaaaaagataataatataataggattgtcaggagtagtgaatgaattagtatctgtgaatagaagagggtcttagtgcttagtgctaatacagtgcttagaagagggcctaacacatacaaaagytgtgtattaagtgtccagtgttattcctcttaatggtcttgaagcctgaggaaggcagagttagggaaatatactctactttgtcagggccatgccactgaatacacatctaccatgttattatgtgtttcaacttgggtgcttaccaagaaatgagaagaatgaaaaaaaaagtaaagaactagaagatttacttggtgactttgggaaggaattcacaccaagattgtagagagtgagattcagaccatagactgaaaaaccagaaagaaaaacaaaccccaaaccccacaccttaaaatgaataaaacaatcttatacctggaatcttgaaaacagaagagaacctgtctcccaaatccaaccttttaatttttttaaaccattttggtgctgtttcttagaccctttttgtatgtacatgaatttaaaaataaaattttgatcatactcacatttttttatttcccattatatggataaatattttaagttatcacataacattcaaaatgaatagctgcgtaataatccctttaataagcatgccatagttcacttgcctatcttccagtgaaggcttatttaacaattctccctattttaatcctctatctttgttgctcaggctgatcttgagctcctggcctcaagcaatcctcctgcctcggcctcccaaagtgctgggtttataagcactatctttgtgcatataatcttttatttatattattatttcacccagatagattcacataggtgtgattaggtatggtcattctatggttcttgattcattttaccaaattgctttytgaaagaataagaacaattcacccaggcatgggcaatatatgagaataccctttcagtgagtataaatcacttaatatcctgaatcctaaagtcatgtgatatgaaagaattatcagtgtataggaagcttgggattcccagccccctacgccactccattccacgttgttgacctgaatattctagactcatccttagcttagttttacacggtgcttcctctaggaagtcttcccaggtcaagccccagttcctcttgagagaaatcatcacttktttctgtcctagtattgtgtttggtacacacgctgatggcatcttactgaattatggtagtattgcttacacatatgttyttcaacagacccagtcaaggagtgactctgaagagcagtaggtagggaccatggcttattcatcttcacagcctccagagtctagcacatttcctggcatataacagacactccaggccaggtgcagtggctcatgcttataaacccagcactttgggaggctgagacaggaggattgcttgaggccaggagctcaagatgagcctgagcaacataatgagaccctgtctctacaaaaaggaaaaagaaaagaaaagaaaagaaaaaaaaacagtagagtgtagtgttgtacacctatagtcctagctacttgggaggctgaggtgggaggattgcttgagcccaggagtctgaggctgcagtgagctatgattgtgccactgcacactccagcctaagtgacagagtgacaccccatctctaaaaaaaacaaaaacaaaactcaaacactcggtatgtctgatacacaaagatgagggaatgaatgaatgcatgcatgcgctaattaatgagaaaaggtttcttgacagagttaactctataataataactttacaagacaagtaaaggatttacattttcaaagcagggcttaattgatggtgaactacggatgttctgaagaggtttccagctgtaagtgggaggttgatttagtaatcccaagatctcttctgattctggagatctacatatagatgataagaacagagaagagcactccagggaaaaggactggcaagtgcagcgagtctcctggccatgagtaactgtttttgttgttgttgttgttttgttttgacacagggtcttgctacatcacccaggctggagtgcagtggcaccatcatgggtcactgcagcctggacctcccaggctcaagtgaccctctcacctcagcctccctagtaactggcactacaggcatgcaccgccaaacccagctaatttgtttgatttttttgtagctgtgaggtttcactgtgttgcccaggctggtctctaactccagaactcaagcaatcctcccgccttggcctctgaaattgctgggattacaggcatgagccaccacacccggccacgagtaactgttgacaaggaaaagcaaatggtagttttgaggtatggaaggttcagatacagacctgggattagtggaaaaccctgaagaccagacaggtttgcatttcacatcagaccatatgaagtagttgtaaaatcttggccaatgtggtgactgtatactctttgcttgggaaattgggcagcaagtgcagaggagggatagtaaggctcaggaggaaaagagaaaacacaggtgcaagaattcayttatcaattcattcatcaaacatttattaagcacctggagggaggagcaagtctggagaccaggacagtctcttgagcaattcaggttgttcctgatattgattgagtcaacaattcagttgatattgatgcaatcttatctggaagaggaatcatacaggggtttttcaagctggattggctcatagaattctttagtctattttgctatgactttcaatcttaagagatgtgttttagagacatggctattttatttcatattttattaagtgtgaggacaatgttttctggattaggtttcgttcatctcttttatctctggactatcctcttaatcctttaaggacatactttttctcaagtacaaagactgggctgcagaataaccctcattaaagttcatcaagcagctaagtgtggttaggggtggtactgccgttgaaccactgggctttcaaacctaaccctgctgcatgctagctacatgactctggttttgaggcttaaagtcagccaggtccaattctcccatctgaaaagtaggtttgatgataatagcacctacctcataggactattctgggaatcagttgatgcatgtagagtgcttccacatgtagaccgtcaatgaacattggccaccrttgttattgtccagagttcagtttctctcaaatctagaaagtttttgactcaaaacagtttgaagctcctgaatacggtgatctctggaggttcttcctgtactgtgagtgtaggctgtgccctaattattaaagaatgagggtaccagaccccaaggcatacctaagaatcagaagcctgagctctaaacactccaagatgtttgtcctttcagtaaactctaagccctcagggctctattgacaagtctggactctcagatgggctctttttgtcatctgtttatctaaaacccacaagcttttgttcctctagtcatccaaaaaataatcgctattataatcctgcctcaggaattcaattatctcccttacrgccttcccccagcttcttaaatgcaaccacagttttgaggcccttgggctattactgtgggtgatgagatgaatttcttctgtcattcattcacacagtcatgagagcagatcttatttttcttggtcatgagcttatatcctgtcaaaccctcacagaaagggaagtgcatccatgattgcatgtttacttattcattcatttggagtaaaagccagataattattttgaaaggcagagacccccagcctctcctgctctctggaagtgtgcaccaaggcctgtagaaatcaccgtgtcaaggaaatgcatagggcaggttcctctcggagaccagatgttaaagctcttgtggccgctttcaagttgtctcctgaaatggcaagtctgagcttctgggttcaggaggaacgcctgtggactcttaacctccatgactactttctgactttgcgtgaaccctaactggggagagtttctatttgtggatacttacctcgctgactttgcctctactgagaattttggattcttatttgaaccctcaccatttctccttggaattactggaaatgcatcctaagttgactccctgcttctttttcactccttctacctttccttcttgctttttagaacggcttttaaaagatgcaagccagattgcattcatttttctacttaaaatccttcaacgctacagacttcttttcagataaagttcacacgcccagtgcagcagatgaggtcatcccaagctggctcttgttttgcatcttcttgcaggcccgcgtgtgtgtatctggttatctcacactctcacgtccaatttgcctatgccatgtcgcctacccgtgactgcttgctgagtgttgcaggctcagacacatttgcccttggcaccattttctcattctcccatcctcagtttttctcttcccctcttctcctgtacctgcaccctttcaaacatgtgagtgctttggggacagggacaatgtcttattcctctctagtcgcaacactcagcatgggtactagaacctgataacacaatgaaataattattaaatgaatggcctcataagtccttttccttcattggtagagaaatagaagtcccgcttctcttgatcccatgacctgtgggccaccttcttcactatggacatatttgtgtaatttttaatgtgcaataattttagtctcctaagaccaaaatgaaccatgtttattatcagagtttctctcaaagaaaagtcacttctgattttaatttattcctttccctaaggggtcaagtcattagtgttagtggacagggtgagatgatctctttcagacttggctctgacctcaactccaaggccacatccctgcctctgcagtgactcccctcctgccctcccccggggcagcrctgtggtgtctgcactgctgccaggcactggggacacagagacaacagacatgcctgttccctccagagtttcagggtctggtgtgagagagagatgtgtgaaggagctcagggaacttcaccccaaagtatgactccctggcatagtaagtattttgatttaaagatcctagagatgaacagtgctaaaggagatttttcccctatgtatgtaaagaccagtcagacctaccaaggagaacgatctctcccacccttctctcaatcctctacctctctcaacacacaggctgaatttcccttagctgcctaaaagtctggacctactaaagaaaagaacaattacttccaatcccttccctgagttttcatgaactgaacccacattgcaggaaagaagactaaagtcggtcaacaaacctggacagacttttgtcacaaatcattgtctgctctgcagattcaatagactttgccccaaaccattgcatgttctttaagcccatgaaattcctctgaaatcacttactatccccctaaaatcatccgcacttcccacaccctttcccctaagaagcagggtatgtaagcacctgtactacattgggatactgggcaatcactctgtgattttccccgtgtgcatagcagtaacaaattggtagtttttgttttgttttgagacagtttcgctcttgttgcccaggctggagtgcagtggcgcaatcttggctcactgcaacctctgcctcccaggttcaagcaattctcctgcctcagccttccgagtagttgtgattataggcattcccgtcacgccctgctaattttttgtatttttagtagagacggggtttcaccatgaccaggtctcgaactcctgacctcaggtgatctgcccgacttggcctcccaaagtgctgggattacaggtgtgagccaccacgctcggccgctagttttttctcttgttaatctgccttatcatgagttggtttttcagcagaccttcccaggacaaaggggaaattccattggcccccatatgggcacacagacagttataagaaaggacctactgttctagaaaatagtttgcctagtgatgcttgctgcagaggctaggtctttgctgcttccggttgaccagcagagaggtgtgctcgaagatcgcctgctcttctcattcttttggccttgtctttgggttttagaaaccacctactgaggccargcaaactctgaactggatgcaggaggctcttctcccgcttactgccccaggcttgtctcgagacttcaaacaaggcagggaagggcccagaccagaatccatttcggggaaacatttctaagcctttctgcctgcaggcttcatacccttgactgttttctgagttctgtgccacattaatggccccaccatcctccaggcccctggctgagaaatctaacatcactgctcattctctgttccgtctccatgtgcctcccatccagtaggcttgctgtgtcgacgatctttcctctagagctggggtgtccaatcttctggcttccctgggccacattggaagaagaagaagtgtcttgggccacacataaaatatagtaacactaatgatagctgatgagcaaaaaaaaatctcataatgttttaagaaagtttacgaatttgtgttgagccacattcaaagctgtcctgggccgtatgtggcccatgggccaggggttggacaagcttgcaatagggtatcttaggaatctgctgtgtctgccctgcctcctccctggtgcttttgctttttcttttttttttaactacatcctcaacacagccacttgcagccaccaccgtctcrccactgcctcatttattccttccgaggtgtagtgttggtcatatccctccggtgtccaaaaaccatcagggttcccgtgctcctagcgaggccctcccagagcatccttctcgtytatttaatcctaggtccttctccatgtcctgtggtccaggaaagtgaatcctccgcaccctacagctccctcctgccctgcctgtcctgagtgctctcccrgccctgggcttgcctgcgccttctcatgcgtgcatccaaagccacctctcgtgtcacctgctccttaccacctcccccttccccctgccccacaggatttcagacaagctgtctcctaaaatagagatgcctttggtaattaatttcccaagggccgattcttcaaattgcagggccttgcccagcacccccccgccagggcatagtcactaaaaacatattgggtaagcctgtaaaggggggtaactgaataaatgagtgtatcatttatgtcttcggctttctcttacctaggctaacagaatctcactttctagtgatgctgagccgtggtcaattctcatttatttatgggctgataatccagtgagtggattatcaagagaggtggttatccttatttctctttctcctcttcctccttccctgtctccctctcctgccaccccttttcttcctctgcctcctcccctcccccatcccaggcctattaggcactcctttctagcgagtaagccagggaaataagagaaggtgtaacgtgaacccacccatgcagttcaaagatcgcagcagctctgggaactagcttggtgggagagaagatgaagttcacagcagatgtcaaaacttcattgggggcaatagtttctgccgtctccatggataactaagacttggcggcagtcaccttatcattacttctgatttctctgcaccctcgtctttgaagtaaaagccccttcacatctgctgcctcttgtatctttagatgaccattgtaggcagagtgagcgtctctccttcccatgttcccagggtgtcaggtgagactcgggtgcagatgcagctctgcttctatctagcagtgtggcctagggcatggcgtcgtataatttccctggcttcccttttttcctggaaattgtagggaattagaccagagaatgagtttttccctgcagtgatgcaacccaccggtctgtggtcaaaaccaattgtgcaatgtgtcacaagtaatgcactactgccaatgttttagaaatacaaggtaaaacagagtcagtgccaccctcactttcttagatktctagatgttttttgaggaagggacgtttcagcatacacaaatggaagtgcaggtcatcatttttcattgagtgtcttgacaggaataataagtttcagaccatgagaccagctgaccttcagggcgccttccagtgatgacatgatggttcatacatcctagttgaacagtgcacctcaaagccaagaggcccagggtaatgtgagttgcctaaggtcacccagatgactcactagtggaattgaggttagagccactttccagaccattccacgggagacgtgcttcaagacctgtagkaacttgggcttctgtggaaggatggaatgaagtgaggcttcctccctccttcctaactggctagacctcccccgttccagaagggcccatgtcttggacttygaacaaaaatgagagcaatgaaaccaaagctgccccccgcctctggtgtgcttgacatggaaggatggaatgaagtgaggcttcctccttccttcccgactggctagacctcccccgttccagaagggcccatgtcttggactttgaacaaaaatgagagcaatgaaaccaaagctgccccccgcctctggtgtgcttgacatggtgatccccggcccagctctcagctgtcagcctctttccctgagatccccaggaccacccatgcagacaggaagtgcgctgagcccactctgggcctgtcagtaggaatggtggggcaggtcctcaacggagggaggcagcagggggagatgtattatatttacatttttctaaattgaactggaacctgggctggggcccagcaggcttgggggaggggctgcgaggtgaagggaggctgggatcagcctgaggaggtgcatgggggtggggagcctcctcaggccagtggatgtggggatgggctggctccagacaaagggaaacctgagagggagggattaagctggagaaacctgggagggtagcagctggctttcgagggaatctccaatatcaaaccttttcctgaagggcttactaagaaggactttaggaatcgtctcccactcccccatctcggaggggatgaaagaaaactggcccaagagatggccatgacattaatcatcactgtcccctaccccaaaatggggcttcaaagctccattgccgcaggcccctcacagccctgtcatggggttwtcctcagggcygatgagaggaaattcttcatttgctttaagagctgcaagcttaagttctctggacacttgcagccatttgacttttcctcctgagcagaaggatgtaggcccaagtttaatcccggaagagtttagtgacaagtcccaaaaaaatctcttggtaaagttttatcaccgtttcattcagataaataaatgatgtgattgtcagttcttctcacctgaagaccaatggcccagggtcatgatactcactaaattgtgatggaagcttcttgagggtgagatttgtgtcttattgattcacagcacttcaccacaaggcctggcgtacagtaagtgctctatgaatgttttcttaagaaggaagaatgaaagaagtgatcctgtagtgaggaccttttgggccggctgggtgtggggacgggctgtcagttggactctgcagacgttacctttcatgaaaactctccagacatccttgtggtattgatttagttgggacaacctacaccaccccttgcagtgcaaagtctccttattttgaagtgctagtaattagggaatgctgtcatccatagagctggtctcctatagcagcataaattgatgaacttatgcaattatctggatagttcaggaaaactaccccatatattagacaactactgctatgataatgctttgtagcaaatactccagagtcccggtgacttaaaacggagacagagaatcaaaaacaatgaaaatgacgggctctggtactgagttccctgcctgacaatgatcaggtgaaagtggacacttattaaaggagcagaatggcctgagcttcagatggagggataacttaggtgacaccacattcttttcaactctgatattctttggtcatggatggtaaagactgcaatgggtaatttccaaatttccaacagaggctggatgtaagtgatcagattttctagaatacctgagaaaccatcagcactgaggcccacatattctgtcacaaagaactgcaagtgtgtgtgtgttacaagccaatggctcaaagaaccaggaaattcctttccctgggccatcctgtttacacacgctgagtcattccactggataatgaggctcctgccatcttctccaaatggcgtttaaacacaattgaggcagcatcgaggggctggcttcagcatttctgagaagtaggttgagtcccaggtcatttctgtccttttgctgctgaggcatagattgcttggtgttatctgccctagactgcatccccacgcctttaagaaaaaaggcaaaagtgtatctggataccacagccctcagcgtaccacaaaaggcttctgggatacagaagatgcctagtcagtgcttgaggagggaaggaaggaatggagggaaggcagtcttttagtttaaaactgatgaagaactgtactgctgccccatttctcttcttgctctaacaaccgggaagctcagagtaaacgttactgctcaaacatagctgcattgtggttccccgagttttcttacttgttttgtcctcttttctgtgctccttatttccgttttctaaaatcctataaacctaattttattttcattttgttcacttttgcacaaaccttttgggaagaggtagaggagaaagaataaagcaaagaaaggtcctcagtaatgatttgttgcttgggaacttcattccaatcatgactggtttcattgcccttcgaactcacgcactacattaccacagtccaaatgagaggatggagggatgggaggaaggatgaatgaataattgtccttcacactcccatcttgcaggtggataacgtaaacaagagtgagaaagccagaccattcatttgttatttcagtaaatatttactggaagttcaccagtctgtcstccaggaagtggatcagtagatcttgccaactcaagtctccctagctttgatgtgggacgggagaaagagcagggactgagtctcctttaaacacaaagaaatgaagaaaactcggagccaaatgtgccttactgatctgtcccagcattgcattgctttgcatgcagtaaactcttaatacctaagctgtgacttcaagcctgtcccttcctgttatgacttcccaggctttttgaatcaggcccgatccattgtgtaaacccccaggtgactccatgcagactgaaaaggaattccacatattgtccttatttcttaagtagttttttgtgaatttggatcagtgaatttgcaggaacgaccttaactaccaaccatatagcaaattttcttatgcgtcttctacttgttcttcacgtggagcccagtgatgaatggtgcaaagcctccatgggtctgctggtgacagtcagttacctctgcccagcactctacagcactgttaatgctggcattttgttctcaccacgtgaggctgtcaaggattgtttccatgtccatcttccccacagcatattctgagcccttggaaggatgccacagtaatctgctcatcttcgtatttagcaatgcacatggtctccagtatatagaatgtgctcagtaaatgcttgctgaatgaatgcatgagtgagtggatggtgagtgatggacgttgagaactctcttatgtttctgtcaaggcttcaccatttttctaagcaatggaggcccatgctgaggatctaaaatagctcgtgccttttcttctcactgtcttttcctakttatgtgtacaatcgacacttgcaattctttttatgccagacgttgtcagcccaaagcatagttggcttcccttgctcttgggaaaaggggatccctgggcacagtcrtaaaatatgggctgakgaaataaatagttatgaccttcccctgctgtgctcttacataagtatgtactaatgggctgtttctagcggaatctttcacttactgcctcctgagtgagaagacaagctcataccagtgtgtccttccatgattcccttgcactgctcattaatggctcataagaaggaggattctttttttaagcatttcagttatttttaattaaagaaaaacagccttctccaagggccacaaagtgaactgaatgtcagaaggaagctgggtgtgagtttctcacaagctcttgctccaaaacctgttagtgaggagaaagggccctccgggagctctggggaaggttggtgcacacaggagtccctttggcggggtaggcagagccgccagccctcacatggtcactggattggttcgagtgggctctaaggcaactgccgtgtgccagtctgttgacatgatcaacattaatattcttgcggcggggggggggtgttcattaaattaaggaatgacacagggagccaagagaatggcttatttgtttggattctgaatcacaatcgggaaatagtctttatctggtgcaaccataattccattttacttggagcaaattcgaaggaaggtgagatcattctgggggtcactttcatgcatggtgctccgtgccttcaggatgaagctgtgcaggaagctggcacactctgtggtggtgaggttgaccatggtgctcttgatgggaatgccatctttgttcaccatgatgatattctgcactcccctctggctctgaagtcacttcagtgtctcctccacctctgatatttacaaccgatctggtagtcctgctttgccaacactcaaaaaggagaattcttaagcccccaatattcaacttctttaagcagactgtgttgcttttattaaacaatagaaagcatttttttttttttttttttttttttttgagacggagtcccgctctttagcccaggccggattgcagtggcacaatcttggctcactgcaagctccgcctcccaggttcacgccattctcctgcctcagcctcccgagtagctgggactacaggcgcccgccactgcgcccggctaattttttgtatttttagtagagacggggtttcaccgtgttagccaagatggtctcgatctcctgaccttgtgatccgcccgcctcggcctcccaaagtgctgggattacaggcgtgagccaccgcgcccagccagaaagcatttttttaaaagctataatcattttcattagaattggactctcctaaccaactgtttttactacaactttcttcgaagtcttctgtgccgattgcagcaatgagaattgcgatgtagaggtgttcatacttcatgtctacctctcttttcaccatcagcaagtgcagtgctctcaggtcacacattttcatttttgaccttgtatgtgtgtgtgtgtttcacaactggtgaaaataaggtcagatttatgaaacagataatctttgagcatctgctatgtgataggcaccacaaaagatggtgagtgaggacttggaaaagaatcaaataaggcccctggtctcaaggggctttccatctagggagcaggtcaaataaacagagaggcgtgtcaaggcattatgggagtgaggatgagagatgcccaaggcaccgagttccacctgcagtgctggtgggaaatggaggtggaggggagtcttcatacagaaggcgaagtttgagttgagcctgagagatgaatagcatcctactcagccgaccagaagaaaaggaaaattacagacagtagtggcatgtaccaaggctcagaaatgtagaaatcatggtgagtttggggaagtacaaatggtcttggaatggttggaaggcaggcggagttgatctccaacatacttgctaaatatttgcccttagcacagaacatgggtggggaggaaatggttctggatatgttcactgaaaaatcttaaataaatgagtaaaaaatcagaattgtattccatcaaaatcttctccaccaatcctggcaagtccattctattttatctactatactgtttgtgttctctaaacagattgtcttgaaacrtccttgttgaatattgtcttggttagtttaacccactcttccttgttattttaacctaaactcaggaaatcactgatgcagaaatgtctccagcttcaggcagtgtagggctgatggttattctagaagatccttggctgctgaagggtgagaagagaaaaccaatggggtttgcatggaggagtttccagcctttgagctcagcattactggagcattttacagcaggctttataaagatttggttgaaaatcaactcaaagtttcctccctaattggcttggccaggcttaatctgttattggtcaggccgagctggcttctattatgcagcgcacggaggatttccggtgttgctcttattctaatggaggcttgctgcttttagaaacaaatcttggtgttggcaaaagccggtatcattgtatcctctgaagtgagcccagaaggactcccagcattttagacctttgactgaaaagagcgagtcttggatttggaatttgcatgctagagagttatggttttatgttttattctcccccaaataaaacaaaacttcctatttgtttctgcctctttgggttgaatcctggcaatgctcagattacccagtctgagcaggcgacatctgcagcaatggggcgtctgcagagagggcctgttcttggctcaggataccatggagtaacaccagaggaggggacaggaggatcttgtcacttcaggtccagcattgctgagcccagtctcttgaggccatccagtgctgarcatagagacttacatggcgaggggaaggaggagggacattttgttatgggactggggtgattaacaggagctattagagagcatcaagccagcactggaagatgtttgcgttgacagaagagggacaccagagagtccatgtctggagagtttgtgaaggtaaagaagcaaaccagcagggaagccctagaagacagcattcatgtctgcctctggagttcaaatgaagagagaagaggaagtggagagtcccatttttcctataaccctggaaggaagttagatttcagagtaccatgtgcacgaatgtggtgagggcatgctgtgtacatttgcaatccctcagaagtaaactgcccttctccctccccatcagtctccttgccaaacccttgcggaggctctggggagtttgcacatttctgctggaggaagtcactcatgataagaacatttgccctgctgaactgagctcattagaatcaagaagaccagcttataactccataaatatacatccatccatacacttaaacacagacatgcattttacaggttttagaatgctagtctaacatctgttttcgtttccttgttaattccattcatccccacaccctcctggccttatccccattcctgactccaaagtgawttcctcagcaaagctttatttaaaagatgagagagatcctgcattttgaactggcttccagagcttgtttttggggatttctccaccaccctccaatcgttgttggccagccagctagtcaggtgatcactctaaggtcccaaccttgacaaatctgtgtatttcggtgcagktgtcttgctaccgaccagcacttgccggcctcctagggcctgcaggaacctactgggcaccaaggacaatggcagtggacagggttgaatcagcaagaacagtgacccacaactgtgggctgagcaaactgccaaatcaaaagcagttgggctggggaaagttccatgcctgttccctttcctgaaacttctattgtggttgctcttatccctctgtagaaacagaatttttttcccatttgtgtcagttttttcattcttcatttgaatattctagactcacgaagcttgtctaagacaatgcgaaccatagcatcacagcaaatcagagttggaggcaatttaaaccggtcccttcaatttatcaatgaggttgctgatgcccattgaaacaaacaggcttggccaaaatcatacctctagttagaagcatatccaggtctagaagtcgggtctctctcattcagtgcttaaaccttaagtttgtgtctgtttagcatataagtatacagtatacattgcagtcatctgtacatgttgatatttattccaataagaataaaattacacataawagataccatttattaaacagttattatgtatccaacattgtacatattgtacattgtatgtacattgtacatattttgtatgtaatatcatttacccttctgggaaccctattgggtgggtattactattatcttcaatttacagttgaagtacctgaagcacagaaagtttaataatttgcccttagtatgtaggggagtcctactacattgtaactttcctggactctgggttgtgtttccatcagcaaatatgtactgaacccctagaagggacggaggccttgccttctcagtgggaaataaagatgtgtgagcaagtcaatcacagaagcacacagtgatggctgcaacagaagcctgaacacagggtggtggggtccagaggaggagggatggggcttcaccaaggaggtggcatttgagtgatcccagggatgcatagaagcttgccagccagagtgtatgcttatgcacaaatgagtggaaagaactaatgtggcaggggacaattaggagggtgagaaggcaggaccatggtcgttgctggggagatgctaggagatgaagctagggaggcagattggaggcagattataaagcacctgtatgcaccggtagggactttggattatattcagtgaacagagtggagccaacaggaatttttataagcaggtagataacagaatcaggtgagaggggctgtgtgctggatagactctagcatcctgggagaatggtgacaagaaaccccgtcaggaggctgttgcaatggtccaggtagggctggactctttccagctgtctcatgggcatgggctgtgccaccatgcttttgctcacactgcttccatagcttagaaggtctctttgacttaatcctcaagaaaactgcatgcccatctttccagactgtgctgagggactctacatggagacccattcagtccctgccctgaacaatgtacgttcctctccatttgggccttctctatcactagtacattctttattctctcttggcatacataaaaccttgttgcacatgtttgcctacacttaactctccactttcaaacccagcttcttgcaggcaagaacagacctttgccttcttaaatacttggtacagggcctgacatttataaatgctctccataaatgcgtgatggatgaataaactttctaaacaaaggcagtgactgtagacatggaaagaagagtccaaatctgggaggtggtttttaaagctatttcaagggaaggcaaactgtggcccgtgggccaaacctagtcactttatatattgcttttgtaaataaagttttattggaactcagccaagcccacttgttgatgtgctgtctatagctgtttttactgtataatggcagagttgagtcgttgtgacaaaaccatatggcctgcaaatccaaaaatgtttattatgatctggccttttactaaaaaagtttaccaaaccctgagttagatcagtaggattagtgactggcagtaaagggtaaaggaagcaattaagacttttttttcttgtatctccccaccatgcctaatccagagctttgctcccaagtgatggcattgaccaacaggcctgcaggtacttagaaagaaataccgtgtatgtgacacaggaggaaaagggagactaaaaattaccccatatgggaaagatacccaaggcagaaaggacaaggggctgtagctgcaagccagaagggacctgagtcctgcttgttcctgctgaagccctcatgctgtgctctctcgcagtcatccagtttggttttgtcaccctcttcgtggcctcctttcccctggcacctgtgtttgccctcctcaacaacgtcattgaagtgcggctcgatgcaaagaagtttgttacagagctgagacggccggatgctgtaagaaccaaagatatcggtacgtgccccacttagaggccccaccaggcccatccttctgccattctgtcccctctggccacagtcacaccacaccaggaatcaagagggctgggaaagcccctcttccctttgggtccctcatcctcatatcctgaagtgcagggacgccttctgagaccgctttatccacccccacttgtgatctgagcttccagatgggggggctacctaagcctttccagacaagcccattctgggggggcccagcaaagctgctccgtagttcacctgcaaaacatcacctggagcttcagcgttgtcatcactgggccgagggcgggagtgagccagacgctgtcttttctgtcttgtaggaatctggtttgacattctctctggaattggcaagttctctgttatcagcaacgtaagtacttgcattcatgacacactcgctctgtgggaagggcttccagagaagctgaggtcttcaaagtgggaagccagcccttgcacctcccagccttttccatttgtagctttattggtgacagtgctctggttaacagctcacaaatgccttgtaacccatcatgctgtcgctgaggctgtgtaggtttaattttaatttcacaaagagaaagaaaggtaattatccatcagaatgcataccttggccctgacggtcaaaatcagatctttccttggagccaagaataatgaggaaagaattccacatatctattcatctctttcctttcttactctactcctgagttaaacaatacctggagcattgcccaggctacaatccctaattaccgttcctccaggttgtcagtgcaaaatcttaattatccccgtggactctggcactgcgtaggttaagataggacatagaagaagggtcccacctgtggtgacctccttaactcccttgccagatatgtctacactgcagaggaaatcctgctgggccccagccagctccttttctgctgtattctctaaggacagtggccaggaagggcctcctgtcccacctcccaggaacatatcagccagctcagtgcacacaaagaaagccacagcccttttcccttggraggcaaacagtgatttgactctgacctgatttcctacccasatcacataaaatggctggaaggtgtgaggtgaggcagagcaaatcagcccactgcattttgaatgttgtgatgtaggaagtgcacatctcgaggcttagaaataaggtgcaagttggaaaacagatcagtccgctactttgaagttgtgtctgttagaacagaggccctgagtattaatcactttccatctacagtacgaaatgacgtgcagtcttacttccctggcctctttaagacttgtttacttatctgtcaaatgggagataataatagtacccaccaaataagatcatttgggaaattaaatggcatgatgaaaggacatataacaagtgcccagtaagttgtagctatgattatgatgttattcactctcaaatatggttctggccgttcacattcacatacacatttagagaacaatatctgaactacattttggtaaagggctttaattgttggtgcaggatgcagtataaacacctgccaaaaagatttaagactttctttgcagaaagtacccctgtgttcaaatacgcaatcattcatttgtcatttggtttgctccatggacatttatagagcacttagacatgccagatgctgtgttgggtgtgtgtggctccacctagcaggacctgtttctttctccactgtgtctccgttttcttaagtaaaatggatacaagaataacttctattacatgacatgctaaaaagtgttgagagataatggtcaaattaagcaaactgtggaatcatattcttggtatttctggctttctggtactactcaggggcagatgtacatgggcattccatttccttgcccattacacttacgtagtaccctcatcactataggtaatttttttcaggaaagcgtgcaccctgttttggcttgctcaacagcaatgttagatatctcagaagtggtttaatccttccagcaccaaatggtccaaattgacttagcatgctttgctgcagtggttgacrtgtgctcttttgacagccactgtctggtggacttattatacttatacacatcaaagatggaaaaggcatgtgactcagctgcatgagctcagggacctgatcatgctgcatgagcttctgtatcagtcagagcagctccttctgatggggagcctaagagtggacagtcctttttagcatcaatcctggctactcagtgcttatggttctgtccctcaggcttttgtcattgcgatcacctccgactttatcccccgcctggtgtaccagtactcctacagtcacaatgggactctgcacggctttgtcaaccacaccctctcctttttcaacgtcagccagctgaaggaggggacgcagccagaaaactcacagtttgaccaggaggttcagttctgcaggtaaagtaatcttcaggagaagggcagcagaggaccagaagcaatagatccaaataattacggggacgacctagaattacaaccctgcacaacatgatgatgttttggacaacagcagaccacatatatggcgattgtcccgtaagattataataccatatttttaccatacatcttctgtatttagatatatttaggtacacaaatacttaccactatattactgcctacagtattcagtacagtaatatgccgtacaagtttgtagcctgggagcaatagactatactttatagcctaggtgtgaygtaggctatatagcatctagatttgtataagcacgttctgtgatgtttgcaaagtcacctaatgatgcatgtctcagaacatatccccatcgttaagcaacacacgactgtacatcattctcctttccctctgtctcctgctctctctgcagttgttataaatcaattgttataaatcagctttgatgactcaaaaaatatttatggactgcctttttctagacactatggagcagacaaagagccttgtcctcaccatcaagggggctatggtctggttgagaagaaaataagcagaacagataggaaatagcaggttatttggtgagcttatgtatggaccatgagcattgtgggtgctcagaggagarggagattacttgagggactagaatggaaagggtgggcctcctggaggggcagctaggtgttgtaagagagaaaagaaaaacattctaggtggggagtcgtcatgggcaaagtcatggggtggggacaaatgtgggctgttggataaagacttggtgctaggtgatatggttagcaaggagacacagtaaagggattaataaaggaaatacagtaaatgtagaaactcctacaccagcataagccaaaaggttgttgaatttgaagagatgggataaagtacataatgggaagtcctgaaatctaacgggaattagaatgtgatgcaataggaagacactggacttttttagtgtcagggaatgataggataaagggaaggtttagagaaattgatctgttctcagtgaggacaatgggctagagttggtaggacccagggagcgcagctgggctgctgcatcatttagacatgaactgtgctgggcataaaccagggtggcgggaggaattaagaggagaggagaagatgagctatttcacatgaaatattgcagagttggtgacagtagacataggagagtggctgagctaggattatctccaaagcttggactgaagtcagaggactgggatgtggttacattgatagggagagggaatatgctgagagagtctaattttatgctacatatgatgaatttgatttcaatcatgttacatttaaaacgatgttaagaaatccaagaggtcattttcacccaactccttgacacactaagctggacttctggagacgtccaacttagagtcctgattgaaggccatcagcactggggtcactgaagccaagaaatggaaaactctccactatttacccaagaagggcaaatgaagagaataagagcagaggggaataatttattcaacccatttgtaccctggttaaaagatagtcccaataaagcacttgaccaaagatcctacctcatatatataaatcagaatagttaattacaccaataacaaaaacctaagagaaggtattgtgggaccaacatagggctttcttagaccatccccaataatatttgatgtaaaagctgtgttttcagttgtgttggcagcagtgatgaccctgggcatgtctgccatgcttggtgcccaaggccagcctttcgtaagacagccacataggttcagatttgtggtctgagaccatgaacgagagaacaccaattggttttcccaacctgggtggctgagttaaacaactgtaccaatctatggtttaaatagaagggtattccagttccaggaacaacaacttcagggttccactgtcgtcaaccaagaaaagataaaaaatgaggaaccagacacaagaattgatgaataaatttactcataagtgtcaatttatattagcctagatgtttcaggatttttcgcatctgggcctataaagagtctgactctcatactaaaatcacattgcaggcagatttgctgccaggctatgcactgcctgggggcccctctgcatggctgacatgctagactgtctgtccatggtgctggacttgggtctgcagaccccagcgacatagttccacagcacagagggtctggaccagctcgaggcctttccagtagcatctaggtcttctcaaagcagggtctaaagctcacatctctctaagagcgcaggtctccacctccrtgtccaatgggaggcagcaccagtgtgacttgtcgtgtgggaaagccaggctcacatcgtctgtttctttagttgctctagaagcacttgtcctcagagcacaagggtctctgatcttgcccttgaccattggattttccactaacacctatgaatatgcttttcaggtatatcactggtgaaacaggcttaaatcaataggaattttaatggtccctatgggaagttgaaggtagatctaatcttaggcaagttttcattcaatccagtctgcccaaatccagtctctgcccacctcccagttccactgcagtcaatgttgactgtgtttttaagttccgtatgattgccaggaactgtggtgagaaataaggcaaatgggtgctactcagccaaaacaaccaatgcccaggacaccaggtattgtgaatatrtgtggatcagattgagctttcttgtatctgccttcagagtcactggattttccggccagctataaggctctgatagttgtctccccattattcccatgcaagtagataagatcatggcttgtttgtggcccgttttagaaaaaaatctgacaccgagtggcagaattatcagtgggcacatgcatagaaagtgcactttcattctatatttctgccaaraaaatttatttgcagaaaataaatcatcccaagatcaagctgaagtgactttgaagcatccatcatttttccttcctctctcagtaccagtgaggattacagattcattaggcaaatatttttgagaccctactaaaggcttggcattggttgtataatagggagcgagatatagtgcatccctcaagaactctagatggagcagacaataagtaaacaaggaattaaaattaaaatacagctttaatgattgacaatagggcaacagcagagagctaagggatccctaaggagggaggccctgcacctaacacagacttaagtgtttaggggattttcaagggagatgaaacctgaagaatgaacagtacaagaatggccatggagacaatcacattgaaactcctcactcatgtggccatgtcagcctggctggtaagtggggtggggagggtggtaggtcatggggcagcaaggggtgtgtcaggtagtgatggaggttccgagagaacactgtattccagggagacaggctcaggtgagaggggtaagctatgagagaggaggctgaaagaaaaaaacaaactccatattaaggagaggatgctggtcctgttgaggtgcgtggagtctctcttagggccacagggtaccactgtaggggtttcagagggcagtgatgagatcaagctttttattggtgttacatctctgcctacagtgtgaagactattgggttacactgagggttatgtttaacataaagagatgccctactgtgaaatgtaggtagatgttcagaaaataaggtcagcatgtgatctagacataatatgtcaaataggtgtgctctgggggctgcgtttcctagattgataagggttgttgatggaaatctctgcctcatatgagtcctatccactgcctgctgtgtgaacttgactgggtcactcaattctctggagatttagaaagcagaggcataacctctatggatgtctttctaagtcaggaattgagatycttgagataattccgtatacatatatgtgtacatggaagagagagagagagagagaagaaagagagaggggaggaggaggagaagggactatgatagagaagtattttgagaaacagagataactcttcagctagtcctagagccagttaaaactgcttccgtggtgggaaacaaggtttgccatgattttctggcaaatagcgttgggaacttgttgacccttcttattcttagctttcagtgacctctggagataaatgtggtcaaataaaactgaggtctccgactccaacccagcctcgccagggatagaggtatcttaaaaatagcaataaaagttagcacaagtctccggctgcccgtttgagatgcattcccagcattttggagcgatgcttgcctctgtcatctgactgctctggcagggctgctccgtaaacagtccygtgacatcaatctgcaggcatgattagcagcatttgacagggtcgaagggccgccacgtcctggaggacggatgtaggcttgacttcccagctcagctggaagggagcatagatatcttgtctcagagctcgaagagcctacctgggcattgtcaacccagcgggtctgcttggaggtgtttgttgagcatccagcagcagcttctgtggatggcttctgccaggttttcctgcaggtcctaagggcttgcacaccccgtatcctgacaaaagtctttgaagaggggtgctcccttccagcccatggctgcctcccatctgcttcccaccgaaaccagaggctgttagcttttctgggtgccacatttcctgattcttatcaaccactggattgacatgctactcattagttcctaattgcctgtactgttttcctttgttaagggtcaattccaggaggcagttttaagtagctcagatggtatgaaaatattgtatgtagttgtgttcagcattaacatgacattaatttccactggggctactaaaatgttttttacatgccactatttggagttgagaaatgcatttactagctgattcattacataacaaaagctcattaaaaagctgttactgatcgttgacttcagcactgtccctgcccacagtgattttgtgttgtgatgaattgtggcagatgtcactgtcactagtcaccctgcaagtgaggacaggatgaggacatctgagccctgagtctctctcctctctgtacctcagttttttcatctgtaaaaatggagactttggaataaaaaatcttcaaagattcttttcttttttttttttaaacttcaggtttaatgrcatgtcatttattaatctagttctacaaaaattctaaacattacaggtaaccactccacctctgttttgcctccaccctaacccctgcccaaccccaggcatccttccaacagtaatagggtgatacttacgggtgaatgttytctaggcatttttctatgcattaacatagtattaacttgtaggacttttaaggtattgtttcatgggtttgttttataatgaaatatattttgagttaatggaaatcttatttaagtcatgtacaaactcaattcaatcaatgtgagttttcacaaagttagaacaatctagataaaatattaacataattttaaagctaaaacataatgttgatttctgtatcactttcatttattatatgagtctgttcaaattaacataattttgctcaggaaagcttactataaaaatgtacttgaatcaactgtgtattgccattaattacattcatcttttaccattttgaactttttaattgtaaaagtaattaatttcatagacacatattgtgtatgtatataagaagaaaagtgtcacttctcagcccccaccccagctgttctatcccagaagaaactgttgtgttcattttctgcaaaagctccggaaatcatattcacctagattgtcttatttaattctcacagtgtctttctttaaaatgcaaggtatacacacaagcagacacacacgcacacacatctattattcactcctggctgggattgagacagctcctctatgctcagcgctgggatacacattttgggagttccactctgtagatcagggacctaggttcggaaatggggaatgacttcctcggtctcttacaggtagtaagtggcrtagctgctccaggtgcagactagctttttagacaggctagttgtctcattattggaagtctctccttattagaaaactcaggggaactctcaaaatttatgttatttaagcctcaaggaaaatgaaggaggactggaggggtgagggtgagatccaggaacatccctaaaataatatgctggggataaaactctgcttctctttgggggccacggctggcagctgcaggaggctgaccagttgtgggggctcacccagtgctggggaactcagtgggactttgggaggcccgagctccccaagccatgggaacgggtctgttgtggagctgtctggcagcctccacccaccagccagcacttgcccatttcatgctatttacctggacagaggtcctgagagaagccctgtatggctgtgcccttggctgactcctgatttgcactaaaacttgcagcatttagtgcttacatgttcaaaaatccttctggaaagctaggaggaactggaagccgtgrtctacatgctctgtcctcttttaacagaaaaggtgtattccataagtaacctccagtaaaaagagaaagaatagttgctatttattgggttcctctgatgggccagatagtgtgcggagcactcggcgttgaccctccgtcttcagaacaactctgtgatggaaagttcaggcccactttatagatgagaaagctgggcatcagaaggttaggtaacttgcaagaggacagagaacgacagtgctggacagggctttcaacccctcacctgctacctccaaagcacgaactgtcgccagtgctaagcactgggtttagaaacaaaacacgcagcatcacggtggtggaaattattcggttgattagccactctctttggtgaacacttctattcttaaagctaattgtctctttgtttaattagtgtcttctaagttactcagtgaaacatttgataagcccgacttcttagggtaaaatttaaaaacaattgtgaaatctgaacttactgttggaatgtaaacaacgagtcatttacctggtggtaggggcttaggagaatcaaggtttttcaaactatgagtcatggttcattagtgaattatgaaatcactttagtgggtcatgatcggcattttgaagaatagggtgggttggccagcacgggcggatcaggaggtcaggagatcgagaccatcttggctaacacagtgaaaccacgtctctactaaaaatacaaaaaattagccgggtgtggtggcgggcgcctgtagtcccagctgagggactgaggctgaggcaggagaatggcgtgaacctgggaggcggaggttgcagtgagccgagatcacgttcctgcactccagcctgggcgacagagcgagactccatctcaaaaaaaaaaaaaaaaaaaaagcatagggtgggttaggatcagatagagtagaataggaaaatactagtgcattctagtgcattgcacacaacaaagtatgttttgtgtaatttttattgcagtctgtgtatgtgcatgaatgtaaaatgtatttctcactgtaggtcatagtttttataaagttagctttggaaagaaatgtgaacagatgaatattaaattgctcactgttcttttctgtggcatggcttaccatcagttcctaacggagctacacttagcctatctgcatcgagctattttcaagtagagttttctgaacagatctctgtgttagtctttctgmagatcctcaattagatggatatgcttgttaaacttaaaacatgttttagacactgagggagracaaagtgacatttccaaaagctggggtgagttaatagcagaggtggaaccagaattagattatttatggattcttttcagactggaaaaaagaggggtgagcagtggctcgcatmccgaggtcagtgagcagctgttcctgcagagatgcagctagagaacaagagaaatggactttcattgtagcagtagggattgggctgaacccagggaaggatttccccatggtaaggagtgtgcgtgtgtgcacacatgtgagtgtgtgtatgtgtgtgtggcacccttctctggaggtctctagaagagtgagataaattgctgttgccatggcgtcctgtctgggggcgacgggaggataggtgagtctgaggtttttcccaccccaagatgttcttattcatttagccacgctctccctctctgccatcagcaaggataatctggagctggccatgtttctgtcctcagctgaggacggttatgatgaatcccgtggtgctctgctgggctgcagttagctttgcttttcatccggatgtcaaaccaagcttgcggcagctgtgatcagctgttgggagagggggagtcgggcagggagagggtagctcctggcctcctgccaagccctagtcgagtccccagtgtccacctctcagttgtgtctttctgttgctgattctatcactgcgctcttttttatctttgtgtgtgcgtctctttttctcttcctctttttctcttctcttcttctctcatctctctttggacaatggaaaacaaactagcttttgcatggaccttttagagcagctaattcatttatggcaggagaagggaccaaagagcacctacttgtgaatgtcccctaaactgcrgtcactggtaagatgccctgtgataatgggaagaaagcctagattcagccagactcgcattcctaccctgactccacctttactggtcacgagactctggccacacacttcaacttctccaagcctcagtttcctcctgtgttatgctggggtaacaatgcctgcctgaggatgttgtcgtgaagatgaaatgtgaaaccttccagaaaaaccctttgctcagggattgacccgggcagagtccctacctgccttccttggcagccactatcattgcttggtggcctgacaccacccacctctttctctggcccaggatgagcaaagatttgttgaattccatggagaaaactgttccaggaagggtcatagttctggtaccagccccttgtcatttttccaggcttagaaaaatgtgagtctgagaaaatgagctagtattcacatgaatcattctgggatgggggtgaaaaggcaagggtgagggaaaacccaaggcttctctatgggtctgagaaagaggcatgagctcacgtcaggcattaacattttgtagtttaaaccatgcagacagatcaggaagatgattagcaaaacagaatactgatcaactgtgatgcttaatgaccctcccatcccaaattcactcagcctccagcttggtctggatcagccttctttttggttcaagaatgcagccatgaagcaaggccagcccctctagtggccgtagtcctgaagcatctggaaggggaagaascccaagactgcctgctggtgtctgcatcttccccaacccccccggctgcagagcaccattcagggtgtctgggtctcccctacccacacagaggccacaggctagtgggaggcccaggtggacccactggcctggactaccctcagatgccctgggctcctttgggagttgatgcctgacaccaaagtaagctttgggagctattggagagggtagtagaaatgtctttttaggacatttctaggctgacattggctttcttggactttagtcctttttggaaatttgttggttaggccatagattccccccacttccccctgcttctcaagtcaatgccaagggcatgcgtgcctgatgctccagccagccctcgaggtttcacccagagaatgaccacccttttctccatgcgctcctgatcttaacaccacatttctctttgggcaggtttaaggattaccgagagccgccatgggccccgaacccttatgagttttcgaaacagtactggtttattctgtcygcccgtctggcttttgtcataatcttccaggtgagttgctgggatagggaatagcccattygaatccgggctgcaggagtaaggacactgcactcattgcttgcacctacctccaggttccggtggtactctgtgacataagaaagcttcatgtgtggcaggcagaagtgagggctcctttccgggttgaagcaggaggactcttgagagggctttctttaatgggtggactttgcagacagaggataaaacacagtgtaaggttacaagacagatgtggaataagttgcagggtggagatagattcctgtttaaacctaaggcaaagaaaggaaaagggccattgaaaccagagtcccagcctggggcagacaaacagccccatctcatctctgcagccatgaaagagctcaggtttggaacctttcttcttgcactctgggctccctcctttgttagtgttgttttagccactgagacatctggtgagaagggcccccagagccatcgagccatccctgaatgaatagcaaactcgagcccagtgattcctatctgggacaatagccacagctccaattgcatcgctgagattctctgagctcgagggcccccaattcccactctgggtgcccccggtcttcaagcagggctggagaacgagcccagatccttttctctttggctccctcaggcttttgtattccctgaaggcagatctctggggggctctaaagtatcctgcccccagaccccagcccagaaagtggagaagcccatcggctagtctttcacctaaagaagacagccattcttcctctggagagatggaggcgatatgtttgaatgatcgctcagacatcccctgctgccccacccccaggagtctcctcactttcccgtatgtcacatgtcacatttcactcayacaggaaggagtggattcagaggaagagtgtgtgacttggtgaagcagctcccaagcacccaagatgcccaggagcctctggaagcagcagttggtccccagtgtcttcccctgaacccctaggaacatgtagggttcaagggctcagtcccagtctcagaggggaaaaggcatgtgagcgtgcaactggcagccagggaagtgtatcacaatgggaggagtgtgttgggtaaagctgggtgaagtgtggcctggggaaatggatgggaatcagatgcattcattgagccatgccaggcattgttgtcctatattcattcattgagacagtaagtgctctggggaaaaggtagtcctagcctactgtgtgcaccagcaaagggatgtggcttagcagcyaggaggaagtccactgcaagtgtgtgccaaagcctagacccaatcggggcaagctggatgcaggggttcccagacaggcagggttagccgaggtggctgcagtgactgagaccggtataaggtgaatgtcagcagtgggttgggtcagtgaaggcccgaagtcaaggcaaaaacctcaagtccgtctctagtgtagaggatagagagagccagatggagggaggagaggaacaagtggcaccgtgacagcccaggagaagccactgggctttgtgaccacttgctagaaagccactttccattttctaaagcagggagggcctggaggcttagaggccaagaagcaagaactggacacatgggaacactctgaagatggtgtgggggcacaagtcctggggaaggggagaagcagtaactactactgatggagtcctgctctgtgccaggcactgcggcagatgctccacatgtatgaacccgtttcatcctgacaaccactccagggtaggcagtgtttccgctccattttatgggtgaggacaccaaggtagagttatgctcactggttgcgatcactgggctggtaagttgcaaagccaggattgacacagaggcattctgctccagggccgccacctccccaggccgggcctctccaactcagcccctctctccttggctttttgcagaacctcgtgatgttcctgagcgtcctcgtggactggatgattccagacatccccacggacatcagcgaccagatcaagaaagagaagagcttattagtggatttcttcctgaaagaggagcatgagaagctcaagctgatggatgagccggctctgaggagcccaggaggtggggatcgaagcaggagccgggcagccagctcagcaccttcaggccaaagccagctgggcagcatgatgtcgtcaggctctcagcacaccaatgtgtgagcagttcagcctgcagcagaggagggcacggcagcagagacacgcacatgcacgtaagcatgttcctacacccacatggcgtgctgtctgtctgcaggggcctggcttgatggggtcttgaagagggggcagtgtgtaaaaagaaagagcctgacagaatgagtgtaggaaggaagagaaatgatgctacatctcagaaacttcaagcttaagtttcttttaggtccccttttaagctgcatccttttgagggattggaaccccactggggtctctccaccccagagtctcaggcaccgcgagcattcccatgtaccctggggcaccctcttgtacttcaccatcatttctgactttgaccagctgtaagagaaatgcagtcaggagcacagcatcccctacttactatcactacaagaaaactgagtcacttgcagtggggctgccacagtctcagcagatgcaaattaagttacaaggctgaatggtgcagccgctggacctgatagtaaggtgcaaaggtccaaacctgggcttgtctccacttcacgtcacaaaaacgtttggagctaaatgcagataaccatcattttatgaaagttcagatttaaaataataaaataaatggacacattctttataaagatgcatctgttgtctttggtgccttgtctctctctcctttcctttcttttcctctcctctcctctcctctcctctcctctcctctcctctcgtctcctctcctctcgtctcctctcctctcctctcctctcctctcctctcctctcctctcctctcctttcctttcctatttattgagcttctactatgtgccaggcattgttctcagactggagatagagcagaagataaaggagacaaaatccctgcctcatgaagcttacatcccggggaaagacagatgataagctaaatgtacagtgttttggatagtaataagtgccgtggagaaatattaggtaagacaagtagacaggaagtgtgaaggcacaggaggtaaggggtttaccattctaaatacaaattaatgacaaaccccgatggtgaagaggttacatcttgcaatactaacataatcaattggtagcagcttcccagagtgctgtgctgagatcatgttgtaaagttggaagcacgggccaaacatcactcatcattgccgttcatacacctcaggcccacctgctgcccagaaatctgttgcacaatcacttcatcctggttccttgcaggtcagcgggactagagtccaacgaaatgtctgagtggaagttgcaggggggatggtactccagaggaaaaatgagagctatggttctgctgtttgagcacacctggcaatgtgcgggcctgtaggtgctggctggtcaccagtgctgcccaccacctttctgatttcctcctaggaacatgcagaattgcactgactgccaaacctcgctcaggaaagcggcttcttcttttgtgggactaataggacatagatacagctcttagtgagagcggtaggctaacgtgtaccaggccactcctgtacaggaaatcttacaaccagttttaatttcctcagatttttttttttaagacggagtttcactcttcttgcccaggctggagcacaacggtgcaatctcggctcaccacaacctccgcctcccaggttcaagcgattctcctgcctcagcctcctgagtagctgggattacaggcatgcgccaccatgcctggttaattttgtatttttagtagagacggggtttctccatgttagtcaggctggtctcgaactcctgacctcaggtgatctgaccgccttggcctcccaaagtgctgggattacaggtgtgagccaccgtatccggcctctcacatcttaatatgcaaacttaccacttgagctgaggttcaaactacagcagtatggaacactgcatcatttgacaataggctttacctgatttggggagagtgcggtgaccagtgggaggaagttgtaattgcaaggagcattgatgacacggagattccaggcctatcaaaggaagcaatccccagggatgactgccagtgtgggtggtgttgacatttgcaggaagcagtgacagtccatggtcaaggttgagggctgcctccaccgccaagacacccacttggctccaactgtgctatctccaggcccactggctgctcatggctggttcaggacccacttgtttttcttcctcttttttaaattaaaagaaacatttttgtatcatcataaaggttaagctcgcataccaagaaatgttcggatagtccaacaaacaatgaagcaaataaaatcacccacaatccccaaatctataattggcattggcacttgctgtgtcttggagactctcattcccccctcacacacatctaatttcttttaaccacagttatgctattttaaagcagaaaagtatctgagacaagtctcaatcaatttggaagtttattttgccaaggtgaaggacatccccagaaggaaagaacacggaatcacagaaggtctgtggtctgtgcctttttctgaagatgatgttgagggcttcaatatttaaaggtaaaaagtgggctgagggtgggtaagagggagggtgtgatcttgttactgaatccacatgttacaagagaaaaggagcaggtaggagaacagctgattttgtgtttttctggtgctcagtaaatcagcattttacataagataaggtgaacgtagagtagcttcctgtggagctatctagacttttctgtgtagctgtctgcttaggagcaaaaggaaaggcagtttcttgcatgactcagctttcagcttcattttttccttttggcagattgctttggggtcctgagtttttatcttcctttcatgctatatgtgctgtcttttcatcttttttcactacatgtgtctcatcagtccttttattccaataaacatagattcattcaaaagtgtgtactgaggccgggcgcggtaatccctcaggccgggcgcctgtaatcccagcactttgggaggccgaggcgggtggatcacgaggtcaagagatcgagaccatcctggctaacacagtgaaaccccgtctctactaaaaatacaaaaaattagccagatgtggtggcgggcgcctgtagtcccagctactggggaggctgaggcaggagaatggcgtgaacccgggaggtggagcttgcagtgagccgatcgcgccactgcactccagcctgggggacagagcgagattctgtctcaaaaaaaaaaaaaaaaaaaagtgtgtactgagcttctactatgtgtcagcctctgtgaggtgctttggatacatcaccccacagaacacagattcctgccctcaggagcttatgctctgtgtgtgggtcagagaggcagagcaacagtgagagcaaactactagtatacagtgggtcagaaggtgatctctgctgtgcaaaaggaaaaagaagagcaaggtaagcgtgctgggagtgagggtacaggctctctggctgccacctccaggaacctccaagtgttcagctatctggcagctgtggaacccagtcatttttggtttttatggaagcttcatcagtaggcaggattggttaaatcactggccgtccttgaacaacttaacctacagcccctctcccctctccacatgttgggggtgggactgaaagtctcaaccctctaatgctgcctccgtctttctggtgaccagccccatcctgaagctacccagggtctgccagccatcaactcattagcatacgaaatgacacttcactttgggattccactgattttaggagttatatgtcaagaaacaaggatgaagtccaaatgtgtacttcactatatcacagaccatagacagatttatgctcgggagggattcaactttcttccccttttccactagaaggaatataggaattttataatttgcccccatccccaggcccaaagtctcagtagcactcatgttactagccagaccaccagatgtgcttgcttcaccccagcagcggtagaggtttaggctaagtaaagagaactttccaacggacttgctaacctgggtgaagacatggtaggtgcactttcaatttaaaaataaagcaaacaatgaagactccttccctgagctctttaaggaaataatgaacattttttattccattgtgacatgccaaaaaaaaaaaattgtgagcaaaaatctgaaacactgaagaaagaaaaagaaattgctcattatccaattcctcctttctagaaataatagtagttaataattcagtttaattgtgatcctatggtatatgtacaataacattcattgatttgtaatagcatttatttggtttaattataaaagtgatccatgctcattgaagaagacttagaaaatgcaagaaataaaatgtcaagtaaaaagtttaaattacctgaatttttacctccaagaactaatttgcaatcagtcttttttcccattcacttattttcatgtacaattgcaatcactccacacacactaacttctagactttgttaacagagacatctaccagccccaggtagacgctgttatgaagggttgtctgtcactgagtggtttcgccattcttttcttatgaaaaacaaaaataaatgaaatcaacttgatggttgattcagataaataatcttaaggctattttctttatgtgctctttgtgcaaaagaatagtataaagtaagagatgagacgttccttcacgtgctctccttcacagcccttccagatccaaagggtctactacatcccacttgtgatgatggaattattctatcctcaagaaagcttttaaagatggagaaaattgccactacatctctgctcaatgaaatggcctaattttgcttttcagtaagagaaataggattcttttgttttgctaatcctcccagcacaatattctaaccttgcaggtagattagtcattgttaagaaaaatagaaagggaatgtgccagttgctcttctgagtggtcataaattgtggtaggacattctgatagatgcaggaggaagataagggggacggtccccggagaatcttccaccagcctgcactgggaggagggggtagagactcgggaagtttgagcagtttgcagaggggaggagcctagcctctccagtgcctgggtggtgacctgggattcaatctgtgagatgggggtctgttaacaggaactcctctcactttgctgagagattctttccttttcacccaataaaccctgccctactcaccctacaatgtgtccatgtgcctaaattatcccgggcatgtgacaagaacccgttgtttttttctacaattccagcaggctgtggaaagcatttcctggagcaaggaaaagaatgagatgggaaaccaagggacgaatctttgccccatagcttatttgaaatatatagccatgcagggtttgtggttaaaaatgaattaggaaaactctttgctctttttatattgtcatttccgtcccttggttcacctgactacaccttcaggttgaaaaaaaattaacaaggtcgtgttaaagttgccaccaaagtccctcaggacttaggtgttcattcctcagctggtgatggtcacaggtgggtcactctggaattgcctcagctgtaagggaactgcccaggccatggtcactgtcccactctggggcagcccacatccagtgactcatcactgcaggggggtaaggcccaccttgccttgattccaactctaaatgctactccagctccagagctttctgtgggattggctgaggcctctgttgcaacatattgcagttcgacttctccctccgcctaattctgcttccctcactaagcagatgccccaggaatctctagcacgcaaggtctgcaggtcttagactctgctttccagagaaactgacctaagacatggggtatttgggtggtatattctctgagcatatacatctctgaaattgcttttatgttggaacaatgacttggctggatttaccattctcagatcaccattcttcctttcaaaatattgtggctatggcgattaatccacactcttctagggtttcagaggaacagcctctggaagaagcctgattgatatgcttttgtaagcctttttcccctactgctttggtgctagcagggttttgaaatttattcttgtaactcaaaaatttcactgggatgtgtctccatgtgcgtttcttttatttaatgtggcctaaaatgtaatgatcatatttggtctgcacagttacttacttttcatctctgaaaagtattcttccagcacaggaacggatctcagcatatctattctgactgtttcggttgctttgggaaaacactccagttttagcttggttctccagtttttaatcttcagtccaccatcttctttctcaacatgtgatgtccttgtcccattcccctatacttcagaagcacactcctcccagtgttactcttttctctgtccccttcccctgaatcaatctatcctccccactatgtttttcaagc

SEQ ID NO: 17953 - DNA, 43159 bp, Homo sapiens
tctcctgaccttgtgatccacccacctcggcctcccaaagtgctgggattacaggcgtgagccactgcgcccggccacattcagttcttatcaaagaaataacccagacttaatcttgaatgatacgattatgcccaatattaagtaaaaaatataagaaaaggttatcttaaatagatcttaggcaaaataccagctgatgaaggcatctgatgccttcatctgttcagtcatctccaaaaacagtaaaaataaccactttttgttgggcaatatgaaatttttaaaggagtagaataccaaatgatagaaacagactgcctgaattgagaattttgattttttaaagtgtgtttctttctaaattgctgttccttaatttgattaatttaattcatgtattatgattaaatctgaggcagatgagcttacaagtattgaaataattactaattaatcacaaatgtgaagttatgcatgatgtaaaaaatacaaacattctaattaaaggctttgcaacacatgccttgtctgtttttatttagactcctatagtgtctctgaagaaaagaatacagatatttgaaaaaatatgatttggtgctcttaatatctcttatatcgtcacttacctcacttaaatagtcagatattgctggagaaaaattcacaagcatgctgacaggtctcactttaaattcataaccataaatctcaaatgagccctcaagtctgcctgaccattttagttacttctctacaatccttccatttttatgtccctagtctccaaaatgactgttactattttacttttcctcttctctcttcaaagcctcaagacacacattcagcctcctcctctgcccccttatcctccaccctcctctgctctcagcagataacctggcctcatattacacttctaaaacaaaagcaacttcataccaagctttcccttctacatcccaaagcagcagtcataccttcccacaggcccatccttccttccttccctcctattatcaggatgaagagcctctgctcctgccaacagcactgactccacatgcagtttccctcccatccctctcactactccaagtcaggctgtttcctgcatccctagtttgtcccttttagctggatcacctccatcattctacagtctgccctagtaaccttccatcttacaacaaatactccactgaccctacataatcctccaactgcaactccattctctgctccctttacagcaagacttctggggaagtatgtctgtacttaccaactccatgacctcacctcccagtgtcttttcaaccctctctaatctggcttctatcctcacccagctgaaactgctcctccaggatttctcccatgattcctcagtgctaattccagtgatcatcttgttcatctcagcagcatttgacaaagtgaaccgcttcatacttttagcagttttttaatcccttggcttttccttatttacatcctacctcactgactgttctttctcagtccttcttgctcactctttctctgctatttaatttctaaatgtgagagtgcctcagggctcaagtctataataattttatatactacatattttacttatttgtctcttctcaccaaaatataacttccaaaatgacagaggtttttccactttttaaaaaaacattgaaataaactcaatcttttaaaaaatataaaagtactgtacaaagatcttttatttttcagaactgttttgagagtaaatagccaacatgatacccaatggccctgattacatcagtgtgtaattcctataaagacattctcctgcataaaacctcaaaacaattatccaaattaggaaattaacactgatacattactaccacctagtcatcagattccactcaatttcatcgattgtcccaataagaccttcataacaaaagcatctaattcagaatcatattgtatttggttgtcatgttttttaagtctctttgaatctggattatttcctcagttgtttctttctggactttttatgaccttgccacttttgaagaccacagactagttatgttatagaatgtacctaaggtttttctggtgttctctcgattccattaagttatgcatctttggtaggaataccacagaagtgatgttctcactgcatcctttcaggtggcattcagtttttgcagttttgatttgccccattattgatgatgttcacttggatcacttgattaaggtgaggcctgcaagccatcttcactgtaaagtatttggggaggaggtgccttgagactactgctcatcaaattttcagtttgtttgtttatttatttagaggcaggatttcactctgtcgcctaggctggagtgcagtggcgcgatctcagctcactgcaacctctgcctcccaggctcatgcaatcctcccgcgtcagcctcctgagtagctgggactactcgcacgcgttaccatgcctggctaatttttgtatttttagtagagatggggttttgccatgttgcccaggcttgtctggaactcctgagctcaagcaatctgcctgccttggcctcccaggtgctggattacaggtgtgaaccaccgtgcctggtcatgcatttatttattatatcagtatggacccatggcttctattttattcaaatcataaggagttatagtccattactattatttattttgatgttcacactgtcctcgatttggccagtgagcccctgcaagttgtcttctgtgccatttcgacatatttccatcattcttcaagcactttcttgttttctggcacaagatattctaaggctcaccttgttccttccttgcttccaaaaatggaaaaggcatttctccaaggagccctgattcctcaaagtgcataatagtattaaaaaaacaggatctgggcactagggtatcactgtttccaggccctatcagtgaacagagctggaagatatatgtatttacactatatttatctctatatctatctatttatattgaaaatcatgaatccacaccaatatctccaattctaatctcacaccacaggattcactctagttttcttctttcgcatgttttaactctcttctctgacagtaagtaacttagcatccattatactcattatccttaaaatgtatccttagtacatttacgtatttgatgggtttgcctgtatgtaaccaattccccaactctgcccaagtgctctccactcaggctctgacatccctcagtgggttgcttccttccccaacacctggacaccctccttaccatgatacatctctgattttataatatgctgaaccactgtcctgataggaagaatagaaatttttcactcattccacttctgtattctaaacacctagaagagtgactggaacatggtacatgctcaatcaatatcagttgatcgaataaatctcttgctgattatttagtatgttccctccaaactgaacattctaagctttttgtttttgagacggagtctcgctctgtcacccaggctggactgcagtggcgcgatctcagctcactgcaacgtccgcctcctgggttcaagcgattctcctgcctcagcctcccgagtagttgggactacaggtactcgccaccacgcctagctcatttttgtatttttagtagagagggggtttcaccatgtcaggagatcgatctcctgacctcgtaatccgcccgccttggcctcccaaagtgctgggattacaggcgcgagccaccgcgcccagcctttttttttttttttttttttttttaattaactcttcaaggccacatgattccagtacaaccgcttgcggggttccaagccacttcttggctatgtaaatgcagcacatagactagccatgtgagggcagcagagggccactacataggtgcaacctttggcttcaaaattcttggaccattctgacgtgattaaactaaaaacgaatgagtttatgcatatcgagataccctgaggtgtacaaaggatgagtcaaggtagcggagagagagttgaagagtgacagctgagaaacagagataggacatgtccaagaagtgccaggataacccaacaacacaggctgattgaggaaactgccagagattagacaaagtagactgaagagggaaagcaatgtttgttggagattttgctttagtttttgataaatatttcttagtcataccaattgttttaaatataattacgcccccaaaccaaatttctactcttattctggcaacagaataaaaatcaatatcaatgtttgatcattttcaaagaaactcagttcctatcttggttgaaatgcagtgacatccatatgacaattgagctcttcatgtggcactaatataactaagccctgagcacatcccttgcacttctatttagtgaagtcttttaaaaagtattttctttacagttgttaagtggaattactaaaaattacaatcagcagtattttctactcttttagcttattttttaaaatatttatctccatgcttttcaatattacacctatattgcttcttcttgatttttccattttaagatactgacttcctactatggaagttaaagattaagctctatttcctcctcctccatccccatcaagcatagtacccttctccaaagcccatccttctaaatgtaattctttttttgagggggaggggggatcaatactcagtttttttttgttttgttttttttttttttttgagacggagtcttgctctgtcacccaggctggagtgcagtggtgcgatctcggctcaaggcaagctccgcctcccgggttcacgccattcttctgcctcagcctcccaagcagctgggactacaggcgcccaccaccacgctcggctaatttttttgtatttttagtagagacgggttttcaccgtgttagccaggatggtctcgatctcctgacctcgtgatccgcccaccttggcctcccaaagtgctgggattacaggcgtgagccaccgcgcccggccaatactcagtatttatgtaacaataaatacaattactttcctttcttgcacaagattttgttttccctagaattaatagctgcataattcttacagccgcttagttttctgtgtacctgtcatgagttaaactccaaactctcggtcaaatctcctcttgattcaacgccagctggaattttgtcaatcccatccttctgaagcagtgtctcccaaagatttctgaccgaatctaatctagatgcgttgccgtctatgcctatacacagctattgttcccggagctctttcagtatcatcttgggatcttactattttctgtgtttgttatttattgtatttcctgcatttcataatttcctccttcttggcttattccctcattttggtggatcagatctacaggatcttcctggaggtactgagaaaggtaagataggtactattttttgtgtgtagtgatttagcacatctgaaactctattctattcacacactagattggtagttggatgagtattgaagactaaatcggaagtaattttccctcagagttttgaagacagtgccgtatggcttcctagattctaactgagcaatctgaagccactctgattctatagtctgtataacctggaagggtgtgggatctctttttcctcgatgttcagaaaattcacaatgatatgccttgacgtggatgctttaatatttgtgctgggtgcttagtaggatctttcagtgtggaaactcatctccttaacatctggacaactttctgaagtcatttattatttcctgcctttcattttttttttggtttggaactcctgaactggtcctgtgatgtgactgcagccgccaggcgcgtgcgcagtgtacactgcgtgcgcatacgcgagcccgttgcgcctgcgcgcggtgcsgccgtcgcccytcttttmgcggcgttctccacctgcgcgggcctgaatggccttcaggagcacagtcggcctgaggagttgayggttactcaccgccgtgagcccaagtaactcgccctccttcggctagaaaccctccgcctgggcccgcgcgacaggagcgcggtctctgaggggagcggcgaccccgccagccccggtctctttccctggcggcggcggcttcttccgtgggacaatatgttcaagagaatggccgaatttgggcctgactccggcgggagagtaaaggtcagtgcccggaccgcccctcttccrgggtggctctcccgccycggttcctccctgcgcggcgcggggagggcccactgggtttcctttcgcgccttttctcctcgggtttgaaccgtggtttcaggttggagagcgagtcagagccattgagcgaaaaaccggcgttcattgggccccaacttcctcgcgtcactgccaactcccayccccrccaaaaaacaaacagataaatggtggcttggggaaacccggacgtggctgccaaggaaacgggcgactccgagggctgggaaagctcagcttggtgcacattcgctgccaatctaggttattggtgaagcggtgacgccaccctcctggtgtgaggataacaataactgtarcaaacagtcgctgagcgcttacccgcagtatttccaagtgcgrtaactgagacaccgaggcatacgaaagctaagaaaatttgctggagttcatggtgttcacaaagcctcaaagcaagagcataacactgtgcctggcacatggggaacattcagyaaatgtcaacttcttttgtttttgatgaaattaccatagaccctagcgtaatgtttgacattgtaatatttatttccctcacacagcccctggcacgttaatttttttttttttttgagacgaagtgtctgtcttgttgcccaggctggagcgcaatggcacgatctcggctcactgcaacctcggcctcccaaagtgctgggattacaggcgtgagccaccgcgcccagccgtggttcattctttttaaagaaaaatttcctttcctttataaataaaaatcagaaggggtacaaatagttgtttttatcaggagccagtgggtcctgccttaaaaattaacgtgcagggccgggcaaggtggctcacgcctgtaatcccagcactttggaaggccgaggagggtggatcacctgagatcagaagttcaagaccaggctggtcaacatggtgaaaccccgtctctactaaatatacaaaaattagccgggcgtggtggcgggcacctgtaatcccagctactagaggggctgaggcaggaaaatcgcttgaacccgagaggcggaagttgcagtgagctgagatcgtgccactgcactctagcctgggcgacagagcaagacaatgtttctttaaaaaaaaaatagcaataattagtaggttttaaaatacttatgtgtgtgtgtgtgtgtgtgtgtgtgtgttttgttttgtttttttttgagacggagttttgctcttgttgcccaggctggagtgcactagcgcaatctcggctctccgcaacctccacctcctggattcaagcgattctcctgcctccaagcgattctcctgcctcagcctcctgaatagctggaattacaggcatgcgccaccatgcccagctaattttgtatttttagtagagacgggggcttctccgtgttggtcaggctggtctcgaactcccgacctcgggtgatctgcccgcctcggcctcccaaagtgctgggattacaggcgtgagccaccgtgcctggccgcttttcttcatttttattgttgttggttacattcactcagcacttttcacatgtggtaaatcttgctcattgttcttcagatacatttctgtaactgagccattggtttcagattcatgtgcaacattcaatattttcacttcaattgaaattttttatctttccaacataatctgtcaatacgcactgcctttgcacttatcagatataagaaatatgtatgttaaactaaggacaaatgtagcaaacatgtcatcagccactatttaccaagcttcagtcatccaagtgactcttggccatttttgccatgtctgaattcaactgtaatatttattgtaacatttacatttaaatcagtttattttttaaaagcctctttctaagcgttaatgttttttaaattgtagggtgtttggttgtttttttttttttttttttttggagacagaggctcgctctgttgcccaggctggagtgcaatggtatgatctcggctcactgcaacctctgcctcccaggttcaagcaattctcctgcttcagcctcccaagtagctgggattacagatgcacaccaccaagcccagctaatttttgtatttttagtagagrtggggtttcaccatcttggccaggctggtcttgaacctctgacctcaggtgatccacccaccttggtgaaattgtaggttttaatttctagttacagttattactattttttaatactgattaaacacgtaagtaaaaaagtgaaaaatgtttgacctttattctacctctcacaaattactcctaatatttatactatactttgggaaacactgccacaggctaggtgataaggacattgccacaggtgatgccagtcagaattggccatttttatttcaatgcctagctttcaggtgtttaagwaaaggccttttgcatttcttttaacaacactctaaaagcgctttacatggtaatttaaataaaagcattttcaaagagggaacattgtaattattctggcgttttttgtgttaatatgaaaggatgtgtctgaaattgatttgagagaaatccatattataagcaaactatagattgttagcctgccattctttaaagcaagttttcagagctcttattctgcatatttagctaatggtacaatattcatttattttaaaattatttttcttttagggtgttactatcgttaaaccaatagtttacggtaatgttgctcggtattttggaaagaaaagagaagaagatgggcacactcatcagtggacagtatatgtgaaaccatatagaaatgaggtaggcactcgttttttctgtaactgttttacttaaagttgtctgtaatttgttttgcttaaagacaacctgtagttttttttttttttttttttttttttttgagatggagtcttgctctgtcgcccaggctggagtgcagtggcgcgatctcagctcactgcaagctccgcctcccgggttcacgccattctcctgcctcagcctcccgagtagctgggactacaggcgcccgccaccacgcccggctaattttttgtattttttggtagagacggggtttcaccatgttagccaggatggtctcaatctcctgacctcgtgatccacccgcctcggcctcccaaagtgctgggattacaggcgtgagccaccgcgcccggccgacaacctgtaattttttatagtaactttctgattataaaattggtccgttgtaggaatgttgtcaaaaagtttttgaaaaaatagagaactgtcatcttcatatgatactagaaatcaattttccaaaaatgtttcctaattaaaattaagataacaagaactatttatgctataaatacagtacaagtacatcttcctaacatcatatctaagttaacatagtatttaatcaggagtttcaggaataagcagctaatccttaaagtaataatgtggtaataagaatgtgaaagacagctctgctgtgtcatctgattgctagtaattttgtttcactgctgaatcttcaatgcctggaacatagccagtacatagtaggcatttaacagatatttattgagtgagtaaattattcctctatttaaaacccttcagagtctacccaaaaacttgcatgtgaatattgataccagtgttattcataatagccaaaaagtggaaacaattcatttgtctatcaactgatgaatggataaataaaatgtgatatatccatacaattgaatattatcaagcaataaaaagtaaagtactgataaagtaaagatgctactacatggatgaaacttgaaagcattatgctaagtaaaagaagccaaatataaaaaaggccaaatattatatgcttttatttatatgaaatgtccagaaggggcaaatccatagacaaagaaaatagataagtggttgctagtgggtgggggagaaagggtattgaggtaagtgctaatggatatggctttcttttgtgtgataaaaatgttctaaaattgtagtgattcttatgagactctgtraatataactaaaaaccattggctaggcaaaatggctcattcctgtaatctcagcactatgggaggcccaagcgggaggatcgcttgagcccaggagtttgagaccagactggcaacatagtaagactccatctctacagaaaaaaaaggtatcattatagtaagattccagtttattttttaaataataaagttagatatgaatgtagatataagtaatttaaaaattcctaaaagtaaattaaaaagttaataaacattactattgaatgtgacttattgctttgcatttttttattcttctataatgaattatatattttaaaagccacttttgccaacagaaacccttttatttgccataactaatgaatatgcttctgtacttttaaaataaagaaaatgaggagtttttgtattcaacaatcttagattgctttaaattagttgtccttagctttatgtaatataattttttgtttgtttgagatggagtttctctcttattgccctggctggaatgcaatggtgtgatctcagcttattgcaacctccgcctcctgggtttaagtgattctcctgcctcagcctcctgagtagctgggattacaggcgccgccaccatgcttggctaattttttgtatttttagtagagatggagtttccccatgttggccaggctggtctcaaactcctgacctcaggtgatccacctgccttggcctcccaaagtgctgggattacaggcgtgagccaccgtgcccggcgtatgtgatataattttgttctttgaaattgactatagatttgccttatatttctgtaatagtaccagatatgtactgttgttttaatggaaaaaaatcaaaattgatttagaatattatctatagaggtgtattaaaacaagatttgccaaaaaaaaagttaatttgggacrtgtatttctatayattacaaatcataaaagaattcaacacaggcttcctttttgtttttttaaaaaaagcaaaataggccaggtgcggtggctcacgcctgtaattccagcacactggtagggcgaggcaggtggatcacctgaggtcaagagttcgagaccagcctggccaacatggtgaaaccccrtctctactaaaaatacaaaaaattagccaggcatggtggcagccrcctgtaatcccagctactcaggaggctgaggcaggagaattgcttgaacctgggtcagggaagttgcagtgagccaagatcatgccactgcactccagcctgggcaacaaagcgagactccatctcaggaaaaaaaaaaaaaaagcaaaataacttcccaggtgtagttcatgttttttagaaaattagattccataaaatttgaagggaagtatgttttttataaaactaagtatatacgctcagtgtattttttttcctagttttcatttgtagatcataaaactaactaattccttatattttaggatatgtcagcatatgtgaagaaaatccagtttaaattacatgaaagctatggcaatcctttaagaggtacaatatagtcttttgattcacaatatccaaagttaaaaatggctaggaaactaaaccgataatttactatttttttctgtctttagttgttactaaacctccatatgaaattactgaaacaggatggggtgaattcgaaataatcatcaaaatatttttcattgaccctaatgaaagacctgtgagtagcattaatctttgtaaatataaaatagatttcttagtaaatgtgaacatgtaataatacttaatgaatagtgttcattcagatgtgttttatgtaaatttatggcacagtktatcttgccatgagttaagtttttcatttttaaatgtagcgcctttcaaaatccttttttttttcaagtatggaaaaaaacatataatatgaacatgtattggaaagaaaccatggaaatcagatgactactgcagcaaaaaaacttaaaactattattatcattcggttattagtaataaataagttgagcccatatgctgtgtaaaatagtttttatagtttttggtagttaaaccctaagaaacagtgtttttgcttttttaagctgtcatcagtactagcgcttcattttatatcttatttatgagtctttatttttatagccactggctttttcatcttttgatctcttcttatcagattgttgcttgataatgtaaaaaaaaaatccctccaggcttttgctttgatccttcagcaactttgttaggttgtgataccctcattttagagatcaggataccaaggctcagaggtcaagtcactgctcaaaaacactcagttaattatggtagagctagtttttgaacccagatatttgcattcatacctttttctagtattttttcttttgagtaaaaccactaggcctttttttttcttaagcctgtagggtcaaaactcagtaatggctctcacattccacatatgtggctggggtttaactccagtttcaaggctttcacattcatcaccattttatcttgttagaatcacatcagtcttttagcaccaaacatttacattttaattatcagattatattttttaaactgtgtatgtatttttaaaggagctgaatatcacctggaccagtatttcagcaaaccggttcctaactggctgcatcagaaacacctgaggtgcttgcttatttatttattaatttttgtgaggtgctttttaaaaattcaagctcctaggcctcaccttttggagagtctgattcagtaggtttggaatggggccagcaccccaggtgattttgatgcacaatgagaattgggacccaatgacgtagacttactcttttcttcctacgtaggaatttatttaggcaatatctcaaatgagaayctagtttgggcttgcatatctccaatatggagaattaacttatgtcactaagtaaaacatcctattcaaggttggggtagttttagttttaagaaagctgtacttcgttacgcttccctgaactttttactgattactattcctaccttagttttcttttctcatgagtaagcatccatagctcatttaaacatwttttgtgttttcatgtgatgaagtttttagatctcctaccatctgtgttgcccttcaggaaaacacactcatgttatattttgtttggcaataattttttttttcttttgagacagagttacactctgctgcccaggctggagtacagtggcataaacacaactcactgcagcctccacctcctggcctcaaacagtcctctgcctcagcctccccagtagatgggaccacagatgcatgccaccatgctgagttaattttttattttctgtagagataggggctcgccatgttgcccaggctgatctcaaactcctgggctcaagcattcctctcgccttgccctcccaaggtgctgggattacaggcatgagccaccatgaccggycaagaaattattaaatattatatctgctatttgtaagatattgtttaagggattgagaaggatacaaaaatgagacactgaccttaatgagaatagtttattagggaaaagagagcatagaatttagcagatgttgagagggagagagaagcagctcatatgttactagagtagaagctctttttaactttgtaagattgctgggttttcatttttattttgagaatatgctgccttacctccctgtctcctcatctgttaccccttatccccagttggaaaataaatctatgaaagaaatcattgtaccctgtaacctcattatgagacagctcttgaagtcactcttagaaaggtatataacctattgcactgctatagtgattaatctgttkaatagattcccatatagatttacataggcctgaattttattctctaaaaaatattatagggttttttagtattattaaactattgtactttttcaatagttagctcttacagaaaatgtccagtgaaggtttatttaaaatatctaagaaagacaasttggttggaagacaacttgtgatttacttctgctacccagtaacctattatacagatcaagccactataaaaagaatggttgtttctaaaagcaaaatgtcaaattgagttttcattcctagaaatagggatttctaggcaagtataggcagtttcattgttctaagaattttcaaacaccactcaaaattacagacatctgtcttgaaatgtttttattgcctatatccgcatgaatgcctctggaagtctgaataataaatttagggaaggacagttttacaatgtaattgtaagaatttcttaattgtaaaagtcagttgtgcacatggttttaagagaagatttttgaaataagtgtaagtcttctgtgttagttttctggtaccatraactgggtggattaaaacaacagaaatttattcccacagatctgaaggctagaagtctgaaatcaaggtgttggccatgttttttccaaagcctttaggggagcatctttccttgcctcttccagccccagatgttccttggcttttggcaacatatctctaatatcttcctccattgtcacatggccttatctttctccctggtctctgtgtcttcttctcttagaaggacaccagtcatattggattgtggtccaccctaatgacttcattgtaattacacctgcaaagaccctgtttccaaataatgtcacatccacaggtrmtgagaattagggcttcgtatcttttgcctgcatttatagtcccagttacttgggaggctgaggcaggagtatcatttgagatcaggaattcaagaccagcctgggcaacatagtaaaaccccatctcaaacaaaatataccttttgcagggaggtcacaattcagcccataacatctttatcccatctttgacctcttttccaagaaaactgctttttaacagttacctgttctcaattcctctagaaattactcactcctgtgcatctcatrtatttaaatccctaatactggatttctcagcttcagatagtatctttcagtgcctaatgattgattataggtgatcctttttcgtcctctttccaagtttctttttttcattttgccaaaggaattttttcagaaaggatgcctgagaaataaactttcagagatattgcccatctgaaatgtccttaktttttcttcatagttcattgttggggagaaaaattctaggcactaaaggtagatatgctttcttgtctatgaatggagagagaagagaaagtcaagaggcctagctaccccatagcattcttgactttgatacttgccagttctgagcttggagcactgtagggctcctgggagctctggctcacacctcttaggcagttttcttaagttttcaggttgtggtttttctctggtgtcattgtttattatccttcttggtagactcatctgctttctgtctgttccagaaatttgttaaattatttgctttaaataatttgatatgtaattcatgctctcttattttgctgttattttagtagaattctgtgcatttccctcctcccctttctacattcttagtgcatcatcttgagcctggaagatgtcctttaagtaggatatttccacttgctgagccatgtccagggaaatctgacattctgttaattgagctagattgtctttagggggagttgatggtgcttgtttaaattcagttgcaaggaattttatattttctgactttttcagtgtacccttccttgctccctatttcatgacttttttgaagagtaccattctcttacaattatgctagctaactttttagaaaattatttggggtctggttttcagaacttcaacatgaagtctgatgttttccgaactagattttattttgctgaaataatcacacattgtgctacaaagcttttcctttgatgtcttactatacctgtttttaggtatttgaagacatgttgctcttgccaaagtgaattattactgaccaactttttatttatttattatgtcatttatgtaataatcttatagatccccaaagaaattatcttgccctcactgaactttttcattccccacagtaaatttgtaaactctaatcttcaaagcagtcacaattaatccacttgtgtaagtaaaagaattcatgttttagtgatttctcagtttaatttctatagctttatcttgtgttatttttagtttcctctctagagattcttgaacagattcttaattaccctctaaagagtattcatgttaggtagatatgaatggatctaataggaaaataaaggtacagaaaatttgggtgatttgctgcaataagttgcagttgaaacargatcatgaatttgacatgtrtatacttattccagtctctatttcagttaaaaaaatgccagtatcttatgatgataaaaaccattgcacagatttgacatctgtttctatttcacaggtaaccctgtatcatttgctaaagctgtttcaatcagacaccaatgcaatgctggggaaaaagacagtggtttcagagttctatgatgaaatggtaagaagattttataatgatagttttaaaagcatttgaagttggagaactttgaagttattgggtttttgttcattttatcccattagatatttcaagacccaacagcaatgatgcaacaattattgacaacatctcgtcagctaacattaggagcctataagcatgaaacagaatgtaagtgccatgcattcataattctgaaaaataacgtattctgtaatagtgaaagggttgtatgattcgtgccttttacactttaaaaaaatgawataggtaagttttttaggtgttaaaaaacacagtttgtattacagtggaacatgtaaaaaggatgttttaaattgttcccaagtaggcctgctttcaagaagggtgaaagacagcctcttacattcgctgaagtactgtttgtctgttttattccctaattacatttaagtatagttttttattagtcttgcttagcctatcattttctgtttactagtctttgctaacaaaatctgtgtgaagaaccttgcaaaccataattatacttttatatactgtgaactagtttatcttatatttttgctgatgtcattttacatagtttcagattaatgctcaagtgttgactacctgaatgccacattgataatcggtcatgttgtattttctctctaagctgacatggtctcagaattctgtackcattaatctgtgcatctattctcagtcatttgcaattggcatttaatatgaaatctatytgacatccctgtgttaacactgatgttactgttcagtcatttctttgattattcattcattacaatatatagtgagtaccagttaatrccaaccattgttctaggtgctagctgctgaggttagagcagtgcctgaatcagacaaaaagccctatcgtcatgggtcctacattctagtgggaggaaaacaggtattaaataaacagaacaaggaagtataaggtagtgattaagtgctatagagacaaacaaagtggggcagggagcatctttggtgggacgagatggttggagttttagatactgatatcaaaatgtcagtcaggaaatgctttctgagcatttggagacctaaaggggtaaaggagtgatctaagggaaggatattatatgtagagggagcagtgaggacaaaggccctcaggtaagtacatggctgaaaaacagcaagaagtccagtgtgactagagtagagtgaacaagaggacgaggagtgggagatgagatcagagaagttaataggggactaggtcatatagggacttgtgggtaactatgagggcttcagattattaaactgagatwtgaagtcatttgtgagttttgagcaaaggaatgacatcagatttaacttctttaaaatgtttaattttgtgggtatattgtaggtatatatatttactgggtacatgggatattttgatacaggcatacaatgtctaaaaattacatccaggaaatgagatatcgatcacctcaagcatttaccctttttgttacaaataatccaaatatactcttttagttatttttaaatgtacaattacattattattgactatagtcaccctgttgtgctatcaaatgcttaatttattcattctttctattttttgtaccaataaccatcctttacccacctacccactacccttcctaccctctggtaaccgtcattctactctgttttctgtatctcatgagtttttttttttttttgagacagagccttgctctgttggcctggctggagggcagtggcatgatctcggctcactgcaacctctgtctcccaggctcaagtgattctcctccctcagcctccctagtagctgggattacaggtgtgtaccaccacacctggctaattttttttatatttttagtagagacagggtttcaccatgttggccaagctggtctcgaactcctgacctcagktaatccacccaccttggcctcccaaagtgctaggattataggcatgagccaccacacccagcctagttgttttaatttttagctcccacaaataagtgagaatatataatgtttatctttctgtgcctggcttacttcacttaatataatgaccttaagttccatccatgttgtttggaatgacaggatttcattccttttttatggctgaatagtactctcttgtgtatatgtaccatattttctttatccattcatctgttgatggacacttgggttgctttcaaatcttggctattgtgaatagtactgcaataacataaacatggaagtgcagatatctttttgatatactgacttattttcttttggatatatacctagcagtgggattgctggatcatatagctctattttttgttttttgaggaatctccaaactgttggccatagtggttttactaatttacattcccaccaacagtatataagggttcccttttctctgcatcctcgcctgcatttgttattgcctgtcttttcgataacagccattttaacaggcatgagatgacatctcattgtagttttaatttgcatttttctgatgatcagtgatgttgagcaccttttcgtatacctgtttgccatttgtatgtcatcttttgataaatgtctattcagatcttttgcccgttttaaaatcagattcttaaggagttgttcgagctccttatatattctgattattaattctttgacagatgggtagtttgcagatattttcttccattctgtgtgttgtctcttcactttgttgtttcctttgtggtacagaagttttttaacttgatgtgatcccgttaatccatttttgccttggttgcctgtgtttatagggtattacacaagaaatctttgtccagtccagtgtcctagagagtttccccaatgttttcttttagtagtttaatagtttgagatcttagatttaagtctttaatccattttaatttgatttttgtatatggcgagagataggagtctagtttcattcttctgcatatagatatccagatttcctggcactatttattgaagagaccatttttttcctcaagtatatattcttggcacctttgtcaaaaatgagttccctgtaagtgtgtggatttgtttctgggttctctagtctgttccgttggtttatgtgtctctttttctgcaartaccatgctgttgtggttactatagctctgtagtataatttgaagtcaggtgattcctccagttttgttcyttttgcggaggataacttaggctattctggatcttttgtggttccacataaaattttaggttttgttttttttttttctatttctgtgaagaatrtcatttgtattttsatagggattgcagtgaatctgtagattgctttgggaagtatgggcattttaacaatattgattttccagttcatgaacatggaatatctttccttttctgtgtgttctcttccgtttctttcattactgttttatatttctcattgtacatatctttcacttctttggttaattcctagttatttaatttgtagctgtggtaaatgagattactttctttttttttatttaattttttagtatttattgatcattcttgggtgtttctcggagagggggatttggcaggatcataggacaatagtggagggaaggtcagcagataaacatgtgaacaaaggtctctggttttcctaggcagagggccctgctgccttcccgcagtgtttgtgtccctgggtacttgagattagggagtatgctgccttcaagcatctgtttracaaagcacatcttgcgccgcccttaatccatttaacccttacacatgtttcagagagcacggggttgggggtaaggttatggattaacagcatcccaaggcagaagaatttttcttagtacacaacaaaatggagtctcctatgtctacttctttctacacagacacagtaacaatctgatctctctttcttttccccacatttcccccttttctattcgacaaaaccgccatcgtcatcatggcccgttctcaatgagctgttaggtacacctcccagacggggtggcggccgggcagaggggctcctcacttcccagacagggtggccgggcaggggcgccmcccacctcccagacagggcggcggccgggcgggggctgccccccacctcccggacggggcagctggccgggygggggctgccccccacctcccggagggggcggctgccgggcggagacgctcctcacttccctgacggggtggctgctgggcggaggggctcctcacttcccagacggggaggctgccgggcgtaggggctcctcacttctcagacggggcggccggtcagagaygctcctcacctcccagacggggtggcggcggggcagagacactcctcagtttccagatggggtcgcggccgggcagaggcgctcttcacatctcagatggggcggcggggcagaggcgctccccacatcccagaggatgggcggccggrcagagacgctcctcacttcctagacgggatgacggccgggaagaggcgctcctcacttcccagactgggcggctggkcagaggggctcctcacatcccagacgatgggcggccaggcagagacgctcctcacttcctagayggggtggcggccgggcagaggctgtaatctyggcactttgggaggccaaggcaggcggctgggagatggaggttgtagcgagcagagatcacgccactgcactccagcctgggcaacattgagcactgagtgagcgagactccgtctgcaatcccggcacctcgggaggccaaggctggcagatcactcgcggtcaggagctggagaccagcccagccaacacggcgaaaccccgtctccaccaaaaaatacaaaaactggtsaggcgtggtggtgcgcgcctgcartcccaggcactcggcaggctgaggcaggagaatcaggcagggaggttgcagtgagccgagatggcggcagtacagtccagcctgggctcggcatcagagggagaccgcgcagagagggagggggagggggagacttctttcttgatttcattttcagattgttcactgttggcatacagagatgctactgatttttttgtatgttgattttgtatcctgcagttttactgaatttgtttatcaactcttaatagcttttttggtggagtctttaggtttttccaaatataatatcatctacaggctgggtgtggtggctcacgcctgtaatcccagcactttgggaggccaaggcagatggatcacctgaggtcaggagttcaagaccagcctggccaacatggcgaaacccttctctgctaaaactataaaaattaaccgagcatggtggcatgtgcctgtaatcccagctactcgtgtggcagaggcaggagaattgcttgaacctgggaggcggaggttgcaatgagccgagattgtgtcactgcactccagcctaggcaacagagtgagactctctctcaraataaataaataaataaataatgataatatcatctacaaacaaggctaatttgacttctgctgaattttatcagatcctttttcagcatcaattgaaatgatcatatggtttttgtccatcattctgtcgatatgaggtatcacattgatttgctcatgttgagcgattcttacatccctgggataaatcccgcttggtcacgatgaatgatctttttaaggtgttgttgaattctttttgctagtgttttgttatggatttttgcatcagtgttcatcagggatattggcctgtggttttctttttttgatgtacctttggttttggtgtctaggtaatactggcctcatagaatgagtttggaagtattattttctcaattttttggaatagtttgagtagggttggtattagttcttcttcaaatgtttggtaaaattcaacagtgaagccattgggtcctgggcttttctttgctgggagactttttactacagcttcaatcttgttgcttgttactggtctgttcaggttttggatttcttcatgattcaatcttggtaggttgtatgtgtctaggaatttatccatttcttctagattttctaatttattggcatataattgctcatagtggccactaatgatcctttgaatttctgcactgtcagttttaatgtctcctttttcatcctttgagttttctcttttttcttaatctggctaaaaatttgtcagttttgtttatcttttcagaaaaccaacttcttgtttcattgagcttgtattttttcttcatttcaattttatttatttttactctgatcttttttcctctactaactttgggtttggtttgctcttgcttttctcattttttacaatacatcgttagatattttatttgaagtttttcctctatttkgctacagacatttaaagctacacatttccctctgagtactgcttttgctgtgttgtttccattatctgtttcaataaatttttcagtttccatctgtccttccttccttcctttcctccttccctcctttctttctttctaacttttttggagctggggatctcgctgtgtttaccaggctggtcttgaactcttgtcctcaagcgatcctcccacctcagcctcccaaagtgctgggattataggtgtgagcctctgcacctgacccaatttttcaattcttaatctcttcattgacccactggtcattcagaagcatattgtttaaattccatgtgtttgtatagtttccagaattcctcttgttattgatttctaattttattccattgtagtcagagaagatacttcacattacttgcttttttaaaaaaaaatgttttatgacttgttttgtggcctaacatatggtctttatccttgagaatgatccatgaggtcaggagaagaatgtgtattctgtagccatttgatgaaatgttctgtaaatacctattaggtccatttggcctattttgcagattaagtccartggtatttttttgttgattttctgtctggatgatctgttcagtgctgaaagttggatgttgrcgatgccaggtattgttgtattggggtctatctctcttaaactctaataatatttgctttatgtatctgactgctccactgttgggtgcatatatgtttacaattgttatatcctcttgctgaattgactcctttattattatataatgaccctgtctctttttatagtttttgttgtgcaatmtgtttgtctgatgtcagtattgctactcctgctcttttttgattttgcatgcaatatctttttttttcatttgcatgcaatatctttttccatccctttattttcagtctacgtgtgtctttataggtgaagtgtgtttcctggaggcagtacatcactgggtcttgttttttcatccattcagccactctgtgtcttttgattggagactttagtccatttacattcactgatattgatatttacattcattagtattgataagtaaggacttccaccattttatttttctgattgtttgatggtcttctctttcttctttccttccttcctgttttccttttagtgaaggtgattttttctggtggtatattttaatttctttttatttttgtgtttctcttttatgtttctaggtttgagcttaccatgaagcttgcaaataatatcctataacccgttgttttaaactgatgacagcttaacactgattgcataaacaagcaagcaaaaagaaagcaataaacactttatattttaacttcatctccccacttttaactttktgttgtttctatttatatcttattgctatctatgtcttgaaaaattgtagttattatttttgatcggttcatcttttcatatttctacctaagacttgtgtagtttacaaactgcaattacaatgtaataatattctttgtttttctgtttacttgccagtgagttttgtatcttcaratgatttcacattacttattaacatgcttttctttcagattgaagaactcttcagcatttcttgtagggcagctctggtgttgatgaaatctctcagcttttgtttgggaaagcatttctccatgttcgaaggctattttcaccagatgtactattctaggacaaaaggctttttttccttcagcactttaaatgtcatgccactttctactggcctataaagtttccactgaaaagtccactaccagatgtattagagctccattgtatgttacttgtttttgtgtttatttcctcttgttgtttttaggatcctttctttatccttgagatttatgagtttgattataaactgccttgaggtagtcttctgtgtgttaaatctccttggtgttctataaccttcttgtacttgaatattgatatttttccctgaatttgggaagttctctattattatccctttgaataaactttctactcctctctctctctatctcctctttaattaaggtcaataactcttagattctacccctaccctgcctttttattttgagacaggtcctgactttgtcacccaggctggagtgcagtggcatgatcttggctcactgcaacctccaccttccgggttcaagcaatcctctcacctcagcctcctgagtagctgggacccacaggcacatgccaccactatgcccagctataattttttttttttttttttttttttttttttttggtggagatgrggttttgccatgttgcccaggctagtctcgaactcctgggctcaagcagtcctccctccttggcctcccaaagtgctgggatcataggtgtgagctgctgcacctggcctggatttccccttttctaggttattttctagaacttgtagatgtgcttcattttctcttgtctcctctcactgtgaatttgcaaatagcctctcttcaagcccactaattctttgttctgcttgatcagttctgctattaagtgactgatgcattcttccatatgtcagtggtgttttcaactccagcatttctgctcgattcttttaatttccatttatttattaaatttatgtgataggattctaaattctttatctgtgttatcttgaatttcttttgagtttcctcaaaacagctattttgagttatctttctgaaaggtcacatatctctgttagagattggtcactgatgccttatttagctcgtttggtgaggtcatgttttcctggatggtcttgatacttgttgatattcatcaatgtctgggcattgcagagttaggtttttattgtagtctttgtaatctaggtttgttgtacctgtccttgggcaggctttccaggtatttgaaggaacttaggtgttgtgatctaaatttttggtcactgcagccatatctgcattaggggataccccaaggcccagtaatgctgtggttcttgcagatttgtagggtacgactttggtggtcttggataagatccagaagaatcctctggattagcaggcagagactcttgttctcgtcccttactttctcccaaacaaacggagtttctgtttctgtgctgaactgcctagacctgaggagggatgacacaagcacccctttagccaccaccactgggactgccttaggtcagacttgaagccagcacattactgggtcttgcccaaggcccactgtaaccrctgcctggctgccacctatgtttgtgtgaggccctaaggctctataatcagcaggtgatgaagtcagccagtatcaggggaaattcagccagatatcgggtgaaattcacccccaatatttcacgtaggttctttcctattttccctaagtgccggccagtctgagaaataaagggacagagtacgaaagagagaaattttaaagctgggtgtccaggggagacatcacatgtcggcaggktccatgatgccccacaagccacaaaaccagcaagtttttattagtgattttcaaaaggggagggagtgtatgaatagggtctgggtcacagagatcacatgcttcacaaggtaayaagatatcacaaggcaaatggaggcagggtgagatcacaggaccggggcaaaactaaaattgctaatgaagttttgggcacatattgtcattgataacatcttatcaggagacagggtttgagagcaggcaaccggtctgaccraaatttattaggcaggaatttcctagtcctaataagcctgggagtgctacgggagactggggctaatttcatccctacagctgcgaccgtaaaagacagccgcccctgaagcagccatttcagaggcttaccctcagggacacattctctttctcagggatgttccttgctgagaaaaagaattcagcgatatttctgtcatttgcttttgaaagaagagaaatayggctctgttctgccyggctcaccggcagtcagagtttaaggttatctctcttgttccttgaaccaattgctgttatcctgttcttttttcaaggtgcccagatttcatattgttcaaacacacatgctctacaaacaatttgtgcagttaacgcaatcatcacagggtcctgaggtgacatacatcctcctcagcttacaaagatgacgggattaagagattaaagtaaagacaggcataggaaatcacaagggtattgattggggaagtgataagtgtccatgaaatcttcacaatttatgttcagagattgtagtaaagacaggcgtaagaaattataaaagtattaatttggggaactaatagatgtccatgaaatcttcacaatttatgttcttctgccatggcttcagccgttccctccgttcggggttcctgacttcccgcaacatctctccctttctttttatataaatgtgccatggtgatgaaggcttgttcattctcttgatttttacccaggattctttgactggtccggcacactaaaaacaagctgattaaacagagaaatgtaattccacaatttactacagtggagcccccaatagacttaatccaagtcgtggggtttaatccataaagattttctgccacctgatctaacgcctcagctccaggcacaatggataagtgagcttgagaggcttcaaaaatttgtttctttaatttagttatgtccaatgataaattatcttccctacccagaaggcgtcctttgaccatttcccatgaataatcagtctcattataggaataggggatgatacagaaatccaaagtattccagttgcactgcatttgcatgcgatgttcgagactcaccacccaatctccaagccaaataacagactgtcttaaatcattaatttgattagcttgtgtccatcccttaagggcactgagtttccctgggctgcgggtaggtccagagattctgtccaggagccagggcctggagttggaaaccttaggaataatcctggtgctctgttttactgtggctgagctggcacccargctacaagacagcatccttcccattcttccctcccctttttccaggcagatgattctttcccygtgtccaccactaccacaggcccacaaggagttctgtcagggtaccacaaatrtttacttaaggcccaagggctcttcagtcagcttgtgttgaatactgccaggcctgggactttcccttcagggcagtgggctcctcttggcctaggtaggtccagagatgccatccaagggccaaggcgtggaattggggagttggtaccaaagcttaagasaaagtcccctttactctttcctgtgtgtggaggctgtcccagtaattcagatttggtagaatggtggcttggaccagagtgatagcaatgggagaagacattagattttggacctgatttgaaaataggtacaggaggatttgctgatgttttgaataatgaggtattggagaaagaaaagcaaaggatgacttacatggttttgggcctgaggaactccaaaaaagtcattgctttttacacaggtgggaggtcttggaggaacaggtttttgcaattcagagtacagctttggcggccaggtgtgatggctcatgcctataatcgcagcacattagrggggctagcatgggaggattgcctgagcccaggacttcaagactagcctgagcaatgtagtgagaccccatctctacaaaaaaaawttttttaattttctgggtgtggtggcacattcctgtagtaccagctactcaggaggctgaggttgggggattacttgagcccaggagggcaaggctttaatgagctgttgtcatgtgactgcacgccagactgaacaatacaacaagattctgtctcaaaaaaaaaaagtgcaagtttggacatgatgggtgtgggatgtctgtaagacatgtaagttgagatgttgagaaggatgttgcaccatggcattcaaagagaggagaagtgtaggctggagacataaatttgaaagttaatacarttataaattatgagaccaaatggtatcatcaaaggagtaagtgaagatagaaaagaggtccaaagactgagagacctgggcactccaaaatttaaagattgaggagataaccagcaaagggaatgaagaacaaacagcaaatatggagggagaaaaactaggtgcatgtaatgtcctcacaggcaagtgaaaaaagtgtatcaggaactagagagtgtctcatactgctgataggtcaagtaagatgagggcccagtaattggatagagtaagatggagctccttgatgactttaacaggagcagtgtaaggagaacagtaaggtcagaagatgacttgaagtggataagagaacatcagataagataaattggagacagacactgtgggcaactctgtcttgaagcctggctgtaaagaggagcagtagtctttgaagcagtaacagaagcaagatacggggtcaagagggtattgttttcagggggaaataaactagtatatttgtaggctgaaagggagtgatgcaataaaagaagaggtagagggatggtaatgaagtggggagggaattgctgtttaacaattagtggttatagaagtgttttgtttatattttcataaaacacttgattaggacttaaaagatctgggtactaattataattttgtgacttaggtagtcattgaaaatttgtatgctttagtttctttatctgcaaaaatgttatgaacataaaacagttaagtatatgatcactttgaaaaggtgaaaagcactactgtgcttcattattgatcactctcttctttctctcataccatgaaatgtgcccattcatggcagaaaattctcttttaaaattcaagtgctcacatttttctgtttttgacaaaactatcatcatttatttatgtataacaagtagttataaataatatgttttgtgaaaaggctataaatctgtttcaatgtgttaaatcttacgtatggagctgtataaccttgggaagtttttatcaataaattaagttttctgtgtgatctttagttcattttcttaacagtaccaaatcaataaggaagaaaagtctaattccataaatggtgttggcataattggtaagcttttgggaagaaaacttaattttgatcatcacttcatagtacttaccaaaacaaattccagtttagttaaagatatttaaatgtttttttgaaaatcagccagcctgttttttgaaaaattagattactggctatcctggctaggaaggactttccaaatttaaagtgttaggaaaaatcacattaaaataaggatagactttattaagtatatttaatttctgcatttccaaaaggcaaagaagaaaagtttgcagaaaatatggcaaagaattaatgtttttttaaatgctaaaattgataaatagaaaaacctgttaaacctcagtagataaatgggcagaaggtatggacagacagatagaataagagatcaccagtaaataaaatgataaaatatctggccctgctaataattttaaaaatgcaaaccaaacagtagtgaatgactatatttgtcctattaaattagcaaaagcatttttttttcccctagagacaggttctcgctctgtcactcaggctgggttgcagtgtcatgatcgtagctcactgtagcctcaaacttgggggctcacatgatcctcctgccttggcccyctaacagtagctaggactacaggtatgtgccaccatgtctggctaattttttttttttttgtaggggcaggtttctccacctcagactcctaaagtactggtattacaggcatgaatcaccatgccagccaggaattttaaatagttgtaccgattaagagtaaactttgcactctcatgaattgttttgtgagtataaatttagctctttaggaaagctatctgggaatattaatcaaaggtctaaaaaatatgtatagttttaataatctgagggcatatgatagtcaatattkagtaataataaaatgccagacttattcagtgcttactatttgtattcttctgagtctgtacatgtataaactcacttaattctataacagctttattaggtaatatttagaaaaggaaaccgaggtataaggaggttaagaaacttgcccagggtcacacagctagttagtagtagaatcagaacttgatccctggcagtcctcagaacttaggctccaaaaatttaatagtatttttatagagagaatatttattatggagtatattggaagtttaagcactaatgatctagctttttagttgcttcttcaagaaatagtaaaaatgatagtgaacacttagtgagagcttactatgtacctgacaagcactttccatttcttaacttatttaatactctaaaataaccctaggaggaagatactatgattagcaccattttgtaggtaaaagctctagaaagatttgataacttgcccaaaattacccagtagagcctgcattttaaacccaaaatctgtccacttaactaataagttgtaaaaagcctgatagtctgtctcctaaccagtaygctsaactgactttataaaagtagtaattctttggatttgttttctcgaaattgagcttcattgggaaattaaaaacagaaacttttctttttttgtataagcatttaacacataggaagcagaacactggaacaagctaaaagaagttttaaaatgttttcccccaggatctcattgctaattaactcatgtcttcttccaaacatctagtgcccttcgcagtcttacaagttgtcaaaaataaaagtatcatgaatcaaacaacaaatctatgttatatctacagtgaatgctgtccttctgacaattgagttaatcaggtctccctggctagttttaaaactaccgcttacagctatacaggactccttgtctttatgctgcttcctgggcctgtatgcccacttcatttacctaactcctttctcattgtttaaaattcagtttagatgttactactaccaagaagccctccttcataaaactcaccctttctacttgatttgaatccagtctactcttgtcgttccctatgattacctcataacattagtgcatttttttcttacctgtttcctgcctctgtaccccagcatctaacaaagcgcatatcattcagtgtgttttttaarttgatgtggggagagagggtataggggaatacaaatttctgcatagtaaaaagcactgggaacaaagtctaaagactgacaggccatagaaaaatgtactcatgtcacaaatgactagtttcttaacatacagtagtccccctttatctggagaggacacattccaagaaccccagtggatgcctaaaactacagatagtaccaagccctatatactgttttttcctatacatatatacctatgataaagtttaatttataaattaggcacaataaaagattaacaacactaattaataaaatagaacattataacaatgaactctaataaaagttatgtaaatgtgtgctctttccccaccccaccccccaaaaaaatcttattctactttttactcacctattttcagaccgctattgacagtggctaactgtaagcatggaaaatgaaaccatggatgaggggggactactgtataaagctgtatrtagctcttacaaatcaataagaaaggccaataacccaataggaaaatgagcaaaaggaaaacagatcatttgtagaaagggagaaatgtctcaaacattataaaaaagatgagtcagccccaatagtaataagatgaatgcgaattacagaaatactgtttttaacctttcaggttaggtaagaccaaaaagttgatgcagtagggaaacagacacaatgctaatgggattataaattggtagatccttttgagttgcttgatgttcttccagaattacaagtacatatatattctrtaacagttccatttccaggaatttatcctacaaatatactaaaatgattatttacagcatacacattattgcattgtttgtaaaagaaaaaaatggagatactctgagtgtacatcaatagggggcagactaaatgaattttatttatccattcaattaggtcctctgtagtcattaaaaagaatgagacagctctgtgttatagggtgagcttccagatataatgttaagtgaaacagcaaggtgcaaaacaatgtgtatagaatgataccacttgtgttgggaagaagaagaaactgcacttgggtatatgctttgtatatcagcagactatttctgggaagatatcagagaacacaacagtgattatctctgggaagaagcactgattggtcatggcaggctggggaacaagtgtagtagaagggcatattttttcactgtctactctttaatcttttaatttgtaatcttgtgtgtactacctatgtataaaaataatttgtaaaagaatgaaaagaattacaaagtaaaatatgaattgttttgacaatcacaaaaagcaagtcaccagcaatgagcaaaataaggaaagaactcattaatattcattgaatttttttattttttttwtttttatwttttttttttgaggcagagtctcgcgctgtcgcccaggctggatggagtgcagggcgcgatctcggctcactgcaagctccgcctcctgcgttcacgccattctcccgcctcagcctcacgcgtagctgggactacaagtgctcgccacyatgcccagctaattttttgtatttttagtagagacagggttttaccgtstattgcatgttttttatgtgctagatgctttacatataattacttcatgtaatcttcgtaaatcctctgagaaatacctagttttagctgtatcgtacaaagagattgatggagccttagaaatgttagcattcggctaataaggaagcaagggtttatttgaaatcagatcttttctgtttccatagttgggtttttttcccaccaaaccatctggcttccaattagtgaccatcttttattagtgaaagtaagtataagtgtactttaatartgagcagcagttaccaaaaatgtccacaagatggaaatgttagacacaagcagatatttttctttgtaaaacatcatgctacatatccaagtggcatatttwaatagatgtgtcctgttttgcagtaacatttctttagtactttgttatagatagatagtttcagatatcacttaatgtttctcttttctcataacaatagttgatagggctttttctgtaccaggcagtattctgggtactttacataaattaatwcattaagtcttctcaacaggctgggtgtggtggctcacacctgtaatcccagctgcttgggaagctgaggtgggataatcacttgaacccgggagtgagagtttgcagtgagccaagatcacaccactgcactccagcctgggtgacagagtaagatcctgtctcaaaagttttctcaacaaataatattatgaagtatttgccattatcatttctgtttcataagtgaggaacataggtgaaatagcttacagtgtcacagctagtaagtggcagagctrggattcaaattttagcagttattgccacctatttgaaaaaaagatattggcttgtattgatagtgtgattttgtttataagtttcacctgggccgggcctggtggcttatgcctgtaatccccgcactttgggaggctaaggagggcggattgcctgagctcaggagttcgcagtcagcctgggcaacacggtgaaaccccgtctctactaaaatacaaaaaattagccgggcatggcagcatgcacctgtagtcccaactactcaggaggttgaggcaggagaattgcttgaacctgggaggcataggttgcagtgagctgagatcatgccactgctctccagcctgggcgacaagagcgagactccatctcaaaaaaaaaaaaaaaagtttcacctgtatataaatttaagaatacttgtagttaacgcttcccccccacccccacccattaagacagagtctcactctgtcgaccaggctggagtgcactagcgtcatctcagctcactgcaacctctgcctcccaagttcaagtgattctcatgcctcagccaccagagtagctgggattacaggtgtgcaccaccacgccctgctaattttgtatttttgatagagacgaggttttgctatgttggccaggttggtctcgaactcctgacctcaagtgatccacctgccttagcctcccaaagtgctgggattacagacataagccactgcgcccagtcacctctcattagctgatgtatcttgggtttgtgtgcccccttatttcaatcttaatatgtgtatggaaaaaaggacattatgtcttaaaattttaactgtgagttggtgaccagaattttatttttagttgtaggaaacatcttagatcctctcttgggaattcagacattcttcccctcccccaacctgcacccatgtttaatgttgtaattcttaagttatccacatttcatcatggaaacattgtcgtcaggaaatgccatatttattaccctgtcatatatcttaaacatgtgagaaaaatactttagtaaaagtatttgttttctttagttgcagagctygaagtgaaaaccagagaaaaattagaagctgctaagaaaaaaacaagctttgagattgcagagcttaaggagagattaaaagcaagtcgtgaaactataaattgtttaaaaaatgaaatcagaaaacttgaagaagatgaccaagcaaaagacatataaacagttctcatgagaacttggtagtaagctaaactgaaaataaggtgggcttcactggagaaatggacttactgcaaatgctgtgatgtttcttagaggaacttcatatacagctgttgaccatgaatttcttagcaataggaatttgtactatttaagcaatctttaatggaaaatatgtgtgtaagaatggatgctatataggtattttaccaacccattttaagaaaattctatgatattaagcacagtttttaaaaatgtttattgtagtatatgtatagcttattacccttttgacaggcatcaaaatttcattataaagtattacttgtacaaattttgtacttctttagtggctagaattagtgaagaaacttaatgtgtatatttaatttcttcaagttcttacctgcccccatccttttttgtatatgatgtgtccagtaagtattcaataaatgtagtttacagatcctatttctccctcctgatgtgtttcttcctctttgaagactttctggaactccctcaatacagttaaagtatctttatagtattgtgacatcacatctcttattggcactcattgtcgcatgtagaagctctttgatggtaaagattatatcttaagttttgttctgcctatatcatagtgtcattattcttcacatacaaatatattaattcttaggggccaggcatggcggcttacgcctgtaataccagcactttgggagtccaaggcaggtggatcacctgaagtcaggagttcaagactggcctggccaacatggtaaaaccccatctctactaaaaatacaaaaattagccaggcatggtggcacatgcctgtaatcccagctacttgggaagctgaggcaggagaattgcttgaacccaggaggcagaggttgcaatgagctgagatcacgccactgcactccagcctgggcggcagaatgagacttcatctcaaaaaaaaaaaaaaaattaaatctttcatagagacatatgggaagcagctgcagctgtgcattagcttcatgcactactcctaccctctcctctttagcctcttctgttcaaatccacacagcaagtcctctacttttagactcatctacttttaacattcattaatacctaatctttaaaggtatgttggctgaaccatcttggcaacctaggaacaaaaatacttttttatctgtctgccctgatggattggttactttttactttgtggctttattttttaaagttgtgacttttgcaattattatggaggatgtacaaaggcctctgtggtctgaaatttcggccagagccctctggggcttgatggtggtactttcaattgtgccaggcatcattcattttctctgcaccttttatccccatgcctacctgccaggcttatcatgataagatttcccaagtatcgcatagggcctggggatagatcaggaaaataacatgagggaaaagccccattctacttgaggagttggcacaggcaatcattattctagtcagctgcccacgaatgtattggttcaaatgtattggttcataaaactaaagtccatgtaggtaggtctgacttcatgcatgcatacaagggttcaaaatatgtggtcatggctcaatcttactctctattggctcttatttctttgttggctttaatcttggtaggatttcactgtgacattgcaaagaactcctgtaactcaataaaaatttttttaatgggcaaaggatttgaacagagatttctccaaggaaggtatcaaaatggtcaataagcatatgaggagatgctctgcatcattcatcattaggaaaatgtgaagtgtatcgcatttcacttcacatccaccattgtggctataattttaaacaaaatacccaaaaaagttgatgaggctatagaaaaattggaaccctcatatattgctggtaggaatgtaaaatggttcagccactttggaaaacagcttggcaattcttcaaaaagttaagcataattatccaatgacacaacaattccactcctagatatatacccaagagaaatgaaaacatgttcacacaaaaacttgtacatcaatgttcatagcatcatgcatgactgccaaaaaggaaacaattcaaaatgtccatcaactaatgaatgcattttttaaatgtggtatctccatatgatagattttcccattcttttataagtggaaagagaatatttcccaagggataatttcttcatctagacaataagaagaattaaagaaactcagctaattaggcagctcacttcttgaaagaagatcaaagtattagtttcattttttctaaccaatgtaggtgtttggtgctgttattcatattttacagataggagattaaggaactatagcttggtgttgagtcaaccagcagtgactcagatgagtaatctgctatgggcttttctgtctcattaatacttaattctcatgttcaaagtgttagcatttttaattgtctgttgctcatgcctaaatacttctcaaacctccttcctttaactaattgtagtaacttaatactatatcaaatatgaacatcaggtagcataaatgcaaaacactgtagataaaaatcttgctagccattaataacatgtaagaaaattctagtattaattttgttggatggaatactaaagcatagatatttgaaatctctagaaaacatttcaggtacctgttccttagcattacccctaatgtcttcagttttgttttgttttgttttttaataataatagatttcaaactcttgagatcaaaaccaaagaaaatgactgggcatggtggctcacgcctgtagtcccaacactttgtggggctgaggatctcttgagggcaggagtttgaaactagcctaggtcacatagtgagacctggtctctacaaaaaaaaccaaacaaacaaaagacacaaacaacagaaaaattggccaggtgtggtggcatccacctgtagtcctagctgctcaggaggctgaggcaggaggattgcttgagcccaagagtttgagactacagtgagctatgtgtgggccactgcattgcagcctggtgacagagcaagaccttgtctcttttaaaaaaagaaagaaaatgagatcatacaagtaccagctaggaaaaaaaaaagagtaaattgcttcccctcaacccagcccctgccaacaattgataaagaaaagaaaaaaaaaaaaggtaaatattattttcttggagttggaaagtacaatgcaaaacccagaaatcataaagttttggatctcaaatttgaatgagtttaggaatctcttgagagttgctaaatctggggaaaggggatggtagggggagtagaaatacagatgaaacaagattggctgttgctaattattaaagcttgataataggtacatgggaatttattgttttctgaactctcgtgtgtgcttgagatttttcataaaaaggtttttaataatgtcagagaaaatcattttttctccctgaagtcaactgatgaagaataagtcaatcttatcttgatcttactggatcagcacactgtctcacaagatgacagtagcttccaattgcatggttagcatgtttacttgtatgttttattttaataattctagcaaattcttcagtactgatcattgaatgtaatagaagtttggaagaatggatgggagggaggaaaaaacaaagggggcagttaggaaaggagaaagaaaaccccttagggagcttcttaatagttcagagtacaatagtaaagacatttgattaggtctagaatggagcccaggaatttgcatttgcacaaggcatccaggtgatttgagaaatggcataatggcacaactgcacaaattgtattacataaaatgcaacccttctaaatggagacaaaaaataaaaatagcctaaaggaaaagtgggacatatatgtgtctaaagctttaagattaaaagaattattatgaatcattaaggaaaacaaatgaaccactggcaaaaggagcaaaagacttgaataggcagttcactgaagaggacataaaaataaccaattttatgcttcgtctcactaaatcttaagaatatgcatatttaaatagcaaatatttctcatccatgtaggatgagataaatggtacagataaactgataacagagaagacatcactgatgataccaacagagagaccagaaacaggccatctggaagatggagatagtgtgtttgtttgtttgtttgtttgtttgtttgtggtagagtctcactctgttgcccaagctggaacactgcagccttgacctttctggctcaggtgatcctcccaactcaagctcctcaaactataggccttcaccaccatgcccagctaatttttgtatattttgtagaatttcgccatagtcttgaactcctgggctcaagcaatcggcccaccttggcctcccaaaatgctgcgattacaggcatgagccaccatgcctagcttgagatagagtatcattttttatctgaaattcaaatttaactaaacatactatacttttatttgctaactctactttttaaattttagatttaaaaaaagcaaagcaaaacaaaaaaagacagtgatagcaagtgaggaaacagctaccctcatacaatgatgggattataaattagttcaatgttttcagaggataatttaggaatatctgctaaaagactgactcaacagtttcacttttaaaattcacacttgtttacttttttattgaaagcaagtagagttttaggaatatattatttattttcacagaaggaagaagggaaaaggaaaaaaataagaaaaaatgtattacttacaaaccatttatccaaatatgcaagatatgtacaagaattttcattacagcattatttacaataaaaaatagaaaaaaaaatggaagcaaggcaaatgtctatcaatagaagctgtataaatatgatatatcatgatacaatggaatcctctgtggttgtcaaaatgaataaagcagatctatgctggtttgttggtgggggagggaaagcagtttgaaaaacagtgtttatgatttaatttttataagtaatatgttagtaagcaaagaaaagtaacttggaggaatgaatcatcaccaaacttaacaggaagaattttagggactgtaactatcttcattatgtatctaaatatttagctttttaaaaaataagaatgtatttcatttgagtgaaagagaataaaaatagtttaaaaattaaatgaaaaggaaaaacagatgtcttgattaacagaacattgcctcctatgatgaagtatcatgtgacagttcaaagaaattaaacatgacctgtaaatgatgtaagggaccagggccaggactccttcaggaactttactgaagggacttacgggtaaggtccttgctcttcagtgcattgtccggtgaactcggataaataacattatggtcctaatgtaaaaataggcagttaaaggtatgagtttcatctatctcctgccccagcctggactctctgatctggcttttaaattatttttagttatttttacttaagataaattttaaccaattgaccacctagatttcagtaaccttatgtaatacgcctcatgtcaatccccaactctaggtagccctcctggatctccaccctaatctgtttactctttctcactttcactggctatcctgagttaactgttctctaccctcaacacggcttcattgctctttagtaattccttagtctacccttagtaaattctttattgttgctgtctgaaaatttccagtctactgaatcaccagtctgcttattcactaaatgaatagagtcataaagctgggagctaatcatctaacttaattccctcatttgataagggagtagagccatgaagaaattaaatgactttcagagtcacacaatctgttgggacagagattcaattttaattcagcatttcctgactgaacagtcatggtacagctcccccaaagcttagaggagagtgtgcaaactggaaatcaactgggaaacaaactttccaagaaagaagaaatctgtaagctgaggtttactgttactgttatagtccaatccctattattaaaattttggctcattctggttaaatcatgttctcatgattaatgagttaaatctggttaactcatgttctcaaaattaatgagaacatgagttaatctggttaagtcatgttctcaaaattaatgagaattgtcactcctatttggtttaattacattcatgaattgaaaccatgaacctatttactcttattttgcacatcagcagatgacctcagttcttacatcattgagatcactgatgctattcaaattgattctgtaaacttccatccatacaaagtttctctttgttctcaccaaatcctgctttctttcatctccctaaat

SEQ ID NO: 17954 - DNA, 20538 bp, Homo sapiens
tcagagttctgcagctcacagaagcaatttcagtttccctggatccggagttttgcatccccatcatggggaccaatatgatttatatgaaagataaatgctcacagcatcaactttataatacggtaatccaattccatctctttaaaacatcataaaggaactactggtttctaaggaaaacatcttattccatacccccattctttgctgtacacatggcttaattaggcatctaggctgattgaaaaatgatgaaagagcttttccatatggcacttgctgctagattaagaaagaaggtcataatactgagaaaagatgcatcaacatgtacatattcatcttatcctgggaacatctatacagcacgatactgacatttcccacacagttatttgatcctcacagcaactctcagaagcaggcaggaccagagcattccaggaccaccggccctgctctcttctggaagccctgcaggtgggctccacctgccgtgagcatttatctttagaatagatcatgcagttagagctataaaactccaagtacagggaaatggaaattgcttccatgagctgcaaaactttatgcacctgctctctcaaaacacccttactctgggctaaaactatcattcaattctcttccctgaaccaaaccaagagctgcacagggcctgctggagggtaggggatatgggatattcatggatagcgtgagtaagtggggtgtggggcttgaacctgggctttctgaccccaagttccaagtgagccttccacaaaggcttatgaacatgtgtgcgttataatacaaatgctggtccccccacctgcgatggttttctcagcttgcttgccttccaaactcctattcagccctgaaaacctagtttaaataatcccctgccatgaattcttccccaactctgcataatagtcgaggttctctagagaaacataaccaacagaaaatagataaatatagatagatttgttataaggaattggtttatgcaattatggaggctgagaagtcccaccatctgctgtctgcaagctggagacccaggaggaccagtgatgtagttccagtgggattgtgaaggccagagacccaggatggccagcgagaaggtgggagaagacagatgtcccagcttgaaaacagccaggcggagagaaccaattctcccttgctgctccttttggttgtattcaggcctccgacaagttggatgccacccaccatgtcagggaagacaatctgccttactcagtctaccaattcaaacattaatcattcaaattaacctaggaaggttaaactcgctcacggcccccccagaaaccatgtttaaccaaatatctgggcaccccatggcccagtcagcatgacacataaattacccatcccactccacctcgagcagaactcatttttttcaaacctcacactcagacacagcctcagaacttcattgccactctgctttctacaacatgttgtcactggatgtcagcttgtccctgtcctcagccatcccaagagctccttaagtgggcacggagtgggctgtgttcgtctatgcaccccctgtgcccacacagggcctggcccccacaaggggtttggcacatgtttgttgacataagacaagctattgctattatatacttatttgtaatacatagttatgaatacactcagcaaatatttgagcacgtgctacttatcagccctgttgtacaagttgggaagatgaacctaatcaaaagagataaatccgttgcctggtggagcaggtggcaatagggctgtgaagagcagtggagcaggccaagaggaggagaggttatttcaggaaaggtctctctgacaagggaggattggtgaggaccagaaggacctgggggagcaagcatggggctctcgatgggaaggtgctccatgtaggggaacggacagtgcaaaggccctgaggtgggagaggaggtggtacattcaaaacagagaggaaaggctgggcatagtggggagtgcctgtaatcccagcattttgggaggccgaggtgggaggatggcttgggcccccaggaatttgagaccagcctaggcgacatagtgagaccttgtgtcaaaaaacaaaaaacacagctcgaggaagccagggcagccaggcaccatgagacgagtgctctgggaggcggctgggtctgtgcatgtgccctgggagacagctgggtttgcgcgtgtgctctgggaggcagctgggtctgcgcatgtgctctgggagacagctgggtctacgcatgtgctctgggggacagctgggtctgcgcatgtgcaaccttgccgccgtaaggtctctgttttcctgggcctgagacagcagcagaggagttcgagaagagacgtgagacggcctggcttcggctttaggagacagagaaatgcagctgattttcctggtacaagccccttctgagagcatgtgcactcctgggattctcgaggctccctaaagaggaaggtctcgtgatcccctgctctgcctgggcgagaaggctttcatctcccaaagcagggccacacaagggcggggaggaacccctggcccagtggagctttatctgctaagtgggcaccttcccaccccagagccagcacccaggacccttcacttctgggctggctgccaggccatggcagcacctggagctgcctgaatgcccaggacgtgctcatgtccaccctgtcatcctgtagatctccaagtgtttgtgctttgctaaatgtatatttgggattttctgcttacctccccccttacacttagacaccgtctgttcaccccatccattccccgcttcctatgtgctagacacgcatgctcttctagggtggcatttgcctggcaccagctgggtgctccatatgtgtttttaaaataaaggggaaagcactcaggccccgtgcttagagaaaagcagaggattacaccaggacttgagtgatggatgaacactgaacagtgcgaggaggaggaggtcattttcagcaaatgctcacaagcaggatgcattcagagcccatgagtcactcgctcagcatggagggtggctctgggtgttacagcaagaccgttggggagctcttgaattccaaggggttgggtcgttgtcctgtggcatgacaaaatccaggtgtttccagaatattaatccagcagaaggatagactgaaggaaaggaatcagaaagccaggagattggtttacagtcctttgttgcagacttgtatgtacgttgcatgagtttctaaaccctgtgatgggaagaaaggtgtgaccgccaacagccttggtcgggggtgaaaggacacgagctggaccacagtgagggtgctgcatttcatcctggcaagaattctgcccagctgtggctttctgtcctccgtctacaattgggagaatactggagacatcagatgtcgtgtaaggactaagaacgaaccctggagaggctcagcatctgggtgctatttgtagaggtctgctgggtgacatgtactagagtctttcattttgaagaacctgctggatatgactagaaaagtaaaggagaaaaaaactccaggactgatggatgagagaactgaaaagtggcccttgatgtcacagtgggcactgggactgcatgtccccaggggccgcaaactccagagctcaccttcccttgaatacacatccagtatggcccaagcccacgcatactacagggagtccagcctgcctggagtgccccctcactagtatttaggacaccccagggaaggttggcctgtcctctatttccagaggcaggcctttatcctctgtgaccacctcttcacccaagtacccaggggacttcatcaagcacagcacacatcagactgtaaggtttaaccaaaccttatagaggctgtgggaattacaaacaactaaattcagaaaaggcaagcattggccgggcacggtgtctcacgcctgtaatcccagcactttgggaggccaaggtgggtggatcacctgaggtcgggagtttgagaccagcctaaccaacatggagaaaccccgtctctactaaaaatacaaaattagctgggtgtggtggtgtgtgcctgtaatcccagctactcgggaggctgaggcaggagaatcgcttgaacccaggaggcgaaggttgcagtgagccgagatcgctccattgcactccagcctgagcaacaagagcgaaactcagtctcaaaaaaaaaagaaaaaaggcaagcgaagcctcagaagagggtcctcagtgcctacccacttcttagtcccctgctatcttctgccacactatagggacctgcttttctttcacagatttggggtcccctccccctgccctcagccccactcccttggccccagagacagtaggagaccctctgctcccctgagcccgggcctgtctcgcatttcccgtggagatgagcaacaaggggaaacgtgggtcttcttaaagaactttcctttccgccctccaccaccttggcaaggcagccagatgcatctccgaagtccagctcactcaggccagctctcttcacagactgtcttccagcaagaggcaaagcagagatgagacctgcacgtgctctttgtggcagagctggccttatacgcactcctgggtgaataaacagggagacatctcctaagaacaaacgcttctcagaaacagtatagtctaaactcatactgaagggagaataagccagccacgggctggagagacccccgcctacattactaagtaacaggaaaggctaagatttggagccttcctccggttcagatctatcccgggagtaatggaagatgcttgcctgttgacaatttttttttattaaaaatcccacccaggaggtctctcctgataggaggggaccatcctatcctctaaggcaaattccagcttcttccctgaaatgtacatccgctactgagcctcagaatgctatttgttccacctacttccacagttttaaggtcttcagcaacaggagaagacagcaggaaaacttgaagtgcagttggctcccgctgagatgtcactagcagaaaaagggaacacaagcaaaaggcaagattctaaagacagaggtgacaccttctgctccaaacatttggagggtcacctttccagaagtcagactcgaagtcctgaattctggcatgaatgagttctcctacgtgtagggggtggcctggaaagatcttaatttgtaagttgacaggtaaggggccttcagttggagaatcttgtcacctgattctcaaagccaaaaatatcttactgtctgaaacatgaggtcttgagtagttcaacttgacccatgcagacataatttgagagacgccaaggaggattaggaaaaaatgtatctggtcttactcaactctgaacattgcatgagtcaaacgttttcctagctctctgtttgtgtgatgggtccactctgatggattcttggcgatgtatctttcatgaccaaaattcaaaagaggccattcgaagtggctcccacaaaagctgctgcagagccccagacattcagaagccaatagtgaaggggccaaaagccatccctcaatgttcactgacactttgcgagccttggggcaagttggcgatgtcaaaacatgtttttagggcgtgtttgccaacatacaggtcttgggcaggattgcagacctctgcagatggtaccaaagtaaagggggagatggtagctgaataatctcttatcatccctaaagtgcaaagtgaaatgagagtggatttttccttccaaatccacttggagtgagtcccgaaagactcacttttgcggcaatccccacaatgacatcactggagcggaggttatataatttaaagcaaccacatctccacagcacttcccagaagagaaaactcctccaaaagcagctctcactatcagaaaacccaactacagttgtgaacrccttcattttctgcctgagtaagtaaatgaccaccttttttttttcttttatgagagtacaatatgagaggaaatctgtgtctcttagaaaaacaaaaaacttccttttacacctacctattggcaaaattttccacttctgtgagggtactttttaaaaataattctaaatcaatttaagagacttttatttcatgcctagtttgggtcttaattgcttttccagaacaggaggaggagggaaaggttttagaactcgtaggaaggttccagtagctccttatatcaaagtcaggtgaaacatgtcagggctgaatgcagccaccagagttcgcatggactgaccagttacagcctgcaaattctgaatcataaaaattaaattagtctctctgggatggcttacaagatttcataagaccaataactggttgggttattcgtggcttgaaagtagcatcttactatgtgaccgtgctgatggtctttaacatctgtggctgaatttccaatgcctttaacatcaccatgctgttgaaattggagttaatttgaagaattaactaatttgttgaagaaagtcacactgtctcatagcctaggttaaaatgtgcagaattcagaaaataccacacaggaattacagaattgccatctcttgtagacttgcccagtgccccttctgagttcttcaaatagggtcacatattactaacaatatccagagatattgtttattgagcacctactatgttccaggcaaatatcagagctaaagctgaaaactggcaaaggaagatttctcctctctagccaactttataaacacagacagcagcaggtgaggacaatccctttaaaaataagccccatgtgagcagacacatgctgtggctgcagtggccccagccacctccccgtcctggggatgggggcggtgtccactgacctaatcaggttcgagctaaagtccctgcgtagctggtcgtctctggcttcctgggcagggtgcarcctcacccccgtgctggtttcctaaggctgctataattaattatcacaaagtgagtggcttaaaacgatgcaagttattatcttacagttctggagatcaggagttcaaactcagtctcgctgagctaaagtcaagatattggcttggctttgttctccatccccatgattcaattatctcccaccaagtccctcacacaacacgagagaattatgggagctacaactcaagatgagatttgggtggggacacagccaaaccatatcagtgctcaacaccctcccatctcttctcaaactctcaatgccccagcccctccaccacaggtcaggacctcgcctcctttctccctgagaaatcccaaccaatcgccggggaattctacagattcccacctgccagcctctgtcaccatagacctcagcttcctggccatcatcagagatagctaggagagggatggtcaggccatgtgtgtgcacactgccggggcaccccaatagtcaaaaattatttcccccaaaaattagtatttacaggtagaaagagagaggaaagaaggaaggaaggaaagaaggaagggaaggaaggaaggaaggaaagcaggatgggagggagggaagaagggagggaggaagggagggatggaggaaggaaggaaggaaggagggaaggagggtagggagggaaggagagaaggagggaatgaagggaaggaaggaaggaaggggaaaaaatccaacaaartggttatattatattgatggtgttataaagtagttctagataaaaactattttcaaaaaagtctttaaatatatatgcatacacctatgaatattaaagcaaaagaaaacatgtttatgttaatcaactgaacatttaaaaataagataagcaaaataattgttcttgttgtatattcacatgctacagtttcttgtacctgactgataccctgtcactggcatttttcacaagaatgtattttcttcagtggggtcttgttatttttaatttttccatataattgcctgaaatcttttttccacaaattttacaattaacaaatttaaattagtaccttcaattgactcttctcttgaaccataatatattgagaaaatgttccctgtgcaggttctgagtgataagctctcagcaaattctgccaggcagaggctgttctcaagtccaattctttgcatatggaattgcataaatattttagcccagatattttcacaggtgctgtctttgtgccttagtttggaatgtagtggtgcgatcttggctcgccacaacctccgcttcccaggttcaagcaattctcctgcctcagcctcctgtgtagctgggattacaggcgcctgccaccatgcccggctaatttttgtgttttcagtagagacaaagtttcaccatgttggccaggttggtcttgaactcctgacctcatgtgatccacctgcctcagcctcccaaagtgcwgggattacaggcatgagccacaccgtgcccagcccacacgtatttttttttaaccagattaaacctttcaaataagttgtacctacttataagttttgaatgttttgtcagattcagatactgcaaaaaaaaaaaaaatcattggctttctcaatttcatctcatttcatacagaacatgaatttatccaattaaaaagattcttcccacaagctgaaatgttccagagctcattttagaatttcaaaattaactcttgtacagcatttgattttgatcattttctgatacattttataatttttctgcataccagctttgttttcaatatttataattcactaaaagctttgaaagttgacgttttgctgctctattcattgaataacttgactaaatatttccaactgatttggaacaaaattcaacgaaaatttatagatctgttttaatacactgtttaataacattttaggatgctgagactcaatgtccactaaaattgattgataatgggaaaataaaagagaaaacacatgtgaaagtccagttttttaaaaaaattcatgaacaactttatcacaagtttgtagttcagtaaatctgtgcatatgttttaacattttgtaaattttgtcacgtacgtctataaatgtcaatttatagaatattgacatttatttatatgcaataacaaattgtgtgtgcaccatgacctgttccaatcacatttctgtttcattagtgtcttaatttagtaggaatattattgttaccatgacgctggactccaccacaatttgtgttttatcctcacaaaaatgcaatgactttatttccaatgtggaaaatttaaacaacttaaatagcattcacaaaaagtcagttgtttcactttgccagaatgaatgtcccaaagccctgcttggcttccatgagctgaatgaaagaatgaattgtgattggaattaacaggtttttctgtctgaagagtccgaggatactggtgttgagctggcaccattttgctttctgtgatgttcttcttatggagccaacacacagtcagccatcacttccactgttgcacgtgcacaagaaaagctggaattaaatgtgagctgagttaacttaaagaacagtcatttgatctaagggaaaagtcatgcctctcagaatgatcttatatcagcatcttttgcagctacatggatgagaaccgtgtcttagggtgcaattttttttttttttttttgagacagagtctcactctgtcacccaggctggagtgtactggtgcgatctcagctcactgcaacctctgcctcctaggttcaagcaattctctgcctcagcctcccaagtagctggaattacaggcacctgccatcacacccagctagtttttgtatttttagtacatacagggtttcaccatcttggccaggctggtcttgaactcctgacctcatgatccacctgcctcggcctcccaaagtgctgggattacaggcttgagccaccacgcccagcctggtgcaatgttcttaaaattactaatttctaaagtagcagctctgtgtcttaggttttcttgcaatcagtgaaattgctacagaccccatagtgatgcaaatgtcaacaaacgttctatgcaagctatctgctcatcaacaacttccttgagcaacagaagtgcagtacttaaatttccattaaatatttgttttttagctcattactccaaaagggtttatttcaaattctttaagtattgccaaatgataaaatacacatagttttggatttatgccctgcaaaaaatgaccaaactattgtaacaagagcctccagcctcctccatattatgctctgggtggggactgctcagcttccatgtgccatggacatttcacaaccaccaaatcataatttcccatgtctcctgttgatctgtcaaccggcagctgtgcaacttctgctcttttatctactctctcccttggtgatttcatccagccttgtggctttaaatgccattcctatagttacaactcccagttaggtctcatcatcccagatcttgtccctgaataccacacttgtctacctaattgcctgctggatgtccccatgtgatgtccaatttatatctcaaccttaacaattccaaagttgaactcctgttcttccccaccccccacaaaaaaaactgcttcatcttcattctgtcaccttcatttcagctgatgacaacttcatacttcccagtgttcagtccaaaaaccttggcattgtccgatttctcctttctcccacccagatccaactgaaaatcacggtgttactacctccaaaacacctctagagtttgatcacttgatcacttctcaccacctgccctgctactctccccagctgtcacccgcyagcatgtttatttagtgtgtgtattgtttatcaacttcttcctcctgctaggcttatacgcacactgagagcagggatttttgcctgctgtattcactgctttgtcctaaatacctagaacagtgcctggcacatagtacattctcagtaaatacttgttcagcaaataaataactggaggaaccagtgaattataccccggtgtgaataactccatgtgagtgacatgacagaatgtcagagctagaagggcctcttgaggacatcatgtcttccttagatgaggaaagtcaggctcagagacatgaactgactctccygaggttacacagccaaatatgctcttccaaggttaattctctgctacacaatagcttttgttggtatctgtgaggctttgcggggttgaaggaatctcaggtgtcacccattaataacaatcatgacrgtgacaactaatgtttgccacgtgcttacaataagtcaggaaccctgccaagcaccgggcgtatattaacctatccaagctggggaagaatgtttaggctctgaagatwgtctggagccgcataaatcccgcagtgtaggcagctgctcattctgcagatagtattctgtggatccctgagttggctgtggccggttttgccagcaggaggccacgaagccatgagcacaggatgggatctaccccttgtgggatcgcagagggctgggagatgcagtcctccctatggaaagagacagagctttctatccctctcccggtgaaactcagcatgggagcatgggaggcaggtcagctgcgtggctatgaacatgagctatggggtgcatgcagaccaaggttcatagtgtacactgtacccaccagctgtagctcctccagcaagcgtgggargccagtcagctgcatggctgtgagcacggcctctggggtccatgcagaccaaggttcctggcgtagcactgtaaccaccacctaggtcttctccgacaagctggttaacttctctgagcctggctttgtcattcatcgcgtggggacaggtgcagcagaagagagcagacagaagcacaggatctcaatcaggctcttgaatcagactgcctgggtttgaatccaggccctactgaccagctgtgtgacctcagacaggcgactccgggtctcagcactcaattttctaattggccarctggagatgacaatggcccctaccttgaatggctgccaggaagattaaatgagaaaatacttaaatgtgaaacacttagaatggcgcctggaacacagaccattaataccatctaacagatgttagttgttawccttatttattactcatgctttcctttctmttttttcttttctctctctctctctcctyytttttttttttttttttgttgttgttgttgttgagacagggtytcagtccgtcggcccagactgaagtgcagtggcacaatcatagctcgctgcagcctcgaccttccaggcttaaacgattctcccacctcagcctctcgagttgctgggaccacaggtatgcaccaccatgcccagctaatttttgtattttttgtaaagacaggatttcaccatgttgcccaggctggtcttgaactcctgggttcatctgatccatctgccttggcctcccaaagtactgagattacaggtgtgaaccaccacacccggccaatactcatgtttttcaagcctgtaagaggaacctcctagcactgtccccaccccggccaccacactggtcccagccccaacaggtcagcttcctttgctgttcccgggcttccctcagctctatctcaagccatgacctctgcytccatgtctgcagccccatgaggctggggctgctctgtcytgcatatctccagtgcctggcaaggggctggcaagaggtagaggctcattaaatgcctgttaaaaccctaatagtaataataataatggtacagttgttactaagactaatcactaccttccaaagtctttcctctatgcaaggcacggagctaagcaccctgtagatcctgacaacagccctcccgtgatcccacaagagagacacgattctctccaatgtttaaaaaggaaagtaaaagtcaatggttctaagtagctcacactgagtgattgtacygggatttggactcaggcaccatcccttaaaccagaggtcagcaaacttttccccctcaggaacagatggtaaatatcttcagctttgcaagccagacagtctctgttacaagcgctcractcccccttgtagcatgaacacagctgtagataatacrtccaggaatgggtgyggctctgtgccaataaaactttattgtccaaaaacaggtgacaggttggtttggctcataggctgtagtctgccacttcctgttttattctaccttctgttcatttcaggtcactgtgcatggcatcatcctggccccctctagagctccaatcctccaaccagagccagctcttccctcaaaatgctacggcctgtgacaatgctccagaagcctgggacctgctgcacagagtgctgccracatttatcatctccatctgtttcttcggcctcctagggaacctttttgtcctgttggtcttcctcctgccccggcggcaactgaacgtggcagaaatctacctggccaacctggcagcctctgatctggtgtttgtcttgggcttgcccttctgggcagagaatatctggaaccagtttaactggcctttcggagccctcctctgccgtgtcatcaacggggtcatcaaggccaatttgttcatcagcatcttcctggtggtggccatcagccaggaccgctaccgcgtgctggtgcaccctatggccagccggaggcagcagcggcggaggcaggcccgggtcacctgcgtgctcatctgggttgtggggggcctcttgagcatccccacattcctgctgcgatccatccaagccgtcccagatctgaacatcaccgcctgcatcctgctcctcccccatgaggcctggcactttgcaaggattgtggagttaaatattctgggtttcctcctaccactggytgcgatcgtcttcttcaactaccacatcctggcctccctgcgaacgcgggargaggtcagcaggacaaggtgcgggggccgcaaggatagcaagaccacagygctgatcctcacgctcgtggttgccttcctggtctgctgggccccttaccacttctttgccttcctggaattcttattccaggtgcaagcagtccgaggctgcttttgggaggacttcattgacctgggcctgcaattggccaacttctttgccttcactaacagctccctgaatccagtaatttatgtctttgtgggccggctcttcaggaccaaggtctgggaactttataaacaatgcacccctaaaagtcttgctccaatatcttcatcccataggaaagaaatcttccaacttttctggcggaattaaaacagcattgaaccaagaagcttggctttcttatcaattctttgtgacataataaatgctattgtgataggctaaatgattactcccgtagattggggggtacctaatccctggacttgatgaatgttaccaaattaagggtcttgagatggggagatgatcctgaattatccaagtgggccctatataatcacaagggtccttataggagggaggcaggaggctcagagtcaggagatgtgactatggaagcagaggccagaggaattcaggacggccactacgagccaaggattgcaggcaccctctagaggctgtaaagggcaaggaaatggcttctcccctggagcctccagaaggaatgggtcctgccaactccctgtcttcagcccagggaaacagatttaggatttctggcctccagaactgttagaggatacatttgtgttttgttttgctttgtttgctttgctttgctttgcttttttgagatggggtctcgctctgtcacccaggctggagtgcactggcacaatcacggctcactgcagcctcaacttcccagactcaagggatcctcccacctcagcctcctgtagctgagactacaggtgtgcaccaccatgcctggctaacttttctattttttgtagagatggtgtcttcctgcattgcctaggctggtctcaaactcaagggctcaagtgatcctccactttggtctcccatagtgctaggattataggcgtggccactgcgcctggccccatttgtattttaagccaccgagtttctggtaatttgtcatagcagcagcaggaaacaaataacaagtatcgggtaatggcctctcttattacacttccatttgtctattcaaagctttctaggctaactgccaggaatacagggatggtatagctagaagttctatattcaaggaacttacatacatctaaatattataatataaaaaatgaaatgagaaattgcatgaacacaccacggatccagcatcttgcgccttcagagagaaaggatatgggttccctctcaggttagcagagaagacgctgtgaagggagtcagccgtgagcctggtttccacaaagggtgcaatctggatacgtggagacagggaggaagggctggcagaggcgggaaagggtgagctgctcacaaaagaatgcttgtgcatgctcttattgaacgtgtaatgcattggtgcgggtcttgctatgagagacccaacggtgagcctaatggtgtctctaccctccaggggctcacagcaaccaggacaataattaagggattgtcatagagcaggatgcccgccaccatcagggtgaggggtgccgtgagaaccagagcagggctccagtctgggtggctgggagggatggttagagaggggttcctggaggaagagacacataaactgaatcccaaaaaatgagaagctggccaagcaaaatgggggaaaggagtgttccagacagaaggaacaaagtaggcccagaggcaggtggggttacaggttaggagggagaggttgaaggatggcagaggaggaggcgggtcatggagagaattggggctggaggagaatggacaggctgggtccaccatggtcagctggcaaagacagttcacccaggaaggatggtgggctccaggcggctttgagggccccattgaagctggaaagcgtggctgtgttgtgtgaatttactctgataatgctcgacagacccaggaaaggattgctctggagtagggtttagccagatagacggccatacgtcatgggagttggggatcctggtcagactcgggggaatgatggagagggaagaaacgagcacagggagagaaggaagtgaagtgagatcagtgtgttaaaggacggatatagtgagagaacctgggtgacagcaagaaacagaagaagagccaggcgtgatcttctgtacactgtgaagggagtcagccgtgagcctggtttccacaaagggtgcaatctgtaatcccagcactttgggaggctgagacaggtggatggcttgagcccgggagtttgagaccagcctgggcaacatagcaagaccccgtctctacaaaaaatacaaaaattatccaggcgtggtagtgcacacctgtagtcccagctacttgggaggctgaggcaagaggatcatctgagcccaggaggtcaaggctacaagcagtgagccaagattgtgccactgcattccagcctggctgacagagtgagaccctgtctcattaaaagagagagaggaaggcatagccacagagcaggaatgtttgagtagaacattccagaggcagagccatctcaggagatgacaaggaccaagtgtatccctggcaccaggtggctgaagtagagggaagaagaaggaggttggagacaacatagagaatggagaggtcaggtggtgggtgggccctacctgggccctcacaggcaggcgggacattgtcaggccctggggaggagagagtccgtgggccaggaggccattccaaggtcagtttccatggagtgggggagagggtgtagtgactggactccaagacacttgggggaatggggagaatggcagtccccacagctgcacgggaagggctggtcctcacagaatagcagcaaagactcattcattccaggaatggaaagaatgccatgttcttggagcctggagacagggtttgagaggctggcagcggctgggccaccaggacctcatcagtgataaccctgtgatcagtgttccagcccctgcaggtttcctggagagcagagtgtcgtcagaaggcctggagctgagccaacaggcaagatccagcctgcacatgtgtttaatttgaaccacatggtattttttaaaactccaagcccccaggctcttgagttggttaccagtactgaaactccccattgggagccagctttccagtttcttttgaaagtttggaacatccagcaacactgattcaatttcattcattcagcagatatttattaagcatctactttgtcagacactgttttgggcactgaaaatatggcagtgaacaaaagagaggaacatccctgggcccttggagttgaccttccagggtccccccggggctccaattctttggtgctgtgtagcagaggccccgtgaacagggcgccctcccatcaggttcacacgcatggaagctatgggaggttaagtttgcaacccctcatccagaccatcccttcacatacagtctaggaaacagagagcagtaagacctgcccaagcacacccagtgcgactcagcagccacacacaggagtaggctcagtcatctcatttaatcgcctgactcccttgtgaggtctgtttcaggatgtccactttctaggtgaggaagaggaggctaaggaaggcagtgcctgctcagactgcagaggctggattcacccaactcatctgacaccaacaccaatgtgatttccaagcccccaggcaggaattcattgggcaaaggctctgtggcaaagtggcaaaagtaggcaggaacaggcaggaatagagagtgggaaagggaaaataatacctgattcctcttctattccgagtgagctgacccacatatgccctcctttcttctttttcagccggccttaagcaggtggcttatcaaaatcctttcgaggtcttgcaaaaaccaatcccacactcgagaagaacgtgctggccggtgaaatcggacaacattgctcacgggatgtaattcaatggtagactgcagccacagcctgagaactcagacacctgatttatgagacgcacataagtaacgtttaccgaagcccagcaaatggccccacagtgggagagaaactggcaaacccgtacagtagaattctgttgcccttctgtggggaaggccagttattcatttacagagggagaaatttctgccttgactaaaaggatcgatgctgtgggaaaaggtaatatatctgagttcccatggatctggttgataggttcacctggcgtgttccatatggggccaggcccaggccacacctgtggtgctaacacctggggtggagggaggaattagcaaatagtcttccagcatccccagctccagcacccatgtgggcttccactctctccctgagaagggccaagtagaaagagagaacaaggtttcactccaatccgttcccagctctgggtctgtcctgggctccagaaccgcgtgatcaggggccatatgtggccttcactgctctctgcagtgggaaggtaagaaaactgcccccaccctgccccatcatcaccccaatccatcatggggagtgggtggcactaaggccctccaaatcccagcctcggggaaactccctgatgttgcaatggccacaggcaggctcttgctctccggagatgagtcacaaatttgatgaggagcaggtcggaagcagccctggaaagtgttcctccccacccctgctcccaccacagctccgaggagcctgggcatccaaccagggctgatccaagccttggctccggctgagctccgctctggcctctgtgcaccttcagctccttcctgcccttctctttccctgtgcccagcccctttctccagacccccttgattccttctcagcatcctcttgcctccccggaccacccccagctcaggcccctgcccaagaagggcctcaccgcggggctgcagagtgcacagtgcagccggtcagaggcccaggtctctgagtcacacatgccactgttccagtcctcactccaccaccgcatgggcctggccgaccaccgaaactcggcatcccatctgtaaaatgggaatgaggagagcagtgcctcactgtgtcgttgtgaaaattaagtgacccaaaaggacggccttattccctttttggaaagaggtaatgggcaaagaaagggaaggaaaggcgagaaaggacaagaggaaggtcagagatgtatgtgagacaccaggacagcgccaccccagcaagcaccaacaaccattttctcctatgagcagaagaggctttaactatgactgaaatgaatgcatgtcaaagcacagtctgaataaaatcccaaaaatggtgtccgtgtcactctcctggttgtgatatggcacgatccttgtgtaagatgttactattgggggaaactgagtaaagaataatggggccgggcacagtgctcatgcctataatcccagcactttgggaggccgagacaggcagatcacatgagcccaggagttcaaagaccagcccaggcaacatggtgaaaccctgtctctagtaaaaatacaaaaattagccaggcatgggggtgcacacctgtagtatcaggtacttgggagaatgtggtgggaaaatcagtagagcccagggttcaaggctgcagtgagccatgattgtgccattgcactccagcctgggcaataaagtgagaccctgtctcagaaaaaaaaaaaaaaaaaagaatgagtacaaggcatctttcttatcactgtatgcaaatctactaaaaaccttaaaaagaatgcatcattaagttcaaccactctgccttacagatgaagaaaccaaggtccagagacaagcagacttgtccaaggtcaccgagtaagcagggctcctgctgaagggctctgttcagacccaagatgcccgctgggccctggtgacaggtctcagtctcaggctgaggtcagagaagaggcctgagtgccagggttctcatttgagtggccatgatgattgcagagactccctatggccaggattgtgtttaaggcagtaaacaggaagccaagcctacttttcaggagcttcaggggacagaaaactatcaggaaggattggttgggacccagcaagtacgagaggaagacatttcagggcttcagtcaacaaggggctcagtgtactgtagctgccaaaat

SEQ ID NO: 17955 - DNA, 12797 bp, Homo sapiens
ctagactttacttgaatacctttagtgacagggaactaactactaccaaaggcaactaactcagctcagcaaacattcagtgatagctgcgcttccccaggaccagagattcagataagcaaacaccctgttctgtgctcaagggactgatggtgtgtgacaatcgagatagtgtgaagaaaaaggacagcatatgtgtgtctctgtgcatgcatgtgcaaacactgacactgcagtatgtattcagaggaagtcactacaatggtgaggcccacctggcaccagaatgaacagatttaagaaagctagtcaccgcagacggtcacagctggaaggattttacaaaataatctatcttatcatcctcctttgccctagagatggggaaactgaggcccaaagagtgaaagccacctgctcaaaggcatattgttgagtctaataataaaaataaccatagcaatagcaacactgagggcagctgtcccagatggacgctggctccatgccagcccctgggctaggcgtctggtggcactacctcatttcactgccataacaactgggtcccccatcttgcagatgaggaagcccaagttcagagaggtgaagtggggggctgggggtctatcccagaccttgttgtcacctcctcactctcccagtagcgccagccagagcacctgtcttgggagccccgaggcagggacaggctatgcatccaggaagcccccaggctctaaggaggcggccctataactgctggatgaccaaaaatcaggcagcgatccctaagtcccttctgagccccaggctccaggctcctccaaccaggtctgccttacgcttttgaccacaatcaacccggctctttctcggttcttttcatctctctggtggttttgtatgcagagtcacccaggtccccacttacgagcctgtgagatgggataaatcacttccctttgctgagcctcagttccttcacctgtaaatgggcataacaagttcctccaggacaatcgtgaggctcagggaaaggactgtcgtgcaaacccaccatggcatgagctgtcgagtgcagtgcccgctgccactaaggaatgagtgccactctgggattgtggaaagtgcagaggggcagggttgagatgctcgtgcatgactttggacaggtcacctccctctcagaggtttagtttccttacttgttaagcttggactaaaaatatctaaatggtgagatttttccaacttctttggctctagcatgtctgtggtccttgatggtttacaaagcgcttttgcacttgagacccctaagtgctaattctaccacatccccatccacttcatagtgggatgaccttagccaaggctcttcacctaaacttccataagcccctcgctggaatttgagcctgttttgcttttttaaagtgagggcaatgctactggccccacccatcttacaggacaagggaagcccaaggacatgagagctttctgagctgcatcccaggccctgctctgccactgactcgctgaggctgggtttccccatctgcaaaataaggacataaaaacccatctagagctgggcatggtggctcatgcctgtaatcccagcactttgggagtccagggcaggcagatcacttgaggtcaagagttcgagaccagcctggccaacatggtgaaaccccatctctactaaaaatacaaaatattagccaggtgtggtagctcatgcctgtaatcccagctactaggaaggctgaggcaggataattgcttgaacccaggggacggaggttgcagtgagccaagatcacgccactgcactccagtctgggtgacagagcgagaccccatttcaaaaaaaacaaacaaacgaaccaaaacaaataaaaacccatctagagtgttgtggggattaaatgagttaatatctgtgaagtgctttgaacagagctggcacggccgggcacggtggctcacgcctataatcacagcgctttgggaggccaaggcagggatcacttgagcctaggagttcaagaccagcctgaccaacatggcaagaccctgtctctactaaaaatacaaaaattagcagggcgtggtagcatgctgctgtaatcccagctactcagaaggctgaggcaggagaatcgcttgaacccaggaggcggaagatgcagtgagccaagattgcgccattgcactccagcctaggtgacagagcgagactctgcctcaaaaaacaagaaccaaaaaccccttaagagaaatggggttttctcttatgagaaaaataaatatccccggtgtttcctctgacttgcccagggctgcacagctcacaggggaggggtggggaccgggacctggcacttggctcctgctgctctgccctatgcccttggggacttctggacaagggtgggcttctctgggctgacagaggagacagaggcaatggtgtgctggtaaatggttaacaactggctctctggaaaaaaatgccctaactgtagcaaaaaaaaaaaagagactagaactggcacattgcagatgatataggcatttgctgtcactatcagcatcagcatcattacttgtcctttcaacaaatatttcctgagcccctgtcgtaggccaggcccagtgctaagaggtggggacacagtggagggaagacagaaagttaagtgtgctgtttccataaagtgtgctgacagccatataggagcactggggctggggtgtctctacggtgcctgggagggtctcctagagaaggtgacatcaagcaggttctgaaggatgagtaggagttggaaggagttggaagagctcctgccctttgtggagcaggagagggaggtggtccagggacctttctggccgaccaaccctagagccaattgcagtgagccattgtgacattggacttgaaactggtcactgcgagagtatttataccatagaaatttgcaaatgctacggttagggcatttttttccagaaagcccgttgttaaccatttaccagcaccccactacctctgtctcctctgtcagcccagggaagcgcacccttgtccagaagtccccaagggcatagggcagagcaacaggagcccaagtaccaggtcccagcccccacccctcccctgagagttgtgtggtcctgggcaagtcagaggaaatgccgggggtatttattttaaaaagtgtctatcaggactctacattatgccaggggtctcaaaggtgaaagaggcatgagtttgtccctcaagcagctcaggaggagctggaggaggtttcctaggcacgagcttatccacaccatgacacatagaccctgaagtgttttaaatcaattacaaaaagcaaaaatacaaggaagctgacagatctttactttgggagaagtggaggcttgggaacaaatgagatcatcaaggtctttttgtccgttttctaaggagttggggtcattggctgagatcctgcagatctggaggtaccaacatgagactccgagggccacctcctctgcccctccctccccaccccctttaaggccctctctggaatccatcccttttcctccatctccccagacctggctgaggcctccgttgtgcctctggtctggtgcctcagccccctcgcttcctgcttccagattttgccaactgccccccacctttgaccatgtccaggcatcctggctcaaaagccaagatgagatctatacttgagagcgtatatgagagggatgcaactgaggctacctggagtgcgtggacacagccatggcctcaggtcatcatctcccccacgaagcctcccacacctcctgtccccatcttgggcacacttcccaccacctgggagacccctgagggcaggcaccatctgtccttcaccactatatccccctataaagagagataatgcagtgaggtgccggggttcaaatcccaactccacccatcaccagctgtgtgactctggacaagccacctctgtgtgactctggacaagtcacctcactgctctattcctccaatttttataaaattgggatagtaccagtgcctgcatctaaaataggtgtggattacatgaattatttcatggaaagtgcttagaacattgcttggcattcatagtaagcctccaaaaactgaagctattattattccctggttgctggcccagactaagcactcataaatttgttgaatgaatgcaatgtaaacagggaaatgctctgtaaatgctggtgcaagctcatcagcttcgttgtcgtcatcagcattgtcctgatgctattcatggtgggtgtcctgtctggagccctgctggctgtagaccaccaatgtgggcacagtcctagcccctcgctcaagtagggtatgcgaggactcaggagacgtcaacagacattcacagtatttacactgggaccttggaaccagtgtggttgagtagacacccggaggacagagttctgagtttatttgggaggggttgccggggagagtcagctgtctggaaaggcttcctggaggaggaagatttgctagaggtgcttgagtggttggtgcaagggggcttgtggggaaccagagcgtcctggtgtttagagcagcaaggaagaggctgggtaaggacaaaggacattgggacagacagaaagcctgactctagaaagaaggggccaaggtcactggagaggagagagaggaaggattaaggacgattgagtgggtcataggggttgagggctctgtgtagggaaaacagtttcccactcaatcctttcgatgccactgtgattaaatgtgtgggtttatttcctcagaaattgtcttacaattccgttcagttctgacattatctgcccggaggcagcacaggataagagctcagtcccacaagactgccgccacttcagaacccatcgcaagtctcaagtggcctgcacttctgaccaaccagctgtaaggcagggttcccacaaccccctccacgggttcagtaatttgctaggatggctcacagcatcagggaaacatttacttacattactgacttataataaaagacaccactcagccacagccaggtggaagagaggcacagacccacacgtggggcaggggcctggagcttcggtgctgtctctgggggcaccaccagctcagcacctccctgcgttcaccaactcggaagctctcccaatcctgtcttttagggattttgatggagacttcatcatataggcatgatggataataaattcaatctccagcccctcttcccttcctggaggatgtggggtgaaagttccaagctttgtatcatggtctggtcattctgatgacagcccccatcctgagcctatccagccaccaccaagagccacctcattagaacaaaagatgtgcctatcatctagaaatgtcaagggagttaggagctccgtgtcaggaactggtgtcaaagaccaaatatgtatttcctaatatatcacgatatcacaggttgtgagaagaatgccatcaatggtcaaactccagagctgcacactctccaatatggcagtgaccagccacatgcagtcaccaagcacttgaaaggtggctgcttcaaactggtatgctaagtgtaaatacacactagattttgaagagttagcaggaaaaaataataatataaaataactcaatgactttttgtattgattacatattaaaataatgttttggatatatttgattatatctcatatataaccaaaattgatttcacctgtgtctttttactttttttaatgtggctactagaaaatttgaagttacttctgtggctaactttatagttctattggacatcaccgaccgctctaggctatggaaaattctgtagaacaaacaactggaagttggaagaaaagacagtaagaaatagcaaggaagggtgtgctgttgggagttgcttggaggttggcggcacagggctgaaggctagcaaaccgagcgatcatgtcacacaaacaaattcactattcggacagatacgacgacgaggagtttgagtatcgacatgtcatgctgcccaaggacatagccaagctggtccctaaaacccatttgatgtctgaatctgaatggaggaatcttggcgttcagcagagtcagggatgggtccataatatgatccatgaatcagaacctcacatcttgctgttccggcgcccaccacccaagaagccaaagaaatgaagctggcgagctacttttcagactcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccakatgagtgctctgtggacccacagcctcagctgagtgtgaccctaggaggcacaatgtgctctgtatccagaacacacttggcagatggaggaagcatctgagtttgagaccatggctgttacagggatcatgtcaacttgctgtttttgttttttcctgcctggtgttgtatgtaaggtcacttgtggatttatgtttcagcgtactggaaactttccattttattcaagaaatctgttcatgttaaaagccttgattaacaaggaagtttttataatctaaaaaaaaaaaagaaatagcagggaaggctgtaggtgaaaagaaacttaagagacctatcaaacaacccaatgtgtaaagtcatttgcattctgattcaagaaaaccagctgtgaagaaagtagcgtgaaattcatatgattgaaagttgtaatacttcctggatagttgatgccatttaggaattattgtcagtttcttcgagatgtgataatggttgtctagttatgctttctgaaataagagtccttagcttttagagaagaatagtgaaatatttacagatgaaatgacagacatgcaggatttactgcaaatattacaggaggggtagggtaggtttgggcatagagaaaaagattggctgcgagttggtaattactgaagctgggtgaagtatgtggagtttcattatgctagtctatctacttgtgggtatattccaaattttccataataaaaagttaaaaagcaaaaaaaagaaccatcatctccacctgaggttctggcccagactgcttatgttcaaatctcaactctagtcttgctagctgtgcctctgtttgctcgtctgcaaaatggggatgataatattagtccctacattgcaggggtttctctgtaatgtgcttaaaaatatggaaacaatataaatgaaatgaagatatgttgcaggcactttgcacattgtcacggtgctcccagtgccttgttccagggaggttatccttatttaccaagaggttaagtcacctgccctaggtcttccagtcagtggaggcaaagccaagacatgtcccgagttcatctgacttctgagttcaggcatgacctgaatgttcttgcctcgggctcagggctcaacatttcctgtcttctctgcttctccagtcctgagagattctgggcccgtttccctgcagatcagctctaaggaacatgcttctctcctgctcctttctagaaaaggcgtaacattggcagaaccaggaactctggaattctgaaggttgactccctcaattccaaggggctccacctcctgagcggaattggatagaagacaaaggtcacatggctagggtgaggctttgagatgggcgagactgtgagcaggactgacaggtcagggccaggacccaggatcttcagaagccacagggagcaaggcagggagcagcctcctttgtgccacacccagtgaaggggaacttgctaagacagatttgttcctcccatctccagaagagccgttggatgccaatgggtgaggagctgaacctctgcagactcagtgtgctgatcccattgcctctgcttgcatgcctctcaggatggggagttcactgcatccccctctttaaagacattacggttgtacaaaggtctccagaatcatctattacatcccctcattctcccaatgaggaaattaaagctcagagatgccgaggcatttacccaagggcacacctggtcctgggcctacgacccttagacaatattccttccacctctttgctatagagtctcagactagggatcttggctggctgagaaatcagggaaggcttcttagaggaggtgagattggaggtggcccttgtagggtggcactaagatgtcgcttgatatcctaattttttttttggccctgcccaccatgtgtgtgcctgtgctgccatgtcacactaagcagagtaaaatgaaggaaggaacggatgaaaggggcaggaaagcgactcccaggagctgaaagggcaatagtataggtcccttcagcacctaggatatgttgtgggaagcccttagaccccagatactaccctgtgcagatagggataaaactccacctgtcccagctcagtgctctccccggctcctctggcctgcttgctgggcagggcccaaaccagttcaggattcctttttctctgtgacctaccagttagggttctctgtttactgtgtctcctcctccttgttttgtatacccagctgggtgggaagaaggtcacagcccaggtttgcacgtggtggaggagcagggccagtaactggttaggcagagaccccgcccaccaccctccactcccaccctagcagggcctgtgccatccccaggacaccggagaccaccagggggctggagaggctgcgggagaaacagccttcctggacacacccagctacggctcacttcccagcctgagctgttccttaggaattgcttttctgggaaacacaccctcttccagacctgcagccttcctttctatgtggtttttggttttgctctctggtgagggtttctattttttcctggtatacatgaatggcatgcaggaaagtggaatgaggacatcatgaccaccatgcaaaggccattgctcttaaggtttgatgtaagctccccactctccacccccactacccctctgcctcggcctggggtatgaggtcttggttttgacaatcagacaatgttagcacactgctgtgtcttccacctgcaatggagcactgtaggacgattttaaaaagcaaagtggcaggccaggtgcggtgactcaagcctgtaatcccagcactttgggaggctgaggcgggcggattacctgaggtcgggagttcgagaccagcctgaccaacatggagaaacccccgtctctactaaaaatacaaaattagctgggcgtagtggtgcatgcctgtaatcccagctacctgggaggctgaggcaggagaattgcttgaacctgggaggcagaggttgcagtgagccgagatcgtgccattgcactccagcctgggcaacaaaagtgagacttggtctcaaaaaaaaaaaaattacaaagtggctgaataccaagatcctaggaactaggttcagccaaactggctgtgtgtcctggtagaatgcccaccctctgtctctgggcctccatgcccatctctgtagcatgagggattctgatgaaataatttccaagagcccttcccacactaatactccaggattctgtaaggttaatttggcaagaattccaacggcggaagaaagatggagggaggaatatgtccagtctaataaccctatgctcaagtcagaaagcccctcgggcagtgtccgagagggctacagccctggccccagaacctgagtccctctaacctgggtcaaacccctaaaagccactccagcaagagacaggcaaagcccgggctcttgctccaggctggcattgccttgccgtgtggctgtagacatcgtttcacctctcgaggcctcagttttcccttctgcaaaagacaggctgggggaggttgggcattttcttcttaactaccaggagtctttcctccaataaaattgtgatggaaaccggatgtcacacaaagggaaaggaaacactggcatttctggagtgtttgaagcatgtgaagtattgtttaagggctttgcaatcattaatgtactttgtgctcacattaaccccacaaagtaggtgctattattatccccatttgacacatgaagaaactgaggccctgaggagttaagccacttgtccaaggtaaagagtgggagctgggcttctgatagggagtgggcctcagtcatgaaaccacaagacttgtgtagttccaaccccctggggacatctccaggcacttgacccatgctcttccaacattcatgtatgcacgcacacgtgtacacacacgtgcacacacaaacacacacatgtgtgcacaaacacatgcatgcacacacaaacacatgcatgcacacacaaacacacacacatatatacacacaccaacacaaacacaaatgtgcacaaacacacgtgtgcacacaaacacacacatgcacacacacacacaaatgcacacacatgcgtgcacactgtggctactcctctgtagcctgctggccacactcggctcaagccccaaatcaaaggtgactagcaagattgcgagacagatttctggagatgggaaactgcgtcatcaaattgtctcagggacggaacacccatcagagccctgggggagagaagagacacggggtggctgccaattttgctgacctatgctgctgactttccagcagcccccgactcctgtggccagctgagcccaggtccaagctgccccctgcacagggcttgttccctggagggctataagccacagcatcccctccaagacagccagtcctgtgaacctgctcaatccctcactattccttggggcctgccctgggagaagggagagttccctggaccccttcttgggacttgcggtgacaggggtgtggctcacttgctcaaatcccttgtgtgaggggaagcatgcaagcaagtgggtgctggggccggggcaagcgcttttgggctctggccctacagtaccgtctagggttgtgttacaattaatgctcttttagcagttgccattcactgatggctaagtgttaaccaactcagtggagagtgagggtgacagccttttacaccttgccctcttggtacctgggtccttgtctggcatccaggaagaatcaggtcacacggacttgaaggatggtgaatgcagaggttttattgagtgatggaggtggctcttagtcgggtggggagctggaaaggggatggagtgggaaggtactcttccagatggctgaactcttctccaactgtccagctgcctcttccacattcagacacttcttctcttctctccttctctgccatgctgctctgctcctctgccagtggagtttggggtttttatgggtatgggatggggggcatggtgggccagggtggttttggcaaaagcaacactcaggtgggaaaacaggaatgtgaagttctcatttagggccgtgggcccaggcttgtgggtggggcttttgccagagagctgtcctcctctacccagtatttccctgcctcctgtccatatcacctgcaccaagaacctcactgggtgggagccaatccagagccagagaaaggacttgacacttggcctcaggcagacccaggcttgaatcctggccctgcctctgatgagcagggtgacctgaactgtctcaggttgcctcgctgactctgctttcccatctggaacatgggaatagcaatgcatcagccactcagtgcagtgttgaggctggaacaggtggggcacactgtgagctccatttccttttgcctccacccagcaattatgtctgctggggagaagaggagaaataaggatcacaccctgccctctatcagtcagtcaacgaccatttattaaacacctactaggtgtcaggcacttgacagagaaatgaaataacaacacaagcaactcttatagctataccctataataaatgttatagaagcaggaggcaggtagaggtggaagagaaccttctgcttgcagggggatatcagtcagagaaacagaaccaataggagacacagattaagagatgtattgcaaggaactggcttatgtgattgtagggatgactaggcaagtcagaagtcgcttgggaatgccagaacactcagccttggaccgaagctcctgcccgcaagctgaatttcttcttcttccaggaaacctcagatctgctctaagtcctttcaactgattgactcaggcccatgcagggagttgaggacaagcttccttagtgaaagccagctggctgtgggctgtcaccacacagacaaactgcttcaccccaacaccaagattagcttgaaatggaataactggggcctgtcatccagccaggtggacccacagactcaccgcagcagagcacctagaggcggccacggagggttagtgacagagcagaatcaggcagggcacccgggcagggggcagacccagcaaaggctcctagggcagattgtagaagaggtccttggagatcagggagtacagcaacgtggctgtggcactattaaattaaattaaattaaattgaaaataaa

SEQ ID NO: 17956 - DNA, 29959 bp, Homo sapiens
cagaacccagggagggagcgcagggctgcccttgctaggctccagcaggtattagaaactgtcacaattgtccggcaggtaacagcataatcacattttgaatcaaaagtgttgttcaagctgaaatcctagtattcaccctcaattcctctgtttccctcacccgtacaacaatctctcaactcagtccatcagccctatctccaagcctccctcaagcctggcgcctcctcaccaactctgtggccatgccacagtacaagctatcatatccctcgcctacactgctgccatggtcttccacacctgcccccagaagccaggctcattcagccatcaaaattagctctttgacttcactgaaatgaaaaacgcttgtgctccaaagggcaccatcaagaaagtaaaaatacatctaatccacaccaccgacaaaaataaaaaaaaaaaacccacaaaatggaagaaaatatctcctggttatatatctgataaagagattttacccagaatatataaagagctcttataactcaataataaaaagacaattttaaaagctgggtgcagtggcacgtggctatagtctcagctacttgggaggctggggtgggaagatcgcttgaacccaggaatttgagaccagcctgatcaacacagcaagacttcatctcaaaacaacaacaaaagacaattttacaatgggcaaagtctaagaaacatttctccaaagaagacacacaaatgcccagtaaggccaggcacggtggctcacatctgtaatcccagcactttgggaggccaacgcaggtggctcacctgaggttgggagttcaagaccagcctggccaacatggtgaaaccctgtctctaccaaaaacacaaaaattaggtgggcatagtggcgcacatctgtaatcccagctactcaggaggccgaaggaacaagaatcacctgaacccgagaggtggaggttgtagtgagccaagatcgcaccactgcactccagcctgggcaacagagcgagactttatttccaaaaaaaaaaaaaaaaaaaaaaaaaaaaaaggccaataagcacataaaaagatgttcagcaccattactcatcagggaaatgcaaatcgaaaccacaaggagataccacttcatacccactagggtatgaacaagtgttagcaaggatgtggaaaaaactgtatacattgctggtgaaaaataaaatggtgcagccaccagtgggcagttcttcaaaaggttacagagttaccatgtgacccagaagttctattcctaggtttatgcccaatagaaatgataacatatctacaaagaatttgtagataaatgttcataatatcaccactcataatagccaaaatgtcaaaacaacctaactgtccatcaactgatgaatggacaaacaaaatgtgatctatccacacaatggaagcctgttcagcaataaaaaggaatgaagtactgattcatgctacaacacggaggaatcctgagaatattatgctaagtgaaagcaaccaggcacaaaacaccatatattatatgattccatgtatacaaaatgtctagaataggcaagctgtaggcagagtaggtcagtggttgcccagggctgggagaagaaggggttagggtgtattgctgaagggtacggagtttccttttagggtgatgagaaagttctaaaattgacgtagtgacggttgcatagctgtgaatacagtaaaaaccattgaattgtatataaatgggtgaactgtgtggcatgtaaattatatctcaataaagctgttaccccccaaaaaacaaaggaaaatatcagctccttcaaagagaaatcagaccatactacccattctactcaaaactcctcactggttgcccagtgctctaagaataaaaaccaaatgccccgtgtggtctaagccctttgcagctcccctgtcacctctctacccgtctccacttgtcctccaagttctagctccactgacccactctgtcccactcaggtgtcataattatttcctctatgcagaataaatgatctcactccatttatctggcttcttctcaactgtggggtctcagcttaaatatcaccaccacagaaaggccttctctgaccagatcactcaagagtacccaactgtcccttctttcctctatcatatgtgcttcataatcctcattacaacctctaattgctttatttgctaaaccatttaaaaatcatctctcctacaagaatgtaagcaacatgaattctctcttgcttaccaaggtaaatcctagtatctaataatagctttggcacagagtagatgctcagtaaagatttgttaacttcaggtcttactgcaaaacaatagtctcaatccaatttttaaaattgggctgggcatgatggctcacgcctgtaatcccagcactttgggaggccgaggtgggaggattgcttgaggccaggagttcgagaccagtctggccaacatggcgaaacccatctctactaaaaaatacaaaaattagccaggtgtggtggcgcacacctgtaatcccagctacttgggaggctgaggcaggagaatcacttgaacctgggaggtggaggctgcagtgaaccaagatcgtgccactgcactccagcctgggtgacagagtgatatttcatctcaaaaataaataaataaataaaaatataatgaataatgcttccttagtcatgactatttcagttaaaaaaatacaaaacaccaccctatggcatccttcaagttacgatgcttcctttccccactagccctgtcaatctcataaccctggaaggtggcagctagccttcactgctgactactaacacccaactgccacccagatggatgatttctcaaactggagctaggactaatatagagtctaagtcatccacttcgctgtacaataaccatgttatcagagtgctctgggtacactaatggtttcaggattctctccaaaatccctaggaagcaacaatttgtatccctattgtagaatctatgtttgaaatctggctacgacatctattaattatttgagtattaaattattaaggaggaacgtaatgagactgaggcagtcatttatcttccagacaaaattttgtcacttccttgctcccatccccattggctacccaatggtcacaagctaaagcctaacacaagcatggaaattagacactatgacaaaacagtctatatctaacttcatctcaggccactcttccatccacacactgtgcactccctaccctttagcaatcacccctctacacgcttcttctctcagccctgggcaaccactgatctcctctctgtctacagttcgcctattctggagatttcattaaaattgaatcatataatatgtggtattttgtgtctggttgctttcacttagcctaatgttctcaaggttcctccatgttgtagcacaaatcagtacttcgttcctttttattgctgaacagccttccattgtgtagacaggccacgttttgtttgtgcatccatcagctttccatcacagtccctgcacacaccataacctgtatgtctctgcagaacaaagtccctttccactcttccctattcccccacatgtgccctgtaagaactagtcctccgccaccaggaagccttcataaattccctcagatacttggttggtctttctctgctttcacagaactccatgatggcagttatcgcacagcaccatcattatctgttttctctccccttcaatggactctttctcatcttcacctatgttcttctagtctgtatactttgtggtgctttaaaagaccaataaagagtatggtacaatcaatgctcaatacacgtttgttgaatgaatctctctctcaaagcactgtgctagattcacccaagtatgacagccctaaatataaaatagtggcaaaaagtcaatagaactcttatgtccaggtccaaagaatacattcattttaaattgaacatgcatcttgagtaacagctcccttctaccttagcaattcgcaaagccatcaactactcccttctaattttactgatctctctgtgcattactgaatctagaaatctcttcgtgcttgacaccaaagcttttcattataaccctttcctgatctattcctcatcttcccaagttcaatcaactgcctctgcctgatgcctgtttccttccttttcttcccactaagttccagtagccatttttttcaactcctacagcggctaatatgaaatgaaattctccccaaacttaagtgtaacttctttaagaaaaaattggaaaaaaaaatccagtagatgccagtcttctattgaaaaagacacgtgggtataatatagctgatgcctaacaaaagctacttcctagtcactccttcagaagagggttatcctcattccatcttccccaccactggttttccaaggcagtcctgaaaattcaatttgtgtgtcccctacacctgcacttagttctcccttttaaagttcatgggccagaccatgatctttctgaggcagtgacctcaggaagggtctgtctggttcaccacagcatccctagagccagcctggcacagtgctggcacacgatggccaaataaccaccaatatgggacgtaagtcaggttaacaacaacaacaacaaaaataaggtcagaggtttatcaaggtacattatagctgggtgtgagaaaacacaaagtcctgcagcctaaaagaccaggaatcgctggtgatcacaaggagctacagtggcttcattcccagattctacctatgcctgggatttgcgttttgagatttcccagaactctgtctacaagaccttggctgcaaggaggcagtccacaagtgcaactggtcactccaatagatgagaaaaggatgcacccaggctggtatcccacattctgccaacacatggaacataagtcacagaacagaataaaattcctgaatcccaataagagaggaagaaaaaagtgcagggaagagaaatggaggtagagaaggagaaactaaagtcatgagaagtcagagacatatcagaagggactagagggcgagaacgcaggctagcacagatgacagcaggggctcccctttactgaaatgtacagcggcaggcaccgtgcttaactttacatgcactgacccatttaatcctcttaccaagccagaggtagaaactattctcatctccattccactggtgatgaaactggagcggagtgaggtagggcacttgccccagcacagagctaggaaggggccgctgggacctgcccggctctgactccaggacaccccatcctttaacacttactacctattctgcctcccatgccttcaaataggattgggaaaggagtcattcacttatccactcatcgaacactgaacaccaactggatgagtgtcaaggcctggggccaggcgccggtgggcggatgtaagggacgcgggctgcgagtgggggacagaacacgacgtcaatcttaaggcgaaggagcagagcccgcggccagaccggcagccgggatgcagggtggggccgggggccgagggcgcgggacgcgcagcggaggcctgaggaggggcgggcggcccctgttccccgctgcggaccgccggattctgcgggcggcgagccaggcgctccgtgtgttgtggcatttagtgtccgccactccgcgcgggcgagaccgcgggcgagggagacggggcggacgggcatggagaccctgcggggctgaggcaagggaagagtggcccgggggaggccgaggaggggctcggggccaggcgtcgggggcgtcgggggcgtcggggccgcttgcggcgtcgccggactcacctcccgcggcagcccctccggactcgtcggccccgccgggccggaggaggcgggatggactccgggccgcgggggctgccgggagcctgttccctgggcaacggggccggcaccggggccagcaccgaagagcagcagctggctccgccgggggctagagcggcagagccacaagtggcagcgggcggggcggacgtgacgcaaatgcgtttccggtggggtgggcggggcttcgcgtctccttctacggatatctgtggaccttatggaaggtgcgtgagatcggttcctttcccggggtggggtggctgtgaatgttactgcttaggccgcaggttggaccagaagctcaggagctccccggattacatgaggttaaatggaggtcctctgtcttaccccagcctagcccgcaggcccctcgcagcctctgcgagctgctcgggagacagttttgccgagcctccgttttttcacatgtgcagtgacagatgaacgggacgatatacgcaaatgagtgtcagcagatccgacatccaaattgtaattattgtcactataaattagtactaacagagttcactgggtaccaagccttgcatgctcatctcgtccagaaactcctctctgaactgccctcagtcagaacattctgcttgtaatgaaagctggctttcgcctagtgctcagtttgctgagtactgctccaagcactttaagtggatcatctcatttgaacctcacagtggtcccatgaagtaatgtcaaccccattttgcagatggggaatcgaggctcagaggggataagtaacttagccactgtgccctcaccctaccctgtcctgtgacgctgatgactggtctgtctttaccagcccttgagtttcttgaagtcagttatgtttttggttcctaaatatgtgccccgtatgagtcaggctgaccatgaatcagatgtgatcctgccctcagaatctcctgttggggggaaaacccttagacaattatagaacaggtggtaagagctattcctccatttacctcattttatgcaaagcctcctatgtgtggaaggtttgaaagagaacgagacatagttcctaccctagtcgaatttccagtttagcagggaatatagacattaaacaagcaaatacactccactggtgaatatcatgatagcagaattatagggtgtaccacatatctagtggtgagtcgtaacccaacctgggggatccaggaatacttctctgtggaaatgactttctaaaaacctaaatcagataatttcactgccctatccagagctcattgctcactccccattgtattaggttggtgcaaaagtaatggcaattttggctgttaaaagtaatggcaaaatctgttacttttgcaccaagctaatacttagaagtccaaacttcatttttttattttgttttgttttgttttgttttgttttgtttttgagacggagtctcgctctgtcacccaggctggagtgcagtggcgcgatctgggctcactgcaagttccgcctcccgggttcacgccattctcctgcctcagcctcctgagtagctgggactacaggcgcccgccaccacgcccggctgattttttgtatttttttagtagagatgaggtttcactgtgttagccaggatggtctcgatctcctgacctcgtgatccgcccgccttggcctcctgaagtgctgggattacaggcgtgagccactgccctcggtccaacttcttatcttggcctattaggttctagttgtctgatcacctactcacrcactagtccttttctgtctatttcattccagcacactggtttttttgtttgcttgtttgttttgttttgttttctgttttttgaactcaccaacctcattatcataattagggcacatactactgacctaccctatttctggcttttcatcattcaaatctcagcctaaacgacaccttctcaggggatcacactaacacaagaccctgttttattttccacacacacttaatcatgatctgaactgatcgtggtcatttgtttattatctgcctcccctttggaaagtaagttccatgaaaacggtcctggtccgtctcattcaatcacttcattcccccatgcctggcgtattgtaggcagtaagcaaatatttgttgtttaagtaaagaatgaatgataaatcaagatgatattttaaagtgaggatactaagtatgaggcaggggagtggggacacacacagataggaaaaatattccaggtcaaagtcagaacttgtacagagccagctctgatgcacagagggcaagtgggaaagggtagaagctgaagtggtgggcagagcttggatagtagaggcccttgagctaacaggtgagatactgggtttttgccttgtgcgaggcctcacagcttcacatatattatctaatctcagcaatcctatgaaatagatactatttttattcccattttacagatgaaaatgttgaggctctgaaaggtacattaagttgcccaagatctcacagctggcgagctggggttcagacgcaggcagtgtggtcttctgacttgaggcatcaaaccatccagctgttgtgtgtcctggattcctcaagaggactttatcctgtgggcagtgagaagcctttgtggggttcaaagtagagaaggcaagagggcacaggagggttcggggagaacaaacaacctgagttggctcttggtggtctgggggttgcttcctacaggcagtgggatccgggtgcatcttggaggatgggcatcgtgagcctgaggaaggaaggagctttcctgcagagagaacacgtgtaaaggcctgcaggcacctcagcttttcaagagctgccagtagttcattttcgctggatattgacggggggccaaggtgtgggttgatgtacgtgatgatgtggaggggtagctaggtctggaaggattttggacttcctcctgattaccaagaagggcagtggcagcatcgtgatcaactctgcatctctgttgtctcagtgtcttgaaatgattagcactcatgggccacgctactctgagcaaatttaaagtatcagagtgcctgagactagatagtggaagtactcgggagtcagggctagattatcctgtagggaagggaacgtgagccattgaagagttttagcagacagtcacaactttaccttatttccaatctttggaaaacaaagggcttaaggtaaaaactttgtggagccattaagctggaagaggattcagctmtatctggtgaattttaaaatgttaaaaatattctatattgtcttcttccaggaactttcacattcattcagactttgtagtttccacatttatttgtccagttgatacagcatttcagatagttttactgttgaaaattataaggacatttgccctccaactatgattgtatattccatgataataattttgtttcttttataccctatcagcaaagactcttggaactgtaacgcccagaaaacctgtcttatctgtcagtgcaagaaaaattaaggacaatgcggctgattggcacaatttaatcctgaagtgggaaaccctcaatgatgcaggttttaccactgcaaataatattgccaacttgaaaatcagtttattgtaagtacatattggtttttcatgctctaagtttttcacccttaataactggggaaataatgtgaataaattttaaaataaaatattaagcaaaaaaagcaagtggtaagatgatacgtgtaagtataaattgtattgtacattttaaatacaaaattatattccatatatatatatatatatatatatatttagttatttatttatttatttttttggagatgaagtctcactctgttgcctaggctggagtgtgatggcgcgatctcagctcactgcaacctctaccgcctgggttcaagcaattctcctacctcagcctccggagtagctgggattacaggcgcccgtcaccacacccagataatttttgtatttttagtagagacgggctttcaccatgttaggctggtctcgaactcctgaccttacgtgatccacctgcctcagcctcccaaagtgctgtgtgagccaccgtgcctggctattctgatttttaaaaccacagattctttgattcttttgtagttcataggcataatgattgggttttcatgctcatgtatgacctgtgccttcctcaaactttgctatgatgttggcacattacctagctgatatggaaaaaactaccatgaattcttttcatccatttttggattttacgtaaacaaaaaacatatgttattgtttcctttatatctcactttctttttctattttttattttttatttttggagacgagtctcactctatcccccaggctggagtgcaatggcgtgatcttggctcactctaacttctgcctgtcaggttcaagtggttctcctgtctcagcctcctgagtagctagaattacagatacctgccaccatgcccggctaatttttgtatgtttagtagagacagagtttcaccatgttggccaggctagtctcaaactcctgacctcaagtgatctgcccaccttggcctccctaaatgccggtattacaggcatgagccactgcgcccagccatgtctcactgtctttcaacatggaagccatgcgtgtaatgtagagccactattctggttctgttctttctcattgctgtttaatagtgtttacccacattagacctctcacactggtttatcaactaagttatataatattctcaatcttttgttgtcatttcaacagtgtgcacagtgtctttcccaggaatagattccatctcaagaaaccaccttctttgctcatccataagaaacaattccttatctgttcaagttttctcatgagattgcagcaattcagttccatcttcagaccccacttccagttctggttctcttgctttttccactggcagagtagatttaacatcattcttaagggccctaggaatttgagaatggtaaatgagcattggattcaacttaaagtcactaactgcaatatcccctaataagagggtgagcctgtctcttgaagctttgaagcctgtcattgacttctctgtagttgtgaatgtcttggatggcatgttcttctaatagaaggctgtttcatctacactgaaaatctgttgtatcatgtagccaccttcatcactgatcttaagtagatcttctggataacttgctccagcttctacattagcgcttgcagcttcaccttgcacttttatgttatggagatggcttttgtccttaaacctcatgaaccaaatcctgctatctcaaacttttcttctgtaacttcctcatatctctcagccttcacagaattgaagagagttagggtcctgctgtggattaggctttgacttaagggaatgctgtgtctggtttgatcttctatccagaccactcaaactttctccatatccacactaaggctgtttcactcatcattcacatgttcactggagtagcacctttaattttcttcagtaacttttcctttgccttcacaacttggccaactgtttggcacaagaggcctggttttcagcttatcttagctttttttttttttttttttgtagagatggagtctcgctctgtcgctcaggctggagtgcaatggtgcaatcttggctcactgcaacctctgcctcccgggttcaagcaattctcctgcctttgcctcccaagtagctgggactacaggtgcacaccgccacgcccagctaatttcttttgtattttagtagagacggagtttcacatgttgcccaggctggtcttgaattcctgagctcaggcaatctgcccgccttggcctcccaaagtgctaggattacaggcgtgagccaccgcacctggccccttatctgagcttttgacatgccttcctcactaagcttaatcatttctagcttttaatttttttgtttcttaaattggccaaagtatagcttttgatttaaaatgagagatatgcaactcttcctttcacttgtacacttagaggccaatgtagggctattaattgggttgatttcagtatcctcctatttcagggaacagggaggcccaaggagatggggagaaaggggagcagccggtcagtggagcagtcagaacacacaacatccattcattaagcttgccgttatatatgcacatggttcatggcacctcaaaacaattaaactagcaatatcaaagattaccaatcacagatcatagacataataatgaaaaagtttgaaatattgtaagaattaccaaaatatgatagagagacatgaagtaagcacatgctgttggcaaaatggtgctgattgacttgctctacatacagagggttgccacaaaccttcaatttgtaaaaaatgcattatctatgaaactgaataaggtgaagcacaataaaatgaggcgtgcctatattcctggattgtgaactctttgaggaaatgatccatgtcttattcatctttgtacatccagcaccatgccctatgccaaggatgccacaccgctgaatggtgttttttttttttttgagacagtcttgctcttttgtgcaggctgagtgcagtggtgctataatggctcactgcagccttgacttcctgggcttaagtgatcctcccacctgagcctcctaagtagctgggaccacatacgtgtcccaccatgcccagctaatttttacttttaatttttgtggagatgaggtctcacygtgttgcccaggctggactcagactcctggactcaagcagtcctcccgcgtccatccctcaaagtgttgggattacaggcatgagccaccaaaaccggctgtcacatggctgaatttaactgacttattttggtgcaaaattgagtgaccaatggacatattcattgcacatataaataataactgcatttgtatcataatgatatgaaagaacaatgcttatgcaaaatgtcccacgtaactatgtggatatagaggtttgtagaatttattataaggaaataaggcaagcttaaagagtatattttgtacacattattttctattttgtttaggaataaagacaagatagaactagacagcagcagcccagcctcgaaggaaaatgaagaaaaggtgtgtctggaatataacgaggaactggagaagctgtgtgaggaactgcaggccaccttggatgggttggtaagacataaagacgcaggccacttgtggtcactgtcactgaatccgatggacgtatttggggtttgcttgaccattggccatcacttactccttctcagtctcctctgatgttctcttcctctgcctgctgcgtaaaccttaatgttccccaagatgctgtcttagacactcactcctcctgtgcgtcatccggggaaatgtcacccactttcagggctcatcacatagtaaattttttttttttttccatgatatggagtcttgctttgtcgcccaggctggagtgcaatggcgtgatcttggctcaccgcaaactccgcctcctgggctcaagcgattctcctgtctcagcctccagagtagctgggactacaggcgtccgccaccatgcctggctaatttttgcatttttagttgagacagggtttcaccatattggtcaggctgatctcaaactcctgacctcaggtgatccacctgctggcctcccaaagggctgggattacaggcatgagctaccacgcccagccacagagtaaatattttaggcttccagggccagccagtctctatctcagctactcatctctgccacataggactaaacagccatagataatatatgcgtaaatggatgtggctgcattccatgaaaactttatctttgttttttggattttctttttttttttttttgagatggagtctcattctgatacccagggtggagtacagtagcatgatcttggctcactgcaaactccgcctcccaggtacaagtgattctgctgccttagcctcccaggtagctgggattacaggctcgtgccaccacatgagctaatttttgtatttttagtagagacagcatttcaccatgttgaccaggctggtctcgaactcctgacctcaagtgatcagcctgccttggcctcccaaactgctgggattacaggcgtgagtcaccgcacctggccttttttgtttttgtttttgttttttttgagacagggcctcactctgccactgaggctggatggagtgcagtggcgagatcttggctcactgcaacctccgcctcctgggttcaagcaattcttgtgcctcaaccttccacatagctgggatcgcaggtgtgcgccaccatgcccagctaattgttgtatttttagtagagatggggtttcaccatgttggccaggctggtctcgaagtcctggcctcaagtgatccacccacctcagcctcccaaagtgttgggattacaggcgtgagccaccatgttcgtccaggaaatctttatctttggacaccraaattagaattttgtataatttttatgagtcacaatcactattgtccttttggttattttcaaccatttaaaaatgtaaaaaccatcttagcttatgggccatacagaaataggctatgggccagaattgacctgtgttccagggatagtttgcccatccctgatacagcacgtaagagactaaagtgtttgtttaatgaactaataactaaatttcaatacctaccatactggccaccagatgtgaagataacaccaccttatttctttgctaggcacaggaaatcaggttttacacatatttgaacttggataactgaagcttacccataaacatttaagatctttatattttcacctttttgtttgtttggagacaaggtctcgctgtggaatgcagtagtatgatcacagctcactgcagcctttacttcctgggcttaagtgatcttcttgcctcagcctcccgagtagctgggactacaagcatgaaccatcatgcccggctaatttttaaaattcgtttgtacagacggggttctcatgttggccaggctggtctcgaactcctgacatgaagtgatcttcccaccttggcctcccaaagtgctgggatcacaggtgtgagccctggcgccctgccttagcttttccgtcatgtcttgttttggcttcaggatcctgtatgacatcgagtccccttgtttcctcaggctccttttggccgtgacagtttctcagacttccctgtttttgatgactttgacaatgttgagggatactggtcaggtattttgtagaacatcatgagatttatctgatgtttttctcctaattagactgaggttacgggttttgttcagaggaggaccacagaagtaaagtgccatttctatcatgtcatatcaagggcacgtactggatatactgtcatcaggacttttctttgggtcccacctattgcccgggctggtctcaaactcctgggctcaagcagtgctcccacctcagcctcccaaagtgctgggattccaggcgtgagccactgtgcacagccaggactttccactgctgaagttgaccttgatcacctggctgggcagtgtttccaggttcctctgctgtgacgttgctctttctcctcctcccacgctgtgctctttggcaggaagtcactatgcatagcccacacctgggggtagggacgtattcaccacctgcttgagggtgcagtatctacataaattatttggaattattctgcgtgggagatttgttccctccctcccatttgttaattttttttttttttgagatggagtttcactcttgttgcccaggctggagtgcagtggggtgatctctgcccactgcaacctctgcctcctgggttcaagtgattctcctgtctcagcttcccaagtagctgggattacaggtgcctgccaccacacccagctaattgttgtatttttatttgtttttttttaatttttgttttggccaggcgcagtggctcatgcctgtaatcccagcactctaggaggccgaggcaggtggatcacctgaggtcaagagtttgagaccagcatggccaacatagtgaaaccccatctctactaaaaatacaaaaaattagctgggggtggtggcaggtgcctgcaatcccagctacttgggaggctgaggcgggagaatcactttcggaggttgcagttagccgagatcaagccactgcactccagtctgggccacagagtgagactccgtgtcaaaaaaaagaaaaaaagaaaaagaaaagtggtttgggaataagttctcattctatgttcaaaaccaaaagttgattttatagggtattattatttttcctattttcctctatccgttatagagaatggtttccagacctggtctgtgtctttcataactttgaccttctgggggtttcatgcaccgttcttcctaagctgggctaacatttcactgtggtctgtgtttgctgtgggaagaagccaccgatgttgaaatgtaagggcctgctgtttatgcactgttcattcagggctgcacgtgcctatgtgacttgaattctttattgatggctgagctgcaggattgagcatgacttcttgcctggggtcaaggctccagaattttccttagtctcctgttatcagcttttcttagaatcaggtggcaccagggagctgctgcaggactcacaggaaagagcagaggattgggtgttaaaacttggtgtcggctgggcgcggtggctcacgcctggaatcccaacactttgggaggctgaggtgggcggatcacaaggtcaggagatcgagaccatcctggctaacacagtgaaaccccagctctgctaaaagtaccaaaaaaattagccaggcacagtggcgggcgcctgtagtcccagctacttgggaggctgaggcaggagaatggcatgaacccgggaggcggaggttgcagtgagcggagatcgcgccactgcactccagcctgggtgacaaagcgagactctgtctcaaaaaaaacaaaaacaaaaacaaaaacaaaaaaacttggtgtcagaaggcatggtatcgagttctggcctcatccttcctcagctcaaccttaagcaatttcccagctgtgaaacggaaatgacaagtcctgcctcttggggttgggccaaataaaatatcaaaccttaaaagatttgggaaactacttaagtaaagtcctttaaaaattaacgttagctgaatttagtgcttgccacttccaatgtaattggagggtggttggaaggaccaagtaaaggaattaagatatttgacaatttatatatcttttcttatttcccctttttcatatttatgtatgtaaagtcaactatacttaggagttcaaaatttggtctttatagacctatgctacttaaatctgaaatcctagttacttcacccattaattttctttatccaacccttatatatctccaagtaggtgcttcacaaatactaactcacttaatcctcttcaccaagctgtgaaagtaagcccgccattgcccctattctgtgctgcctggtgtgtgcagtggggttggtttagtgtctcccacaagtagccatacacatcatgcagttacagggcttaggacagagcctggtccacrctgagggaccgtcaatggcagcttgccacgtttccttcctttctgcgtgaagtgtgtagggctccctttctgtgttgccattttataaacaaggaagtcaaggaggtttccgtaaataaaggcagttaataagagagagtcaggcctggtgcggtgtctcatgcctagaatcccagcactttgggcggccgaggtgggcggatcacgagttcaggagatcaagaccagcctggccaacatggtgaaaccccgtctctactaaaaatacacaaattagctgggcgtggtggcacatgcctgcaatcccagctacttgggaggctgaggcaggagaatcgcttgaaccagggaatcagaggttgtagtgaaccgagatctcgccactgcactccagcctggcactgcactccagcttggcaacagagcaagactccgtctcaaaaaaaaaaaaaaaaaagagagagagagagaacatcagaaacgagctcatttgatagagagacagagagcctcagaaacgagctcatttgataaaagagagagagagagagcatcagaaacgagctcatttgatgcctttctctctcacttcttaaaagcagcaagagccagccaggcgcggtggcgcatgcctgtataatcccagcactttgggaggctgaggcgggaggattgctggagcccaggagttagagaccagcctgggcaacataacgagaccctgtctccacaaattaaaaaaaattagctgggtgtggtggtgcacacctgtgatcccagctacttgggaggctgaggtgccagcggttgaggctgcataaggcatgatcatgccacacagaatgagaccctgtcgcaaaaaaaaaaagaaaaaaaaaaaaaggcagcaagagcctgccttgggattcctccaggtctttgggtctaagacattaatgctgtttggaaatcctagtgaaatggcactcggaaacctttcttgctctaggactggaaatctggggtttattaccaaagtcattcaaattaatgaaatcatagcaactgtccaccttcatctccctgggaatttgctgtaygtagagttaacagtgtttagttattggaatttttatcataatagacttacacttcttagctttgaaatcttagagttattaaatctgagactggagatttcaaataatattatcatattccaaatggatatctttcagaccaaaatacaggtgaaaatggaaaagctgtcttcaactaccaagggaatttgtgaactagaaaactaccattatggggaggagagtaaacgaccccctctgttccacacgtggcctacaacccatttctgtaagtagttccttctcagttgattttcaggagggtaaaggttattaagggcatttagtatcgtttacatctggtactttaagaagctgacaaggctttcaaattcaatgcaaaagtatcgggaggaaaggagacagaggcatcttaaacatttcttcttggctttaattacctggttatcagcagagtatatgaaacatagagacccgtgaagcaagctgctgttattaggcctctaaaaccaatgggcagagtgaattccacctcctctgtggaagcagatatctctcattttgagggggggaaaggaagaaaggagtttttttggtttgttgaggtttttcttttgttttttgttttaattaaaaaacaaattgagggtcactgcagccaacctcatggaagatgactgggaaaaatgaaacccatggcttcagtaaactctatgaggcgcttcttaaagggttacttttagcttttattagttcaagacaagggtaagctatttgatgttgacctgagactttttaaataaggcaggaaagggtaaaatcacctagtggaatgtgtttagtgaaatattgtcagtttgaggggaatctcctactgataatcactgtaggtcacctaagagtcaagtagaaaaggttatatatactttttttgagacagagtctcgctctgtcacgcctgctggagtgtagtggtgcaatcttggctcactacagcctccgcctcccaggcacaagcgattctcgtgcctcagcctcccaagtagctgagattacaggtgcgtgccaccacacctggctagtttttgtattttttagtagagacaggttttcgccacgatggctaggctgttctcaaactcctgaactcaggtgatccacccacttgggcctcccaaagtgctgggattacaggtgtgggccaccacgcccggcttgtatacactttttatttcactctgctgaccatgttatcaaattgtactaatctgcaccagctagagtagtaaactccatcgggcccttcttcccctcagtgctgttgctgattctggtttttaatcaagagctgttaaaatgtagttcttcccaagtcgacactatgttcttgaatcactgccattaagggagattcacgtttctttcagatgaggtttcgcataagctcttggagatgtacaggaaggagctgctcctgaagcrcacggtggccaaggagcttgcccacaccggggatcccgacctcaccctgagctacctgtccatgtggctgcaccagccctatgtggagagcgacagyaggctgcatctggagagcatgctgctggagacaggccaccgagctctctgacgtcctgagacggctgcggacactggctccttccacgtctcaccaggcagacagtctgcctaggacccagtgccgcaggcctggatcagaccccaggatcagacctyggggtcttctggccagagcttgtcaccagccccayggcctctccaggsgtgctcatgcccacaacccgcggccagccccacgtggtgccgctcagccttytctgcccctcctgggaatctgtcattcgtgggtgcttcagagtaaaatcaatgagtttctgagcagaatgagtgagtgatctagtttctataaattaggcatgctttatacattatgtttgtgtagaaaatccctggtttaatatttttactttatgcctatctgattgttgaagtttttatgagactatattagtttttgggccaggtgcggtggctcatgcctgtaatcccagcactttgggaggccgaggtgggcggatcactttaggttcggaattcaagtccagcctgaccaacatgatgaaaccctgtctctactaaaaatacaaaaatcagctggcgtggtggcgcgtgcctgcaatctcagctacttgagaggctgaggcaggagaatggcttgaaccgggaggcagaggctgctgtgagccattgcactccagcctgggcgacagagtgagacttcgtcttaaataataagatcccatggagttaaaatgaagtttgacatcatgaaaatgaaaataacctacaaaaaaattgccgctgtttgcatactggggacatggcaagcgatgtaaactgccttccctggcattcttctgacacaaatcctcgagtttcacaatgtttgcagccatttccagagttaacatactaggttagaatgagggaaaggtgacagttttgaaacagaccgaagagactggccaaaagctagggcatggggagaatgtgaaggtatgcaaaagcctacttttttttttttttttaatggagtctcgctctgtcaccaggctggtgtgcagtggcacgatgtaagctcactgcaacctccgcctcctgggttcaggcgattctcatgcctcagcctccagagtagttgggactacaggcacgcgccgccacacccagctaatgtttgtatttttagtagagacggggtttcaccacattggccaagatggtctccatctcctgacctcgtgatccacccaccgcgccctcccaaaatgctaggattacaggcgtgagccaccgcgccgagcctgcaaaagcctaaactcttttttgtggcattacttgttacatggtttctacatctgcgtttgcctttttgtaagttctctgatcccaaactgtttatattctgtgggactgtgtatagagtgatacttaataaacagcagttttagttttttggtttttatgagataggctcttaccatgtggcccaagtagtgtcaaactcctgaggtcaagtgatcctccctacttagtctcctcagagactacagtcatgcactgcccagcccagcaataatgttgttggtgtttttagatacagggtcttgctctgttgtccaggctagaatgcagtggcatgattgtagctcactgtaatctcaacctcaaactcctgtgctcaggtgatcctcctgcctcagcctccagagtagctgggactgtaggtgtgcataaccacgtccggctaatttttttatttttactttttagagatgggggtcttactatgttgccctggcttgccttgaactcctggcctcaagtgatcctcctgcctcggcttcccaaagtgctgggattataggtgcgagccactgcacctggccaagtatagtttttaattgtgtcattttagtatttaactataaatactatttatctaagtttattaagactattgtaactttatttattttttgagacagagtctcgctcttgttgcccaggctggagtgcagtggtgcaatctcggctcatcacaacctccgcctcccgggttcaagcgattctccccgctcagcctcccaagtagctgggattacaggcacctgccaccatgcctggctgatttttacaggcatgcgccaccacactcagctaataccgtattttcagtgagatggggtttcaccatgttggtcaggctggtcttgaactactgacctcaggtgacccacccgccttggcctccccaagtgctgggattacaggtgtgagccaccgtgcctggccaaaagcatttaaaggcaacatttcttaggatttctctttcctctgcctttgctatatttattaagatctgactatcggctggatgcagtggctcatgcctgtaatcccagcactttgggaggctgaggtgggtggatcacctgaggtcaggagtttgagaccagcctggccaacatggtgaaatctcatctctactaaaaatacaaaaattaggctgggcgcactagctcaatgcctgtaatcccagcactttgggaagccaaggtgggtggatgacctgaggtcaggagttcaagaccatcctggccaacatggtgaaactccatctctactaaaaatacaaaaattagccgggcatggtgctgcatgcctgtaatcctaactactcaggagcctgaggcaggagaatcccttgaacccggaaggcagaggctgcagtgagccgggatcgtgccactgcacttcagcctggtgacagcgagactctacctcaaaaaataataataatgataataatatgacctggctaggcatgagtcattacgggctcacacctgtaattccagcactttggtggctgaggcaagcagattgcttgagcctaccaggaggttgagaccagcctgggcaacatctacaaaaaatacaaaaaactaaccaggtgtcatggtgcatgcctgtggtcccaactactcaggaggctgaggtagratcacctgagcctgggacattgaggctgcagtgagccacgactgcaccactgcactgcagcctgggtgacagagcaaagccctgtggaaaaaaaaaaaaagtgcctcagagggcattaaagatccactctgccctggctcctttctttcctgctggttcagctctccccactcctgtgaccatttgggaggtgccagggctgcagtgccgtgggtgcctgaccaggggtacccaaccagggttgcagccacaggaatcctcatggtttccagggaacacaagggaattttctttctttgcctttagtaataataactgaacatggaccaggtgccagggatcatgacaaatgctgaaaccacgtgtcctcattgaagccccagccagccacccctgggagtcatttgggtgtccttgtcccccggtctgtactctaatgtctcttcacacttgctcttaatctgagtatttgaaattaaaagtactatgtatacaaaacaaagttcttcatgagaaaaggaaatttccatttatcattctttcataaataaggttatgtctgtctttttttctttctttttctctacaggtgtgcactaccatgctgggctaattttttttttttaatttttagtagagatggggtctcacggagttgtccaggctggtcttgaacacctgggctcaagcgatcctcccgcctcagcctcctaggttacgtctattagaagggggttgtaatgtggaagctgtgcatacatctgtctctatgctgtattggggaactctgcaaaggccaagctggaagagaggataaggcacagggctcccaaagagtagggcccatgagtccccctcactgccgtcagtcctgtgcctggcacacagcagcactcgacaggcacgtggccgattcatgaggacactgctctcagagcctcctgtgtcttcaattctgtctggtggaacaaaggtttatttgttgtaggttttttttacatcagttacattgaccatccattcatagtagcacatacacagtggtgaaactaagatgtgttgggatattcactagtgtcctatagatagaaaataaatgtatatttaccagggcctcatccagaccatggtcatactcgagtcagcatgttgtgtcagttacctgacagtggttatgaatgatcctcagggctcttgtctccatctccaggatcccaggagggcactcatggtggtttatgggactctggactcctgagaagcggccttgagtctacaggatacatctacagcctgacctgaccacccaacactcccaggcagccgcggcttgctcccctgctggccatttccagcctgctagaaaacccacctttttgttcctaccgaccgtggctttgagatcaagtgagggtaggaaatgcccctggtcactaaaagggctgtaggaaaggctggctctctgagaatacagctgccctccagggcaggacctggaaggagcacagcgccagggcgacacatggtcacaagcccagctctgtccctgagcagcgtgctctctgcttggggtctctcctgaccgtctctgcaaggcgtggggagagacctgctgctccctttgaatgctttcttccacatgtggacaaatggcccttcccttccttccccgtaacacagcccacggaaatattgaagacatgccactaagtgactttccaagtgggacatcaaagaactgggcttctaccctgagcagcatcttgctgtggacctcaagtaagtcaccccatcatttatgcctcaccttcctcatctgtaaaatgtgaggagagccaggcaccgtggcgcacgcctgtagtcccagctactcaggaggccgaggcaggaggatcgcttaagcctgggagttaaaggctgcaatgagctatgattgcaccactgcactccagcctgggcaacagagtgaaaactcatctctaaaaaaaaaaatcaggccggggccgggcacagtggctcacgcctgtaatcccagcactttgggaggccgaggcaggcagatcacgaggtcaagagatcgagaccatcctggccaacatggtgaaacctcatctctactaaaaatacaaaaattagccgggtgtggtggcggacacctgtagtcccagctactcggcaggctgaggcaggagaatcacttgaacccaggaagcggagggtgcagtgagccgagattgcaccattgcacttcagcctggcgacagcaagactccatctcaaaaaaaaacaatcaggcccagtgcagtggctcacacctataatcccagcactttgggatgctgaggcgcgtagatcacctgaggtcaggagttcaagaccagcctgaccaccatggagataccccgtctctactaaaaatacaaaatgatccaggtgtgatggcacatgcctgtaatcccagctacttgggaggctgaggcaggagaattgcttgaaccctgtggtggaggttgcggtgagccaagatcgagccattgcactccagcttgggcaacaagaccaaaactccatctcaaaaaaaaaaaaaaaaatcattggccaggtgcagtggctcatgcctgtactgtaatcccagcactttgggaagctgaggtgggcggattgcctgagctcaagagtttgagaccaccctgggcaacatggtgaaaccccgtatctactaaaatacaaaaaaaaaaaattagctgggcatggtggcatgctcctgtagtcacagctactcaggaggctgaggcacgagaatcgcttgagcccaggcggcagaggttgcagtgagccaagatcgcgccactgcactccagcttgggctacagagtaagacttggtctcaaaaataattaaattaatttaatttaatttaatttaaaaaatcatgcaagtagaaatgactttttcccccttctatcaataaaatgctgcccagaatgactagcttattttctttttaattgaacccaaaagaagcttctagtatggagcaagtctggtggaaaagcagcatatctcccaggagagaagggaaacggagcagggccaatcatcaggtgacagtgcagtgctactcatcaccatcatgaaaaactcatgagcgtcagacgcgccacagggattcctgatcaggtaatatctgctattattatgacaagctccatagaaaaatgtagacagcagggcagaaagacattattctttataaataaaaggttcatctgtgcaatattcacattagaaaaatatacattgcttgccatagaccttctctggataaaatcagacgaatctaggatctgactccacttcactgtgagggctctggctccacggtgacgaccgactccacagcttctagaggaactccttctagcgggcccatccgcaggcacgcccctctgcatcagtcactgtgacaatgtcctcctcctgagacactattgtacctggaggggacaagataagcccatcggaagtctgaataaaaatctgcttctgtccctgagacagtaactcatggctcccattggaaatttcaaaagccatggcttcgccgacagcaaccacgctctccagttctctctggccagagtgcacctccatcccacaggggaaccggttcaagtcccccgaaaggcttctgagacacccttcagtcaatagtgatccatgtgggccaggctgaggccctggcttgggcacagtcctgtaggcacagtccactgccacgctatccacagacaaaattttctcaagcggaggggctgccacctctgtaggcaggacgctggtggggctgggctgctggtggttcaggtggaagtcacaaaccttgccgaggtgtcctgcctctgcatgtccaggccccccaggcggcagggactctgctccaccaccagatgacaaagggctgcagaaacccgggctcctcaggctgtcccaggtgtcctggtctgaagagtgttccaaagcattctctccaggaaacgctgccacctgtgcctgggtcagcctcctaggctctcctgactgagcataaacaggcagcccactgacatcccgggatgagagagcagcacctatagaccccctcctggcttctaagttagccagtgcctgaagctgcgggcccgcctggaacacgctcccattgccaccagaaaccgtcgttgtatggctttcttcagaacggggagagacagtcacatttactggaggggaaaaacctaaacattttgggaaacaggtgaacatggcgtgtactgtgtcatggcccactcactgcactcaccacccaaaaccagctaggccaagtcacctgccctgcagaaaagtcaaagcatcgatgctccttgctccttgggattggtagcaattttaaaaaatacgtccctattctctattcacaaagacagattttgtattaaaaatatgctctaagagccaatcgacagtgtgcttttttttttttttttttttgagatggagtctcgctctgtcacccaggctggagtgcagtggcacgatttcagctcactgcagcctccacctcctgggttcaagcaattctcctgccttagcctcctgatagctgggattacaggcatgcgccaccatgcccagctaatttttgtatttttagtagagacaaggtttcaccatgtaggtcaggctggtctcaaactcctcaccttgtgagccacccgactcagcctcccaaagtgctgggattacaggcatgagccaccacacccagcaacagtgattttatgccaatactgaatgaatgattggtgattcttcatcagagtgagctggagaatcacccaaagaggcctttccaaatactcacatccacaccctcccaacaaccctacctgcagacctggaattcccagaggtccaggcccctgtatttcacaataacctccccaggtggttccaacacatgccccaattaagaatcaccatcaggctgggcacggtggctgctcacgcctgtaatcctagcactatgggaggctgaggcgggcagatcatttgaggtcaggagttcaagaccagcctggccaacatggggaaaccctatctctactaaaaatacaaaaattagccagatgtggtggtgggcgcctgtaatcccagctactcaggaggctgaggcaggagaattgcttgagcctgggaggcagaggttgcagtgagcagagatcatgccattgcactccagcctgggtgacagagcaagactccatctcaaaaaaaaaaaaaaaggctggcgtagtggctcatgcctgtaatcccagcactttgggaggccgaggtgggcagatcacctgcagtcaggagtttcagaccagcctgaccaaaatggtaaaaccccatctctacaaaaatacaaaaaaaaattagccgggcatgatggcgggtgcctgtaatcccagctactggggaggctgagtcagtagaattgcttgaacccaggaggcagaggttgcagtgagccgagattgtgccactgcactccagcctgggtgacaaagtgcgactcccgtctcaaaaaaaaaatttatatatataattttttaagtgcctagttgataggttctggctagagccagaataaaagccaggacctgtcttgttttcaaatgttaaatctcagctggcatgtacagcgaagtctcatgaaagccaagccatagatggatgtgtcctgggacccgtctcagcctaacctcttgggaccctcctggtatagcctgtttactaccatttggtggctctccttttttttttgagatggagtctcactctgttacccaggctggagtgcagtggtgcaatctcggctcactgcaacctcctgcctcccaggttcaagcaattctcctgcctcagcctccgaagtagctgggattacaggcacacgccaccacacccagctagttttttttgtatttttagtagagacggggttttgccatgttggccaggctggtctcgaattcccgacgtcaggtgatccgcccacctcggcctcccaaagtgctgggattataggcgtgagccactgcacctggcctgtggctctccattttaacaaggcactctagaaaaccctgaagacctcaagactcgcagggaatgaatctggaatgacagaacactgggaggctggaatgaaacttgagaaaccagagggtccccttaaatccagcacaggtcacccaacctgaaaaatggcaatcctgggtacatctgtgcatgtcagcagggctgccaggccatggatacaccccacaaacagcattttaccctcaccagcggccaaagcatgcaagggcctgggcttctcccggcctctgctgttggcagcaagagattcagtggtatcgttggacagggcttctcttctgggccttttcactgaggccagtccc

SEQ ID NO: 17957 - DNA, 37021 bp, Homo sapiens
tgtactactctggtagagtatgttaatggaggagtatatacagctgtgggggtaggaggcatatgggaaatctgtgtactccagtctatttgatgtaaacctaaaattcctgtaaaaattaagatctattttttaaaaggggaggagagaagatctgtccctttccagatggtgaggcaataatatttgtattacaagagtcacctctggccttgttttcagccatgtggaggaagtcagtctgagataattagcttgagatataaagagaaggatagaaaaaagatgaataagagaagagaacaggaaagttggggagggggaaagatagagactcttaagagcattggagtcctgggtttctattctgctgagaggcccagatgaaacttctacttttcatgttttggttataagaatcaacaaattctccattttcctcaagctggcttgagttaaatttctatcacttgcaaccaaggagttctgaataacatacactgcaagccgttgtgggccacactgttgccttccatctgggctccccatacgtatccttgctctcttgtactcaattctcaaacttcaatcagaattatcttcttaaaatgaaacatctaaccctcaaaatgaagtcctcaatcttaacataccttccaaggccttatgggatctgacccctaactacctctcaaacttcattttgaatcattctgttatactccacgcactaaccaaactgttttcttctgtttctccagcatcggccagtccagaaagattttacttctgtgcctccctgcattgccctcctttcccaccttggctaacttcaattcatctgtaagtgccactttaggaggcttaatctaacaccctgaacctggaacataaccttaaatgctccttatcatcacccctttaattgctacttgtttaaagttgttagactttaagttccatcaaagtagaaacttgatctgccttgctcacctctcaatcacttccccttcccaacattcagtgactggaacagaggagatgcatattagtatttgctgaattaaaaataaattttgaaatacaaattagttgccgttttccaattatcaaattgtcaaagtgttctttattatgataggtaacattggtagagatctttcactcactgatgatgaaagtataaatatttcaatggcaattaagtagtaagcataaaatctttaaaaatgtatatagtcttaagacttatgtatatagtcttaagactataaagtcttaagttattctttttagaataacaagaaaaaaattgacaagagattgtacaaaggaatattcaccacagctttgttttagtaaagtacaaaaaaaaagagagaaaaaattaaatgtccaatattatggaattattttatacaaatacaataagaataaaatatggttatttaaagttacaaggtaaaacattattaatatggaaaagtattcatagcatgttctttaaaaaaaggcacacacaaaaatgatctgaatggcacattactttaaattgacatgcaaataaatataaattaaaaagtaatgtttcaggccgggcacagtggctcacgcctgtaatcccagcactttgggaggccgaggcgggtggatcatgaggtcagaagatcgagaccatcctggccaacatggtgaaaccccgtctctactaaaatacaaaaaaaattagccgggcgtggtggcacgcacctgtagtcccagctactcagaaggccgaggcaggggaatcacttgaacccaggaggcaggggttgtagtgagccgagatggtgccactgtactccagcctggtgacagagcaagactctgtctcaaaaaaaaaaaaaaaaaaaaaaaaaaaaaagtcatgtttctctgggaggtgaaattagattgatttttattttaatagttttcttacatatatttctgggtttttttaataagcatatactgcgtaacttaaaatctcttgttacttagtgttataaatgaggaactagagattcagatatattaatttgctcacagcaacaacacagcctgtattccaacccagtttgtcagtctctaaagccctggctcttaaccatcacactgtaataacatggtgcctaaatgtgtacaaggcactatggggaggcactgagtaaataagaagttagcagcttggaagccaatagataagaaatatagacaaatacgtgacatggcaaaatgtgttttgtaacctgagaggtacaagcatggaggtcacaaagttcaatgtttgcttggaataaaaaacaagtcagttgtcctgttttactagtgcagtttctccaagtgtggtctatagtccacctgcaacatattcctaaacagacctgttaaagaaaaatctccatgcagctcaagaaagttcaaattacctccaggagcatcatacatttggtgccttgcattttttttagatgccttataatacttataaatactactagtaaaattttaggacaggcgcagtggcttgtgcctgtaatcccaacactttgggaggccaaggcgggtggatcacctgaggtcaggagttcgagacaagcctggccaaaatggtgaaactccatctctactaaaaaatacaaaaaattagccgggcatggtggtgggcgcctgtaatcccagtgactcaggaggctgaggcaggagaatctcttgaacccaggaggcagaggttgcagtgagccgagatcacgccattgcactccagcctgggcaacaagagcaaaattccgtctcaaaaaaaaaaaaaatcataaaaataaaaatgaaagtttaggaatagaccattattgaagggaatatacagtgtgccaagaccaggctttgttacgtttctaaatatctgaggtcagataaatactacacaagctcaccaacatcccctaatcctttgggtcccagtttagattgactttgaaattgcccttaggaggacttttcctgaatttcaaagaaggttaacagtgtgtggcataaacgaaatctcggaataaaatctgaaggacagattgaaaggaattcaagatgcctccagggtctcatactctcatggaaaatatcaaacacccaattgcatcacccccatactcactcaaaaggtctactattttatttcataggttgaaaggttagaattggatctcaccaagcatttcactacagaccaacatcccctaaactgaactgatctctggaaatgcgaagagaggaaaaactaggacaggtggacggcagcagttagacaaaattctatgaggtttgagccattaaaagccctatagggctttagtcttacaactccaatgtcatagtgtctgtaaaatctcaattaatctcattctatttttgcagtaactggcttattaccatagttcctcccttcacctgatttcaataagatcatctgatcgaggaatcctctaattgaacatttatttgaatcttcctattaatagtgctactacagctatgtgtggttgtgtctgaaaataccagccatgaatcaagagtccgtcaaggctgcctacatatgaacacactctttattaattaatacctgtcatctgttgtttatagacaaaactttgttgctctgggcctctgaaactcaaaatatttgttcagaatacacaagtgttggctcttccatccacagccaaaagcataatgcgagaaatatcttcaatccatttatgctgaaacattaaactaaaaaatgttttttccttgttgctttacatgtttgtttagttcattgtttggttgattgttcttgtaggaattgggggaagtacataaggtgtatgcaaaaatatctcagtaagcttggccagtttgtcccactcaatttacatttaaagtgaaaccactgatcttcaaagacacttttggcacaagttattaaactttcgaacagtggttataaaatagttagatttcaactttaattatatgctacctctctgagcagtgctacaacaaaataacagaatattcccccttaaataattataaggtctgtttaaacattcaaattcgaatcagaattcctttgactatacacattactgcttaaaacccctattataattttaatcaaacacagtattcattaccaagaatttataactaagagaaataaatatttggagcctgttaattttatcatatctacttaagttggaagttacttagcaggagatcaaattgcaatacaattcaaacataaacaacagaaagtaatagtatttttaaaatgttcctaaatatggagcaaaacaaaatatataaaaacagagtttcaaagagctaaagatcttctgaaccaacatgaacagtaatattgcatagagggaaaaaatgcttaatcctaagacttctactatatggaaggttcgtagcctctttctttatttttgggatggtgctcagaaaaaaaaaaaagaaagaaagaaaagaaaagaaacaaaaaggcaaagctcagtggctttggtaggagatagcagattgctgtgatgcacctgattatatcccgtttgttctcccttttggtttagctcacatgtgaaaatctcctgtggacaacttggtttttttcccagaagcttggtccaatccctgtttccaatgctgtcagcatgaaagggaccaggcagcagggccaagcagttgcagatctgtgtggatactgcttcaggtgatgaaagggacattgctgacaagtcagtagagaggagaaagccaggctaatggctattctcaagtggtcattcacagctatttgccagtgaaaattgaaacttaaatttccctaatttaccttccctagaacttcaatatttcttacagtaagtaattttttaacttctttataactctcccagcagtgtggcagctttggtgtgtgacaaatggaggttagattctcctgcttaccactttcgaacatgaatttgaaaaagttacttaacctctctaaacactcaaatgctcactgtaaaaggtaacattagggttgtttgaagattatgggagacattgcataagaatgttctaacacaattcatgacataaaacagattctgaataaactgatatttccaaagtccacgtccctcctccctaaaacactaatgtctccactacactcatgatcccagtacctctcagtcctctgcggacactgtgccgacaattatatttttcctcttctttcctggtggctactgaaaaatcaacaagcattcaatgaacatgtgtttagtaaaagccaggtatttttttacatgttaccttaacctacccctatcctctcctgaaggtattggtatttctcctttctgctgtgatgaaacttcttaaattaggtgacaataagtaaagccagataaagatagttgtcagaggaaatgtgaatatctagatattgcattcaatatttagattgtgtgtgcatgtgagcattttccagaaaaaaaaatcaattttttccgtcatagtctcaaaagatccctgactctcaatatgttatgatacattgaatctatattagtagttgttcaggactgtcctgctattccattgtatctgtttctgtccttacctgaaagcagtgtagctatggtcgtagggaaacttttacttttaaattcaaatttctgttttttagccttcatcctatgttatttatctttatcatgtaacactcataacaacctttctttcttcgaattttttcttcatttgattgctgacactactcatatctcccaataagtcatctttgagcacttccatatctttctttggctcctacttctcagtatgactcatgaattctgatgtttcctgggatactctttgtcttaatttactgttgttgcacatgcactccttggattatatactctatgggcaaagctttgcacatctccaggtcagacctatcctaatatctacatctacatttccaggtaactagaaagtaaatggcacatatgttcaaaaatacactaaatcactactataaaaaaatcaacttaacacaaagatacaaagatactacttttctttatcatatgatccatgtatattattttattataatttcccgtgttggcaattttaagaagaccagagccactaaatcatttctagaggagtatggattattacgacctttatagagtagaatttgtctatayagctcagaagtctttaaaatgtgcatacacatcactatttcctgaagtatgrctttatcctgaagagtcctcccactaaaagacaactagaacttagataagttaagacaaacatatttttatggctaagctcacagaaaggaaaagaaatctcgaagtgtgagggggtaggcaatgagctaaaatctgagcagagagccatgagtaatcaataagtgacaggaagttgttctgggagaaaatactgatacaaggcctaggatctgggagacctaaactttgagtctgtctcaaggttagggagctgatgtgagtttcctatattacccttaatcccccatggagctaaagtgatcctagatgttagggaattctgtayagtggcaatgcaaccaaatcytttctcagggaatatttccaacataaacacttaggattcttacagattaagttaaaaaacagatgatcttataaacaaaaatcaaactactgtaactgagagttctcagaaacaaaatacagattaagtttaaaagaaaatttgtatgctgaaattatcagatacacagtataaaccaaccatatataaaatggttaaaagattttaaaactgattatttctaattaaccaaaaaaggctacttaaaatggccaagaagtatttagaactaaactaacttaatctttgatattaaaatagtaytgaatgagtaacagcatatcagatacagatgaaagggatgatttgtgaacttgaaaatagattttaagaaattatacaggattatcacaaaaggcatcaaataaagaccctgtataatgtagtgatagagaaaaaaattcaagaatcagaataaatttgaatcacagctctataagtaactagcgctgtgactttgagtatgttactaccgtctctgtacctcagtttcaccatatatttttaaatgatggtttatgtaagaattaaatttaaaatatttatatataattcttgaataaagtctggtaatattaagcactatggaataattatcattattaatatgacagaagtaagcccaaacatacctatgatattaagaaatatgcaggcttaatttacctcctaaaagaaagaacttttcagattaactcccaaaacatatctctattatatgctgtgtatgacagggacacactaaatacaaatttatacctaaagataacaatagaagaacgggcacagtgggatacaaaagaaaaaaagggagagagaaaaaggaaggagagaggtaagaaaaaaatgagtcatgatcwtatttgaaaaggtaacattcagagcttttgaaaaagcattaaatgtgacatagaaaagtagtttaaatatactaaagggaacaattcacagtaaagatatgagtgttatacatttctatgcacccaatgagtaaaacaacttcatgaagcagaaaacacaggagatgcaaagacaaacaggcagaaacatttaaataatagtagcttaattctcatgcagtccaagttctagtaaggtaaaaagtataaagaaggatttgtaagacttaarttacatttttaataaagtagattgtatggagatctatagagtagtgagaacttttgtatcttaaacagaaaatatgccttttccagtgctcgtggaaactttactgaaatagattatatactagattacaaatataaatataataaagtctcaaatagcaataatacagaaaatattgaccacaaaatagtaaaagaaataatttcactgagaaagatttacgaacaaaatctactgagctaaagaaaggataaaaacaaacaaacactatagaatgtccagaaaacctttatgggttgaactgtgtccctgcaaaatgcatctgttgaagtccaaatagtacctcagaatgaaaccacatttgtaaacagagttatttccaaagtaattgttaagatgaagtcatactgagatactttgagaccctagtataatataactggtggacgtataaaaaggggaagtttggtcacagagacacacacacagggataatgcctcatgggaatgaagacaaaaatcaggtgatgctgcttctccaaacmaacaagattgccagcaaactaccagaagctagaaagaggcatggaacagccctcagatagaaccaaccctgctgacacctaatcttagacttcttgcctccagaactgtgaaactataaatttctgttgtttaagccacatggtgttgcagcactttttgtcccaactggttggaaatgtcattgttattttcccatttgttgaccaaatctccaactggactatatgtaaggatttagcgtccaatagatgctctaagtattattgaatgaataattcaagcattatgggagagttaaattattcttaaggtttcttctaactcagcgattatttttcatttgtttctgtgtttattttttttgtttttatctggaggaatcatcaagcctttctaaagctcctaatctgtatgtctgaaacaagatctcaggagtccttaaaaaatgcattttcttttaaaatatgaaaacagtattagaaaacacatgttcttgcttaagaaaatttattgagaagtttttaaaatataaacatgcaaaccattaaataccgaattctccataaaagcacacaaagaaaattaagctctaagtgagagggcactgctcactcttactcagactttggtgggtgggtggcgtgaggtggggcagggtggagtgagttggtctcctgtctcttttcaaaactttactcacatgttttgaatctggtaaaaggagatatgaaaagagtgttggaataggcatttttcacttaataaacttaaaaatgtctgtgctacattttaaaggatggtagaaagaataattttttaaaagacaactctagattgttctctrgcaaagtgaatctgtgatacaaagagatgaaagtatgctggaaaaaatcattaagcttgctaatttgcagctttttacatagaaaatagtgttctttaagcattcttagtggaatgaaatagaaaaagtattgtttgataccaaccagcacagattttaaaacacatatttttcctctccaaaaaatgtttcgagcaatactacttttaaactatgtggcaatccactaacgagatggttttaaaactatgtagcaacattaaaaatgcctagagaaatgtcatccatggcttagtactaacacaaaaagtattataatatttttgttttattttattgtatgcaaatattgtgtatagttctatcatcatatatagataattttgtgtcttatattttatcactagttaatacttttcaatttttagttcctttttaattttttataattaaaaattaactttgaaacatgaaaagaagtctacaaacaataaatgaacaatattgaaaaaattaaaagaaaaataaaaagcggtttgttggagatacttttaaaatataaagatgcaaaccattaaatactgaattctaatacataagtctaaatacctaccaaagccacaaagagattcctgaaggaataaacatgtaatctatacttcatttaaccatggcaatattaaaatgaaaacaaataaataaaaagaacacatgagagaggaaacaataacaggctgaagatattcacatatatttggaaggtggcaaaagactgaggagagataatgacttatcttcagaatcctatgcttagctaagacagcaatgttaacaggaagcaagctgctactccagtgtccctgcaagtctagggatttttagaccccagaaaactcagaagcaaggccatgggataagactaaaagctagaagatttttatatactttaagactatggactttaagaaagaccatccccgcatacttccttccaagcatccaggtaacaaccttctctaaccctaacaacagtttaatttctggataaattaaacktgatagactctaggtctgtggaaaccaatcaccataaagggaagaagaaaaacactagtttaaaaacagggaaaatcaactaaattataaaccctcttcctcaacttgactattcactccttgtgtaaaacattagtgaaaaaaaaaacacaaacctgaaatcgcctggctaaaagaaccacaaatactgatatttgggagtctcccagataaatggccttcttcctacccaataaccttgcaatgaaatccaccatttggcaagccatgtccatgcatgtaacacccaatcaacattgtagtgtctcactaataaatgtcaatggacttctaattagccaggcatggtggtgggcacctgtggtcccagctactcgggaggctgaggcaggagaatggcrtgaacccaggaggcagagcttgcagtgagccgagatcgtgccactgcactccagcctgggcgacagagcgagactccgtcttaaaaaaaaaaaaaaaatcaatggacttcttacctctccttacatacttaaacaagagaaaagaagaagcatgtgtcarcacaaagacttgtacatgaatatttgttgcagctttatttgtaatagcctcaaactagaaacaacccgaagtccattaacaaaatggctaaacattttgtaatatattcacacaatgaaacactactccacaatttaaaatatgcacatggatacggaatgcagataaatttcaaaatcattatgctatgtaaaaaaaaaaagtcaggcaaaaaggaatacatgctatactatctcatctgtatagaattctggaaaatgcaaacaaatccataggaacaaaacacacagcagcagttacctgaggagtgggttggggagtagaaggaaatgaggaagtgtaacgagataaactaaaaaaggttacaagacaacattttagaaggatggaaatgtctgttacattgattgtggtgatggtttcaggagtgtgtgcattggccaaaaccagtcaaattatacattttaaatatgtgcagtttattgaattttgataatccctaaatgaaggtgtaaaaygacaccaatataaaaataaataaatgggccaataaggatcatyagatatttaaagaaagctccaataagaaatataaacatcagagggtggcaccaagatggccgaataggaacagctccagtctgcagctcccagtgtgaaggacgcagaagactggtgatttctgcatttccaactgaggtaccaggttcatctcactggggcttgccagacaagtgggtgcagcccacagagctgggcagggcattgcctcaccmaggaagcacaaggggtgggggaattccctttcctagcaaagggaagccatgacagacagcasctggaaaatcgggacactcccaccctaatactgctcttttccaacagccttagcaaatggcacaccaggagattatatcccgcggctggcttggaggctcccacacccacggaggctcgctcactgctagcacagcagtctgagatggaactgcaaggcagcagcaaggctgggggaggggcgtccgccattgctgaggcttgagaaggtaaacaaagcagctaggaacttgaactcggtggagcccaccgcagctcaaggaggcctgcctgcctctgtagactccacctctaggggcagggcatagctgaataaaaggcagcagaaacttctgcagacttaaacatccctgtctgacagctttgaagagagttgtggttctcccagcacggagtttgagatctgagaaaggaaagactgcctcctcaagtgggtccctgacccctgagtagcctaactgggaggcacctcccagtaggggccgacagacacctcatacagggggatgcccctctaagacaaagcttycagaggaaggatcagacagcaacatctgctgttctgcaatattagctgttcttcagcctcygctggtgatacccaggcaaacagggtctggagtggacctccagcaaactccaacagacctgcagttgagggtcctgactgttagaaggaaaactaacaaacagaaaggacatccacaccaaaaccccatctgtaggtcaccatcatcagagacgaaatgtagataaaaccacaaagatggggagaaaccagagcagaaaagctgaaaattctaaaaattagcgcacctcttctcctccaaaggaacagagctccttgccagtaatggaacaaagctggacagagaatgactttgacgagttgacagaagaaggcttcagaagattggtaataacaaacttctccgagctaaaggaggatgtttgaacctatcacaaagaagctaaaaaccttgaaaaaagagtagacgaatggcagtgtagagaawagacartgtagagaagtccttaaatgacctgatggagctgaaaatcatggcacaaggactacgtgacgcatgtacaagcttcagtagcygatttgatcaaatagaagaaagggtatcagtgattgaagatcaaatgaatgaaatgcagggagaagagaagtttagagaaaaaagagtaaaaagaaatgaacaaagcctccaagaaatatgggactatgtgaaaagaccaaatctacgtctgattggtgtacctgaaaatgacggggagaatggaaccaagttggaaaacactcttcaggatatcatgccggagaacttccccaacctagcggggaaggccaacattcaaattcagaaaatacagagaatgccacaaagatactcctygagaagagaaactccaagacacataattgtcagattcaccaaagttgaaatgaaggaaaaaatgttaagggcagccagagagaaaggtcaggttacccacaaagggaagcccattagactaacagtgagcggstctctcggcagaaactctacaagccagtagagagtgggggccaatattcaacattcttaaagaaaagaattttcaacccagaatttcatacccagtcaaactaagcttcatacgtgatggagaaataaaatgctttacagacaaacaaatgctgagagattttgtcaccaccatgcctgacttacaagagctccttaaggaagcactaaacatggaaaggaacaaccggtaccagccactgcaaaaacacgccaaattgtaaagaccattggtactaggaggaaactgcatcaactaatgagcaaaataaccagctaacatcataatgacgggataaaattcacacataacaatattaaccttaaatgtaaatgggctaaatgctccaattagaagacacagactggcaaattggataaagagtcaagacgcatcagtgtgtggtattcaggagacccatctcacacgcagagacacgcataggctcaaaataaagggatggaggaagatctaccaagcaaatggaaaacaaaaaaaggcagggttgcaatcctagtctctgataaaacagactttaaaccaataaagatcaaaagagacaaggccattacataatggtaacaggatcaattcaacaagaagagctaactatcctaaatatatatgcatccaatacaggagcacccagattcataaagcaagtcattagagacctacaaagagacttagactcccacacaataataatgggagacattaacaccccactgtgaacattagacagatcaacaagacagaaagttaacaaggatatccaggaattwaactcagctctgcaccaagcggacctaatagacatctacagaacyctccaccccaaaacaacagaatatacattcttctcagcaacacatcacacttattccaaaatggaccacatagttggaagtaaagcactcctcagcaaatgtaaaagaacagaaattataacaaactatctctcagaccacagtgcaatcaaactagaactcaggattaagaaactcactcaaaaccgctcaactacatggaaactgaacaacctgctcctgaatgactactgggtacataacgaaatgaaggcagaaataaagatgttctttgaaacgaatgagaacaaagacacaacataccagaatctctgggacacatttaaagcagtatgtagagggaaatttatagcactaaatgcccacaagacaaagcaggagagatcttaaattgacaccctaacatcacaattaaaagaactacagaagcaagagcaaacacattcaaaagctagcagaaggcaagaaataactaagatcagagcagaactgaagtagatagagacacaaaaaaacccttcaaaaaataaattaagccaggagctggtttttggaaaagatgaacaaaattgatagactgctagcaagactaataaagaagaaaagagagaagtgtcaaacagaagcaataaaaaatgataaaggggatatcaccatcgatcccacagaaatacaaactactatcagagaatactataaacacctctgtgcaaatcagctagaaaatctagaagaaatggataaattcctggacttatacaccctcctaagactaaaccaggaagaagctgaatccctgaatagaccaataacaggttctgaaattgaggcaataattaatagcctaccaaccaaaaaaagtccaggaccagatggattcacagccgaattctaccagaggtaaaaagaggagctggtaccattccttctgaaactattccaatcaatagaaaaagagggaatcctccctcagtcattttatgaggccagcatcatcctgataccaaagcctggcagaracacaacaaaaaaagagaattttagaccaatatccctgatgaacatcgatgcaaaaatcctcaataaaatactggcaaaccgaatccagcaacacatcaaaaagcttatccaccatgatcaagttggcttcatccctgggatgcaaggctggttcaacatatgcaaatcaataaacataatccatcatataaacagaaccaaagacaaaaaccacatgattatctcaatagatgaagaaaaggcctttgacaaaatttaacagctcttcatgctgaaaactctcaataaactaggtattgatggkatgtatctcaaaataatatgatctatttatgacaaacccacagscaatatcatactgaatgggcaaaaactggaagcattccctttgaaaatgggcacaagatagggatgccctctctcaccactcctattcaacakagtgttggaagttctggccagggcaatcagggaagagaaagaaataaagggtattcaattaggaaaagaggaagtcaaattgtycctgttgcagaggacatgattgtatatttagaaaaccccaacatctcagcccaaaatctccttaagctgataagcaacttcagcaaaatctcaggatacaaactcagtgtgcaaaattcacaagcattcctatacaccaataacagacaaacggagagacaaatcatgagtgaactccattcacagttgcttcaaagagaataaaatacctaggaatccaacttacaagggatgtgaagkacctcttcaaggagaactacaaaccactgctcagcaaaataaaacaggacacaaasaaatggaagaacatttyatgctcgtggataggaagaatcaatgttgtgaaaatggccatactgcctgaggtaatttatagattcaatgccatccccatcaagctaccaatgactttcttcacagaattggaaaaaactactttaaagttcatatggaaccaaaaaagagctctcattgccaatacgatcctaagccaaaagaacaaagctggaggcatcacactacctgacttcaaactatactacaaggctacagtaaccaaaacagcatggtactggtaccaaaacagagatatagaccaatggaacagaatagagccctcagaaataataccacacatctacaaccatctgatctttgacaaacctgacaaaaacaagaaatggggaaaggattccctatttaataaayggtgctgggaaaactggctagccatatgtagaaagctgaaactggatcccttccttacaccttatacaaaaatcagttcaagtgggattaaagacttaaatgttatacctaaaaccataaaaaccctagaagaaaacctaggccataccattcaggacataggcattggcaaggactttatgactaaaacaccaaaagcaatggcaacaaaagccaaaattgacaaatgggaactaattgaactaaagagcttctgcacatcaaaagaaactaccatcagagtgaacaggcaacctacagaatgggagaaaatttttacaatctacccatctgacaaagggctaatatccagaatctacaaagaacttaaacaaatttacaagaaaaaaaacaaacaaccccattaaaaagtgggtgaaggatatgaacagacacttctcaaaagaagacatttatgcagccaacagacacatgaaaaaatgctcatcatcactggccatcagagaaatgcamatcaaaaccacaatgagataccatctcatgccagttagactggcaatcattaaaaagtcagkaaacaacaggtgctggagaggatgtggagaaataggaacacttttacactgttggtgggactgtaaagtagttcaaccattgtggaagacagtggggcaattcctcaagtatcttgaactagaaataccatttgacccagccatcccattactgggcatatacccaaaggagtataaatcatgctgctataaagacacatgcatacgtatgtttattgcagcactattcacaacagcaaagacttggaaccaacccaaatgtccatcagtgatagactggattaagaaaatgtggcacatatacaccatggaacattatgcagccataaaaaaggatgagttcatatcctttatagagacatggaggaagctggaaaccatcattctgagcaaagtatcacaaggacaaaaaaccaaacaccacatgttctcactcataggtgagaattgaacaatgagaacacagggacacagggtggggaacatcacacacacgggcctgccggggggtgggcgggggagggatagcattaggagatatacctaatgtaaatgacgagttgacrggtgcagcacamcaacatggcgcacgtattcctatgtaacaaacctgcacattgtgcacatgtamcctagaaccttaagtaaaataataaaataaaaataaaaaagaaatataaacattaaaagatattttttaacaaaagggatctgaaggaaatgaagaccacaacagaaggagaattttgaaaagaaaccagaaaagagaaagctgtaaatagcatcctcagagataasgatggatattacatcaatgaaacaaaagcaggatgctataaaagaagattcagaaagcamgatctcttgaaaattaaaaatatgattgtagaagttgtttttttatggaaaagttggtagattaggaaayttcatagaagttaaataattaaagagattaaaaatagtgaaaatatatataaacacaagattaataaaagcgttttgggagaggaaagcagagaaaatggagaggagacaaatatcaagaaaaaattcaaaagtacttttcagaactaaataacacaaatttatatattaaaagatacactgagtttccagctcagtcaatagaaaaagatccacaccaaagcatatcagcctgaatttaaatatatcaggaatacagaaaagatcctaaggacttctacagagaggttttaaacaatgaaatataaaaaatcaaaaactgcttttcttttagccacattagyggttagaatacaatgaaataatgcctttataattctgaataaaaataatgtgtttagaactatgctcagaaacaaaaggtctcagtckttcatgtgtccattctcaggaagctactgcagtatatgttccatcaaaataaggacrtaaatcaagaaaactagaacagtatttttaaaatggaagaatgatgggagtatttctcaatatgaaagcaaaaggataaaaacaactacgtagcaatcctagaaagcartcagtttggagaaaagcagaaggtcagaggctataggagaaagatttccatgagaatgggcagtgagaggggaagttggaaataagaaggaaatattatcatatgaagagtggtcatatcatattttatcattctctgagacaatttgcaagcctaaaactgaacaatcgaaaaagaggcaaatgttaattagaagaaaaacaaaaggttaaataaaaaaggaaaatactcacagcatattactcagttcaatagtaatcagcatttaggttgttataaaatcacgccattcatcagaaattaataaagctatcaaagtaccgagactacaagacatagaaggcaactggaagggattcctgttgatccaacatgggataattttaatatgaaaaagacaaaggaaatcaaaatacatataaagtatatttcaaaaaaatgaaaaagaaaaatcatatatcttgcctttcatttaaaactacctcaaggtaatcaaatagttaacaagagatgttctctttcattgaagaatttcaactaataaatgacaaatgaatgacagaattagactagcactatttttcaacccctaataaaaaggatttcaggcaattatcagcaaagattgctaaaaccagtaaatgaaaggctgatagagaactcagaatgaacaacttgcctgctatctgaacccactgatcatttttaacctcataaaagatattatgtaccccttgatataatgcaataggaaataaacagcatcacgtgagacatattcttaccaaaataatggaagccgaatcatatcaagcctctagaccaaactacaagtatagaggaaatgcaaatgagaaaggaacgtgttaaatgataccacacgtatgccatcagcaaaatccaggatgtgggaaattctacacaacaaatgcccccattttttaaatatcagtaatgtgaaaaataacggacagaaaattgtaaattaamgagtcacacagagcaaccaaatgcaatcttgtttagatcctgaatccaacaaaccagttaaattttttttttgtagacaactggaaaacgtgaatgctgaatgaatatttatattaaggaattcccataaattgtatgtttagatgggataatggtttcagagctatgttctataaaatgtccttatcttttatagcactaaaaaatgtacagttaaaattatgtgatctctaggatttgttttaaataatacagtgggaggtgggaggaaagtaggtaggaatatagagtgagcaagatagatcatttgttgataattgttctaattttatatacatttgaaagttcccaaaagaaacactttaaaatgtaaatagaaaaaagatgtacacctaatattgatataattcaaaaaatttattaaactattttacgatagtgatagagaagaaaagtgaggagagctgaatcttcttcttctaatatgggatatcaacatataaaatgtaaatttaataaatcaagagtgtccagagaagtaaatatttttgaaatgtagaaacagctaaaataaagaaatgtagaaacacctaaaatagttaaaactgtgtggagagcaaaatttatgggtgggcagaattaaggcaaggaactactgtgtttattattagtcttctaataccatttgaacacatacaaatttgataaaatgtaaaaattatttttaaaatgatatataaaacatcttttacttttaaaatgtgataggaagaagattaatacatattatgaattatatcctgacactcatgtttatcttcaatctcttctcatttcttccctttattcatgtcattgtcaaagcatgttatgattatgaatatgacttggagtcatttacttctctaactcctcagcaaccaccctggtctaaggcctcatgatctcactgacatcgtctgctaatagatttcctgtttttactcttgccaccctctaattcattccacaaatatcctgggacaggcagatgagaatttgtctttcactctgcacttaatagctctttcaccttaagcaagtcacttatgttctttgaatctcagtttcactatctataaattagagcagatgataaccaccgtagaggtgtgaagatgaagtgagatatcacatattattccacatccagactgatgttttaaagttgygggacagtttttctccaactgtagtgtgtatgcaattgctaaggaaagatcatttttgaaatgcagattttgatagagtggatccaaggtggggcctgagattctgcatttctaataagctcccaggtgatgcaaaagctgccagcacctcattcacactttgacttagcaaggctagaggggataccaagataagtgacagtgatgcttgtcctttagaaaggagattatgcccttgtaaagataatctaaatatccacataccttcactttcattagtgctacagggagcatgtaaactctgaagctatttgagattgggatagatgttgattttactaaacattatacgagacagaccagcataaggtcacatctggctataacaaaatcattcaaggtgttgtaacaagatatacaacttagagaaagcaattagcaatttagaatatgaaaatatagatcatttttaacaaaaaaacaaatatcctggatcagacagataagaatttgtctttcattctgctcctgagtagctctgtaaccttaagcaagtcacttatattctttgaatctcattttcattatctataaattagggcaaataataaccaccgaagaggtgcaaagatgaagtgggatatcgcatatcaattttatgactgtgcctgacatatgatagtccttataaaataccaggtcttccttttcttttttttttattatactttaagttttagggtacatgtgcataacgtgcaggtttgttacatatatatacatgtgccatgttggtgtgctgcacccatcaactcgtcatttaacattaggtatatctcctaatgctatccctcccccctcccccgaccccacaacaggccctggtgtgtgatgttccccttcctgtgtccatgtgttctcattgttcaattcccacctatgagtgagaacgtgcagtgtttcgayagaagattttccttataacattagggtaagagaggatccattttgaatgttatgtttggcacccttaacatcttagagaaacaaaaaaggttatgaaaatagaayaaataacaatgtaggtaataagcaagtatttttgtctaaatgaacactagaccatgagtcataaagctaagctttggtccaggattcagcattaactagatgtttgatgttgaactttatttaatgtcactggccctggtatgctttctacatcactgtatttaacgcagaacaggtgagacccaaactggggcttagccctcaagggttcttggctttgttcatgaaagagttcaggggcaagttggaggtagaagaaaacagctttattgaagaggcggtgttacagctctggcatttataactctgtgactgctcctgcagggcagggctaacccatatgcagagagtagcagcttacggcggttttgcagtcatatttatacccacttttaactacatgcagattaagggatggtttatgcggaaatttcaagggaagtggtagtaayttttgggtcatctggtcattgccctggaaagaggcagtaactcctgggtgttgttatagcaatggtaaactgacatggcacactagggggcgtgtcttatggaaagctgctttccattggccctgttttagctagttctcaatttggtctggtgttcaagccctgcctctggagtctagtcctgcctcctacctcatattcaccttgttaagtacattatcttcttacggaaatgcattatccttccatttcttttgattttttttcttttggaatatcagtaaatttcacagaaatattaaaattgtagaatcattgaataattagaacaaggattctaaacaagtttctttcctcctgaaatctctaccaaacaccttcaaacaatgttacaaagcttttaagaagtatatgaaatcaatgaactaatgtttctagttagagaacttcaatttttttaagattacacaggcatgcacattttcactgacaattgaaatttatttgctttacatgacactaagttgttctattaataactaagataccaaatataatttagaaatacaaaaaaagaggatgggtgcggtggctgacgcctgtaatcccagcactttgggaggcagaagtgggcggatcacctgaggttgggagttcgagaccagcctgaccaacatagagaatccccgtctccactaaaaatacaaaattagccatacatggtgatgcatgcctgtaatcccagctactctgtaggctgaggcaggagaatcacttgaacccgggaggcacaggttacagtgagccgagatcgcacccttgtactccagcctgggcaacaaagagtgaaacttcatctcaaaaaaaaagaaaaaaaaagaaagagagaaagaaatacaagaaaaagaaaaagcaatttggagaaaattttaaaaagcaaatcattttaaaagacaaactacaaagtactgtgtgagctaagccattcataatgttctcatggagctaatgggaaacaaatctgttctttcaaaataattgtaaaatttctgtgtaagaatgaatggaaaaggtcatccaaaaactacttgactacatatacctatggatctctatctaagtgctgaaaaatgaatttttttattcatttggttatgtagcatttgttcattctaattttgttttgttccctgtcatatctctggtacctagaataatccctaccacagagtaggtcttccattactcttatgcttttaaatctcccctcacctcattgtaaatgacttttgatttctcttttatgccctttttatacacctttcccttatatctccatttattcctgaagcttcatgggattcagccattgaggtcacttgggtttagatataccaaaagtctgtgatttctctgtttgcatatatgcacatttgttgttatccttacccttttctatcagttccttaccataacatacacttaattcttggaaattcactcatgtcttacaaagatggcaaattcamacttctgctgtgtatgacacaccattaactgcacaaggacactgtgtatttgctacgttaatatttactgatgagttaatgtaataatgacccatccrcttctgctgcctgtgaggtactttctatctatagggatggaaattaatgacagaggctctctgagctgcctgatgtcagagctgagaaaggtgtgaggggtatataagagctggattactagttagcaaatgagggggtaaatattccagtggatacaagcttggactcttttcttgaagctttctttctatcagaagcatttgctgatattgctgacattgaaacattaaaaggtaaagaatttcctatttctgggaaagttttatttatttagagaaaygcacacttggtgttaaattcatggtttatttcaaagaaaggctaaagggagaatgtattacaatataaatgttcagattgcttagagaaggaaattgggaaagtaaaaatctcgaaattacttgaaaagtggacaatattaagggactgtatcaataamaattttgatccttgtaaattacgttttaaaaagatgtttcttttaaaaactaagctctaatttaaaattacrtcaattagaactgtaagaaatctcttgatttcagtgctggattattctttgcagaaaatttgagaagcaatgggcatcctgaagctgcaagtatttctcattgtgctctctgttgcattgaaccatctgaaagctacacccattgaaaggttggtaactttaaaatcctgtttctttgtaacttttgtaaagtgtgagaaaattagaattaaatactgtcaaataactacagccttagatttctgactatatcatrcttaagaacagtaccttcagctattccattgttccttgaattctgtgttctttaaagaataacaccagtggcaaataaatatctttgatggaacttctgacagacaggaatggataattccagttttgtcaagaaatatactcttggaacttagaggggcaaagccagaacatgaagcrggaaaaaaatcaaaaggtagtaatttcttctatattaacctgatactgaaacaaaccagagaaacttaactaaagcatatatttttataccaagtggattctttttgtatatattacttagatttttgttttcctcagatgtctctggaaatgttaaaaacttttacatcttgtggaaatggaaatgtatagaaataatcaggagcaaattaatgtttttaagaaatgaaayctaaaagaagtagttaaaaagccatttgctgttgggggatttattctatattgctagctagctattctgtgagtgaaacagatttataaaaagttattcttcttattacttctaagctgctataaacttaatactttttaaaattactttcagtaggtagcatgtatgtcaggatttcctgggaagtcttattacgaaaggtttcatgtcatttaaatggtaattaaggacatctaacaactatgtcacgtaaaactcttagagtagttaaaattttcaaactgagattttaaaactgtaatttatttaaagggttattaagttcaaatatgtgcataagtcataaataacatagtgaggatttgtttgtgcctaaattagttttgctccatatagtcttatgggactgaacttacacactctttaacaccaaggagaattaagtttacctttgtaaagagtgtgcatgtcatattataattcttctcattagaatgatcgtcatcttgtctttgttttccttcgaggtagtttttcttggaagcccatagcaatatgcaaagatttctacagcacctacgtataataaatagcaagaatcattatcagaggctttttgtcatttcaaggcttatttagtttacagggtgttcttctcagaactgactgtaattttctatttgctttttcataaaaataacttttaaaatgacatgaagtttctgataagcagaatatctgaatgatgacaggaaaatcagtagtatttcctagtatatctgtttatatcttgatactttctttcaatagatatagaaatttactaagcacttttaccctctcttttttttattttattttgagacagggtctctctctctctctctctctgtctctgtcacccaggctgctggagcacagtggtacaatcatggctcactgtagccttgacattctaggctcaggtgatcctcccacctcagcctcccaagtagctgggaccacaggcacctgccaccatacccagctaattgttttatctttattttatagggaaagggtctccctatgwtgcccaggctggtgtcaaactcctgggctcaagccttcctcctgcctcagtcttccaaaattctgggattataagagtgagccactgaacccagaccattatgtttttatagatgtttgtttattatgagagaaacttcacttagaaatagagcaatatgtaatataatattacttgttataaaattattttgatgttagtctcacaatctttaactttgaattattagaaatcttgtaaaacattcttcaaattgctttttaatatgttgcctgaaatgagtatgtttgaacatttgttaaagggagtatgatttgtcatgctgagatgttaaatcatgtactattctacatatctcacagaaagctaggaaaatctatggggaaaatgtgtcaaattttaaactctttttaaaaaataaaactaacattattcaatgtcattttcctcacaaaatttaatcatctcatttgagattttttcaatttgtaaatgtatgaaataggataaaaggatcacatactttcccaccaacttttttacactcccttgtaaatatctgcctggcaggtaatcaaaggatagttaaaaatataattacatagatgccaagatgcaatcactaggatctccctgcaggagctcacatacttccacagatgaatgttaaggctgagagcagggactcactttaaagtcattttgaaaactctggagagacaatttaaaagagaggcaatttaagagttatactttggcttattgtcatctctgtttaaactctcttaaagtcaagaatttccatgtgtgtatgtgcctgtaagtggtctacagctttaatgtttgttactagctcgtatgttacctgtccaggtagtcaatgagaaaaaaatgcctgaaaccagggaggtaatgccttttattaaccatttcagacaactttttccatcctaaagattgctttagatagaatcttatatatactgaatagtatatttagatgaaaagtcttttttagaaaagcaatttcacaaatatgataaaaacataaatgcttttactatttcttctaagtggaatgatggcccatctagctaactcaaataaggtaacattttatttagaacaattttaaattatattattgaccttccaaccaattatcaaaataccactcagcatttagcatataaaktatttcacactgtgcttcagtcatatgctaaacatatcttggaacagatattacctttgaaycttctcaatttgacccataattttcctttattactttttttgagatgtttggaccaaattccaatttttactgtttttcaagaaaagtaagtattttagaattcaatgcaaatgtatgaaattactagttcaatccttaaagcataaatcactcttttgaaatgtacattggtcatatttatggtaccttcaaaaataaataattgaacagatagtgtgaatgagattgatataggttaaataattagatcccaaagtggttttctttgcccagataatttgttcaaacatttgtcagcatacacttacattcaacaagtatccagttcacctaatgctgtaagaagttttctgtacttaggaagaaatatgggagtaaaatttaaaaaaaaaacagtttcacatgagattattaaatatttactcttaggctatctctacttagagatagagataatgaaatactccccacacmaggtaaacacaatgagataaatccattgcatttgagtcccagattatgcatatccactggctcctggacattgagtttttagccctataactatttcattttccatttaccctaagtttcaccaatattttgatttctatggagctgaaaactaaaacatttctctaactttcctaataatcagcaaagaggaascaatgttattattctgcatccatttccgatatcgttttaaaagcacattgaaacaaaaggctgtcaaaaaaatagagttggtatacaaataaatgtcttaaataaaaacataagttaaaattaaatgaattatttaatgtgtggttatgatttctgagtttataagtattattatgcacttcttccaggtggctagaaaaatgtgatgaatattaataccattgacataaaaagtcttttggttttaacatttaacctagtcttatcattaaaattcttgaaagcataagatccaagcaggaaaatgtatttatgctaaaagtaataaaactctcacactgcaatagagtacctgaacaggtgatagatttgattcttttggagactttatgatattctctttttttgacatactttttatgacattattttttactttattatatttcattttattgttttaagaacaaagcatgatatctacccttttaacaaatttttaagcatgcaatacattattctggattatgtgcaaaatgttgggcagcagatctctagagcttagtcatcttgcttgactgaagctgtacacccaatggttagtaactccctatttccccctctcccttgcccctgataaccaccattccactctttaactcatgaatttgactattttaaatacttcatatacatggaaccaagtggtatttatctttctatgactagcttctttcactcaacctaatgtcctcaaggttcatccgtgtgttgcatattgcagaattcccttatgacatttcttgcataacactcctgattcaattatctcaaggaacttaaagactaagtaatgctgctttattcttattggaaagatgtagaaataattatttttaaatttcttcatatttcagattacatataaattttaccttctaaattctttttatatattaaaaataaattcttcaagatttttaaaaatgtaagacaaagacactgttattttgattatatgtaatatattctgaatttccaaaggaagacttttaactgagaaatgcaacattgactgtaatgaaagatgttgtatgattttcaattgttatttcaaggtgtcaaaaaaaaatctcagccatctaggtgtttgcaaaccaaaacactgagttacttatgtgaaaattgtttctttggttttcatcaatacaagatatttgatgtcacatggctggatccagctaaaattctaaggctctaacttttcacatttgttccatgttaccagtcatcaggtggaaaagcggaaatgcaacactgccacatgtgcaacgcagcgcctggcaaattttttagttcattccrgcaacaactttggtgccattctctcatctaccaacgtgggatccaatacatatggcaagaggaatgcagtagaggttttaaagagagagccactgaattacttgcccctttagaggacaatgtaactctatagttattgttttatgttctagtgatttcctgtataatttaacagtgcccttttcatctycagtgtgaatatatggtctgtgtgtctgatgtttgttgctaggacatataccttctcaaaagattgttttatatgtagtactaactaaggtcccataataaaaagatagtatcttttaaaatgaaatgtttttgctatagatttgtattttaaaacataagaacgtcattttgggacctatatctcagtggcacaggtttaagaacgaaggagaaaaaggtagtttgaaccttggtaaattgtaaacagctaataatgaagttattcttgacatgagaaaatcagtaattggaccaggcgcggtggctcttgcctgtaatcccagcactttgggaggccgaggcaggcagatcacaaggtcaggagttcgagaccagcctgaccaacatggtgaaaccctgtctctactraaaatacaraaattagccgggggtggtgacatgtgcctgtaatcccagctactcaggaggctaaggcaggagaatcgcttaaacccaggaggcggaggttgcagtgagccgagattgcaccactgcactccagcctgggtggcagagtgagactcgtctcaaaaaaaagaaagaaaattagtaattgtaagtacccctgataagcaaattagtaattgtcaatacccctgttaagcaattcctttttgcagtrtatttctgaaatgacagaatgctgttttaaaaacaaakaaataaaatcctgctcctgactcggtcaaaatattttttaaagtctattgttygttgtgcttgctggtactaagaggcwatttaaaagtataaaactgctttgtatccatgagggtttcattgtgtgttagcagcagtgagcttctattaaatgtatatgtcatttattttgtttaagtggctttcmgcaaacctcagtcatattcttatgcagggtattgcgaaacaacttgtgttctattaatcgtgtcttcaattaaaagaccacagacttctggaaactctttgctgtataagaattatttcttttgtttaacaaattagacatttctggcagaggttatgtatatgatacactttttttgatagcagctgcaatgttggacagaagatgaaatgctttgctttsagtcagattcttatgaatatctgcttttccctgactttgagttaggtagctttggaagtagcattaattcagataaactgccatcatgctgcgttatgccatttctaaagacactcaacttgtacttttaaaaaaatagaaaaaataagcatttcaatctaagtggaaatttgactcattgacttacatttctaagttaaaatttccctttatgaagtgtgccttaggttaccaaattgtagaggctttcgttggtggtggtaagtggtagcggtagtgagtgtatagaggcagggaaatatatttataataaattctatgtcatgaattacatattgaaataaataggtgaatatacaaatttatatttgtgatgctcaattgttggtccttctttcaaagtggcctcaaacccaatatttcaaattgaataaggtacaattaaattataatctctcaaacttatttgaaaaatttcccacaatagtctacagttttattgcatatcacacctatatatgatataaataggtataacaaaatatgtaatttataatatgtcaagttataatatcaacattatatttaggtttataaatattacatatatggatttgttatttaacattataatttatttcaattcccccatctctctttctagtgttaacaaaattttaatgagtgcatatcatgttcaaggacattgcctatggtagcatacaattcccaggaattaaacaagaagaattatgaatagtaacccaacaacctctggtgctagagattaaaacatagttagagtgactctataacacaaaggttattatatggatacagcagatattaatcgaagattttattctgaagtttattcattcaatttcttacgaaagtgaaacatttaaacaaattcagcattatttccttagttaggttggtatttgcagctcagtaaggaatcaaatacataaagactgagaatacattactgccagggagcttactgagtgtattctctggtttctcacaactactttgggaaaaaaataatgagaataactaaattattgtaattggaggtaccaacagtaaaattttggtgactacgtttatcttaacctttctcattgtgtctaggtacatgaaatcataggtacccttgagtaacctgagtgagttaggcttccaagtgctagaatgggtagctaggcaaccatgagcagggaagagagggccccccaacccaacccacacccccatgcccccactgccccagcccccgaccaagaattatcaggcgactatcagctgatggtcaggtgattgttaaattgtctctctaaaataataactggtcgtagccagcaccagagaaaggtagactcccaataggtagaaaacacctaaaactgatgatcggcagcttccagataagatctcagaagttgggtgagtgggcttaagtatgtacactatgagaaaaaatgacagagtttaactggtatatgatcccaaaaataaatgcaacaaaaacaaaaataaataaatgggatgtaattaaactaaaaagcttctgcacagcaggagaaataataaacagagtaaacagacaacccacagaatcggagaaaatatttgcaaactacccatccgataaagaactagtatccagaatctaaaaggaactcgaacaaatcagcaagaaaaaaataaataatcccattgaaaagtgggcaaaggacatgaatagacatttacttaaaaaaagatatacaaatggccaacaaacatgaaaaaaatgcgcaacatcactaatcatcagggaaatgcaaatcaaaaccacagtgagataccaccttactcctgcaagaatgtccattattaaaaagtcaaaaaacaggctgggcgtggtggctcacagctgtaatcccggcactttgggaggctgaggcaggcagatcatgaggtcaggagatggagaccattccggccaacatggtgaaatcccatctctactaaaatacaaaaaattagccgggcatggtggcatgtgcctgtagtcccagctacttgggaggctgaggaaagagaatcacttgaacccgggaggcagaggttgcagtgagccaagatcatgccactgcactccagcctggctacagagcgagactccgtctcaaaaagaaaaaaaagaaaaaagtagaaaaacaatagatattcgtgtaaatgtggggaaaaagaaatgcttacacaatgctagtgagaatgtaaattagtacaacctctctggaaaagaatatggagattccttaaagagctaaaagtacatctacaatttgatacagtaatcccagtattgagtatctaaccaaaggaagagcagtgattatatgaaaaacacacttgcacacatatgtttatagcagtacaattcacagttgcaaaggtgtgaagccaacctaagtgcccatcaactaatgagtggataaagaaaatatggtatttacccactatgggatactactcagccattaaaaggaatgaaataatgtcttttgcagcaacttggatggagctggagaccattattctaagcgaagtaacaacaagagtggaaaaccaaaaactgtatgttctcacttacaagggggagctaagctatcagttatgcaaaggcacacagagtgatataatggactttagagattcagaagcgggagggtgagagggggccaggaataaagaaccatcagtcagatataatgtacgcttcttgggtgacaggtacactaaaatgttaaaattcaccactatataattcatcggtgtaaccaaaaaccacttgtaccccaaaagctattgaaataaagaaatgataataaatttttaagaaagaaaatggctgatgcggtggttcacacctgtaatcccagcactttgggaggccgaggtgggcggatcacaaggtcaggagttcaagacaagcctggacaacatggtgaaaccccgtctctacaaaaatacaaaaattagccgggaatgatggtggaagtctctaatcccagatacttgggaggctgagacgggagagtcgcttgaacctgggaggcagaggttgcagtgagccaagatcatgccactacactccagcctgggcgacagaagaaactccgtctcaaaaaaaaaaaaaaaaagaaagaaaagaaacgaaaaaagaaagaaagaaaatgagctgacttatctaagatcacatagtcaggatggattcaggattgaaactcaggtatattgactctgaagtgcagacaatttctctacatcatgtccaaataaaaatatttttcttttactcccactttgcactgtgttttattaaatgtcagaccatgccaaatcagtctgtcttgaaactggacacacaggtcaggcaaaagaagaatgggactaaaatagttattcactttgtctgatattgagaataacaatctttaccctacccattatgagatacttttgctttgttttattttgttttttaaggttttaactggaagaaagttaaaaaaaattcaatacacttactaaatatttccaacactgaaagattgctggtagcacatcttttttttcttccaaaatccaaatgggattgtcctattttctttgttccgtatacaactaagaacattttcttctatggttcaataaaacctttgccgactaagtagacccacatcctatagctggtcccttaacgtcctccccatggaattttggtctatattttcatctgcctcattactgcttcccttgtgcattaaccatcccataccccacactcacctgcctccacgttcttgctttatacaacttgctgccttgaaatatcctttcctcacctctgggatctacactgtaccctggttctgctcaaagaccacactgtccatggagcctatcatgattctttccgtcatacatagataagagtctcacacagataagagtctatgtaaatacaggtcctgaatttacatagacattccctcagtcactgaacatgtttagtgagcttatttttatatttgatatgatattagtggttgggattttgagaccacctagaagaagttcacaggttctaccttattttttggttatgtatgctcaagtgttatttccccatccagcctgtaaactaactgaggtgaaggatgtatgagtcatctctgtaatccccacaacatttaagcccattatgtgcctataacagatgcacaatacatattggttgaatacatttactctaggaataatgaaaaaacaaattattttaatataaatttataatttaatacagtgtgattaagttgatagagtgtggcatcttatactccctttgtaaaacggatagtaatatctatcttgaatagttttcttgaagattagaaataaaatatgcaaagtatctggtatatttttaatgtccaatcagtgataactgaattaacaatgataactacacaaaccaaagaacagtatggtattacagtgggtactttctaaattcattttattaagaattttaaaagagacagagaagaaaaaaaagtcagtcacaaaagcgggtacaaaacaatgcagagaaagcttcaaagatgaacaaaaaggaaaatagaataatgaaattaatctacccaaatcctaaatgagatttgcataagtagataccttccctgctccaataacaaaatgacacaaagaaacttgtaccgcacaaccacatctagaattacgaaatgcttaaagaaccataaagatactggctctgaaaatccaccacttctctgtgggaacattccttatggtatttagaacaaaggttatcatcagtaggaagtggcacacaaacccttaaaaggatatcacagacaatatagaaacagcatatctggtaagtttatcagggttgtaagtagattagaatagcaggaagaaaatctaaaatactaaaaaggtataatttaagtagttagaaatcttaccacatagataacaaactgcattaataaactttttaaaacttgaaatcatggaaaggcattataaaaagaaaaattaaatatatcaaaaaaatatgtccacttagtttttttttcttttttttttttttgagtcggagtctcgttctgtcactcaggctggagagcggtggcgcgatctcggctcacttcaagctccgccttccaggttcacgccattctccagcctcggcttcccgagtagctgggactacaggctcccgccaccatgccgagctaattttttgtatttttagtagagacggggtttcaccttgttagccaggatggtctcgatctcctgacctcgtcatccgtccgtctcggcctcccaaagtgctgggattacaggcgtgaaccacttcgcccggccagattttttttaaaaactcttttttaccttcatggacataatgccctgattatcatataaatatataaatatgaaacctctgcaattgaaatgctgaaaatttagtataagtttacgtgaaagctaggaggctgtggtcccacatacagctataactgttataaaactctcttctggtttctgatcactcacttctttgtattgactccatgcctccactttgtaaatacaaataacctgatcaagcaacagatcttgagcagaaactctgtccagaatttactccataaccttctataatttgaaattcattcttgtgcataagtgcttttcagttgaagaatctctcattaaaagacaaatccttcttgaaataaaaactctcatcaatatcaactaacagttgaagttagctaacagctggttaagagcaaagctctaagagaacaggataggcaccttaagcaagaacattggtagaggactggtaggggtaaactgtgaggaaagcaaaacggaaaaagagcaaaagagaagggcatgaaggagtcctattaccgtacaatgtctctggttgggctttgagacccatatacatttgcaatcacttttcttcacacagctgggtgtgataaggatttaaagcatctattccactctggttttgaaatcctaatatgttaacctggaggatgggtagaggaggctggcatgacaagacagggaaaggagcaagacaacagaaacagatttgtttttctgaagcttcatcagccttctgaaaacagtatttgatccttacgaggtgcttagaaaccatatttttccagaacccctcctgcagaaaagccactggaaaataaaagaggatatgaaccagaaccaagcccttggagtacccagatattcaaact

SEQ ID NO: 17958 - DNA, 53331 bp, Homo sapiens
atccccgccaccaggatgatccagccactcacctgccacacagatgtcaaagtagtcaccaaactcacttcggatgtgcttcaccaggtccactgcgtagttgaagcctccctcctcctcttcccactggtcacctattgggtctgcagggttggtggaggtcatagtcactgggtctcacccaacctccagagaccctttctgttccctctacctagccccgacacccaggactgcgagtccctggaaggcagaaacttcatattatttaggtttggttcgtctctttctagcacttggtaagacagcaggagggaaaaaagcagcccaccagttcaatattcactgcatgctgaccctgtgctggcggtggagaataggagaccaccgctgcttctcaccgtgcctggaggattggagagcccttccctacttctacctgggcacgcctgccaccctctcccatcccacggccttggggctcctgcctcctgggagaattttctactcatctcaagtgaaggggtcttgtggtagggagcacgaggccataggatcccacccatcaggctccctcttcccactcttaggtggcctgacaacagcgggcaccagaggcctgaccggctattctcactcctggatactctgttactctgtgattgggccaagtgctgggtgcagccagcaatcgatgcagtggtgtaggcaaggcagagggttatcaggccgcgactgcattcctgacggaactcctatgtcgaggtcaagaggtggaagaggtggctgcctgtgtgtggtgcccaggatgactcactacccacaatgcctactgacactactggcggggatgggatcctgcggatcctcagcgtggggcccaggaagaagtaaaggaccatttcaggaaccaagttcaggctaccaagtggcctccgggaaagccagaacccagagtgtaggggagtgctggctccacacctccccgcagcgccatgatgttcttcaggcccagctgcttagctttgtgcagatggcccgtgatctcctccaggcgctgacggcagcaggtcatgtgcaggatggtctccaggccacagtagttcacggcggtgctggcgatcatcatggaggaggtctccttgtctgagccagggtcacctgctgggtgccaggtcacgtctatgtagagggggccacctgctgccatccggtcaaacctgtagggggtttgtttctgaagagaggttccaggagaaataccatccgtcactgccttcccatggggcccgggagttagagaagcatcaatgaaggttggagacagaccaatcagcgttcatatcctggctttgctacttatagctgtgtgatcttgggtacattacttaatctctgtgagttctgtttccttatttataagacacggcagatagtagtacccacttcataataacactaggatgctgggcgtggtggctcacgcctgtaatcccagcacttcaggaggctgaagtgagtggatcacttgaggtcaggagttccagaccgcctggccaacatagtgaaacctcatctctactaaaaatacaaaaattagctgggtgtggtggtgggcacctgtaatcccagctacttgagaggctgaggcaggagaattgcttgagccaggaggcagaggttgcaatgagccaagatcacaccactgcactccagcctgggccacagaatgagactctgtctcaaaaaaaaaaagcaacaacaacaacaaaaaaccataacactaggagaatatgacggcagctggttccacagaacttagaacagtgcctggtgtacaaaccgaatactcagtatatgtgaggtgccgttataatcactattacagaggtaagacacaacaacagcgctatcattttgtgtgagagcagcacttcagacttttcacagcgcttgcctgtttattatctcaggtgagttaagacatcatgattgagagttaggggaatcctaactgtggcaagcacagcctcgctgtaggaacagttagaaagagggtcagcagactcactttctttcatgccaccccccaagccctgtgcagcagcttacagttatgcagaccaaggccaagttccgaaacgagactcaaaaaaaagcctggatgtgcacgagtacttgtgttacaagctatcaacggtgtatttaaacatccttgtgcatttaaacttcaaaaacttgggagtgacacgtgagacgtgcatacagtaaaaggcataaacttaaaaaaaaaactgcaattcatgaagtgctaatgtaattcagttggcatttctagagttcaagaagcataatccaaatttctaacttgctgaaaacaatctcactgctttgtgacttcctaaactgcactcgtgatccagcccccaagttccctcaaagaatacagtgtgagaatcaacatttttaacccattgaagagtgtgtctaaaataccttgacactgtggagggacttttacaggcaacagagaagttgcagatcagatgacccactctgccttctccttcctgccccctccggctgcttttttctgccgggttaaagggcagcccagcctcagggctgacagtttgctccccaggcaccaccactcccgcctcccaccttaaccttgcatgagtttaccttgagatgagattgacagctccctcagcagttcgaggagggaagaattccagggagaaccacttgtcaccagattccaatcgccgcctcatcttctcccggagtctctcatgccgctcggggtccaggcccggggtggaacatctcgaactatctttggagctctcactgccactgctggcactgccctccaagcaggggttgaggctgctgtttcctctggcttcgttcaccatggctgggttcctactgcacagggtggggcagggagcatcagggggcaggcagccacacccccgacacatcaagacacctgagtggcaggttcaagccggaggcgctgtatttccacacaggaagaaggccaaaaaaggtgacactgccccctcccagtggctccatgctcctcagctatggctgtccgggccgcctcactcaaagccttgccctccgctgctgccaggctccttgcatgcaaggcagcccccacccggcactgcaacatgctcctcggtgacagctacctgatggaaggtggcacagaggacctcacgctgccgacctgcgaggcccatattcctagcgaggggcagtagtgcccagctgggaggaccctggcttttcgatggtccatctctgtcagctcaggcccagagtgcgtggggagggaacagaggcaccttccccagcgggtgtgttcaactgggcggagctgcgacaaaggaagaggcttgagctccagccagcacaagggggcgggggcaaggcttccaggcgaggagggagggctgaggctctagtaaggggaggcggatggaaggagggggactcaggggcagagactgcaggggttggtggagatgaggccaacaggcgttcagggataccagatcaccctccagagaaggaacagctcactctggctggctctgcctggaacatctgttacttgaaacagttcgtgcacaggatggaaggggtgagggcttgactatgcagccagatttctcctgaattcatgctactccaaaaagaccgtgttgtgggttagaacttgatgctggccatgttccaaaaatagccagacccaagttcagtaagggcacgaatttctcagaacaaaagctgccccatctgtgcttgccttgcaggctgctcttcttacacatcacagaattcaattcaaatcatcacagtgacccagctactgggaaggctgaggcagaaggattgcctgagcccaggagttcaaggccagcctgggcaacatagcgagactccatctcttaaaaaaacaaaaaacacacctgtaatcccagcactttgggaggccgaggtgggtggatcacctgaggccaggagtttgagaccagcctggccaacatggtgaaatcccgactctactaaaaatataaaaattagccaggtttggtggcgggcgcctgtaatcccagctactctggaggctgaggcaggagaatcgcttgaacccggaaggcagaggttgcagtgaaccaagattgtgccatagcactccagcctgggcgacaaaagcaaaactccatctcaaaaaaaaaaaacaaaaacaaaaaacagaaacaagtaatcagagccaccagggcacagacaggccaacagagggcatagggtcatctggcagtctggttaagaaaataagacaaacacttaaaaacaaacaaaacacttgcacagcaatgggcaaacacacagtagtgaatgggtgtgtggtgacatggcacaacagaggaaagcccaggtgaggttcatttctttcagactgtccaccactaaccctgtgtacctaaccatttggggtcttagactcttttgacaatctgattaaatgcactgctcccttcccctgaaatacacacacaggtgcacagactacacggggatacatccaaagacaaggagttgattccagactaagaaccctgggccaaagctttctccctctagggctgctctctttcattctgacctcaaactccagattctcagtggggatggctgtggggagtgaggaacgggggcgggggggaggagtaacagcaagagcagccagttggctttcctccagcgtttaagggcgcacctcgttaattgcttgctggaacagaacctagagtaggaggaagctgaaccacctgtaaaccctctgattttcaaagacttattgcattcctagtatatgccacgcatgtgccatatttgtaagccaactcccacgatttatccgttatcagctggactcccatagcaccctgggttgtaactgtgggtgaaaaggcctgtctcctttctctttccccagttccctgagacaggaccggtgtcctgcctggggtatccccagagtttggcacacggtgatagccaacattcactgagcgccaaagggccaggtgctgccactctctcaaaataagcctctgccacttactgaacaactagtctgcgccaagcactgggatactaagcctacgactcccagaaaggtcccggcggacccccgtgcgcagcgggacgcagtgggcgccagggaccgcagtgccccgggcccagcgctcttctccaggtgatcgccggggaggcaggtttaaaaggcaggagccggaagccgtctcggcgcccaggtggccgagaatccagtcaccaggtcactgagtcaccgatgggggcgaggacacgggcctgggccggtcagaggggcgggatcgtcacccctggctcaggggcccctccgtccaggcagggagccaaagtcagtcttcgcttgagggttggcggtcgctggaagtggtagccattgggagttacactaatcccgcgaagggtgcgcaagggaggcggcagccccccccaagaagagaggcaggccggcctccagcgctccccgcccacaagcacgtccttgcccccgggaggttgtttgccggctccaggatctccctcccggcgaccccggcctcgccgtcactcaccctccagtcccgggtgactcagaacgctcggccgccggccgcaccactgtggccgctgcaggggcggggaacgcagtgaaggggcgcggcgcaggtgtcaggttgctggagaggcgggcctacagggcggaaaccaccggcgcgggtgaccggaagccccgcccccaacatggccgtgcccacaggtctcgttggaggccgtgcctttatcgtcatgtgacgcgagtcctcgccccacccgtctgcagccactcctggtctcagtcccagagctcgagagggccacgtgaccgtcccggggccagtcacgtgaggcgcagatcctggctgggagggggttggtagaggggtccagagtggcagtaaaggaggaagatggcggggtgcagggggtctctgtgctgctgctgcaggtggtgctgctgctgcggtgagcgtgagacccgcacccccgaggagctggtaagaagccggcggagtcggcctggggagggggcggttgctaarggactgagagaggcgttgccgggggtggggccgggccaatctgggcccgcaggtggcagcgggtggggcctggggaccgcagccagggctctcgaagcgtctaccctgcttcacgtgcctaagtctggggtcttttctcataacccctcctggaatctgagggagaatccaggccagctccagtaaatcccacccatgtttccttttatttccatctgaaaagagtttggaatgaaacaagcgttttcagaatgagcttcctcacaggactttgtgcttatcatgctgctgttttagcttctccagtcctttctcactctatccctcaccctttctgggtcactgacagtccagcttccccctgcaaagcatcctgggaaaacttgagttgtgttcccagagttgacaagtcctttctgatttcagatacgtcacactgtcaaatggaacctgcatttttaccccccttttcagctggcgttggacatctttgaggtgtcctgaagaggagggtggttatttggagactatcagtggaaatgaagagctcagctgatggctgtagatcctcacccacatggtccctcaccccygaaaggttttttttgagggctggttcctatttgataatggctccagatgatttagaagctagccactgatttcagtaaatacttctgcctccttccactcctaaccactaaaaaaggctccctctgcggatctgtktttctagaccatccttggagaaacacaggaggaggaggatgagattcttccaaggaaagactatgaggtgagctcctttgatactgcttgggcaactaaagtagtgagtggcctggtcacttcaggccgaagcattatgattccaaccagagatgctctttgaccttctgtcccagggagtgagtgggtaagagaacttccttctaggaaagagactgtttagcaagcccttttctcaccttaaccccaaaacaaggtctggtgtttttacacgtttataaatctgtggcaccttaacctggatagagtatgtatttgccattaaactgtttgcttttacagcttacagagagacttagagtgaaaggcactggcaggcagtatgtgcccctaacaggtgtgtgcttataaactgttaaggaggccttgcttctcttctaggagagcttgcttttcagatattttcttgctcaagcagcttctctctgacatgttcttgattaagttccacctttcatgtatgggattcttagagtatgtgtttttagtaaagccaacactgctggggtgaaacaacatgcgtgactttttatcattaaattcttaaacgtaataaagaaggtagagaaaagcctataactccattcattaaaagatgactgttaacaccttactaagtatctttctacatccttacccatgcttttatatacatgatacatgctttttttaagtaacaaaaatgagattccactaaatcatctattttaacctgtcccactcaccccctttattatactttttgtatcattaggtaattttccacaaccttttcttttttttgacagagtctcactcttccataaattcttcatgctgtagaatttagtgtcagcgttaggatttgtagcacttttttgtttaacttttattatgaaggatttcaactatatgcaaaaacagaataatctgttgaaaccccttgtcctcatcacacagcttccacagtgatttagctcaagcccagtcttcttttgtctgtgctttcgttatccacttctcctttctcatattattattttttattgtatgtgtgtgtgtgtttgtgtgtgtgtgtgtgtgtgtgtgtgtgtgtgtgtgtgtgtgttttaaagtaaagacagtctccctatgttgcccaggctgttctcgaactccttgacaccagcgatcctcccatgtcagcctcccaaagttctgggattacagtcatgatctaccatacctggccgcccttcccatgttattttgaaagaaattctgtacatcatattatttcacccataattctatatgcatctctaatggataaggacttttaaaaagcataacccaatactattaccacatctaaaaaattaggaatttcttgatatcaaatatctactgtccagattttccagttttcttgtaaatgtcatatgtattttaactttatttgaattaggttccaaaagtccttttttatttgtttgataaatctgttaaatctcttttaatctgtagcttcttccttcatcttttttttttttttgtaagttatttgacaacataattaggacctgggattttctactgtctagattttgccatttggagccgtttgtatagtttaatatgctactctgatgggactgctttgaatgaaccaaaaagcactgtatccactgctgtgttttgttctatttctttttttttcttttttttaaatttgagatggagtctcactcttagtgcccaggttggagtgcaatggctcgatctcagctcactgcaacctccaccccaccctaggttcaagcggttcttctgccccagcctcccgagtagatgggattacaggcgcccaccaccatgcccggctaatttttgtatttttagtagagatagggtttcaccatgttggccaggctggtctcgaactcctgacctcaggtgatactgcttcggtctcccagagtgctgggattacaggtatgagccactatacctggccattttcttctgtttygtaagtatttgttttcttgtacatagttgagaagtttgcaggaattagtataagatactccatattgttctgtcaccttgcactccctcactgaaccctgttacatcatcctgactgtatcaccaggactgagactgtctcacagccttcatcctacttctaggagctcaccaaggcttccccattgacacccaggctccctcaccccttctactaaattgtacttacatttgtaatgtgcttgccttcagctgatatgcatattcatgtaaatttttgttgttsttgtcattgtttgagacagagtctcactctgtcgcccaggctggaatgcagtggtacggtctyggatcactgcgacctccacccccgcctctgagttcaagctgttctcctacctcagcctcccaagtagctgggactacatgcatacaccaccatgcctggctaagttttgtatttttagtagagatggggtttcaccatgttggtcaggctggtcttgaactcctgacctcaggtgatccacccacctcagcctcccaaagtactgggattacaagcgtgagccaccacgcgtggccatattcatgtacatttcatgggttaatgttcttttgatattggtcattgatatttctcaaccatcttcaagaatgagcttcttgagagcacttgctttgtgtaagaacaaattcaggcacttaaacagaaaagtctggattttatttattcaataaataaatcaacttgacacaaaaagtataataaagaggggagtgagtgggacaggttaaaatagttgatttagtggaatctcatttttgttatttaaaacacgtgttaaaagcatgtgtataaaaacgtgggtaaggatgtagaaggatatttagtaaggtattaatagtcatattttaatgaatggagttatagggttttctctaccttgatagtcagtcaactagaaaacccttctgttgaatatctttctaaaaagtgccccttcttcctgtctcaggaagagttcattgcacatatttgactctttrtttgataaatttagggtcttacaaaatgttagaatcccattttgacatccattctcattataggtggtttgaaaaatggtaactttctgtgagatgtgccattgcaaacaggaatgttttcatgcaggtcacacagtctatttatattgtacctttgaattagaaagaggcacactcagaacgtaagacttagaattaaaggcctcccccactggccatagcagcacccctagctcacaaccagttgaaggtggttttggtgtgaacactaagatgccccttcctggttgaattggggctggttcagcccccacctccctcccggccaggtgccattttgctcgtaaccccctgtaacagccctgcaagacacagataacattttatttttttaaaaagttgttagtcccctaaaccaaagagcaacatatactgcagaaataaaaagttartcatagcaaaggagaagtaacagtatctggttttaataatagctcatatattccattggtacatatttacaaagggccaaactcaactaatttatttaaaaaaaaaagaagcgtggcacagtggctcacgcctatatgctcagcactttgggaggccaaggcaggaggatcgcttaaagccaggagttcaagaccatcctgggcaataaagtgagactttgttcctacaaaaaaatttgttcaaaattagcagggggccgggtgcagtggcccacacctgttacccccacactttaggaggctgaggcaggtggatcacttgagcccaggacttcataccagcctgggcaacatggcgagactccatctcaacaacaaatacgaaaaaattaacgaggtgtggtggctaacctgtggtcccccctactcaggagatcgaagcaggtgaattgcttgagcccaggagacggaggttgcagagagctgtgatcacgccactgcactccagcctgggtgacagagcgagaccctgacaaaaaaaaaagggattctggtgttctagcgttgcggttgtttctaaatgcccttcttagcagttttattgcactataattggcatactattcagttcacccatgtagagtgtacaattcaatggggttttaaaaattagtatattcacagagttgtacaaccattcctacagtcaatttttttttttttttgagacggagtttcgctcttgttgcccaggcaagagtgcaatgttgtgatctcagctcactgcaacctctgcctcccgggttcaagtgattctcctgcctcagcctcccaagtagctgggattacaggcgtctgccaccacacccggctaattttgtatttttagtagagacgaggcttctccatgttggtcaggctggtcttgaactcctggcctcgggtgatccgcccgccttggcctcccaaagtgctgrgattacagacgtgagccactgcgcccagctaattcctacagtcaattttagaatattttcatcacctgagaggaaaccctgcactcattagcagccactgcctgttctccttgcccctgactccaggcaaccagtgatctcctttctgtctatttgcctattctagatatctaaaaaccttctaaatgtttacggaaccatatcattattagatggaaccatcaatgaagtacttgaccagtaatttccatacatattttggatgaaggcaagggtattgtttctcctctgctctcaggcaccactcgcggaacactgctaacaccgatatgtggaggttgtttccccactactcaggaggctgaggtgggaggatggcttaagcccaggagttggaggttgcagtgaaccgagattatgccactgcactccatgctgggtgacagagaaagaccccatctcaaaaaaaaaaagtagtaggttgtcacctgcatttctcagcagctggcagtgaattgaaggttcacaggactccctccttgagtttggttaacttgctagagcgggtcagaaaacacagaaatgctacttacatttgctagtttattaataaaggatatcataaaggatacagaagaacagccagatggagagattcaaggaacgtgggagggggcacggagctttcatgccctctccaggcacgctaccctccaggaacctccaaacggttcagctgtctggaagctctctgaaccttgtcattttggagttttatggaagcttttttatgcagtcatgattgattacatcaccagcccttggtgatcagcttaaccttcagcttcggtctcctccctggagggatgggtgtcccaccccgctaatcctgccttggtctttctggtgaccagccccttttctgaagccatctaagggcccccagccgccactcatctcattagcaaacaaaagataccacggctcaaaaaaaaaaaaagacaaagtatgtttgtgtgtgtgtgtgtgtgtgtgtgtgtgtgtgtgtgtgtgtgtgtgtgtattgttggggctcagaaaatgatacctggaaatatggtgctttgatatgctgaactctccaccctcacactttgtctctcccaaagcacaggatgaggctcttctctgccgttcccttatctacctagaaactggacctaccagagaggaacacagttgtctttgatccctttcctgaaatgtcattaaccagggaacattaaaactcatcttacagaggagactgaagaccaaacaacatacctagagcctggacaaactgtcccaaccgttgtttgttcactgtcccatacaatttccaaagagaatcattcacaagatgatatctgcttcccagatccattcattccccactaagaattatttcctcccacatccctatctccccttcccctgtgaagaagagtatagaagcgtctgtacctcgctggcattattgggtaatcattctgcagttcccctgtgcaatgcatgttaaataagtggatgcctttgctcccattaatctgccttttgtcggttcactttcagcagacctttagagagtgaaaggggaagcttttcctcttggccgctacaatacatatgtaggtgcatatatgtttaatcacttatggatgagtctagtttctaaaagtacttttttcatcactgtgtttcttttctgatcagtaaaaaagattttttttttttttttgagaccgagtctcactctgtcgcctaggctggagtgcagtagcacaatctcggctcactgcagcctctgcctcctgggttcaagcgattctcctgcctcagccaccctagtagctgggattacaagtgtgtgccaccacacccacctaatttgtgtatttttggtagagacggggtttcgccatgttggccgggctggtctcaaactcttggcctcaagtgatccacctatctcggcctcccaaactgctggaattacagacgtgagccatcacgcccagccgatcattttttaaaatataaaaaagcacaccatttgtgctatgagaatttcagacaacacccagaaacaaatatctccttaagcactacctcacggatgttttyccattatgaatgctgacktacaaataatcctaattttgtttaatcaaaaagggatattatacttttaattctccatcctgctttatttttattttttaattgcatcttgctcttttgctgaataatttttggagattttccatatctttctatatagacttaactataatcattttattggtgtatagtttactatatttggatgtataattgatttactcagtcacttgttggtactccaggactcataaaaaaagaatttggactaactctaggtagtcatatagatagaataaattgtcactcatcacatgtgtttggctgacttgaaactattgtctgggagtgtggctgccacccagccaatgtccagctgatgtgggtaggaacaggttgtgggaaggagagctgatggccgaccattatttttctttgttgccaaactgctgcgtcttttttttttttttttttgagagtgtctcactttgttgcccaggctggagtgcagtggcatgatcttggctggctcactgcaacctccgcctcctaggttcaagcagctctcctgccctagcctcccgagtagctgggattacaggcgtgctccaccactcccagctaacttgtatttttagtagagatggggtttcaccatcttgcctaggctggtctcgaacttctggcctcaagtgatcctcctgcctcagcctcccaaagtgctgggattacaggtgtgagccactgcacccagcccagactgctgcttctctaacaagacaactaaaatgatttcctttgaattgtttctctaaatgtctgtggcatacctgcaagttgcttgcaggatttctgtgttttgtgatgcatgttgtaaaggatgctgcttcagatgtagaagttttaggagccgagagccaagctgaatctgtgcctcttcctaacataaagtggaagttggccaggcgcagtggctcatgcctgtaatcccagcactttgggaggctgaggagggcggatcacgaggtcaggagatcgagaccatcctggctaacacggtgaaatcccgtctctactaaaaatacaaaaaaattagccgggcgtgttggcaggcgcctgtagtcccagctactcaggaggctgaggcaggagaatggtgtgaacccgggaggcggagcttgcagtgagctgagattgcgccactgcactccagcctgggcgacagagcgagactccgtctcaaaaaaaaaaaaaaaaagtggaagttgcttttaaaaatactttccatgttagtttgtcttgtgactaacctcatttccatagacactaactacaaaagataattataactaattgacattctaaattaatttggttctggctaactgaaacttttgttcatatctaatggagtaagtttcataaggctgatgatagctgaaggtctttaaatattttgccaaaacaggaagtttaaaaataggtaatttaaaacttctcctaaagcatgaagtatgaacctaaagcaacaccactcaaattttaatgtgcatctgagtcatctggggctgcagggctgcaggagtctaagattctgcattttgtttttgtgtttgtttttgaaacggagtctcgctgtgtcacccaggctggagtgcagtggtgcgatctcggctcaccacaacctccacctcccaggttccagtgattctcctgcctcagcctccaaagtagctgggactacaggtgcgcgccaccatgccyggctaattttgtatttttagtagagacagggtttcaccatgttggctagactggtcttgaactcctgacctcaggtgatccacctgccttgacctcccaaagtgctgggattataggcatgagccaccgcacccagccagattctgcattttgaaccagctcctcctgggtgctgcaggtaccactgctctgcccatccacacgttgagtagcaggaacccagaggtttgtccctttgcaggtcttctcacctgacatgaccttttgactcaactttgcctcttttcagagtttggattatgatcgctgtatcaatgacccttacctggaagttttggagaccatggataataaggtgggtcttacaattcttcatctctggggatcaaatcagtcttaacatggcattttttttctcttctaaaggccccagtaaacatctttacaccttgttttttgaaccttttcatgcgatacaggcagacctcactttatgcgctttgctttatttcacctcgcaggtactgcaggttttacaaactggaggttggtggcaaccctgtgttgagcaaggtgccatttttccaatagcatgcattttgtttgcattttttagccataaagtattttttaattaaggtaggtacatttttgtaggcataatgctattacacactttatagacctcagtatagtgtaaacatcacttttatatgcactgggtaaccaaaacactcgtgtgactcactttattgtgatatttgctttattgtggtggtctagaaccaaacccatgctatctgyaaggtaggcctatgttggcatttattccctaggcctttatcctgccaaccagagttccccctgtcagtgcaccttgcccagcctcttaagagtccatcatttttgcactgtaaagcacctgaaatcccaacatcatctttactgtgcctgctctccacgtggaatttagcttaaaactggttggccaagatgtatttcttcccctctgccaccataaccctgtaaactgaatcattcttttcctrtgtgaacagaaaggtcgaagatatgaggcrgtgaagtggatggtggtgtttgccattggagtctgcactggcctggtgaggaggcagggcctggagggatggtgggccatagggctggaggggcttacagggaaagccctggcctggtgaataacattgtcatttgtcattataacatttataacattataatgcaataacacttgtcattataatcaagagtgccttttcttttttcccttttttttttttaaatgaataatcctggcacagtttttcacacttcccctgcttttgctttgtgaaatgaaagcgagacacatgacaatggtgctcttgaagcgctcaaaggtttgggcaggactttatcttttatgatatgattatggatcataatctctaatctacctagtaaactagatgtctccctaatgggtagataatgcattgggtagagtaaataatggaagttaaagttacttttttttttcttttaatttaaatagagacagggtctcgctttgtcaccctggctggagcacagtggcgtaatcacagttcactgcagcctcgaccttctgggcttgggtgatcctcctacctcagcctcccgagtggttaggactctaggcaggcatgagatcgctctttagggaaaaagcgaagtcgtgggtacggaactgtgaacatcgtgcccttcatttagcacagcgtgccagtgaacagggtggcacaccatagctattgatctcatgcagggagtttatggtgctatcctgggctcctccccgtacgtcgttaatgttatctagaagatagagccagcagctgtgagtgaagggatatgcccgtatgaacagagttggtggaggcagcaacttcacaggtgaatcaaagacaaggcaagattggaaacatggccaaagatgaggatagcaaaaagtctggaaccaaaactgccgacttcacattgttaaatatgaggaagagaagctggaaaaatcagcatcagtcaaaaagatccatgtcaaatctgattccggtcagtacagtgttgggatagggtatctgtcctcagtaacagcctgttgaccacctttatcttgaactggccacaagcctcctacttaatttgacatgatatgcctagaaaatgtacacatgtgttcggtataatatagccacaggggccaaccacaatttttattttcatggcatgcatcaaatttttactatagtaaatccacaagtaaaggaacatcttactaggtaagactgatggcattcagaagccctcttcagtgatattctgatggataccattttggggaaacttgggttgatttattgttttatttaaatctcagggtgttgggccagggacggtggctcacacctgtaatcccagcattttgagaggccgagacaggaggactgcttgagcccaggagtttgagaccagcctgggcaacgtagggagaccctgtctccttaaaaataaaaaaaaaattaaaaaaaagaaatctcagggtatttattttgctatatatgtttctggttgcagatttctctataataagcatagtccttaggcctctagttgttagtgtttgtgctacttttatatcaaactctttggagctgccacttgtcagtactacaggttgagtgttccttatcagaaaatccaaaatgctccaaaatccaaaactttttgaatgctgacacgattctcaggaaatactcattggcgcattcagattttggatttcaaatttttggatttgggatgtttaatcagtataatgtagatattcgaaaaaaaaatctgaaatccaaaacacttctggtcccaagcatttcagataagtgttactcaagctgaagcaactttacctcctacctttgtattttaggaaggcacacctgcctttatgacatagcactcccaactctygtccattgatgtgtggccactttatggcttcagtatcaaaaagcctccaggcattggcttgagggaaggccagagttaaaggcaagaagctttgatcctgaatccataaaattagaagtctttctagttctcctttaagccctgagcactttggagagtggaatactggaatttggttgttttctctacccagagtaactatggactataagatggttataagtcaagcctggcacagtggggtgtgcctgtaatcccagctacctgggaggctgaggcaggaggatctcttaaaccctggagttcaaggccagcctaggcaatatagcaagaccccatctcaaaaaaagatgatttcaagtcaaaataatgacttacaaaatagaacctgctaataaggaacatgcaaaaagcacatacacctaaatgaatgttgtgttttaaagcaagcttgtccaacccatggcccaacacagattcatataccttttaaaaacatttatgagatttttctgagtttttcttttcttagctcatcagctrtcattagtgtattttatgtgtggccaaagacaattcttcttccagtgtggtccagggaagccaaaagagtagacacccctgtgtcagtagtctttcttggtctcrcatctttttctgcacctgcttccctctttgttttccgttgcttcactcaacttagctgtactctctgcctttgttctttggaggggcagtggractgggctggagaagggatctcctccttctgcgcttttctgctgtgcattcacgtactgctggctggtgagcagcctccgtatgtgcagtgggggaggagatgccttyaagaggagcacacctgtactatacttgtgctacacttggaaataaggctgtgtgacagatctcttgctcttcacaggtgggtctctttgtggacttttttgtgcgactcttcacccaactcaagttcrgagtggtacagacatgtatccttttcacggttcctggtgttcgtggacttcagtggtcaccaagattctttcttacatagaaatgggtytaacagtaagcatrgtattagaagggccgcttattagctattcagctttaatatttctaatgatcactgaaggacacaaaagaaggactttaataagcaaagacatatacctatgtttgtggttgataagattacagatgccgcaaagatgcctgtactccctaatctgtaaatttaatgtagttccaatcaaaattccaatagaatttgttgtggaactcagaaattctttgtaaatttgtgtagaagagtaaagggccaaaagcagtcagtatagttctaaatgacaagaaggtggacttgaccctgtcagatatcaagtcttataaaattaacaagtttggggagttagggaaaaaaaagtcataaaatttaagatacagtcattgaaattggtcatattggtgcaggaatacctagacagtggaaaatgatagagaagcagaagctggtcctcacatacatggaactttggtgaatgacagttaatattacaaatcagtgagggagtgatgaatgatttaataaaagacgctgtgttatttaataaataaaagatacacatctctgtagtcccagctacttaggaggtgagcccaggagtttgaggctgtaatgcaccatgactgtgcctgggcagcatagcaagaccctgtcttaaaaaaaatgatgctgggacatgggtgatccatatggaaaaatagttatattcctatttcatactataaataagataaattccagatgaagatgtaaatatgcagaacaaaacttcgggagactatatgttgtcaagagtggggaataatttcttaaaactccagaaggcacagactataagaaaaaacatcaatggggccggacacagtggctcacgcctgtaatcccagcattttgggaggcagaggcaggcggatcacaaggtcaggagattgagaccatcctggctaacacggtgaaaccccgtctctactaaaaatacaaaaaaattagctgggcgtggcggtgtgcgcctgtagtcccagatgctggggaggctgaggcaggagaatggcatgaacctgggaggcggagcttgcagtaagccaagatcacgccactgcactccagcctgggtgacagagcaagactccrtctcaaaaacaaacaaacaaaaacatcaatggctgggtgcagtggctcatgcctgtaatctcaggactttgggaggccgaggcaggcagatcacctgaggtcaggagttcaaggccagcctggctaacatgacaaaaccccatctctactaaaagtacaaaaaattagctgggcatggtggcgggtgcctgtaatcccagctacttggaaggctgaggtgggagaatcgcttgaacccgggagacagaggctgcagtgagccgagatcgcgccattgcactccagcctgggcaatgagagcaaaactgtctcaaaaaamaacaacaaaaaaaaaaaacaaacaaaatcaataaatttgaccacatcaaagtacatattgtatttataaagacaaaaactccaaataacaacaataaaacaccataaataaagtgaaaacaagtccacagcctgagagaggttatttactatgcatttaagaggcagataattagtatccasaatacaggaagaggctgggcgcggtggctgacgcctgtaatcccagcactttgggaggccgaggcaggcggatcacttgaggtcaggagttcaagaccagcctggccaacatggtgaaaccctgtctctactaaaaatacaaattgagctgagtgtggtggtgtgcacctttagtccagatacttgggaggcagaggcaggagaatcacttgaacccaggaggcggaggttgcagtgagccgagattgcaacactgtactccagcctgggtgacagaatgagactctgattcagaacaaataatacaggaagaactcctgcaactcaatcagaaaaacaacagatggtccaatggaaggaaaacgagcaaaggatgtgaactggaattctcaaaagagaaaaactggccagtaaacctctagaaaaaggaaggtgcacattcctgtgactcatacattcctcttagaaatttgaaccgtagacatgtacaaaggtggtaattatagctttatgatagcaaaaagctggagtcaccaaatgggagaatggaaaaattatggtacattcatatggtatcattttagacatcatgtcatttctgtagattgtaaaataaaaattttagacaagtgaaagtgaacgaaccacagagttgtgtgtatcaacatggctaattctcaaagacttaatgttgagaaaaaaagagcaagttacagaatatacaagtgccgtgtacaacagtgtggacacttttgaaatacacacaataatttcaggttagtggtttctcccaggggagagaggaaggaaaactgtttttttttttgttttgttttgtttcttaaaatggtactgaatgttttcttttttaaaaatacctggagcatatatggcatgttgttgagatttgttaaagctacagttgtgagggtatgggtattcgttactttttgtaatgtttgaagtatttcctaatgtcaaaggcatctcaaacaattttttcttttttttaagagatgaggcctcacactgttgcctaggctggaatgcagtggtgcaatgacagctcactgcagcctcagcctcccaggctcaagcgatcctcccacctcagcttcttgagtagctgggaccataggcatataccttttgtactttttgtagcracatggtctcactacattgcccaggctggcctccaactcttaggctcaagtgatcctcctgcctcagcctcccaaagtgttgggattacaggcatgagccattgcacccagtcatctcaggcagtttttaaaaaatttttatatakagagaaaaagtgcactcagcagccagcatgatccaaaggagaagcagctgcaccctctcaagtgatgacggggacacccctcggctgatgaacaagtttccttaacccagtttccgcagcggtggaggagtgcagccagaaaggctgcctcgctctgtctctccttgaactcctgggttttaacctcacctttgtcttcctggcaagcctccttgttctcattgaggtgaggtggtttggattcacctgctcgcttaggaggttttagagtcccgcaytccttttccccacctccttccagaatgtcaggaaactgagaatgcagattcctgcagaaagtggcctcttgttcactaaaggtaaaggtttcacctctggtgagattaaagaagaaaggcctcccaggtgatgctcattcacagggaacttgtacagattctggggggaggaaaaaagggggaaagggctgaaaacaaaactgttgggtgccatgcgcactacctgggtgacaggatcattcatgtcccaaacctcagcatcatgcaatataccctcgtaacatacctgtacatgcaatccctgaacctaaaataaaagtggaaattatttttctttaaaaagtgcaagtctggccactttgggaggccaaggcgggcagatcacctaagatcgggagtttgagaccattctgaccagtgtrgagaaacccygtctctagtaaaaatacaaaattagccggtaaaaatacaaaattagccgggcgtggtggcgcatgcctgtaatcccagctactcgggcgactgaggcaggggaattgctggaacccagaaggcggaggttgcaatgagtggagattgtgccattgcactccagcctgggcaacaagagtgaaactctayctcaaaaaaaaaaaagaaaaaaaagtgcaagtcctcccattgcccctcagacctcctgagtcagatcctctggagtggggcccagcagctgtggttcwgcaagccctccaggtgacgctcacgctgctaatgaaggtggccagctctccctcttccgccgcccagattgttgagggtaagccagagaaccaatggatttcgagttatgggtgtgcctgctctcctccatcagccggtggcagcaggttccgggatacccgaggtcaaatgctatctgaatggcgtaaaggtgccaggaatcgtccgtctccggaccctgctctgcaaggtccttggagtgctgttcagtgtggctggaggtaagaagggtccaacttgtatccttcaaatactcaaagggcagagacgacaagaagcatgatgtatttcagttattagatttggactgcagggcccagcctcaaacagctgatgtctgcactttttgttgatgggctgtttttaaatgcagacactgttcgtatgttaccattcagatacctgacaaacacactcttcagttttgggatttggaatttagcttgtggaattagcttttgtcaaaattagcaagctytttgtgtcaacagccagatagtaaatatttaaggctttgtgggccaagaatcagaatggaagctcttatgtagatgtttatgtaactatttacatgtgtgcatttaagaacgtaaaagccagtcttagttctcaggccgtgtaaaaccaggagggagctggtggtctgggctcacaggctctcatttgctgacacacaatttagaatgtagagtgttttctcttctagcaagacttgaaatggagcttatttggtgggaatttggctctttctcttataaagtcttaggatcatctctgttcagttgtcacgaggaaggtttttgtagccaaggtctcctgacccaggggcgtttctgcactgactgttggtctttcctttttcaccctgcccagggctcttcgtggrgaaggaaggccccatgatccacagtggttcggtggtgggagctggcctccctcaggtaagatgrgctgagagrgtgtgggcctctgggcaggcctagtgggaggtctggttacactgggccaaatccattgggacaccctgacatcacattggaacctggtgccattctggcttcacgtgtaaaccatgtgtctatctctcaggaaagggcataacttatacttggaagttttaatgatgccctaccgagccctaggagcaaaaatgagacatagagaaaaactgtgacgtggcggatgaaagtcactgggtgcttccatagccatcaccaggcgcctctatatagggtggctgggtggatcatctcagtgctgccagatccaagaggctcgaagcatcgactgacatggttttaggcacagttccgtgctgattctagttggcgtggtacagtcataataactgctgctaattatggtctgtgtgccagacgccatgtatactaactgctttctccttatagccaccttcaatgattcgttgttattattacccccatcctcagatggggaaactgaggcttagagaggttgaggtactagctcgagacctcaaagctcccattcttgggggctactccagatccctggctgctgttggagaagtctcagttccctgtgaactgtcactcttagtcatttccctctccagtcctgagaagagggagttattgtggttgggagtctctgaggtgaaggagggaagattctttcgtccagagctcgtcttttggtctctctcctgctactgccttgagcaccagatctggcagaagtgagccaaggggtggaaggccaggcgtggagtgggcatcagtgtgcacctttgtggggcagacagaggacaggctctgggcccttctcttcctggcgctgctgagcagagcagactcggtcttctgcaacagcttccgcgtccccttccctcagctcagccatttgcctttattctttcagacttgttgactctgcacaaaatgggatttcagaaggtcctagaaacacgagggcaggaaaaataagctcctcccaagggtggggggtaatctccttttttcccaagtttttttattttcattttttgagacggagtctcactctgttgcccaggctggagtgcgatggtgccatctctgctcactacagcctccgcctcctgggttcaagcgattctcctggctcagcctcctgagtagctgggattacaggcatatgtcaccacgcctggctaaattttgtatttttagtagagacagggttttgccacgttggccaggttggtctccaactcctgaccttaggtaatcagccgtccgcctcggcctcccaaagtggtgggattacaggcgtgagccatgagctaccacgcccagcctccttttttcccaagttgctgttctggactttccttcctgcagcacacttacccaggtgtgctcaagcagaggggcctcccctgatgccgtggattcccatagtttcagtcctaggctgcccctgacctgtgttcttttttttttttccataattactggggtacaggtagtatttggttatatgagtaggctctttagtggctctcttttctcttgctttagtttcagagcatctccttacggaagatccagtttaacttcccctatttccgaagcgacaggtatggaaaggttagaaattggtttcttttttggaaacaacatgttcatgcgctgcgggtcagactcgacacttgctctagcctggcagtatcccctgcggggaaacccgactgggagaagggggcgggctttgaacttttcttctggaaataagaagccaaagcaccaggctggcatcgtgacttttattttgtcatgccgtaaggcctagaagcatctcaggcaaatgaagatggtcccagattaaaaacccaaccaagaaaggccacagacaggcatattcttaggaaggcgttttgtattccccagtgattcacttggtcagccaccctcctgggtcagaaggtactcttagtagacttcttagccctgtatcagatgtgtgtgttactgacctgccggcctcgtaaggctctttcaatcagagactcagtttagagtcacggaccaccttctttttgtattcctgcaagttcggcacatacccagaaggcaccttgatgtttttactgatgccggggttttctggaaggaagatccrgtgggaacatggtgcagcagtgatcgtgccgatctttgatctgccccctgagctgggggctgagattctgagatcacagaaaacacagaggtcaggggctcctgttcccaggcagagtagccgccatgctgaaagggactctggtgctaaggtgtgtggctctcgggtggacacactcgcggcaaaggctgcctcaccagtgacctgcccttccaggatccctgcctattcattcacaggtgtgagaaaatgttcatgataaggaagtcagaaaccaccttttgggggctgggggctctttattggataacycgtctctctcctctcctcagagacaagagagactttgtatcagcaggagcggctgctggagttgctgcagctttcggggcgccaatcgggggtaccttgttcagtctagaggagggttcgtccttctggaaccaagggctcacgtggaaagtggtgaggaggaccttcagtgaaagcrttaaccacacccmccgaattacactgggtgtcccttactcggtacatggaatggtagttttgatgagactgrgggggtcractggatcagaaacagctttcctcttgtgcccataacctccacactggactttctgtacttctcatatcaataccctccctaaccccaaatcaaaccgctgttactttttttttttttttttttttttgagatggagtcttgctctgttgcccaggctggagggcagtgacgcgatctcggcttactgcagcctctgcctcctggattcaagcgattctcctgcctcagccttatgagtagctgggattataggcacgtgccaccgcatccagctaatttttgtatttttagtagagatggggcttctgacatcaggtgatccacccgccttggcttcccaaagtgttgggattacaggcgtgagccaccacgcctggccttgttatcctttcttgatgaaccacctgacatgaaaatgtgaaactggctgttgtcataaagcaggaagtgatggggcttggactggagccggtcttctccctcagagcaggctgtccttccctttgcattgatccttccttttggtgcaaggtctggtctgtaaaggctgtaaataggctctcatagtagagtaggctgctggaacggaaacttcttaaagcccaatctagagttggtcatacctggggtgtatctactgtaagggtgactagatctctgtacccggatgtagattcyggaggtctctgygtagagcagtgggtaccaggaggaagggttgggagagagtaggacatgccactcctgaaccttcttgtcttttgtcacctctcccctagctcttttgttccatgtctgccaccttcaccctcaacttcttccgttctgggattcagtttggaagctggggttccttccagctccctggattgctgaactttggcgagtttaaggtatgttttgtcctttccccaaggatttttaatttgacccatgaaaatttcctctcaagtgaaggaccagagagaaatgagcagagggctaggtacaacttccagggrcacatctcacccattagcctctgccgtgcgggaaagcagccccactcttgcttctgtcttctcttctgtctcttccggttctcatggctgctatggtttttctctccctctccctttccccttctctcagtgctctgactctgataaaaaatgtcatctctggacagctatggatttgggtttcttcgtcgtgatgggggtcattgggggcctcctgggagccacattcaactgtctgaacaagaggcttgcaaagtaccgtatgcgaaacgtgcacccgaaacctaagctcgtcaggtatctgcacagtcgcctcccccccgagcctgctgcggctccctgagcttggtgtgggccgcgccatctctcccgaggagcggaccctgcctccacggctttgatttctcatctaagactgagaatctaaacacggccatgcatcttccctacttgacaggccaaagggctgagccagcttaattgatgtcagagttgctggttgactccctgcctgtcctgacttggccactcggacacatgacaaggttagaagggtcaccgtggccctgccgagcagcttgctctcaggaggcttctcgccccaggacttattataatggaaagccattcattccttggagagagatgatgtggacgtagcagcccactttaactgtccactttttacaaacaaattgctggaatacagcaaatcacggatcaattctgcacacatgttgactgaccaggggctgctgtgaatgctgttyggagaaatcggggctgggggtaggcagggttatgttttgaatttctgagaccagagctkctttctgtggcrttgtaacagctgtgctttgcctcctagagtcttagagagcctccttgtgtctctggtaaccaccgtggtggtgtttgtggcctcgatggtgttaggagaatgccgacagatgtcctcttcgagtcaaatcggtaatgactcattccagctccaggtaaccccagtgcacctgctacctttatcccataccacgaggaagaatccagaaatgtatgaccttcctctgttgagaactaatagatrtgttgggttcatccttccacacccattacctgagcgttgagagatatgggaatctgtagtcgtctttttacctcagagaaagtgcacaccacatgccctgtgtctttgccacttctgtgaacaaccctggcgtcacagaggggaacctgggaacaaccctggcgtcacagaggggaacctgggaacaaccctggcgtcacagaggggaacctgggaacaaccctggcgtcacagaggggaacctgggaacaaccctggcgtcacagaggggaacctgggaacaaccctggcatcacagaggggaacctgggaacgaccctggcgtcacagaggggaacctgggaacgacactggcgtcacagaggggaacctgggaacaaccctggcatcacagagggcaactcctctctgttgaacaacactcatgggaaacagacacttggaaagctgacagcaaggtgctttctgagccccagttactcttccacctccccttgcctgaaggggccacagcccagaggctcagcacccacctcatggcctctgtgactatgacagtcactcttgagaggaagaaatatctgtgtcagggcaaggaggcttctctcttcccagcatcctctgcctcttcccggcgttgggtcctttgtgggtgcgccaccctcctgcactcctccttttcccttcttggggggcgcgatattttccagaggctttccctgaggagtggtcccatgaggtagtccgtggagcctactccacgctgtgttctttcggtccaacccggaggctctgagagctacacctgtggttcagtgagtcagccagatgtgtgattccagcccttggctgcagacaggtgagcattctctaagtgcggtcggccatccacatttgtgggtcctgcatccatggaattacgtagggtcaaccaactgtggagcaaatatattcaggatgcaaaacataaaaaagaacaagacaacagtaaaaaataatgcaaataaaaaacagtacagtgtaacaattatttacatagcatttacattgtattagggtattataaataatctagagatgatttaaaagtatataggaggacctacataggttatatgcaaatatacaccattttatatctgggacttgagcatccctggattttggtatccatcgggatcctggaccctatccctggtgaatackgaggaacaactgtactctttycttgttgcttctctgtaaccacttgaatctctcagatccccaytggggcccttgtcttggaggacagcctcttcagtgtccccagttatatgtatatattatwtatatatatatatatatatatatacacacacacactatatatayacacayacacacacacacacacacacacaaacacacattatatatttctgtttgttttgtttttttaagacggagtcttactctgttacccaggccggagtgcagtggcgcgatcttggcccactgcaacttccgcctcccaagttcaagtgattctcctgcctcagcctcccgagtaactgggattacaggcacccaccaccatgcccagctaattttgtatttttagtagagatggtgtttcaccatgttggccaggctggtctcgaactcctgacctcaagtgatccacccatctcggcctcccaaattgctaggattacaggtgtgtcaccacgcccagcctggtttatatatatatgtttttgtttttgtttttgytttttttttggcaaagtctcactctgttgcccaagctggagtggagtggcaagatctcggctcactgcaaactccacctcctgggttcaagcgattctcctgcctcagcctcccaagtagctgggacttcaggcacgcaccaccattcccagataatttttgtatttctagtagagacggagtttcactattttggctgggcttgttttgaactcctgaccttgtgatccgcccacctcggcctcccaaagtgctaggattgcaggcgtgagccaccgtgtccagctggtttatatatttttaaagggttgagagaaaaaaaagaatatgccgcagagactgtacatcactggcaacttctaaaatatttactgtctggctctttatgaaaaagtttgccgacccctgttactagttattcccaagcctagctcattaccagacagataccttgatgcgtgtgatttaaagcatacaaaaaacgattctgtggtcaaatgggctaggaattaaatatgcttctttatctttttagagacaggatctcactctgtcacccaggctggagtacggtggtgtgatcatagcttattgtaacctcaaactcctgggctcaagcgatcctcccatctcagcctcccaagtagctgggactacaggtgcatgccaccacatccagcttatttttatagagacaggatctcactatgttgcccaggctggtctcgaacttctggcctaaaatgatctcctgttttaggagtgctaggattatagacacaagccatagcacccaacctaaatacgttcctttagtacagaacttctagggccttattcccataagtgttataaatgtttggtgtctttattgtgtaccagatattccactgagtactttatatgatttcatttaatccttatcagcactgtgcttgctggccagtagctgtgcccccattttacagctaaggaagctgaggcacagtatggtcttgaccaaaaaccttcagctagtcatatatagtgagagggtaggtgttgttaccattttataggtgaggaaactcacaaaatgaaatatccttctcaacgtcactagagagtggcagagtttagagacaaagccatctgattttggagcctgtgctcagcttttagcagacacactgatttccaagaattgctaggatgtttctcagtgcagttgaccacaggactctctggaaagccttcaggactgaacttcctccagacagtttgggaaacactgcatgtgtctattatgaagccatcagctgagctcatcccccgtgcactccacaacgctgaggctctgcacatggctcaccagtgccaggtgctgccagtcagcagtgccgtgctgtttscacagcagcctgcatacgtctatattgcccagccygtttcacctggcggggtcacacaaaccaccccctggtattgttagcacgtccacataatggcatctccacagctgtgtcatccagaagaaacccatagccttgattaacctttgtaataagactccctatttgcatgcacagtgataggtgtgaagtacaaccttgtaccgttgtacactgtcaactagaaaataaaacagcacacttgaaacacccttgccttctagcaaagatcccatcttcccacacagaatgatggcaagaaaatgaggtctaaaatgtgtagaagtagtagaagaaataatctctttttctgtttgggttttgttccccagatggggtctagaaggagaggcagcctggaggactgggtctgctctccaggcattatggaggtgggttttcttttgcagcaaattcaggtgctttttttttttttgtagcaaattgcagcaaaatcaaaggctttttctatttggaaccagagttggggctttcggtcaagtggtgccctggattttcctccccagatacctgtcaactcccagtcacttgctctcacctgcctcatattcccccagtcctagggctctcaggccaggcttctagcagcatcacttagaaagttagcaccgggagaggaagcagaaccaaattcacggtgaatcacggccatagtgacattttcatcatgagtgtggatgaacaaaaggccctcatcccgattctttcatctgtgcattcagaatgtgaagaatacacttgcccgtgtggctgccgttggtagaggtcagtttttggcctgtttgattgatggggaaagctgtgcagccacctgttttggacccggctggagacatcccacttgaagactcaaagtcaggtgtccttgtactgattttctgattccttcttctcaggtcacagaagatgtgaattcaagtatcaagacatttttttgtcccaatgatacctacaatgacatggccacactcttcttcaacccgcaggagtctgccatcctccagctcttccaccaggatggtgagtgtctgcactgcagcccaatcrtgggtgattggtgtcatctcggacacagccaggcttgcccttcattccaagcaagaccaggacttctttgtaacgcccacccagacaaaagattggtttctgcctccwgtgttggaaggggaactggtatggggtgtggtcgggccyggtaggtctactgggccttggcaggcatccggtagtgggactcaggttggctcttcccttgcaggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaaggtactctgtgtgtgtgcgtgtgtgtgcgcatgtgcatgtgtgtgcrcgtgtgcrtgtgtatgcatgtgtgtgcgtgtgcgtgcgttgatgtgtctgtgcccatgcatgcacatatgtgcataggcacaagagtatgagctgtaggtcctccccacagcctatcartgtggttcaaagccatgttctcggtgttttccttcactagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtgagcacactccctccaggcccctgtcaggctcagggccacgtccgccccacaggacctatttttaggtctttgctttgtgtttcaggtggccaaatggacaggggactttttcaataagggcatttatgatatccacgtgggcctgcgaggcgtgccgcttctggaatgggagacagaggtggaaatggacaagtaaggccatgattttgctcatgtcctagtttcagaatgtataagctctgaggcctaaggaatgttgttattagggtaggaaacagtaactyacttttcttgggctgaaagaagcaacacacccattcctgagcatgtgtgagaatgtggagcagcccatgggctgggggctgcgggggcagggcaggggacacgggcactgtgggactgcagtgggcagggcctcttcgtggtggtttgactcccatggcattctggttagatatgaggtgaggtctctggatcaagttcgtgatgtgattgaatgtttaagggtatgccaagccccaggagtgagaatagcctgtttcacatgtgcccaccagaatgccctactgccagccgggattgttctgggcataatcacctcataacccacctgctaatccacaggtacctgggcttcctgtgtctagatagcaggcaaggcccttacgggctaacacgggggccagcaagccgtttctgtggagggccagacaggagtttattttcaactttccgggctgtatggtctctgtcacgactactcgactctgtcattgcagcaggaaagcagtaagcgtgacggacttgatcagtgggctacagtttgctgtgccctgatctaaagggggacccaagtgctgtgtttattttattattattgtttttcttttttgggacaggatctcactctgtcgcctaggctggagtagggtggcatgattatagctcactgcaacctatgcctcccaggctcaagcgatcctccacctcagcctcctgagtagctgggatcacaggcgcgtgccaccacacctggctaatttttaacattttttttatagaaatggggttttgctgtgttgcccaggctggttttgaactcctgggctcaagcaatctgctggcctcggcctcccaaagtgctgggattacatgcgtgagccgctgcacccagcccacccatttacccagttgtggtaaatgctgtagcagaattagcagttcaggggtagtatgtggagcgtgctgcagggcaccgaggagggcgtggccagcccctggaccagcagccagggcttcctggtgaggggatgttgctgttgagctgagggatgagcccgagcccatcagcctggtacagcagggtacgacattccaggtgcgggaacagcatgtgtcgggggatagaagtacaaaggaatgcatcgggtttgagggagagctggggcagttcagaagagccccccaccccgcccgtggtctgagcagrgctggagagccagcacagcttsctcccaggggcctgcgggcactgtcatgaggctggatgayttgccctcctcccccaggctgagagccagcgacatcatggagcccaacctgacctacgtctacccgcacacccgcatccagtctctggtgagcatcctgcgcaccacggtccaccatgccttcccggtggtcacrgagaaccgcggtaacgagaaggagttcatgaagggcaaccagctcatcagcaacaacatcaagttcaaggtaaagaaaacggcatgagaggaaaggcaggtgagagacaagcggtcccgtctcacacggcttagtgctttgcccacccctggctggggtggacttaccggctctcaggggaagttggcactgttctcatcacaygcgacagggagagtagatttgacagcaggggcagctttatcaggccgtgaagatgtgtgtgcgttcttgccgcaatgagcatgtggacagatctgtttttcaagtcagcagctttcatggtttgtttaccatgtgagagtatcagggagagttctagagatgccagcaacagaaatggacttcgacctccttaagaaagagaaagaaatccacaggaaagctcaggacagctgggaaagctgaaggaccagaaccaygtgctgtggggagcagtgcagggtctagcagacatcccttgggtaccaggargaaggagcactggccctgggttcctcctgattccgattcagaatccagggagagggggtatcctgttgcctcacttgggtcatgtgccactccttggctttgggggcaggcacgttgattgaaaattctatcaagacaggatgtaggagatggcttgttcccctctggagaawcaagctgctcttcccagattaaaggaaaccacagaagctgcagccaggtcctagggttcaggctcatttgaaccaccagcctgagccactcttttgaacctcagccccattaagttcctgcgtccggatgtgcttctgaccctccctgtcacccaaatccttaagctccatcagtactgctgtgttcgtttgcccatgcgcagtagcctgtggcctccccacccacagaaatccagcatcctcacccgggctggygagcagcgcaaacggagccagtccatgaagtcctacccatccagcgagctacggaacatgtgtgatgagcacatcgcctctgaggagccagccgagaaggaggacctcctgcagcagatgctggaaaggaggtgagarcctggcggggcccccactgcccgcagggctacacagcggtggggtgagccyttggctcagatgttktgaggtggctcctgagtttcctgggaaagttggatggggagcgggctgggaacatggatcagaagcgctcccgctgagggtatcccaggcagcatctggtttttgtgtaacagatacactccctaccccaacctataccctgaccagtccccaagtgaagactggaccatggaggagcggttccgccctctgaccttccacggcctgatccttcggtcgcagcttgtcaccctgcttgtccgaggagtttgttactctgaaagccagtcggtaagtctctccgaggcagaaatcagccaggccagrcctgacgaagctcgaggggttgggcgctgccggcgggccgtgaacagtgccatagggaaagctgaatgcaaggcgagaagtgcagagtggacttaggggaggagtcgccacagccgggtggtgagaagcaacagcggtttattccttcatagttcaaggccagaartacaaaatccgggtgtcaccagggcagcgctccctggctctggtgctgtccttgccccttcctagctcatgggagttgcctgcagaccttggtgctcctgactgtgaacacagcccccatcctcgccactgtcatcacacggcgttctcctgtgtatcttctctcctttccctaaggacgcttgtcaccggatttggggcccrccctaatccagcatgggttcatctgaactcggtcacatctgtagagaccttgtttccagaaaggtcgcattcataggtactagggcttaggacttggccatatcttttggtggggggacacattcaccccccagccactttacttagtgctttctcacttaaacttccwaataagccatttgcatctcatgaatcaggaagaaagggagtgcagacagatcaggggacttgcccagggtgccacagctaggacttggccaaggactyggtttgactrgagagctctcactctggagcgcttgctgctgctgcaccacctgcctcagcagcctggagctgggcatattcaggcatcaaggggaggggctctaaggtgaccctgctggccactgctgcctgagcacggacagtgtctgggttggaattgcagagcgccagccagccgcgcctctcctatgccgagatggccgaggactacccgcggtaccccgacatccacgacctggacctgacgctgctcaacccgcgcatgatcgtggtgagaagggctgccccggcctgtcccatgcggagctgcctcttcatgccgttggcgtctcaggcagtcagtgacacgtggtctctttgcaggatgtcaccccatacatgaacccttcgcctttyaccgtctcgcccaacacccacgtctcccaagtcttcaacctgttcagaacgatgggcctgcgccacctgcccgtggtgaacgctgtgggagaggtgagcgaggccccggccctgcccccacctttgagagaggatcccctagccaggtgctgtttgtgcacccakgcttctcaccagaaacgtaggcatcccaccaggaggggagagtgtggcccaacactagckttgaaccctgctcggcttccgtgcactcgggaccctttcccctgcctgccagcagatggcaccagcgtcccactggccgtcctttccagccagagccgcgcctctaccaggctgtgtcttcctcctgaaatgttgctcttcactccgtaccactggtgttccttggttctccacctgcgtaggkatttgcgcattagatgagagaatttcaagcaaaatactttgagttttacaaagatataaaacacctagtaattattgctgcagactttccttttttcttctttttagaacttcattattttcttattacacaaatattttcttattacacaaatatgatttcattgtaggaaaatacaaaaacacatatgagcaaaaaacaagcaaaaaccaaaccctcgtccctaccctgtcgcggtagccctggtaacttttcaaggccaccctctcagtcttttgttgttgttgctgttgttgttgttttgagacagggtctcactctgtcacccaggctggagtgcagtggcaagatctcggctcactgcagcctcgaccttccaggctcaagcagtcctcccacctcagcctcctgagtagctgggaccacaggcatgcgccactatgcccagctagtttttgtatttatggtagagacacggtttcgccatgttgcccaggctggtcttgaactcctgaactcaagtgattcacctgcctcggcctcccaaagtgctgggattacatgcgtcagccactgcacccggcctcagtcttttcttctayrcggcacaaccctggcatgcatagtgcgtacttacacaggttttgttgcagtaggttaacttatgtcccttgaaatgtaattgccaactacactgacagagtcctaacatagtttatgacgtggctttggagttcccaacaacagtgacacgtgggaaccactgtaacgacctgtaacaaatgactcccataggtcactttgcaaggtggtgagtatgaggcatggcaggggtcataatctcaggagacttcaagggccccaccgcttgcacatctgtgaagcaggctggtcatgatgggagctgagcgctgagcatgtgccctgtggaaggacattttagttcagatgccagctggcccaagccctttttggagctaaccttgtccccttggcctccartgtgtgagccctcgttagctgtttatcccaatcaagctgtgtctggctgtgcactatccaggcctccacattctgtgacaaactaacagggccggctcctgtcactyctgttctcgccagcgggttttaccctkaaggtgactcaggccttctctttgccctagatcgtggggatcatcacacggcacaacctcacctatgaatttctgcaggcccggctgaggcagcactaccagaccatctgacagcccagcccaccctctcctggtgctgcctggggaggcaaatcatgctcactccggcgggcacagctggctggggctgttccggggcatggaagattcccagtyacccactcactcagaaagccgggagtcatcggacaccttgctggtcagaggycctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcytaacacggtatcctcgctagttkgttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaaggtatgtgctatgataaagcagatggcctatttgaggaagagggtgtctgcccttcacaaacacctctctctcccctgcactagctgtcccaagcttacatacagaggcccttcaggagggcctcctgtgccgcagggagggtgcgtggggaagatgcttcctgccagcacgtgcctgaaggtttcacatgaagcatgggaagcgcaccctgtcgttcagtgacgtcattcttctccaggctggcccgccccctctgactaggcacccaaagtgagcatctgggcattgggcattcatgcttatcttcccccaccttctacatggtatyagtcccagcaggcatccctggggcagacgtgctttggctcaagatggccttcatttacgtttagttttttttaaaaccgtggaggttgcccacgggcctcggcacctggccctggcagcacagctctcaggcccagccctgggcgacctccttggccaagtctgcctttcaccctggggtgagcatcagtcctggctctgctggtccagatcttgcgctcagcacactctagggaataattccactccagagatggggctgcttcaaggtcttttctagctgattgtggcccctccattttccccattttcttatctccctgaccaaaattgctttgacttctaaatgtttctgcttcccagaatgcacctgacttatgaaatggggataatactcccaggaaatagcgcaggacatcacaaggaccaaaaaggcaattcttatttaaatgttactatttggccagctgctgctgtgttttatggcagtgttcagagcttgatcacgttatttcttccttttattaagaaggaagccaattgtccaagtcaggagaatggtgtgatcacctgtcacagacactttgtcccctctccccgccccttcctggagctggcagagctaacgccctgcaggaggaccccggcctctcgagggctggatcagcagccgcctgccctgaggctgccccggtgaatgttattggaattcatccctcgtgcacatcctgttgtgtttaagtcaccagatattttgttcccatcagtttagcccagagatagacagtagaatgcaaatacctccctcccctaaactgactggacggctgccaaggaggccccaaacccaggccccatgcaaaggcacgtggtttccttttctcctctctctgcatctgcgctttccagataagcccaaagacagcaacttctccactcatgacaaatcaactgtgaccctcgctccttccatttctgtccattagaaaccagccttttcagcatctcacccattagcagccccatcacccagtgatcagtcgcctcagtaaagcagatctgtggatggggagcctacgggtggtaagaagtggtgttttgtgtttcatctccagcttggtgttccatggcccctaggcgaggtgatcagggagtggggccaatgggcccccggccctggctttgggaccttgtgctgagggatgatttgctcctgaccttgattaacttaacagttcccagctggaagggacactttcaggacccagtccactgtatggcatttgtgatgcagaattatgcactgacatgaccctgggtgacaggaaagcctttcgagaggcccaaggtggcctcgccagccctgcagtattgatgtgcagtattgcaccacagctctgcggaccttggccattgccrcagtcgcagcttccttttttctgtttgcactgtttgtttgtatgatgttagctaattccactgtgtatataaattgtattttttttaatttgtaaaatgctatttttatttgaacctttggaacttgggagttctcattgtaaccctaacatgtgagaataaaatgtcttctgtctcctctgtctcctttagccttttgtctccatgctgctttctttctttctttctttytttgagacagagtctcgctgtcacccaggctggagtgcagtggtgccatctcagctcactgcaagctccgcctcccaggttcacgccattctcctgcctcagcctcccgagtggctgggactacaggcgcccaccaccatgcctggctaattttttgtatttttggtagagatggggtttcaccatgttagccaggatggtctcaatctcctgacctggtgatcctacccgcctcggcctcccaaagtgctgggattacaggcgtgagccaccacgcccggccctgctgctctttctttcaagggatacttgctttttattttactccccctctttctgatgtgtggaaattacactaggacgtagttttagagtctcagagctctccctatgcagctgggcagtggggctcttcattcttgcgggtccacttctctgtattagacagtgaccttaataagaacagatttcatcctgtggatcttagcagaggtcaccgttgtctgtttctcccttcagatgaacactcttcctgatcctctcctctagaattcatctcctcctgctagcagccgcgtcctggaggagcagcggatggggaatccattctgtttcttcctggtgtttaggaagttgccccacamacagattgccccgatgtccaaccagaagaagtgaaactgctgctgggtctggagaggtgaagacccgtggccagcttctgttgttgccatcggccattgctttttgttcgcttgcttttggttttgcaagaagagcggcctctgtctctgatctgcttcaaatcatcattccatcagtgacagaagtggcygttccatcagtggtcgcagccagttcagctcctgcatccatccccaagtgttctgtaagtcccaggggcattttctgccttgtgtttttgtcatttttcaatcagttycattcaatgagaactccctgtgttacctgtgttacggtgacaccttgagaatgggctacttcccctcctagcaacccgcaacaccatcccagacctcaggagccaggtttgggccagtgctgtctcctgtcgctcttactttcatccttgtcattctctaccccctggttttcctggtatttaaagtccaggtagagaagattttgactggaggtggttaggtgaggctctccccccacctcaaccccctgccattagttcactgggagcctccccctttcctccgcaaggagcaagttactacttcatttcctcttttcccaatttctggacaagaccaaggcaatttgaccaacatttatggggcatcaactctgagagtgcygaaggggcatttgccctcaaagagcttgcagtctagggacgtagacacaagcaattgcacataggcaactcgtgttgtgtgctattataacagttacatgtgcaacactgcctacgaagggactcattgttactaggcatgaggtaccaggaaagaagtagtgttcatatgagccttaagaaatcagtacaatgtcctcgggaggaccagaggaaggacaccccaggtggaaggaacagcagaaataaaggcacagtggcatgtgtgggtgtggggtgttggagtgtcatagaatctgatgaggttgggatccatgggggtaacaggtgggaaaacagtttactctgtttaaggtgaacttattgcctggtgttttgtgctcagagcaaataccctcttcaggagcagatacaaaaagccggcatcttctccagcagctcttagtaaaatacaagcccaggcccttcagacccggattaggcaaagactatgtctgttttccaaatacttgttagtacacaaaaggcacatgaacttgtagtttgtctgcatggcaaacctttcttcactttgctcagtttttatttttttgagacaagtctcattctgtcacccaggctggaatgcagtggcacaataccagctcactgcagcctccacctcccaggctcaagccatcctcccacttcggcctcctgaatagctggaactacaggtgcacatcatcatgcctggctaatttttaaattttttgtagagatggggtctcactctattgctcaggctggtcttgaactcctgggctcaagtgatttgcccaccttggcctcccaaaatgctgggattacaggagtgagccaccacacccggcctgctcagcttttaaattcaacactctgcctactcttttcaaaactaaaagtaccattaccttagctgtagaacctaactctctcgaaatgtaccagagaaaatctaattaatactctcattttctgaatgttcccccctaaaaacaacaaaaaccccactaggagtggaatttgaggcctccccaaccaccyaccaaaaaaggagggtgaaatgaaaggaagaagaaaaactcagcattctttcctctgacaaagagtaaaacgacaaggaatatcggcctgaattctcttcccaagaagaaagaaagcacaccaacgcaggcatttgtcttctgtccatggkgctgaagtttattcactttcaaaccactttcagtaacaggtgaggttctaccttaaaatttaatgcatggggtgggagaggcgaggaagtcaccatcaaaccactttatctacagttagcataagatgtgagaagtgttgacaggaagctgcagcttaratgggatgatcacaactccatggcaacaagrtgacacraatgcagcagagamcccaggggacaggagcctcttgcagtctgtccctaggcccagccctgcttgtcctccctggctgttatcttcrgtactgcaaagagaacacagacatatctggcttggtgacctggctgtcctggaaaagtcagcttcatgtatgagtgtgcccatcctctgaacttgattactgaccacctgcttcccaccggcccccaccccagcctgatgaccctctgagcttcatgaattgataagcaagttactcatcagagtaaatttcacttaagcccttcaggatcttgcaattctggggaggaatatgaactgctaatcagccatgcaaagataacttggctctatgaatattttaatttcccagtgctagtggcagttgcttttttttttttttttttttgagacggagtcttgctctgtcgcccaggctggagtgcagtggygccatctctgctcactgcaagctccgcctcccgggttcacgccattctcctgcctcagcctccggagtagctaggacttacaggcgcctgccaccacgcctggctaattttttgtatttttagtagagacggggtttcaccgtgttagccaggatggtctccatctcctgacctcgtgatccacccgccttggcctcccaaagygctgggattacaggcgtgagccaccgygcctggcctttttttttttttttttttttttttgagacagtctcgctctatcacctaggctggactgcagtggcgygatctctgctcactgcaacctctgcctcctgggttcaagtgattctcctgcctcagcctcccaagtagctgagagtacaggtgccygccaccacacccagctaatttttgtatttttagtagagctggggtttcaccatgttggccaggatagtcttgatctcttgacctcatgatcsgcctgcctcggcctcccaaagtgctgggattacaggcgtgagccacygtgcccagcccccccccttytttttttaagcattttctcagcagactagctaaggacaatagatggcatgtcctgacacccatggggcactctgggtgttggggcagaaacttgagagggaatgagcttctgcattggtccctttcctgctgaaggtgtctcccagtagtgtccatcccatcccatttccatccccagttcctcttacccggaagctgttacagcccagtccgctctgggctccaatcctgtccatcctgcccccgaagcagctggatctcygcaggctccgaggggcagtgagcagcgccctcagcttgctttttaggagggcagatcgatcagaggagtcccaggggccccgcccgagggcacctccatctctctgggctgggctgacttccccggtccagggaggcacctcagggarggggctgagagcagcccccgcttcttcattcggctcactgagcacttgtgggggcacgacctcatcttctaaaggcatcttttcttccaaatggtccagcaaattctttagaaaaggaaaatacagggaaagggataaacctcactgacttggaggaaatcaagaggagtgagcacagcatcagaaagccccctggccccagactgcacccgctttcctggccctaccttgaaatccatcaggtctgcgttggacacggcattgtacatgggattagctctggtctgacctaggagctggaatgccagtaaaaggaggaagctcacggtggtggtggagaaggagctcatgctggcgtcgtcaaggagcaatccactgcttgctgctctgtctctcccctctggttcctctctggttcccctctcttggcctacgtctgtccctgtctcccagctgcccagtgccgcctctttttatagccccccagctctccaagcacgcaggagagacagaaccctccccattctgtcacttgcagtgataaagctgccaagtgagaagccagcaggagatgcccttttaaagttatcatcccgcagggcttgtcacagcccctctctgccttgggcagccccaacagccccccagaccctcagctgcaagagccgcattcttactgatttgactcaagaggctcccacttcaaaggtgtgagaagagtaaaaaagagtccttggttatctcaccgccgtgcctcaggattctttctcctcgacgctggtacccgtgcggggaaacagagggtgacgcttggctggtgcccagctcccctggtttgtttgtggctcagctgtcagggcctccaaataagggtggagaggaggaaatggcaggcagccagcagcccgagacaaatggatccagatgctcaagctggcctcacacctgcctcatccgccacgtgggcagacctctggcctcagacagggctgccttcacccctggcagtccctctccatggtcaggcgaaaggaagttattttttagtatataaagtcagctgagaaccaaatgtgatgaagctcccaggaatccaacccccaaatagaaatagcaagaaaaggcgggggagcacaagcatcctctctccaaagctcctcctcttccatgtcccccgcgaccctcctccagcatgctgcggggacaggcttagaggacgcagccaatttcatttcttccgttgctgtttatagatgctcagactcttcgtgtctgaagtttgttaacatccccctgcccttcctgggcttgtgcccgtggcaacttgaccgatggaggaagggaggtgggggtgaaggaggtatagtcagtttccctcaatgccttctacatccttccctgaggacgtggcaagtggcaagtgaccgagccaccaaggtcacaatttccctggcccccaaaagggaaataacaggcagcaagtctgtctatgtttaatgaatggcctgtttgctaagcactgaactcagtgttagccattaccattcaatgcaacgtatactgggggaaaactctaaatttgaagggctgagagaccagtactgtagcccaaaacaaaccagttgcatacctcttcgcagccttactttccttgtgtgtaaaatgagaaagaatgttaaaaaccggccgggtgcagtggctcacacgtataatcccagcactttgggaggctaaggtgggtggatcacctgaggccaggagtttgagaccagccctaccaacatggcaaaactctgtctctactaaaaatataaaaattagctgggtgtggtggcatgtgcctgtaatccccgctactagggaggctgaggtaaaagaattgcttgaccttgggaggcggaggttgtagtgaaccaagatcgcaccactgcactctagcctgggcaacagagtgggactcggtctcaaaaaataaataaataaatgaatgaataaagtagaaatcttccctgcctaccttgcaggattgttgtggagcccaagtgagctgagaacgtgtcaacacataacaagtgtgcagtgctgagtccctgcaagatggccatcatagttgtctttattggttgcttgtagcatgcctagcactgtgctgagaactttatggaaatgattttattttgatcaccatccccaggtggtagatagcattgtccttgcttacaagggaacagaactgagcccgagaggctatgccacttgcccaaggccactaggtgcctaagtggcggaaccaggactggatccccaggtctgacgctgatgtctgtatcctagcctatttcacgtagagagctgccaccttacctcttagctgcattccccaattaaacccccattccccatctttcagatgccccaagggagctccttcaccttccccatgcccctggggctgtagcttttttgtgcacttaccaagtctgtgtgtgttggctgctctcctgatctatttctacaccgaatgtgttttaatccactccttagaagctcagaaaatgtgtgttgagtgaccagctctgtcctggctggccagatctgtccccaggtgtgctgacctcatgactgaccaggtgaacaggacgttgtgcagccataaggttggaaatcagggcagcaagtgactagaggtcacaagaggtatccagggtgatattattctaagataagataaaagggaccctctttggcaagccttggggtttgtctgtaggtggggatctaatatttcatggggtggttagaagcagcctgtaggagtgagagagaagaaaagtaacaggcacagaaagccaggcccacctccatccccacctcttccacggctgaaaaatcaaaagccttttatttccttatcactggaaagaagtcatcttagtcatacaacgggtggagcactgcaaacgggtgggagaatccagaatccgggtgttgccagattccagcccagagtttggcttcacgattctctgggggtatgccttgggctgctgcagggagccccagagtgtgcagtgtcacccgcgtgcagagctggcacgaaatccccaacacattcgtggcatgattctgcgggacccagatggtctaaagcagaagccccagttgggaaaaattggttcatacttagggatgatcgttgctgactttgaaaatgatgttttgtttctttggtttaatatggaggtcactaagggctgaagactggggacagtttccctagaaaacaaagcccaaggcaaaaggtcactcgctaaagttttgtgggggttcctattcaaaggaagcaagagtgaggcggagtgagaggctgttttagttaactactgccgggtaacaagtcaccccagactgggcgtggtgactcacgcctgtcattccaacactttgggaggatcatttgaacccaggagttcaagaccaccctgggcaacatggcaaaaacccatttgtactaaaaatacaaaaaattagctgggtgcagtggtgcgtgcctgtcatcccagctaccctggacactgaggtgggagaatcaccacagcccaagaagttgaggctgccgtgagccatgaccaagccactgcactccagcctgggtgacagagtgagaacctgtctcaaaaagaacaaaagccaggcatggtggctcacgcctgtaatactagccctttgggaggctgaggcaggaagatctcttgagctcaggagttccagacaagactgagcaacataaggaaccctgtttttaataaataaacaaacaaaaaacaaaacaaaaaccaagtcaccccaaaccttagcaacttcacacaatgcacatctattatctcatcacctctgtgctctgtggatcagggatctggccctgcttggcctggggcccctgggcaatgaaggcgttggctgcggctgcagtcatctcaaggcttggctgggggaggataggctttcaggctcactcctgcagctgttggcagaagccacaggttctcgctggctggtggctggtggaaacatcagtttcttgccacgtgggtctctccatggagacgcaactgtcttctattaggtcaggcgagaaagagaagttacggaagaagccacagtctctttgttacctaatctcagaagtgacatcccattcttcatgttgtactgttctgtgtcccttagaagtgagtctctgggtctcactcacactctaagggagggggttacagagggtatgaagaccaggaggttggggatctctgggggccttctgaaagcactgcccacacaaatagagaaggaaggaaagcaaatgtaaggtgacattggctgagtgcagtggctcatgcctgtaatcccagcactttgggaggctgaggtgggtggatcacttgaggtcaggagctcgagaccagcctgaccaacatggtgaaaccccgtctctactaaaaatacaaaaattagccaggcatggtggtgtgcacctgtagtcccagctactcgggaggctgaggcaggagaatcatgaagggcagggctctgcaggaaggttgacttatttgggagtgtcttagtttaagttctcttgaaccggagacagatattccagtattagtggctgatcttggagacaaacccaggaaatgtcagtggagagtggggaagtgatacagaaaaagtagaagtcagtgaccacctctggcagtaggtgcttaatcctcctcccacagagaactccaaacaggttctctgtttggagaacagagacacatgccacctatgactcaagggagctgggtgtttgttttattttattttattttattttatttttgaaacagagtcttgctctgtcacccaggctggagtgaagtggtaatttcagccttgacttcccggctcagtgatcctcccatttcagcctcccgagtagctggactacagatgttcaccaccatacccggctaattttttttcttttatttttagtagagacgaggtctctctttgttgcccaggccggtctcgaacatctgaactcaatttatcctcccacctcagcctcccaaagtgctgggattacaagtgtaagctgctgcaccaggcgtgagctgggtctttaaatgccaactcctggccaggtgcagtggctcacacctgtaatcccagcactttgggaggctaaggtaggaggattgcttgaggccgtgagttcaaaatcagccttgcaaacatagtgagactctccatctctacagaaaaaaaaaattattttaattagccagacatggcagcatactcctgtaatcccagctacttgggaggctgacgtgggaggatcgcttgagcccaagagtttgaggttatagtgagctatgatcatgccactgcactccagccttggtgacagagcaagactctgtctctatttaaaaaaaaaaaaaaaaaaaaaaagccagctcctgtcagatgttggttgagcactgctcaggtcaatgtcaattccccagcacttcctgccggccccaaggagctgagtgggctgcggctgccagagaaagttcttaggcagaaaagtgcagtgctgctggatgaaaggattgatgtgtgctgaagatcaggggctacgggcctctgccgtgcccgaaacgggacagctagaggcaggagagtgggagccagtgtccaagggcagatactgagtttggttctagaaacgcttaaggcagctgtatggggcaggctccagaccccaagggaaaaatggatcacttggtggaataagactgattatttaagctaaggcagtggatgaaaaatcctagagagaggctgagatctacaacatgaacaaagacaaatggccaagttcatgtcatggtttagacccagctctgcaggaagagaaatgcattttttttccttgccacaaatcattctcagaaaggccaaagcaggtggggcacggtggctcatgcctgtaatcccagcactttgggaggccgaggagggcggatcacgaggtcaggagatggagaccattctggctaacacactgaaaccccgtctctactaaaaatacaaaaaaattagccgggcgtggtggcgcacacctgtagtctcagctact

SEQ ID NO: 17959 - DNA, 32128 bp, Homo sapiens
tcctgagggtcgacaggaggcaacatgggagctgctcagcctgcccatcatggggtccttgggctgccccgagccacctcccgagggcccccctccagaggacactgctagctccactcacccagaatcttcctggtacagttcaaatatgtggcaggaggcgtagggggcttgttcaccattgtagacatccagtgccatttgcagggcaaccagggtagtgtcgtgctgcgggggagaggggctgcccgtcagcattgttccccacacccgcaggaaccgaacagagaagaaatccagctccttgcctgacacagcacgctagggagcgcaggcactcaccgcagagtaaaccagcagcttggggagctgggaggtggtcgccattagggtcaggttcttccttatctgagccagcaggactcctgaaggagaaaagtccccggtgttgctggctacagccacctctgccttctaattagacctatctgtgctcctttcaccctctgccaggcctgggcctcatcacctacacggagaactctttagtgtcatagggaccatgtaagaactctgtggcacccctcctctctaagaactgtcaaatgtacagaaggaagcaagacaaaacaagatatctgcctatatttcaacacggatgtagaaacctgcctgtgtttacagaagcacttcagtttgaaacaaatgtaaacttaagattgcttcagagtacacagcgggtgggtgcatgcccgggtaactaccatatgctctgaaaagtgagatgtcaaaaaggtgtgacagcaggcatgcccttaggtgctcaaataaggaagctggcatgtgtgttactctcagccttctcaaaatggcccccagtggttctcttggggcagctattcatttaggagagggagggtcttctgatgtgggcgaaacttaagaacatgaatggcagggctgggcgtggtggctcatgtgtgtaatcccagcactttggaaggctgaggcgggcagatcaccagaggtcaggagtttgagaccagcctggccaacatagtgaaaccccatctctactaaaaatataaaaattagttgggcgtggtggcaggcacttgtagtcccagctacttaggaggctgaggcgggagaatcgcttgaacctgggaggtggaggctgcaatgagccgagatcgtgccactctactatagcctgggtgacagagcaagactctgtctcaaaataaataggctgggtatggcggctcatgcctgtaatcccagcactttgggaggccaaggtgggtggatcacctgaggtcaggagttcaagaccagcttggccaacatggtgaaaccctgtttctactaaaaatacaaaaattagctgggcatggtggctgaggtcaggagtttgagtccagcctggcgaacatggtgaaaccccgttcctactaaaaatacaaaagttagccaggcatgatggcatgtgcctgcaatcccagctactcagaagactgaggcaggagaattgcttgaactcaggaggcagaggttgtagtgagccaagatcgagccattgcactccagcctgggtgacaagagggaaactccatccccccgaaaaaaaataacaatttttttaaaaagaatatgaatggcagaaaaggaagagaggtggggaaatttggtgactagcggcatgaggagggggatttggttttgaaagagcagggagtgtttcagtagagagggaagtgtgtgagaagcccccacagcagatttttaacgccttagggtcctgaggagtagagtgacacgctgtccttgtcactcacccccctgaagccgggccttctccgcctgctggtagattccgaagaggaagcggaagctgaagtcctttagccggctgagacgctgcatggtttggggtgaggcccagggcggcaggcgcagcccgtgcgtttgctgtgtatcgcagcaggcaggttagcgccccaggcctaggccagcctctccagggggcagctctcttccctagtgggaaggtgcctgtgtgtgtgagggagggagaggggagagaggcagaggggctggaaccagtagacatggcaggcggtgtggatgcttcagggcacaggaaaggaagctcaggcacaaaaagtgagactcagcagaaaggagctctgggtggagagcagcagggactgctgacaattaataaaccatttcccactctgaggatctctgtcacccatgagggaagttcccgtgtttcacaagcacagcctccctggacctccccaggggcgtgacggtatcaggcactgtgttctaccgtcctggtgacctgggcctgctgagagggaaaagaatgatcacagtgggcaccctagtgggctcacctcacagaagagtgtgtcatagacattccagacggtctccagtgtcaggtctgtaagccctgtctcgttggccaccatgtccagaaattgctatgaaaaatggatcagggtctcagtcctgctctggggaaaagacagcgtggtgagctgcacctctgcccccactcactgcattccgagaactctcattctgatactctggtgtctgccgggtctcgttctgcagctgctcataacggggacatgggcccaacgggaacttcagcagctgtagagcgaagcggggaaacaggcagcgggaaaaggagcctggcatcagcaggcctacggccagagctgtcccctcaccaccccagggaagggctggccactcttaccctgtcctcagtgatgggcacagtgtgcacaggaataggctgccacgagatgttcgggttgaagcgctgcatcccgttgggagggaagagtccagccaggttggcctcagcactcatgagagtccggtcaaagtctgtgcttcgcacataaacctgcagcgatagcaacacaagtcgtgtgtgtgtgtgtgtgtgtgtgtgtgttggggaagttttggtcaccctgaagtggagccttgtatgtatgtgtgtgtgtgtggtgggaagttttggtcaccccaaagtggagccccagaggagaacctgttcctgatggtcacccagcaaactaaacctaccatacatctggccctcaccctcctctggcctctggccttccccatcccccaaacactccactgggggttgtcaccactctgtgaagaactcttgtgggaatggccttagttgaaatgccccttccagtcaaaagtgctgagtcaatcagtaaggctctctggtctgtctggtttcataacaacacctctctccctgtctagatcagggtccttggggcagaaactggctccagtgacgacccttagagaccagggagaaaaaaataagataaagggctgggcctggtggctcacacctataatcctagcactttgggaggccaatgcaggaggatcgcttgaggccaggagctcgagaccagcctgggcaacatagtgagaccctgtctctacaaaaaaaaattttttaattacccaagtgtggcgggcacttgtagtcccagctacttgggatgctgaggcaggaggatcacttgagcccaggagtttgaggctgcagtgagctatgactgaggcatgtgctacagtttgggtgacagagtgagacccctttaaaatatatgtatatattttgggccgggcacggtggctcatgcctgtaatcccagcactttaggaggccgaggcaggcggatcagctgaggtcaggagttcaagaccagcctggccaacatgatgaaatcctgtctctactaaaaatacaaaaattagccaggcatggtggcacacacctgtaatcccagctacttgggaggctgagacaggagaatcgcttgaacctaggaggtggaggttgcagtgagccaagaccatgtcactgcactccagcctgagcaacacagcaagactctgtctcaaaaaaaaaaattttttttgaagagcttattcagagatagtggctcatgaaaagggaggaggaaactggggaaggacaagctcaggacagagctgggccttaagagaacaataacaatgtctatggattcttgatacggctgaggctgacagtggtaatcagaggaacagcttcccccattcctggggtggggcgaagactcaaggagcaggcacactcaccagtcctccctgatgtgccctaggaatatagcacgacctggcgcagcagacagggctcaaaaacctcatcttgatcaagaaaagacaagccctctctacgcatgtcttccccgctgtctttcatcttggccctgtctggtttatcattagatacccccacaacattctaagctccatgaagacagagatcatatctgtatggtgcacaactgaatgcaaagtgctagcacagtccttggcctttaataggtactcaatgtcttggatggaaagcctgtgatttcacagtcagaaaccactttgccaggcccgcccttaagtccgaatttggatgcttaatcaaatttgcctcatcccagccaagcaggggcaactcagctcctagggctttgttccagacagctctcagatgtcttttcctgtagttgtgaccaaaaatacaagaaggaggccaaagtgcccagcctcagccttaggctccctgagggcaaaagatgagggcagcataccttgttccccttgcctctggagctcccaaccttacctcttgccggtgataagaggtgtttaggaagccgtgatagcgctgccgcagggcctggcccagttcccagtgctgtagcatcccctcctgtgggcaaacccaagggttaagagggtctagagggaaggggtggcttcaagccccatggggtttaggccctgttgctttccaggttcacgctttgctggagtcaattaatctgatcccagaagtctttcattaagtggccagtcatgcacagcaatatcatgggcacagagattaaggttatgaaatctggtcaaagtcagcacccatatgggaaaaggcagtttagtaggaccccaagttttgtagactgctctagacgtcgctcattctgcagctcatcctgaggaaaggctggcttctgacccaccttggttaactgaccaaacccctggggccattcttcttcctgataggggtccttgggatatgtcttcactggtgaacggtctccatggcggtacagctgagagaataaaatggtttgcctataggtcagaagcatccccttgatagggacccagagcctaccttttgccccatgttagggaaggaagtctcattccctctgggaagcctactggctgcaaaagaccccagctaggagtcagtcacttcttccagattccagagattctaacttagctaagcaatgctactggagaccataggcaaagccaaggtacaggtaggaagggaaaagagaagtgaaagcaacgtatgtggtggggacaactggggaaaaaagataaccaaaggcttctttagggatgagtcttaaccattcaaccacttccctgtctcaaggcagactcaccccgacgtattcggtcatcctgactcccataagccagggctccaggtcaatcctgaatccagcctcccaactacccaggccagtcgtcccctcctaaaccagctgttccttcccgagatcctcgacctccaccagctggcctttgcccttttagcttcagggaagtctttggtgagcccatctctcattaccaaggtaacgaagcgcagactccgggcccgggtgggcggcatcaccaccaggttcacgccgagaaggagctggaggagagccgcccggctccagccggaccgcttgcccgccatcaccgttgtaatctatgcagcaaacaagctggaacccgctgggtggcacctgcaagcagccgcccggacgcacccgtaaggacacacgccggaagtgcgttcgccgccatcttacttagggacctgctggggtgcggggaaaaggcgcagtctcggtgggattgcgtgcaggagggtcgtggtctggctgtggcggaggagcataagaaggtaacgcgacctggcgcggcagacagggctcgaagacctcatcttgattaagaaggccacaaattcgcgtttgcctctgctcggagaaatcccttaccaaggtggcacttgcagtgggcgggaccatgtctggagaaccagcgtcccctccaggcttgaccccatagctagatcgggtgcagaattgaggcgagggatgggaaagtagaggtcgcttctctccaygcccctgcctttgtggggagattgagccctggccctgttctccaggagatgttttgcttggggtgcaggacacagtatgtaaacaaccctttggactccgtgtgtccttgaggttgccccagtctggcctaccgttcctgccctgcacaaagcttcagtagccctctcactttcccttccagtcctttccctgtcctccctcccctccacttccaagttttagttaattagagtcaagacgtcatgtcatgcctcttcccaaaggagttgggttgcacaggatgttcagactttacaaacccaaagcactgaatccctgggggaggaatttcagaccagtggggaggtattttgaggtaagggacaggcgcatatcataaagtgggagtaggtggggtttccacagaatcaatggccctcttggcattgaccattaggattcaggtgcagccagtttggcctcaggactttgtgactcctgtgacggttgcaggtcagatcataggtcctggggatgctttgattcagatctgcctactggaagcaaatctcctcagatctttgggaaacaaaactgatcaggcttggcctgggcgccgtggctcacctgtaataccagcactttgagaggccgaagcaggcagatcacctgaggtcaggagttcgagaccagcctggccaacgtggcgaaaccccgtctctactaaaaatacaaaaaaaaaaaaattagccgggtgcagtggcgtgctcctgtaatcccagctactctggaggctgaggcaggagaatcgcttgaactcggaaagcggaggttgcagtgagctgagatcacgccactgcactccagcctgcgcgacagagtgagactgtctcaaaacaacaacaacaaaaacctgattaggcttggtgtggtggctcacgtttctaatcccagcactttgggaggccagggtgggaagattgcttgagcccaggagttggagaccagcctgagcagcttaggaagatctcctctctacaaaaaaaagtttaaaaattagctgggtgtggtggcacacacctgtggtcctagctcctcgggaggctgaggtgggaggatcaccttcagcccaggaggttgaggctgcagtgagccatgatggtgcaactgcactccagtctagatgacagagcaagactgtgtctcaaaaagaagaaaagaaaaaaaaagatcaggattatctgtctttattttgtcctaggactccagattcaattatttatatatacttcaggatttaaactttgcttccagagttgtcatggaggaggccaagaagcaaatagagtaagagccaaagcctgggtagccaaacagttcttaaccttcttatttaatcacaagcccctttatgaatcacatgaaaattttgcacctctcctccagaaaaatgttcacacatataaacacacacatggaattttgcatataatcccaaatggttcacaaagaccatttattacaggtttcataaatcagcatctctgaatacctgatttaacctagtcctcttactttacagcttaggaracaaacctaaagagaggaagtgacttgcccaaattcacagtttgggcatgggcacagtttgagaatggattaaaagtcaagttttggccgggtgcgtgctcacgcctgtaatcccggcactttgggaggccgaggcgggtggatcacgaggtcaggagatcaagaccatcctggctaacatggtgaaaccccatctctactaaaaatacaaaaagttagccgggtgtggtggcrggtgccggtagtcccagctactcaggaggctgaggcaggagaatgtcgtgaacccagcaggcggagcttgcagtgagcggagatcgtgccactgcaccccagcctgggcgacagagcaagactccgtctcaaaaaaaaaaagtcaggttttgtgattttcagttaaatagtctataatgggctgcttcttgcaggctactcaaactgcattactaaactgtaattggtgatcccgaaatcctttcaataaagaggtatctgtcaaaggaaaccttttcaaattagttggactaaacgggacctaggccggacatggctcacacctgtaatcccagcactttgggaggaygaggcgggtggatcacctgaggtcagcagttcaagaccagcctggccaccatggtgaaaccccatctctactaaaaatacaaaaattagccagtcgtggtggcgtgtgcctgtaatcccagctaccggggaggctgagacaggagaatcacttgaacccasgatacagaggctgccgtgagccgagattgtgccacttcactccagcctgggcaacagagcgagactctgtctcaaaaaaaaaaataaaataaagagggcttgggtaattggcaaaatgctgcatattagtggtagtgggaggcagttgagtgttttgttttaatgggcctcttactccttgcaaactagccagaccattgtactttcagagtgtaaatctttggctcaccaaatttcagctatctctcaaattcagcttttgcttttcttcccacttgctcaaatatgtctatattctttgtgcatgcaagtatcccacgtaggagggattgatgaagcagatactatttcagtttttatagggagaaactattccaggaagggtggggattacagcgcaagtagatagtagagcctgaagctgagccctagtttcttcacccctttgccttcagcttttgcattttctgccagatgattctgtggttcttacactttggttcgtaactacaggtgcaaaaaaaaaaaagaaaaaaaaaaaacacatgtagatagatggatatgtgggcctatcccagatcaaataaatcagaatctctgaaggtgaggacaggaaccactaccatattctgtgttggcagaagcaaacctaaatccaggtatgttagccattttttttccatctgaagaggcagtttttgttttgttttgttgttgttgttgttgttgttgttgtttttgagatggagttttgctcttgttgcccaggctggagtgcaatggcgttatctcggctcacagcaacctccgcctcccgggttcaagcgattctcctgcctcagcctcccgagtagctgggattacaggcatgtgccaccacgcctggctaattttgtatttttagtagagacagcttctccatgttggtcaggctggtctcgaactcccgacctcaggtgatctgcccattttggcctcccaaagtgctgggattacaggtgtgagccaccgcacccacccggctgttttttttgtttgttttgttttgtttttgtgacagagtctcccactgtcgcccaggctggagtgcagtggcacagtctcggctcactgcaagcttcacctcccaggttcacgccattctcctgcctcagcctctcgagtagctgggactacaggcacctgccaccacacctggctaatttttttggctttttttttttgtatttttagtagagacagggtttcgccgtgttagcctgacctagtgatccacccactcggcctcccaaagtgctgggattacaggcatgagctactgcgcccggccccagccggcagttttatataatggagtgtatttgtgatttttgtttgtttgagcttgagctcaaacttttgaatcagctaaacttgtattctttttttttttttttttttgagacagtctccctctgtcacccaggctggagtgcagtggtgcaatcatggctcactgcagcctcgacctcctgggctccaacagtcctcctacctcagccccccaagtggctgggactacaggcagatgccaccacgcctggctaatttttgtgcgtgtgtgtgttttctgtaaaggtgaggtttcgccatgttgcctaggctagtctcaaactcctggactcaagcgatctgcccttcttggcctcccaaagtgctaggattacaagtgtgagccaccacacccagtcttatacctgtattcaaatttgatatttgccccttgctagtaactatctcctagagtttactgtgagaataaatgaaataatgcatgtaaagataaatgtatgtagtagggatgaaataaatgtcacatctttcctttctgccttctgtatcatctctgaactcaggtctgggaatccaggtttctggattattctctatgttgtgattggaaggttgggcagaagtcacttgagtagatacgcagtggtctgcaagatgatccctgcactttccacccttccagaacggtgaaggagggaacaagaagcagttctcctggtccatccctgcagaccttaccctgtggcctgcttcatgggaatgagtactttcagggcagttagccagtactacctgtgaccatggctggtgaatgctcctgtttctgcttcaagtttctccttgctgtgagaagaaacctgtggaggttctggggggccagatatgtgacttggtagatccccgagtgtgttcccagagacattgcctcctgcaggagccaaggaaacacagaagaggcccataggactgggggactttggacctaacaactgtgggctggtgggactgtggcacgggggtggggctgccaaagtgggaacatgattccagctgctgatcacttcactgcttgccctggcttgaagtaagtctcagtggttggtctccagaaactccatggaaatactgcccacaggttttggtcttctcccattttcctctccttttccctctttgtagggatgagggttggggtttctgagctgtaacctgataggacggctctggcagttgaagtcctggttataattcctcctaaacaggagaccctagcctgcccacccccactcccacaagatggggctcgtatgtggtcctgggtcctgggaagccacctgtggggagactaggtgtcaggggagggagttgaagaacaaagtggatgaaagaggcttctcccagctcccagaagatagggcaccaggccccagaccattgagtcctgagtttcttgaaaccagccatctctgtgacatctctggctgccctgctgggctggagcttctgggagcagggaggtagaggagggagctggactggtgatgtgggtgctgggacagaatagtgccagtctctcagtgactagagtccctggtttctgcttttccaggacagctggggccttgtgaaaatcagagagggaacacaggcgagaggaatggagagccttgtgcttgtgactcagagatacccagaccagggtgggggccttgggaggggacgaccttgtgatgagggggaacaaaagcaaaagctggaggcagaagtctgagatgggggtgtcacaggggcttttctgaaatgtgaaaatgaatacatgggcagattttgcaacagcacccagcctgctgtcttctcacactctgctccccagcccyggcctgttccccctctcccaccctgtgcttcctctcatctttcaccaggctsctcttctgcctcagccttcatctttttctcatctggttccttctgtcccatctacaccccctgtccactctttccctgtttcctgtgttctcttccctggtgccctgttcatctgtttcggtctctttggctgcttgccctggcccccgtccttctatgctttaatgtggggcccatgggaactggagttcatagcaaaacaggaagagccggtgagcaggaaactgggaatggggcagggggtgaatgaccagcagtaacctcagcagcttgcctcccacatctggactggagcatctgcagggttctcagcctctcccctgtrgcccaccagccctggctgcttccattacagcacttcactggcccaagacgcaacaagacaagattgtcctggactctgacacagcaaagggactggagtgaggacatctgggttctgatcccagcccagccactaactgtgtggtcttggaaaaggccctcacatgagtttcagtgttctctgtcaaatggagctcgggttacttaccctcctttcctcccagcgctgctctaaggaccagaaaagatagtgaagggtttgtgctgtgtatggaaacaagtacaaagttcaaaatccaccaagttaaagcaatgggaagacctacagctgaaagaactgggagggtgatgataactcgtgccatttctcaaacactatgtgccacacgttgtgatagactctctttctttctttytytttctttctttctttctttctttctttctttctttctttctttctttytctctctctctctctctctytctttctttctttctttctttctttctttctctttctctctctctctctctttctttcttctttttttttggagttttgctgttgttgcccgggctggagggcaatggcgcgatctcgggtcattgcaacttctgcctgccaggttcaagtgattctcctgcctcagcctcctgagtagctgggattacaggaatgcatcatcacacccggctaattttttgtatttttagtagtgatggggtttcaccatgttggccaggctggtctggaactcctgacctcaagtgatccatctgccttggcctcccaaactgctgggattacaggcatgagccaccgcaccctgcatgatctgtagtttcaatcccacaacaaccttgtgtggtaaaaattactattatccctattttatttatctttctttctttttcttttttttattttgagatggagtctcagtctgtcacccaggctggagtgtggtggcacaatctcggctcactgcaacctcccagattcaagtgattctcctccctcagcctcccgagtagctgggattacagacccgcatcactatgcctggctaacttttgtatttttagtagagacggggtttcaccatgttggccaggctggtctcgaactcctgacctcaagtgatccacccgcctaggcctcccaaagtgctgggattacaggcgtgagccaccgtgcccgttctatttatttttcaacacaccattgctggctcaactattcttattttaaagatagggaaacaaagattcagagacgttaagtaacttgctcaatcaagatcacataggtaataagaggtttaggatttgaacccaaaatctgagcccagagtctgaacgctaaatcaacatgctgagttgaaattgactacagcagttgtgatggcgtgtgcctgtaatcctagcactttggaaggctgaggtgggaggatggcttgagcccaggagtgtgaagccagcctgggcaacatagtgagaccctaccccaaaaaaggtaaaaaaaaaaaaaaaaaggaataataaaaaaaattgactagggctaataagtacgggatagacgagaataatatttcttttttttttttttttggggacagagtctcgctctgtcactcaggcaggagtgcagtggcgcaatctcggctcactgcaagctctgcctcccgggttcacgccattcttctgtctcagcctcccgagtagctggaactacaggcgcctgccaccatgcccggctaattttttgtatttttaggagagacggggtttcaccgtgttagccaggatggtctygatctcctgacctcgtgatccgcctgcctcggcctcccaaagtgctgggattacaggcgtgagccaccgcgcccggccgagaatatattatatttttcttgttattcattcaacaaataggaacacagtacctactctgttgccacatctatgccagccctgtttcaggggtgttgggggagatgaaatcaataaaatatgatgtctactttcagggatggatttcatgccccaggcagcagagtaggaagaatgactatagtctcagtagctgctggttggagcctgccatcacttcagatggggttgttccccagaagaggcaacccgcataccttcccaggtccatcctgggctgccacctgagttgcctgtcttccttctgccacctccacccctatcccaggcctgccaytgctcatagcagatttcctaycaaaggctctcctggcctcctctcttatctgtggcccccgcagggcacccactttcagaaactccctggaaggcccagcacctgcctctctccacccctggatttctaccagcttggctgaggcctggggctagtggggagagcttcttggcctcttyccagaggcaagggaggaggagggaggctgggaaagccgctggggctcagtgtcgcaattccgggccgtgctgggacctttgctccacgaggtgcctatggaggggagggaacacgattctggaggctgctgggattggggtgggggttcctgggaggcagtccttttgcaagagctgctaagagcgctgggtaaggagaggaaggggagagacatggaacttggctggtctgcagggaaatgccactgttttggccgggagtagggggcgggagtggcgggagagggggtggccggctggggaggagccagcctggtggagaagctgccctgtgggcgggggtgaggaggggagggctgtggtcaccaggcaggaaggaggggtggcctgacccctcggcagtccctcccctcagcctttccccaaattgctacttctctggggctccaggtcctgcttgtgctcagctccagctcactggctggccaccgagacttctggacaggaaactgcaccatcctcttctcccagcaagggggctccagagactgcccacccaggaagtctggtggcctggggatttggtgggtctgctccttagcagtggcctggggctctgtgtgtgtatctggggtggggtcggggaatgtcctaaggatctgagaagggggtttctggggagaagtgaggggtgatggtgatggaagcttgggacaggagcaggactctgggtcccagaataactcatgaggggctcaggggaggaggtcctctatgtgaattggggagattcttggagacaggtttgtgctgggaccctggaaagtggcacgagcgaggttctctaataagcagcgtgtttcactgggtggagtgagctgtcctcagtgttggagtgagggggaaggggcccragagaagcagggcagatgcacccaaacattccctgctggcctggaggggactttgggggagaaaagccggcacggtggctgggagcccagactttggagtcagaggagggttggagtcttgactctaccgccgcctaactgtgtgaccatagttacttaatctctttgaacctcagtttgcttatctgtaaaatgagtttaagaatagtcctgagccaggagcagtagcgtgcgcccataatctcagatactcaggaagctgaaacctgattgcttcagcccagtagtttgaggcgatagtgtcctattattgcacctgtgaatagcactgagttccagcctgggcaacatagagagaccccatctcaaaaaaaaaattaatagttttgacctcagagggatattatgaggaaagcacataaagccttataacaggctgggcgcagtggcttactccaataatccccacactttgggaggcccaggtgagaggatcacttgagcccaggaattcctagactagcctgggcaaaatagggagaacctgtctctaaaaaacataatagtaatataataaagccttagtacaggctaatatatggcaagtaaatgttagctgatattgttgatattgataaaagggaggatcaggtggagaagggagctgaggccagaaaggagcccagttctagaagagtataatctgggtccttcctgcaggacagtgccttggtaatgaccagggctccagraagagatgtccttgtggctgggggcccctgtgcctgacattcctcctggtaagcttcattccatccctctcccctgagcccagaccgcaggctccacgcctcctgtaggaatcagcctccttcattacctgccttcttccttcctccagagagcagtccagagtcattcttagtcgtgcttgcctcccgcccagatcacctctcccctggttccagtgcctggcccttgcaggcacccgcccagtcctccccagtctggatttgctgctagagagttggccagctgagtgcttaccctgctctggctttgaagagttttatctgatctctgaaatgcatacactccagccccccaaagggacaaggattaacatcttcatttaaggtcctgagatgtaagaaactacaagtgactagtcctagctagagcccacacagactctagggtcccaaagcctgagctgggactttgctgccctctaagggtggggataagtttgcagtttcccagctaggacgctgggccgtggagccgggatggggcctgagacccccttgtgcctctcttttggagctcagactctgcggtggagctgtggaagccaggcgcacaggatgcaagcagccaggcccagggaggcagcagctgcatcctcagagaggaagccaggatgccccactctgctgggggtactgcaggggtggggctggaggctgcagagcccacagccctgctcaccagggcagagcccccttcagaacccacaggtgaggagcttctgggtttggaggaggtaggggtccagattccaggtcctggatctggaagaggttccttgggggtttttactttatatataatctcatggttaagttcagaggctttagagctaactaaatctgactgatctaagtgtgaattttgtctctaggcctttctgagcctcactttccttgtttataaaatggaaataaaaattatggttgtcataaggatcagtgcatataaaaggctcayacagtacctagaacataatggcacttggcaaatgagggctactcttctcataaaagagagactggagtttgtataatgaagggaatgaaggtcactgagtgcccagggcagtggctgagtcagggagaacatgatgtttttcctcgggggagagcgttgaagcactttcctgtatccagagatccgtccacaaaagcggaaaaaggggccagcccccaaaatgctggggaacgagctatgcagygtgtgtggggacaaggcctcgggcttccactacaatgttctgagctgcgagggctgcaagggattcttccgccgcagcgtcatcaagggagcgcactacatctgccacagtggcggccactgccccatggacacctacatgcgtcgcaagtgccaggagtgtcggcttcgcaaatgccgtcaggctggcatgcgggaggagtgtgagtttctggggctggagtggggaagaggctgaggggaaagagggggccagggtgtgacccaaaacaggtgcctgaacttgcaggggctaactgatccctaagtatggatcccagtatctttcttgaccgggcgcggtggctcatgcctgtaatcccagcactttgggaggccgaagcgggtggatcacctgagatcagaagtccgagaccagcctggccaacatagtgaaaccccgactctactaaaaatacaaaaattagccgggtgtggtggtgagcgcctgtaatcccagctactcaagagactgaggcaggagaatcacttgaacacgggaggtggaggttgcagtgtgccaagatcatgccactgcactccagcctgagcaagtgtgagactctgtttcaaaaaaaaaaaatcttcttgcctttacccagtgctgtctgcttttctggagccccaaaccaccccctttgccccatccttccctcctgtctttcccccacccccttgccccatcctttccccatctgctcccttcctcatatttggccctgtccttaggtgtcctgtcagaagaacagatccgcctgaagaaactgaagcggcaagaggaggaacaggctcatgccacatccttgccccccagggcttcctcacccccccaaatcctgccccagctcagcccggaacaactgggcatgatcgagaagctcgtcgctgcccagcaacagtgtaaccggcgctccttttctgaccggcttcgagtcacggtacttgacacacctggggagaggcrgctgcgcccagatcaccagtgggcttcttgatgtccgactcaaagcgctttgccttttccctcctgggtagccttggcccatggcaccagatccccatagccgggaggcccgtcagcagcgctttgcccacttcactgagctggccatcgtctctgtgcaggagatagttgactttgctaaacagctacccggcttcctgcagctcagccgggaggaccagattgccctgctgaagacctctgcgatcgaggtggctggagaagggcaagggatgaagggagaagcagagtgggattatctgtgggaggggcctccagacatcgagctgggagagccaaatctgctgggaagcagggatgaggagaatcggcctccctggaagaggccrtgctccaagaccagccctcctagtccccgtttgaggtttgctgcttgtgtgcaggtgatgcttctggagacatctcggaggtacaaccctgggagtgagagtatcaccttcctcaaggatttcagttataaccgggaagactttgccaaagcaggtgagaactgagatcacacagggattggggttgggtggacagatgcttctttttttattttttatttttaaaaattgagggccaggcgcggtggctcatgcctgtaatcccagcactttgggaggccgaggtgggcagatcaccaggtcagtagatcaagaccattctggctaacacggtgaaaccctgtctctactgaaaatacaaaaaattagtcaggcatggtggcacgcgcctgtagccccagctacttgggagatcgaggcaggagaatcacttgaatctgggaggcagaggttgtagtgagccaagatcgcaccactgcactccagcctgggcaacaacaacaacaacaacaaaaattgagatagagtcttactatgttgcccaggttggtcccaaactcctggcctcaagtgatcctcctgcctctgactcccaaagtgctgggattacaggcgtgagccacccaccatgcccggccaagtactttttttttgtttcatttttttttttagacagagtttgctctgtcacccaagcaggagtgcagtggcgtgatcttggctcactacaacctccgcctcccgggttcaagcaattctcctgcttcagcttctcaagtagctgggattaggtgcaccaccatgcccagctaatttttgtacttttagtagagacagggttttaccatgttgaccaggctggtcttgaactcctgaccttaagtgatccatgtgcctcagcctcccaaaatgctgggattacaggcatgagccactgaacctggccaggactggtgctttttgtcagaggcccatagtgactacagagccacaggcccaatgtttgggtggctggtaagggaaggctcccttgttttttgaagatagaaaattggaatgctgataggcttctctcagctgctccagatagacccctgtcctctgttgctttaggtcagtggttttcaaactgtattccaaggaacctgagagatatatggaatggcaccttggaggagaaacagggaggcacaggaatgtccttcatctttactttagccaaacaagaagctccatttaaatctgcattatatattgcactgctacatagtattttgcttgcagattttacagcttgaaaaaaaagtttgaaactcagtgcactcaactttttagtagtcaaaaagtgaacaaatcttcctcacatgtgctctttggggatcatgggggctgatttcccctacttttttttttttttttgagataagttcttgctctgtcacgcaggctgaagtgcagtggcatgaacgtggctcactgcagcctcaaccacctgggctccagtaatcctcctgcctcagcccccaagtaggtgggactacaggcatgcaccaccatgccaggctaatttttatatttttttgtagagagtgggtttcgccatgttgcccaggctggtctcaaaatggtctcgaactcctgagctcaagtgatccacccacctcggcctcccaatgtgctgggattacaggcatgagccaccacacacagcctcccctactctttttctttttttttcttttctttttttttttttttgagatggattctcactctgttgccaggctggagtgcagtgacgcgatcttggctcactgcaacttctgcctcccggattcaaacgattcccctgcctcagcctcctgagtagctgggactacaggcgcgcgccactacgctcagctaacttttgtatttttagtagagatggggtttcactgttttgcccaggctggtcttgaactcctgagctcaggcaatccgcccgccttggcctcccaaagtcctgggattacagccatgagccacttgtccaggcccctcccctactctttttcaattgcactttctgacgaaccagaaccatggcatggcaaacatgcccagagaggatgtacaataagagcgaatgcttccatctccatcctatatctgaagtattttctccaaaaattagttcattctgcggctctctatctgatgctcgcttgggagctacgcagaaggggtttcttcatattcaactattgataatgtttgtatcatgagaactggcctgggaaaggacgggaggctgagggagttttggagggactggaattgagcttcagcaggaaaccaagtagcttaacgactggatgagtggggctgtaaaatatggctgatgccctgactccactctcagggctggtagatctgtggccaggccagtcatcaagccttccttggtttctgataactcaggccagctcacgtgcctcttgctctcccaacgcagtccacccagtgagctttctaggaaggccactcttcgctgtagggcataacagggctatgttggcaccttttgccttctatagtaaccggtgtgctgcctggatgtattgacacctaatggggtgatttaatgactttatccagctttaaagcccagccctgctcccctcttccaaaccactttttcctcgatggttattatctcagaccttcttaaccgtggctctcccctccttcagaatatcctccttgtggaaccctgcccagttctaagatctttgtattcctttggcacttgtagactcatgctatctgaatctgcacctattcatagatttatttatacaagcagttttgaagtaatcatgcttgcatttctyatttcatgagtgaggtcttggggagaaggaacaggagctctgcttgtcaagtctcctcccctccctatccgctactatttactgcatgcagtagataactggtgacatggactgagcacatttraggtgttcattccgtgggcatcagcagaccctcagaggtgcattagctaactatagaacctcctcttaatttctctataaagggggctgtttgccacactttggggctcaaaacctcaccaagaaatgctttagaaaatggggcttgccgccgggcgtggtggcttacacctgaaatcccagcactttgggaggccgaggcaggcggatcacctgaggtcaggagttcgagaccagcctggcccatatggcraaaccccatctctactgaaaatacaaaaattagctgggcgtggtggtgcacacctgtggtcccagctactcaggaggctgaggcaggagaattgcttgaaccagaaggctgaggttgcagtgagctgagatcgcgccactgcactccagcctgggtgacagagcaagactccatctcaaaaaaagaaaaaagaaaaagaaaatggggcctgcccattaaatggaccaacacacaacacttgataaacatcagggtgaaagtacaggaagtgactcaccaagaagccttgaatggaaaagtgtagcagatggttgctaaaagaaatctgamaaagcctggggaactctgtagggtgcagagactttgacaatgtgtatgagagacattctctaggtatcattactttagctcatgttttgttgcattttagtcttctcagcaggaagactgtttccaagaaaaatgtattatttattgaccaggcgcggtggctcatgcctgtaatcccagtactttgggaggccgaggcaggcagatcaygaggtcaagagatcgagaccatcctggccaacatggtgaaatcctgtctctactaaaaatacaaaaattagctgggcgtggtgacatgcaccagtagtcccagctactcaagaggctgaggcaggagaattgcttgaacctgggaggcagagcttgcagtgagccgagatcatgcaactgcactctagtctggcaacagagcaagactctttgtctcaaaaaaaatttttttatttattttacaaacacttatgtggtagttaccatatatgccacatatttatgagataggtactattattattcccattttacagatgggaaaaccaaagcccagagaggttaaataacttacacaaggtcacactgccttgtaagtggtagaggcaggactcaacccgaggcagtctggcaccaaaatccacatcctcacccatactgcaatattccctcgaggatgtgatacatgaaatgtatctctagtgttcaaataagtaaggccaatgccagtgaaaaacaagtcttttttttttctttgaaacagggtctcgctctgtcgcccaggctgaatgcagtggtgtgatcaatcatggctcaatgcagcctcgaccttctgggctcaagtgatcctccttgagtagctgggactacaggtgtgaaccaccgtgccctgctgaaaaaggattttttttttttttgagccagaatcttgctctgtcgcccaggctggagtgcaagtagaacaatctcggctcactgcaacctccacctcccaggttcaagcaattcgcctgctcagcctcccgagtagctgggactacaggtgcgccaccatgcccagttaatttttgtatttttagtagagaccgggtttcactgtgttgcccaggctggtctcaaactcttgagctcaggcaatccgtctgcctcggcctcctaaagtgctgggattatagggataagccaccgcatccagccttttttctttttctttttttttttttgagatggagtttcgctctgtcatccaggctggagtgcagtggcgtgatctcggcttactgcaacctccgcctcccagattcaagcaattctcctgcctcagcctcctaagtagctggaattacaggagtgcaccaccacgcccagctaatttttgtattttcagtgagacagggttttgccatgtcggccaggctggtctcaaactcctgaactcaggtgatccccctgcctcggcctcccaaaatactgggattacaggcatgaaccgccgtgccttgctgaaaaacgattcttgataaacaaaaataagagttgcctctatttctagaaatgtggagccctcaagaattttaatgacagaattggcaggtgatggtgtctggtgcctgtaatcccagcactttgggagggcgaggcgggtggattgcttgagtccaggagttcgagaccagcctgggcaacatggtgaaatcctgtcacaactgaaaatataagaattagctacttgtgatggtatgcacctgtagtcccagctactagggaggctgaagtaggaggatggcttgcacccgggaggtcgaggctgcagtgagctgtgattgtgccactgcactccagtctgggtgatagaacaagaccctgtctcaaagaaaaaaaacaagaataccagaattattatttaattcagcacctcttgtgtgccagacacagcgctaagtgccctgcatactttgtcattgaactataccaacaattttctgagaagggttcagatatgattcccatttcacagatgaggcttatagaggggttaagacatttgctcaaggttacacagcaaagccttgtagaccttttttttttttttgacggaatctcgctctatcgcccaggctggagtgcagtagtgcaatcttgggtcactgcaacctctgcctcccgtgttcaagcaattctcctgcctcagcctcccaagtagctgggattacaggcacctgccaccacgcccggctagtttttgtgtttttagtacagacggggtttcgccatgttggccaggctcttctcgaactcctgacttcaggtgatccgcccgcctcagcctccgaaagtgctgggattacaggcgtgagccactgtgcccggcctcagtaaacttcttagtgagttcctaatagttccctaaggtgaggagagaagaaagttcctgctgctcctgctgcttgcgtcagcctcccttcttcctccccagggctgcaagtggaattcatcaaccccatcttcgagttctccagggccatgaatgagctgcaactcaatgatgccgagtttgccttgctcattgctatcagcatcttctctgcaggtgtggaggaggggcaatgggaaacagcaagagacttacaccaaggagggctgcaggtcccacaggaatcggtggggggaggggggtggtggcttgggarggtggaggcatttgctgtgttattttaggatgagagagcttggctggagcatgtctctatattttggttgcaatttggggtatggaactggaccctggccagacctgctcctcaactctcttggtgacctatagaccggcccaacgtgcaggaccagctccaggtagagaggctgcagcacacatatgtggaagccctgcatgcctacgtctccatccaccatccccatgtgagtctccccatggtgttccttttcctccttcccacacacaggcccattccctgacatacctactttcccttcaagaatttctctctgactgcatgctgtgcagacaattcacctctcccacaactcccctactcttgccccgcttccctggggacaggcaaaagctgtgtttgtctctctcctttccccaggaccgactgatgttcccacggatgctaatgaaactggtgagcctccrgaccctgagcagcgtccactcagagcaagtgtttgcactgcgtctgcaggacaaaaagctcccmccgctgctctctgagatctgggatgtgcacgaatgactgttctgtccccatattttytgttttyttggccggatggctgaggcctggtggctgcctcctaraagtggaacagactgagaagggcaaacattcctgggagctgggcaaggrgatcctcccgtggcattaaaagagagtcaaagggttgcgagttttgtggctactgagcagtggagccctcgctaacactgtgcygtgtctgaagatcatgctgaccccacaaacggatgggcctgggggccactttgcacagggttctccagagccctgcccatcctgcctccaccacttcctgtttttcccacagggccccaagaaaaattctccactgtcactctgtggtatggccataaatgcctcagcgccgcctcactgataggtctggtactgtttgaacaggaagatcaaaatgaatacaaaatgagagaaaccaatttctggattgggggtggggacacggtaatagaggaggaagcctgcgatctttaggatccgcctccaggcccagaggagggagagtcacaaatgacagccttggccgtgagagggggcctcttcttactaacccccactgcgccatatgggtaaatggaatgctgaggcttaggcgcccccttcccctgctgggatccgggtaggatccggttgcctttctgcggtggaggaggaagtgttggatttcagcgctaaggcgtcggcggtgcacctcacgtgcatgtgtagcatgccttggtttttcctttggcatctgaaaaaggcacaacctgaaagacctagaacccagtgtcggtccccaggccctttgggacaggaagagaagagccgtgtggccgcggggaggatgtcctgcggcggggctgtcctcgcggactgactggactccatctcccagcgggcgccgcggcgcggccacgcccccccactccccgcgcgcgcccggtggaggtaaccgcggccgcgcgcccccctctgcccccgctgcccaggattggtaggctccaccgctcggcagccggcttccctgctcggacgccgagcaccgccaaagcgcgtgagtggggggtggggactgggggatggggagcccgtcaggaagtctcaggggccgattatcttgggaagtgactttcagaggaatccccatgtcgtcgaaacgggcgctatgaccccgtcgggtgagagtctctctgagcaacccaaacagaaggtactgctgtgggtcccccacttggcacgcgacggcgctgggtcggcctggcgcgccctcccgcgcccacgggcgctaggctaggtctgtgcgcagccgctgtctcccgaggtcggccccgccccgcggcgctcggctcggtgcagccccggccccccgggctgaatggtacggccccggccccggcctccccctccgcaccccgcgcgagtggtgcgtgccccccagtgcagacgcggaactggcgcccgctcggagcggcgccgcgctggggagcgactgacgccccgctgccgggggacgtcgggctgggcctggccagtcccccagagcttgggaggtaggagagtctgggccggtggggtcctgggcgagcgtctggggactccgagcgggagacgggctctgagaggacaccgtggctcttggaggaaggggtctctcaggaggccctgggggagtgtgaaggggcgtggggacgggggtctgccgaggaggggcggggacggggatgggggcgccccgggcagaggagggggctcaggctactgggcttggttcctgccgagcgggcggctcgggttcaggttcggggcgggggcgggggcgggggagaactgtccagcaggtgagggggcgggcagagctggccagccctggggccgaacccgcacagcgcttggcgggtgtgcttgtgcgtgtgcgtgcttgcgccttatttttggctagaatttggagaaacacgtttggttctcaagaaattttttttttaacttgatatttcaaaattgacttgctggagagagaacaccatttcatctttctgcaatcgctctcctccccatcctcgtgtatctaccttcttccacctttccctgccctcccctctaccccaaccctgccagctgccagcctccttgctccagttctcccatacgctggaccagtctgtgctgatgagcttgcaaggtcactgcctggggaggtagaggaggggaggagagcctcctgttgtgttcacgtcagcagagatgtcatatcgctctctggttcctgtggttttactgtgagatcctgtccaaaatgagggacgaatccaaagggttggttagcatggctatttctgctgaaaaggcatagataacttaaaagtttgtgaatcctaaatctacctctgggtggagctgatggtgatgtcggacttcagcagatagatatgcattttgagctggatgcttttggaatacaggaagataggaaccagaggctctacgttagtaaacatggttgaggcaagaggcagagtcggagcctcgttggttgtgaagacaagagtgtgagttgtgggtgatgttagaggatttagtctttagaggagttaaaggtgttagtctttttggggaggggagagaggagagaatgagaaggaaaatcttagttatctttgcaatctgaataactgaaggcagtggctgctgatcagatgtgaactctggctaaaaatttatcctaccacccgtagctagaataataacaagatctcagggtccttgtggctctggaaggaaatgattgtgagtgacttgagtttcgtcagatagttgtcagtggagagggactgagatcccaccaaggctagagaggcctgatgcgtactcagtaggaggtgcttcaggcctgatctttgagattttggttggagagggctccgggttttcaatgtaaacatagattgcaaggtgtagtctagagctctggttctataaattctgttttactttaagatactttggctctcactctagtcatttctacataattcttttttttttttcgaatcccatgacaggttaactacataattctttattaaaacaaattatgctttttactcatatcccatttcatttctctatttctctcccccttggattctgctcaggaggagctgagtgcggctctgttatagtgccccacctcctgcagtttgctcatgactctattgcagttgggagaaccaagggactatttgggttcgttaagcagtggtgatacctagaaatgaatatatggcgtgctcagaaacctggtggtgttctagagatatcactatcaaaagccagaattaggacgaagtacaaactacagacagatgagggagaagacaacctaattcttagcaggtactgtcagtgggagaagtgtctctaggttcgaggagagtgaattgttatgggccttggctgactctggagtagcagctgctagcactgtgcggtcaccaagcaggggaggggctgtggctctgctataaatagtgctgggagccagagtcgctatagagataaaactgaatcctattacctgcaggtcctctactgggagcaagggaaaggagaaagcagtattttgaggatttgagaggtattgcaaataggtcttgtttattgttaggtaggggagaaaaaacttctactcattacctaaaccaaatagggccttaagcatccagggagtgtgtatgtctgtatatatgggagtgcccgcagcagcaggtgagggagtagagggtgtgtgtgtgtatacgataatgggtttctctccgtgtgcattgaacaaggtcttaggccgcatgtagagcacagaggtagaatcctggaacactagaaatatgagaaaagaacttctactcatagaagaagtagccctaccagaaatagctgtgcagcggggtgaaacgttttatttagagaagtgtatagacacttaacacgaaataaattataattaagaccatgaaagcttttcctaattttaggacatagtttagaaatttctctgagcacctctccctgtccttgcagaaatcctggtatttctgcctctaattcatagcctctgtaatgtatagtaggacaaggactcatctgtgggtattgtattactgattctgagcctgagatcaaaatagaggagagattatgattcagcaccaagggcagagctagtagcagtggcctctgggctcctttcttgcctgaaggagggagaaaagtggtgcagattaggcaattggggcatggacattttcatttgagatcacatgaggtagaatagccagctgttattgtctgagcatggttaactagacagtctatgtggtagttttacatcaagctgaatgtagattgttgaaacagaataattaagtttccatctagacctagaagtgcaggttagtgctagctagttgaggagtctggtttgatcctgatccaccctggagggatcctgagagtgacttcaatttttgttacaatgactgagtccagattagatggcctaggtctgtttttcagaaacagagccccaggcgttaagctggaaattaagtcattggtagggataggtaggtgaaccattatttatctacattttttttttttcttgagacggagtctcactctgtcacccaggctcgagtgcagtggtgcgatctcagctcaccacagcctccacctcctgggttcaagcgattctcatgcctcagactcccgagtagctgggattacagatgtgtgccaccacacccggctaatttttttgtatttttagtagagatggggttttgccatgttggccagctggtctcaaactcctgacctcaggtgatccgcctcggcctcccagagttctgggattacaggcgtgagccaccatgcctggcctattttttaacattcgattctgtgagctcatgagcctagacacgaggctaggcaagcgtcaagttctcctatcattagtatgaaagtggaagaccttctgacctctgcctctggccgggaagaagttgagagggatgagtcccttaggcacagcagtggatcttatcagtactttttttcctattagacttcgattttcagaattcctcctgggaatgctgactccttgcttggtgccctgatgcttctctgagataaactgatgaattggaaccatggtgcaaaagaagaagttctgtcctcggttacttgactatctagtgatcgtaggggccaggtaaccaagaagagattgacttttgtcttaatatctgggatagccataaaatctgcagttgttcccttctccgatttccatgttgctttgcatagctcatcttctcctgttattttaccctgatgggagcatcgaagccagtagggaaaaaacaaaatcaggtggattgaaagcaaaaccctgctcttaactaacatcttcttgatgtcgagcaaatatactctttatacctcagttttcttattttgtaaaaagaaaaagtacattataagctactcctctatgtatacttttttggtaatttattagttaattcactttaaaagatgttaatcatcttaaggtgccagtgataattttattgtcaaaatctccccttcgtttcagaatagatgccttcatgacagtgtagacttcacttaggttaccagctccatgcggcaggcagcacccatattttccaaggtgttacagtcaggttactttatccaaaatagcatcttgagctttatttgttgactgtggttaaaatttgatagcccattccatcccttcaggctgctgaatttgtctttatgttcttcaggcacccgagcagtgatagcgtggcccagactcctgaattgctacggcgataccccttggaggatcacactgagtttcccctgcccccagatgtagtgttcttctgccagcccgagggctgcctgagcgtgcggcagcggcgcatgagccttcgggatgatacctcttttgtcttcaccctcactgacaaggacactggagtcacgcgatatggcatctgtgttaacttctaccgctccttccaaaagcgaatctctaaggagaagggggaaggtggggcagggtcccgtgggaaggaaggaacccatgccacctgtgcctcagaagagggtggcactgagagctcagagagtggctcatccctgcagcctctcagtgctgactctacccctgatgtgaaccagtctcctcggggcaaacgccgggccaaggcggggagccgctcccgcaacagtactctcacgtccctgtgcgtgc

SEQ ID NO: 17960 - DNA, 71553 bp, Homo sapiens
  misc_feature (1)...(71553): n = A,T,C or G, or insertion/deletion polymorphism (see Tables 1-2)
tatacagaaaggacagactgattcttagattcatttggatattataaagattcatattagtcacaacaatgttgaagggaaaaaaagaactaagagcttttctactttctaattttgaaacttaccacacaagctgtagcaatctcaagacagcatggtactagcataaggatagatatatagatcaatggaagaacattgagagtccataaataaatccacacatttttggtcagtttatttttgaaaagggtgccaagaacatttaatggggaaaggataatattttcaacataaatgatgaaaaaaacaaatacccatatgcaaaagaaagattggagttggacccctaacacacattatatacaaaaaattaactcaaatcgattacaaacccaaatgtaagagctaaaataataaaactcctaggaggagacataggtataaatccttgggaccttggattaggcaataatttattaaatatgacatcagaagcacaatgaaccaaaaaatgttttaaattgtattttattaaaactaaaaacttctatgtgtctcaggacgctatcatgcatgaagagacaactcacagaacaggagtaaatatttgcaaattatatatctgataaagatcaaagatccaaaatatgtaaagaactcttacaattcaacaataaaaagataaacaattgaattaaaagatgggcaaaggaattcaacagacattcctctaaagatgatacataaatggtcagtaagcacatgagaatatgctcaaaatcattattcactaggaaaatacaaattaaaaccataaagagatacctctttatatccactatggctatcattctaaaaattaaatatagacagaataacaaatgttgccaaaaatgtggagaaaatgggatgttcatacactgctggtgggaatttaaaatgtttcagccactgtgaaaaatagtctggcagttctgcaaaaagttaaacactgagctaccatatgacccacagattcactcctgtatatattcccccaaaaaatgaaatcatatgctcatgcaaacacttgtatacaaatatttatagcagaattattcacaatagctaataaatgagaataactcaaatgtctatcaactgaggaatggataaacaaaatgtggtatgtccatacattggaatattgttcaatatcgttcactcatgtaaaggaatgaagtactatatatatgctacaacatggaagaactttgaaaacatcacgctatgtgaaagaagccacacaacataggccacatatattatgattctattaatatgaaatgtccaaataggtaaattcataaaaatataaagtagattagtgtttgcagagaatgcacgaattagtatttctacttgttgaaaataggaagtgactactaacatgtatgtagtttcttttgggggtgatggaaatgttccataatttcatagtggtaataattacataacaccatgagcatactaacagccactgaattgtacactgtaatgtaataaatgttatgtaatgggaatttgtgtccatttaaaaattgtaaaaaatagccaactatggaaaaaatttactggttttttttttcagattcaatgttataaatgaaggaaataatttcctttcctgcaaactttattgcacattcattcagattttctctttcactgtcccatttcacattctggaaaaatcagatattttaagacaaaactactcttttcctcatttggaaaacatttgtcctattatcttgcatagacagttatgttttttgtcactactgtttctaccatggcctcaactatacatattagttataacatttaatgaaagaaaataactaacataaaaaaactagaaaagatgattggctactttctttcttatacagtgaatcctaaaatggccttgaaatctggtaccagctcctctatgatgcagtctaagagcagtcttgccctcacagggacctaatgggagaaatgctcacaagtgccctggtaggctgaacttggtcccactgtggatcttaaaacagcactgtatactggctccaggccctctcatctgtgatttgagagcaggcctgcccactcagggacccagtgggacacatgcccattcatgaacccagaggcaggcctgaagacctgggtctcagctgtaggccctgaggcagccctgttacttggttctcttttctctcagctgcaatctggaccagcactgtctgcctaggaacctacccagtgacccagtaggagccctcctaaggacccagaggaagccacattcatccacatatctcgtaactagcctacaatctgtggactctaaagtagaccctcatcccagtgccagacctactgaccaaggtctaggaggcagtccaatttacccagggaacagacagaatctaagcctactagagccccagttaacaggcctgccaaccacagacctcactgttgacccagcaaaaccatgtgacctggctctacctccagttgaccacaattctggaagcaatcttgtcaatcctgggaacccaacaggaggatcctgaggatctttacctgtaaaaccagtctataaagatgggaaaaggtgtttgctccttcagatgcatagaaaccaatgcaaagttacacagataatgatgaaccaggcaaacataataccaccaaaggaaactaatgaagttccagtaactaatctccaccccaaatggagatctacaaatttccccccaaaattcaaaataatcatcttaaagatgctcagtaagatgcaagaaaacacagatagacaactaaataaaattagaaaaacaatgtatgaacaaaatgagaagtttaataaagaaatagaaaccattaagaaaaaacacacaaaaattatataagaacagaactgaatattttaatggagagcttcaacagcaaacacagtcacacaaaagaaagaattagtaacttgaagacaggtcatgtaaatagttaattaaaggtgaaaaaagaaaaaaaattaaagaagagtgaagaaagtataagggacctatggaataccatcaagcatgcaaatacacatattatgggagtcctagaaggagaaaagagggaaatgagcagaaagcttatttaaaggaatactggaagaaaaatgtaaaagctagagtattggtggcaatatggggatacgaaaatcctcatgcactactggtagaattgtggtgtgatgcaaccattctggagagttatttgtcactatttagtcacttaagtacatgcctctcatacaacaatctcactcctgtgtatgcgtcttgcaagaggatttacctgtctcaaagggtatatgtaaaaagatatttatcaaagcattatttcctcatggcaggacaatagagacaatcctgtttttatcattaggagagtggaaacattaaacctcttggatgatcaccaaagagggctatactgtaataaaatgcaattaataaaatacatacatataaacatataaacatgggaggatgttttaaaactagcaataactaaaaagaataagaaacaggcaaggtctttttccaatactctttatataaaataaaaatacacacttaagactttcctttccagtaatggtatacaaggtaattgagaccaaacttcccacttaaattaggaatggttggttatatatatattcactggaggtattgaaaagcaaagactgtgaagaattatgaatccaaagttcagaagcaacatagcaacccaaaggggcaattctgtgtttaagggcactttccccttagggtatttaacagctccagaatatttggctgagagatttagaagcacattttaaagcctttagtaaataaaattgcagcgtctagagtccaaggctcatgaaactggggcaaggagatgttcctgatagaccctttacatattgtgttgagatatcaaactgatggtataattcaaatggtccataaacatatgaaaagatgtgtaaagtcattaataatgaaaattaaggcaagatactgcttcactcatcagattgataaaaagtaaaatgcctagcagagtaaaacgatggtaaatatataataaactgaaaatatccactgttgcagatgggtattcaaatccatgtaatactctgaagagcaatttaccaatctgatagatttcaagatgtacatacatatatagcctataacccaatctctgctatataccctagagaaagtcttgcaaatatgcttaagtagacataccgtatttgtagcagtattatttgtaatgttgaaaactatgaagaatccaaaattcagcactaggggaatagagtaacaggttcggccacattcatacaatagaatgtcgtatagatggtcattaaaattaataaattttatcctcattatcaatgctaataagtcttaaaaccataatagtgatgacatattttacaatatgtgcataccacttatacatataaaatacaaaacacaaaattatgctatatattatttacataaatatggattaaaaacataaacacatcttgaagaatacatatcaacttcctaatcccacaacattggaagggaaatgagattggagagaattacaaaggaaactccaaccatatttgtcttgatttatttctttttttgggttggtggatctggtaaaaactggaaaagcttctagacaaattttaaaagagcgctaccattgccatctttcatttcttaagaagaaatgaccttaaacaaacttggcaagtgtttaattttattaaagttgggtgcatgtaaggtacgagtgtcttttatcttgctctctatatttgtgagtatatatatatataacatttcataatttaaaagaaattatttcattctatgataatgtgacaaaagaaacaaagatgtgaaataaaaactaataggaaggaatccactttcagcagtgtggccaggaatttgctctccaaagaagggatgattaggctgaaatatggagaaagagaaagaaagttgatttaaaaagtttcaagcaatacagtatgtaaacagacaccaatgtctgcagtctaaggatggcattaaatctgctggtggtttatatgtgatcatcattgtactacaagttctatgagagcatggatactgaatatcctgttcaatattgtattttcatcaccagaatagcacttagcacacagtatggctcaaaaaaaaaaatctcagataaagtcaatgacatggtttaagggactcaaacgttagagtgctcagacagtaacaaggacagataggatcaactaagaatctgatcaggtcaatgctgtgaaatagacaagtgtgatctttgataactcctttctaaaatctctttgatcttttatctcttttatctttcattgatcctctactcttgaaatccttattttatatcactttcttccaggaccatgtactcaatcaactgctaaaaaagaaaacccaaaaaccctaaagtctatagttataactcactcagtcccagaaatgaatctgcaatgcatgagctactatcatggtaacatgtccctgacattctttgtcagcatcctttgtcacctgcttgtaaggattttgaaagagatggagaaaggtaggttgaaggttccttatcaggaggtttgctgtcaaagctcattctaaatggaatacaaattttatcttccagacatgcctcagtacctatcagaatttagccttgagaaaaatgaggcaaccactgagagtaatgacccttttagggaatctgtgctcaattctgaactctattcagaggccttggggtggggcttgtttgtacatagtggccacataaagcctggtaaactcagctggtctccagggcgaggctgagggcagagagttggacacaaccctgagatttatccctcacaatgcggaaagacagacttcttcatttatgtcttgtgctacttcttatcctgctttctgccagtgactcaaactctacagaaccgtaagtctcactcaagaccccttcctccagagtgcgtttcagtctctcccttgtgtcttcgctttgccttcctttgtaaatgccacctttccactcattacaataccttccaaatataagaaattattccagttaatcccttgtttgtctttcatttatcctctattcttgaaatcattttttctacactgggccaatcagagtcataaatacgattagtcactaggaagcatgattaaataaaacactagatcccaacttcacagaacagttcttttggatggaaggcactgaatatagagatattcgaaatatatagtgaagtgcaacttaacatgtattgtaggccatatatatatatacagaaagtatagytcctttatttttcaatcatgtatcaagtcttcaccaacagcccccagtgggggaccaaagcagggaaaataattttaaccctatccagttgtaagttggtacaactcaataattgtaagacttcttttccacctctccccagttcctctcctctatagtgtctagagaactgtggtctccattaactcctaatagagaaaactgtcagagtccttggtctcaaagttctccgtccttcttggctactgtcagtctgacttctccttacttgctggcatgcactgttgaagtttagccatctggtttctcttgtgtgttcaggacccaacagtcctctctaactgactgtctcacttcagctgtttcatatcccatagaactcctacctttgcatcctgcctcaaatactatggctattgtttcaacacagcctgtgatgcagggtcaccttgcccctttgcagtccaggccatttaaggtccctggccttaacccagctgcctttacatttcttccagagaatggtgagaactcttgggtccaataatagcacataggcactgaggtgtcctggagaggttaaacttctacctctctcttgcatacccacactgcacttctagatgcctatcgtgtctcctgtattccagactgatacagggaagtcttcagagtcccaaatcgggaaagggataaggggtccctctgctctgtgtgttacccttatccatctaacacaaatagccttcttcaggccaaagcgcagaaagcagaaataaggagttcaatccagtaagtctcctgctttcctcaggctttttccttgcacaatttcctggcaaccggtaggggtacatttctcccccactatccctctacctcatctacagcagtgggctctactacttccagctgctctccatccagaaagcatatgggaatatgtggaggctattttgctttctgagagcagactgaatggataaagcgagtagcgtgtattgggtcagaaacattaagcaatttgtggttctggatgcattcctacactacattggaccatgctgccattgaaaccatccttttacgttgtgtctgccactgaacaaagaacaacaagcctcatgccctagttgtcacaagcagaaggggtgttttctccctttataaggagaaaacttaacttcatccctccagaattaacccttgatgtgataaatgtgagagactacaaargagaaccaatagccattctcccctgccttggggcagtaagcttcagaaagatgaaggtttcaggggaataaaatgaaaaagagaaaattaaaagttatcactttaatatttgctacatttagtccctgctaaagaggcaaatatttaaaatgcaaacattcatgattgagtaaacatatattaaaacattttagcagctcactaccaatgacatcttgggcaagtttgtcaacctggatttgttctgayttcaatatctgttaaaaaaatattaactgaactcatataaaatagttctttagaatatcaaatatatgtggaattaatttttaatcgtgatatcttttaggcttataatttataagaataaaaatagtaaataaattataaatatatatataccttcttattaagatcaaagaactaaaggaaaaattttttgatggggatgtaaaaaatgatacatttttattatttattatgctgttaaaagagcagtgatcaggagatcagaagcatccagataccagaaaaagattaagacataagagactagctgaatgactatcagtgagttactgaactgccctcagcttctctgctagagaacaaaaccttactactcatacagtaaaatcatctgaaacttggatgatttcagagtggccctggagattcatggcatatagttttgcccaggaacactttaaaacacatgtagcaagactggtgtgctggagcagactacatggaggatgaggggaccaaatttgagttccacattccacaactcaattatccttggattctctcctcctagtctcacacctattaattttgtaaagcaacaatattgggtttcttgtgtcaaattgcctgtccagaaaacaatttaaaaagtaagagtttatgttggcaatggaaagtaagggtagtaaaataatayaagaaaataatagtttttacttgcaaatttactctataaatggcctaaccctgcagatattgaatcatgaatcaytgaatcattaaagctttgaagagttacattttagtcacaatttactgattttactgatttggcatgggggcagggattttatccatctgttatggattcaagttttggggactgatgaggatctcatgttttagcttccatgaacatggagagtatcatgcatgtaccttacagcattgctgggaagattaaatggcttaatacagagacagcttaacaattcttgtcatgtggcagatgctcaaaaacagcaacaacaaaaacacattctctttcagcccatgggatttcagagtgtggagagattatattgaattggaggcttctggaaagtgacaggaaaatatggagtggggggcattagagacaaaggacactcatcaataaagctaaggccagaatgtgaggcttacacaaaaaattgcctgtgcctctgaaaaactgaaaactttcaacaatttaaataaaaaagaaaagacttttcaaaataatatgacttttagtactcatataaactttgttttgtttttttttgaaacagggtctcactctgtcactctgaaagcactggtgcaatcatagctcactgtagcctcaacctcgtgggcttaagtgatccttcttgcctcagcctcctgagtaactrctactacagccatgtgccacctggctaaattttttattttaatttttgtagagatgggggacctcacaatgttgygcaggctgttctcaaactcctggcctcaagtgactctcctgcctcagcctcccaaagtgccgggaactaggtataagccacttctcccagcctgaacctgtttgtttttttttattgaaaagataacctatccacccatgtgattcgaaacaaacatgtttataaacatggacatactaatattaaattattaatgttaattgcctcaagaaattgagcataaagggaaatgataataaaatacagtgtgtgtttgtgtagtgtgtgtgtagcagggagttgtgcatgtaaataattgacaaaattttcaaactcgttgataaaatattgactttgactgagctgtatctgaggagcctaagagaaacagcaaatactttttttcagtgttgctgatattaagaaaatgattttgcaatatagacatgtgttattttgtgtaatgatatatgcttactgaagttctttcagttgaatttctgtaaatctagtcacggtgttcattccaaagtgatgtttatctagacagattttaatgtaagtcctttttacaatgaataatcactcccaattttttatatatgtgtgtgtgtttgtgtgcgtgcacttttatggatatatattcaagaattcagattctttttaaaggtcaaagttaaagtttaaagagctcagactgctctttacagcaaggaatgcctgtgaaattgtaacatcttggaaagcaatctccagtgttgtatggctccagattgtgtggctgaggcatggctgatgagtaaaagataaaatttttgtgctgatctgtgacagaacctccattgacttagtccattgacttttagaataaaactgattgcaccaattaatacatattgttatgaaaacacmtttatggrtgaaaacgcttactatcatcagtttttctctaatttagacttcttcctttcccaggcagtatatggtgctggtcccctccctgctccacactgaggcccctaagaagggctgtgtccttctgagccacctgaatgagacagtgactgtaagtgcttccttggagtctggcagggaaaacaggagcctcttcactgacctggtggcggagaaggacttattccactgtgtctccttcactgtgagtgctacggtgccagctggctatccctgcttgatacattttattgagctctataggtcatggtgatggagctctggtgtgcgatcccaaggtatgactttaagaatgtagttaggacttcaggggccaggtgcggtggctcacgcctgtaatcccagcactttgggaagccaaggcgggcagatcacgaggtcaggagatcgagaccatcctggctaacaagatgaaaccccgtctctaccaaaaatacaaaaaattagccgggcgtagtggcaggcgcccgtagtcccagctacctgggaggctgaggcaggagaatggcgtgaacccgggaggcgaagtttgcagtgagccgagatcgccccactgcactccagcctgggcgacagagcgagaytccgtctcaaaaaaaaaaaaaaaaaaaaaaggaatgtagttaggacttcagaaaggactaaaaatagtgagttttcaactattaaggaacaaagcattttttaccagagtaaggaagaaatactcttctaaatttcattcctaaataataatcctattgcccacaaaaatttcatgacttagaggagttttctagttttgattgtaactgtctctttaaggatcgggctggacatttcctagaaatagatcatatgaaaatttcatgataaaaactttgcatgcaacataattttttgcacatgcaggataccctaagcaaacacctagtacctctttaaagttgcctaacttgggaaactcagctcctatgctctcccatattttttcagagatgtttctctccattgcttcagaatatacatactcagttaaaaggcatctaatttaataactagagctctaggtgaactccatggagatctgggttctattgatggccactcttactgataccattcctccatctcacattaatatcgtcactcttatgtctgaagaaatagtcacaccttccttctccttggtgaagctgaaggagagataggaaatagcaatgactgaagaatgcagagggagaagactgcacagttcctcagtagtaaaaaatcctttgctttttagctcccaaggatctcagcctcttcagaggtggcattccttagcatccagataaaggggcctacgcaagatttcaggaagaggaacacagttctggtactgaacacccaaagtctggtctttgkccagacagacaaacccatgtataaaccaggacagacaggtaagtagggaaattccactgtttggggcaacactgagaagggccacctgaacagccaaagtctccattatcctagccccgtagcctcctgtcttattacccaaattacctgctttatcatgtctgaatcttatcggagaactacttttccagtaagattccgtgttgtctccgtggatgaaaattttcgccctcgaaatgaactggtaagcatccactatctgtggtttgggttgtgggtagagtgggaatactcacccagagtgaggtagaaaggtacaagaaaagcgagaggatgaaagacacttgtttttgaacttggctccagcctcagcacagatttgcagtcttatacaaaacaaaaattgagggacaagagatgaggaagttctttctcttataacagtatttaatcagtctggcaatagctgcatttgttactctgaacacactgcattaagaatattaaagaagcatagaaaaaaggcactattcctattcatactttcaaggaatttatgattaaaaaagcaacaaagaattatgcttttatgaatatataggtatatacaatagaccatattataattttattatatattcgatacatatagtatagaaatatattatacacaaagacttttttatgctaattgaatttcccttttttcaacttaccttcaatattagtgcaaaggaacaaagctrcttttaataggtagaaaatagacaatgttgaaattagaagaaatattcttggtttacttkcaaccaaatgattctgggaattctatttctgttaggtctaaatcataatgacatataactctattaatatctatttcccaacttatgaaagtaagcagtatagtcatattattcactaggagaattttagtatccaaataatattaatacttaaagattcaataatatcattcaccaataataattttcagggaaatggcaacacataataataattattgaatatattgtgtatgctcatcctagaactatttaataatttccctgagatttttccagttctgttatgtttcttgttgaatttagctacagataatattcttcctcagtttgttgtttgatcacaagtctgaaattgtagcctttgctggaattctaatcacatctcttctttccttttatcatatagattccactgatataccttgaggtaagtatcagaaaaagtatcttataaggaaattagtgcttttagagrgtaggaggttctgataatactctagacagatgaactactttaaaaawtttcagatctgaattcctcctactcccagttgtcaggttgattgtattttctcttccttctgtatttgtctttccagaggcaatgctaattatcaccttcaaaatcatttgagttgctcaaggactattgtgactaaatgattaccgcccatgtttcttgtttcccttcagaacccaagaagaaatcgaattgcacaatggcagagtctcaagctagaagctggcatcaatcagttgtcctttcccctctcatcagagcccattcagggctcctacagggtggtggtacagacagaatcaggtggaaggatacagcaccccttcaccgtggaggaatttggtatggattatggaagatgaaaaaggcataacattttggttcctagagtgtgagctcacttagatcctttgaatttcctgtagatatgttgaacttgcagtagagtcagacttactgcttctaagaccattaggacggtgtgaacacagaagctcataagagcttgctgattttcagtagcaaattacgctttgccaagtatgaaacttcttgtttcagtgaaaccaccatcatttgttaacgtcactgagacccgctgtgctcaagaagtcagttagattctgcatgaattgttaaaccttaccatcttaaagttgatacattggaaagtaaatctaacattcagagtgttattttgggaaaaattatagacatactgaaattatttgtatttccaataaatgtttaccaaccttccttattcctattatctctattaacagtgcttcccaagtttgaggtcaaagttcaggtgccaaagataatcagtatcatggatgaaaaagtgaacataacagtctgtggagagtgagttacattgtttttatctaaaattttatattttgcctcaattttgagkgattatgtaggtacaaaattataaatttactttgcctcagcacttttgtaatattactcctttgacttctctttatttaacgacttactattaaaattttcaaatacataaaagaayagaaacacacttaattatgatttaacaataaacatctttccgtattgtttcatcatatattttgctttaacatcttaggataaatcacaaagatcatgatatttttctgtacatgcagtagtatgtacctctaaaatacagagacatygtccacttctgcgacaacacgatcacttaacaaaattggaagtaattttccaaaactaattgcaagtttacagtcaagtatcttcaattgtcctaaaaatggtctcataaagctgggtgttcgcacattggttttggttattatgactcctaagtaccttttctttttccaaactctctacaacggaaattttcaatcacgtgccaaagttaacagagaagtaaaacacaatttcatgtacctatcacctatttttaaaattgtaaaatttgccaggttctttttgtcccatttcctcctctacagtagtttttttgctctaatattttaaagcaagccataggaatctataaatatcttagaggtttaaaagtctataacctcctttttttaatgacatttcgctgaagatcatcagttggcctctagaagtcttgcttgcagaatctgcctgtttgttttctcatggaacattgaattaattatgcctaatctttcctctgggcaattttaagaggatacattgaatgttttacattgatctttttgatagaacaattgttcaataaccagaaatagtgcaatggtagaacaaattgtttaataacctgaaataatctctcccccagaaatttccactccaggaaatttcactttctccttttcttcatatgtataccataaatactaatcctgtcattgaggaaggaggatgcgctgatacgatggactaaaaatgtgacagagaaacctaaagatcacaggtcacaattactgggcaaaagccaatgattaggattttatagaagtgacttaaacataatataaatgatccagtgactgatgtcatgattatgaagggtactagactcagaatcggcagtgatgagtgtgcctcccctatcagaacttactgttttcactaggcattctgctgcttctctgtgcctccatctcttaagcagtagacagagggcatgaaccttacctatgaygttcctttccactgttgccctctgtgattacagatacctcttacagttccttttaacctgaagaagcaaaactgatagcctacaaacaaacagtcccagagggagcacgcagggtaaaggaatatgccagcctaaatattatataccagaaacaccaaaacgcctagatctctgcctcatttcagcctcagagcaatggccaaggagttatgtgtccaaattaatagtgccgtagtgcagatatctatatgttggagaagggcttcagaataagctgctttgattctatctttttatttgaagtaatttcagagccatttgcaaataggaaagaaaaccaatgtccaaaacaaaattattgtgtattattctgttacccattatctaatcagagaaaggactaatataacatgtgcacacacacataaccccactaattattttgtatttacatgcctcatgtgttcctaggcttctttttctccctctctctcccttctcttctctgtgcatgtgtgtcagtgcacgtgtgcgtgtgtctgtgcattttgtgttagatttgcttagttattatgtacttatttttattcaattcatcatctacatttgctcacttggtatacagaataagctttgatattattaaaacaaaataaagaagaatgatagaaaataagtaggttaaaaggaagaaacatttttttagtagacagagtctctcacccaggctggagtgcagtggagcaatcttagctcactgtagcctcaaactcctgggcttatgtgaatctcctgcctaaacctccttaagtagctaggactacaggtgcatgtcaccatacccagctaatctttttaaaaagcttgtagagattgggtcctgctatgttacccatgctagttgggaacttttggcctcaagcaatccttcttggcttcccaaagtgttggggttgcaggcatgagccaaagcacctggccaaaggaaaaacatatatatatatatgtttgcatatatatatgactgcactgtaccaccacattctctttgggattaaatatatatataatatatattaatatataatatataaatatgtaatataaatataatatatagataacttatataatatataatataaatatatataatttatatattattaatatttatattatatattatatataattaatattatatattatatattgtataatatataattatatatattatgtattgtataatatataattatatatattatgtattgtataatatataattatatatattatgtattgtataatatataattatatatattatgtattgtataatatataattatatatattatgtattgtataatatatataataattttatattatattatataatataatatataatataatatataaatatataatatatattatatttatatattatattatgtcatatattatatattacattatatattattaatcagtactctaataattaataattattttcaacattatacataatatatttatatataatatattatattattatatattatattattatatattattaagcagtactccaataattaataattattttaattaaacattaaaatataataattataatattatatattaaatatataaaaatatttatataaatatatatattcaatcccaaagagaatgtggtggtacagtgcagtcaagtttcaaaggttttaatggctaatatttttgagggagacattttccagacagctttctacttggtgggcacccagatgataaagatgtgtaggcaactctaaagagggacagttctgtggaggagtggtagtggaaaatgcaaacagccattctcaattcctgatttatttctcatgtaccagatacayttatgggaagcctgtcccaggacttgcaactgtgagcctgtgtagaaaattatctcgtgttcttaattgtgacaagcaggaggtctgtgaggaattcagtcaacaggttagtaggyggtattctccctcagtgctatcactgtttacraccagtgagactccattttactaactagaaagagggcatcaggacaagcttgtcgcaaaatatcccccaccaaaaaacgaatttctgttcttagtcaacaagattctcatttggacgactaactttggaggttacaaagcagatatgagtattaagttctcgaaggtcaattaacttacttaatgcaaaaaaaaaagttttcttgtcattagagacagaatagtagattcagtgactattgatctcaatcagtttgacatttattggttttggtatttttctcagcttaacagcaatggctgcatcacccaacaagtacacaccaaaatgctccagattacaaatacgggctttgaaatgaagcttagagtggaagccaggatcagagaagaggggacaggtgtgagtaatgaacgaatatgggaaataaaacaatagtttactttccataacaaaataaaggtcatttgtaagaaagaaattttatgactaaagtaayttctaaaagtactgactctttatatttttcagacctggaagtcactgcaaacaggatcagtgaaatcacaaacattgtatccaaactcaaattcgtgaaagtggattcacactttagacaaggaatccccttttttgcacaggtaagatatgttgtaatgcacaggtaagcaaagtatccagttgcacctaagcacaggacacaatgatgcagcccacacttggttagtgttatcagttaattaatatgaccaaaaaccatgaaaccaaggagaaatactttcctttctaaatatcactgatgaaacaaacagacacatactaaattattatgagaatcagagataatattttaatatgtagctaataaagatacttaatgtaatgtgacttagttgttatatcaaacctcttctttcatgcagtttagaataaatgatatttctatcatgacctgggcagcatcagaattttcagagtttgtaacatttatggctgtcagtgttctttttatatctgttgatctcttctgacataaataaataagtctttaattttaggcataggtattaaaataacatgcatttcatggttattattattatatttttatatgtttaacttatatattttaacaataataaagccaataaaatattaattttattcatattgataattaattttacctgttttataattagtaaattgagacatttggccaggcatagtggctcatgcttataatcccagaactttgggaggccaaggggggaggatcgcctgaggccaggagttctagatcggccctagtaacatagtaagactctacctctgcaaaaaaaaaaaaaaaaaaaaaaattagcagtgggctggtggcgtgcacctgtagtcccagctgcttgggaagctgaggtgggaggatccctcgagcccagaacttcgatgctgctgtgagttataatggcaccactgcactccagcctgggcaacagagaccagttgtgaaagaaaagaaaagaaggaaaggggaaggaaaaggaaaagaaggaaaaaggggaaggggaaagggaagggccaggggaaggggaagggaaaggaagggaagaaaacattctcatgtgtattttcttagctggtttgttgcaggagataataataacgttagtaactaacatttatggaataattatcgtacaccaaatatcttctaatgtatttttattattttaaattttttaaaaattgatacatcatagtatcaattttggggagtacatgtgattatttaatacattcaaataatttttgaagatccaatcagcataattgagatattcatcaccttaaatatttgtcctttttttgctaaaaattcaaattattctcttctggctatttttaaatcacaacagattattggaaaactatagtcgccctactcctctaatgtatttttaaataattatttaatcttcaatactaccatataaaggaggcacaactattatcccccttttaatgaaggtggaaaactgaagcgcagagaagtaacttttttagctagtagagttcagaacacagccaagcattctagcctccgtctatgcgaaaagggaaaaacagccagtttaaattcatttcttttattcttattccaagtgcatattaagtggcaagttgtagttattaaaaatctccctgactttggccgggcacggtggctcacgcctgtaatcccagcactttcggaggccgaggcgggcagatcacgaggtcaggcgatcgagaccatcctggctaacatggtgaaaycccgtctctactaaaaatacaaaaaattagctgggcggggtggcgggcgcctgtagtcccagctactcgggaggctgaggcaggagaatggcgtgagtccaggaggcagagcttgcagtgagccgagatcgcgccactgcactccagcctgggcgacagagcgagactccgtctcaaaaaaaaaaaaaaaaaaactccctgactttactggaaatactacaaagtttcatagataagctatgtaggacatgaggatccaaatggaaggaaacattttgtcgtaaatatgaaggtttggtggggtttttttgagggggaggttgttgttttagttatagcagcaaaagcatttgttcacatgagttcagtcctctctgggtgttgttcacatcaactatcaagtacttttcttctttaggtgcttctggtggatggaaaaggtgtgcccatccccaataaastcttcttcatytctgtgaatgacgccaattattactccaatgcaaccaccaatgagcagggtcttgcacagttttcaatcaatactaccagtatctcggttaataaactttttgtccgggtaagtatagaaagacaaatctctgaggacaaaggaaatgttaggaacagtgatatattcagaagaaatgtacagattgcatttaagagtaagaaataagaagatatctaactttgagtttacaaatttgaggataatagaatttcatgaaaaacaataaaggcattagaaaaggcactgcagaagtgcctgataatttcactatcattatctgtaacattttatatagtatgaaaaaaatcttatttgatttgggtcgtgaacaatatcagctgcttcagtaattcatgtactttgttttatgttattttttccaggtcacttagaaattttgtaaagtgatcacacacacacacacttaatatacactgtctaatgacgatgatcaaaagatttccctagctaaaaagttttcatgcttgttatctcaaagaagtgataaaagactataatttatggatttcagtgtcgataaataacatatacattatttctgtttctcagtttcacgtgttaactcagtttaaaaacatgtaatgatgtttaatgttttctatgtgatagacactcgctctccctaggatttaaaaggtgactaaatagtgtccctacactttaaaatttcctattttcatggagttaaaagatctgtaaattattagtatgatgtgtttatgcgcaaaaggtttttttaaataggaactttattatgagaccaaatagaagagtccacaaaatatgcctaataaatttagaaaaaaataagtgcactttgaagaaaagctaaggagcagttaccacaagggaaatagaattgtgcgcaaaacattatctgcaaggcttaaagtttcagaartcacataggtcttaaaggttggaagtcacaataatgataagaggcataaatgctaatttactaaggattactaaaaacaattttgaagctcataaggtaatagaatgttttattaatacaaaccctaattttaattaagccaattcatgaggtaattctaatatctgaaaaatcccttttccacttgtttgagttatttatcattctcatttttcctctagttctgaggggcaggaggaaaatgtcaaagtagtaatgagttagcagaatcagggcaaaagagataaatttgtggatgatttccttttaatatttgaatgttgggagactgaaaattcatttatttggctgtcgaccagtatgagggagaggcatagtgtattttagagtggaagacaccgttgtaacyattcattttggtgagaagctaaggtgamgaatttcaagacagtattctttctttgcttttctgtttactcaggttttcactgtgcatcccaacttgtgttttcactattcatgggtagcagaagaccaccagggygctcagcacactgcaaatcgtgttttctccttaagtggaagttacattcacctggagcctgtggctggtaccctgccctgtggccacacggagactatcacggcacactatacactgaatagacaggccatgggagagttatcggagctcagtttccattacctggtaagaatgaggccatggaatacaattgcagcttatcagtaggacaaaagtggtcaataggctcaggaatgtcaaaataaactacttgcacacagccaccttgtgttcttgttgtgcgtccttcattccatgagttttcttgaggytgattctctccagcacagacttgacaactgaaagtgggtcatgtggggaatagaaggctgagaactgtgtccagctcaagaaayttccttcactgttttttcatttcagatcatggctaagggagtcatcgtcagatctggaacccacactctgcctgtggagtcaggagacagtgagtatcctcagattcatctctccttgctcccctaacacatccttacccttccctcggtgacagttcataaatgggaaatcgtttccatcatcccttcacaataaggaggacacgcaggaaaatactcgtcttatgactctttggcattttaaaattcaacagtcaacagataaatgtgattgtctactctgtatcagtcactctgctaaggtacactagtttttcactttagtttgtttcttctaacagcaaaacaaagctcttttcaaaatctaagctgccttctatttatctccacccccaataaagtgtacattgattaaattaacattgcagagaagaaaaaagtaattatcatgggaaatgggaaggaagaaaggtgatagatttttttttcttgtgccaggccatgagtactttatatacgaaattggattcacttcaagaataaattgaggcctggggaaccaagatcgttttctattctaagtcaaataatctagaggttaaaccactgaaaagagaacccgtgaacatttttgtaattaacctaaactaagggaaacattttaccaatttccaccacacccctaagctaaacttaataaccattaggatttgctccatgcctaatattttctatttatgtagtttctcttcctgctaagctggaaaaattaaatattaatttttaatttttatttttcagttttgaaaattgaaacaattttgagaaagttaaaatttatgcattattaatcagtactctaataattaataattattttaattaaacattaaaaactgctgccagttttgaatatcagttttttcccaatactagtgtagaggtagttagatatggagaatggaccccactgtgtacattgttcttcaatttttgttgaataattttcttctaatactggtctatgtatcacattcacagaaataatcaaaggttttaaaacatttatttgattttttcttttataatattccaatttgaattttattcataacaggaagagtctgtatgaaaatctctatatagtaaaatgaggactagttatttaatcatttactttgtgaagatgccacaaaattttattgaaagtagctgagtcaacaattggaaaaaatttctctatatagctaattaaatcataattgtttcatcataaaacaattttaaccacatattttaatagttattaattaccgatttactcttcaccaaagaattatcaaaagcacttacacctctatgataaaagaacaaattttattcacaatttgtctaaattcaactttttaaaacttttcaaattgtccaagttgagcttcctcatattgttctcttttcacactattcttcatactgtccaaattattattacctaaattatttgcctatttaattttcagaattgagattttaaataatgaaatcttctcaaattttattatttattattatgtttaaaacttttattttaggtttgaagggttcatgttcaggtttgttatgtaggtaaactcgtgtcatggggtttgttgtacagattatttcgttacccaggttctaagcctactacccaataattattttttctgatcctctttctccacctaccctccaccctccaataggcctcaatgtcttctgctctccctcctcccgccctccaccctcagataggccccactgtgtgttgtcctctttgtatccattatgttctcatcatttagctcccacttataactgagcacatggaatatttggttttctgttcctacattattttgctaagaatgatagcttctagctccatgtatgctcctgcaaaggacatgatggcgttcttttttatggctgcatagttccatggtgtrtatgtaccacattttctttattcagtcttccactgatgggcatttaggttgattccatgtctttgctactgttcattgcaacagggttgcaatgaacatatgtgtgcatgtgtctttatgacagaacaatttatattcctttggatatatacccagtactgggattcttgggtcaaatgatagttctgtttttagctctttgaggaatcgccacactgctttccataatggctgaactaatttacattcccaccaagagtgtataagcattcccttttctccacaaccttgccaacatctgttattttttgactcttaataatagccattctgactgatgtgagatgataatctcattgtggttttgagttgcatttctctaatattcagtagtattgagctttttttcattggcttgttggccacatgtatatcttcttttgaaaagtgtttattcctgtcctttgcccactttttaatgtggtggtttgttttttccttgtaaatgtgtttaaattctatacagatgctagatattagacctttattggatgcatagattgcaaaagttttctctcattctctaagttgtctgtttactctattgatagtttcttttgctgtgcagaagctctttaggttaattagatcccatttgtcaatgtttgcatttgttgagattgtttttagtgtcttcttcatgaaatctttgcagttcctgtgtccagaatggtattgcctaggttgtcttccagagtttgtatactttttggttttacatttaagtctttaaccaatcttgagttgatttttgtgcattgtgtaaggcggggatccagtttcaatmttctgcctatggctagccagttatctcagcaccatttattgaatagggagtcctttccttgtgtttgttagctttgttgaagatcagatggttgtgggtgtgcagcattatttmtggtctctgcattctgtcccattgatttgtgtgtctgtttttgtacaagtactatgctgttttggtaactgtagccctgtagtatagtttgaagttgggtggtgtgatgcctcctcctttcttctttttgcttaggattgccttggctatttgggctctttttttagttccatatacatttttaaatagttttatctaggtctgtgaaggatgtcrttggtagttttataggaaaaacattaaatctataaattgctttgggcaatatgaccattttcatgatattgattcttcctatctatgagcatggaatattttttccatttgcatcatctctgatttctttgagcagtgttttgtaattctcattgtagagatctttgggcaatatgaccattttcatactgattcttcctatctatgagcatggaatatttttccatttgtttgtgtcatctctgatttctttgagcggtgttttataattctcattgtatagatctttcacctccctggttagctatatttctaggtattttattctttctgtgacaattgtgaatgggattgcttgcattcctgatttggcttttggcttgactgttgttggtgtataggaatgctagtaatttttgtacattgattttgtatcctgaaattttgctaacatcatttttcagcttaaggagctttggggccaacactatggggttttctagatataaaatcatgtcgtctgcaaacagggatagtttgacttcctctcttcctattctgatgccctttatttctttgtcttgcccgattgttctggtgaggacttccaatactgtgttcaataggagtggtgagagaggacatccttgtcttgtgccagtttttaaggagaatgcttccagcttttgcccattcagtatgatgttggccatgggtttgtcatagatggctgttattattttgaggtatgttctttcaatatctagtttattgggagtttttaacatgaagaggtgttgaattttactaaaatccttttctacatctgataagataatcgtatttttgtcattggttctgtttatatgaatgaatcacatttattgatatgcctatgttgaaccaaccttgcatcccagggatgaagtctacttgatcgcggtagctaagctttttgatgtgctgctggattcagtttaccagtattttattgaggattttcrcatcratgttcatcaggaatattggtttgcaaatattttgttgaggatttttgcatcaatgttcatcaaggacgtttggccagactattttttatgtgagtcccacttctcckcatgggggcaaccccacaacctgggactgcagccaccaccaccccacccccatcagggttttcaggctggtagcaactttacatttccctgggacggagctcacagagggtgaggctggctgccattttttccatcttgaagcttccgttgctgtaactttcaggttccgaagagcaagtagtgattagggtgtagcatggatcacctgcacagcacagctgacccactagttctttyagttgtgatgtgaggttaagttgagatctttctaacttttcgatgtggatgtttagtgctataagtttccctcttaacaccgccttagctgtgtcccagaaattctggtgtgttgtatctttgttcttactggtttcaaagaacttcctgatttctgccaaaatttcattatttacccaaaagtcatgcaggagcaggttgtttaatttctatgtaattgtatggttttgagtgattttcttcttattgaattctattttaatcacatggtagtccgagagtgtggagtgtatgatttcatttttctaaatttgctgaggatagttttatgtctgattgtgtgatcggytttagagtagtgccgtgtgcagttgagaagaatgtatgtgttgttgttttgtagtggatagttttgtagatgtctatcagatccatttgggtcctgtgctgagttcagatcctaaatttctgccttgatgatctgtctaatactgtctgtggagtgttgaagtttctcaatattattgtgtgggagyctgagtctctttgaaggtctctaagcacttgttttatgaatctgggtgctcctgtgttgggtgcatgtagattttgtttagttaggtcttctcattgaattaaaccctttaccattatgcaattctcttgtcttttttttttttttttgacctttcttggtttaaagtctgttttgtctgaaattagtattgcaacccctgcttttctctttttctttttttttaaattatactttaagttctgggatacatgggcagaacgtgcaggtttgttacataggtgtacatgtgccatggtggtttgctgcacccatcagcctgtcatctatattaggtatttctcctaatgctatccctcccccagccccccacccccgacaggccccagtgtgtgatgttcccctccctgtgtccatgtgttctcatttttcaacttccacttatgagtgagaacatgtggtgtttggttttctgttcttgtgttagtttgctgagaatgacagtttccagcttcatccatgtccctggaaaggacatgaactcatccttttttatggctgcatagtattccatggtgtatatgtgccacattttctttatccagtctatcattgatgggcatgtggcaacccctgcttttttctattttccatttgcttgacagatttttctcctttcctttatctcgagcctatcagtgtcattgcatgtgagatgggtctcttaaagacggcataccactgagtcttgcttcttcatctggcttgccactctgtgcctcttaattggggcatttagtctgtttacattagaggttaatattgagatgcgtgaatttgaatctgccatcatgttgttagctgtttgtcaacttgtttgtgtaactgctctatagtgtcactggtctgtgtacttcagtgtggttatgtagtggctcgtaatattctttcctttttatattcagtgcttctttctggagctcttgcaagttggatctggtggtaacaaattccctcagcatttccttgtctgagaagcatcttatttctccttcacttatgaagtttagtttggctagatatgaaattcttggttggaatttattttctttaagaatgttggccaggtgcagtggctcatacctgtaatcccagcactttggggggycaaggtggtcagatcatgaagtcaggagatcgagaccatcctggccaacatggtgaaaccccatctctactaaaaatacaaaaattagccaggtgtgatggtgcacgcctgtagtcccagctactcgggaggctgaggcaggagaactgtttgaacctgggaggtgggggttgcagtgagccgagatcatgccactgcactccagcctggtgacagagtgagactctgtcaagaagaaaraaaaaaagaaaagaaaagaaaagaaaagaaatgttgaacataggccccaaatctcttatggcttgtagggtgtctgctaagaggcccaccattagtctgatgggcttccctttgtaggtgacttgtcctttctctctagctacctttaacattttttttttcattcatttcaaccttggtgaatctgatgattgtgtgtcttagggatgactttcttgtgaagtatattttggggttctcttcatttcctgaatatgaatttggcctctctagctaggaggggaagttctcatggatgatatcctaaaatatgttttccaagttgctttcattatgctcatctctttcaaggatatcaaggagttgtagattcagtctttttacataaataatcccagatttctcagaggttttgtttattccttttcattcttctttctttattcttgtctgactgttgtattgcagaaagtcaattttgtggctctgagattctttcctcagcttggtctgttctgctgttaatacttgtgattgcattacgaaattcttgtagactgttgttcagctctgtcaggttggttatgttcttttctatactggctattttgtctgtcagcttctgcatcattttattgtgattcttagcttccttagattaggtttcaacattctcctgaatctcaatgaccttcattcctatccatagtctgaattctatttctgtcatttcagccatctcagcccwattaagaacccttgctggagaactggtgtgattgtttggaggaaagaagatgctctggctctttgagttgtcagagttcttgtgctggttctttctcatctttgcgggctgatgttccttcactcttagaaactgctgttgttttgattttttccttttatcctattcgatgaccttggaggtttgattgtggtataaggtgagttcagtcaactgactttgttaccagaagatttgggggcagtggaggcagggaggagcaaggctcagttcaggactcctggattgcatgctgtaactctggggaactggtatctggctccagctttgttctctggctccttgaggttaagaacatgttgcactgaagggaccaaggtgctcccagaccactggtcacaacacttccatgggtgatgtcagccaaagcactttgcaggatggtagcagtgggatccctcctcattcacatgtaccagcagcatggcagtggcagcgtggtggggtacacgctcatcagctgtggcagggtgctagcaggtgccaggttgctggcctttgtgcaggcattcatagcaatgatcatggcagtatgactcaggggattgggggatccccactagcaactgtgcatgcatttgcactgacggtggtgttagcatgggggtggggcactggtgggtgcaggactgtatgaaccttttgtgtgcattcatactggtggcagtgtctgtacatggctaggggtgggtttgtgtgttttgtgcctagttttgcactggcagctccattgcaggggcagggtgctggcaggggtggggttggcgagcttagtgcctgccaatgctctgatgtcagtggctgtgtggtaggagtaggggtgatggaggacactcacgctgccagcagtggcaaggcagggtgcacacacacacatgtgttggcaaattttattattaaaagctttaatttcctaccactattctttgccataaagtcaccayaattttttttctggttttatgacatttcaatctaccccactttccttgttgaactcaagacagtgataaaagggcttccttccttttagaaggggagcttatttcctttttgaggtctgagctaaaacttgatctgtccaactgaacacaaatatgaatggcataacactgccttaaggatattttaagcttcctttcttcccaaacttaagagctttgcagtataaacacatagtgatataaaayaagtaatgttaagctaaagtcaaatttgcatgaagttggaaaaattccayattctacgtagagttataacaatttttaattgagtgccaccaatctcaggctttaatataatcattttaaaaaagtaaattttggccgggcacattggctgctgcctgtaattgcagcattttgggaggattgcttgaaccgaggagtttgggaccagcctgggctacatagcaagatcctatctctacaaaaatatataaaaaattagccaaacgtggtgttgtgcacctatagtcccagctactggggaggctgaggcagtacaatcacttgagcccagaaattcgaggctgcagtgagctatgattgcaccactgcatttcagcctgggcaacagagcaagaccctgtctcaaaaaaaaattacatttatttaaggtgtacaacataacgttatgggacacatatagataataaaatgactactatagtgatggaaagtaacatggccatcatctcacctacttactcatttgtgtatgtgtggcaagaacagctaaaatgcactcatttgacaaaaatctaaaatatagtaccattttattaactacagtcttcatgttgtgtgttagatagctagccttgttcatcctgatattatactttgtaaaatattcctaagggtattagacttaatttttaatacatatggttaagaaaaaaataaaatcaattatagttcttctacaattctaattgtccttgtcctacattattttgagtttcaacaatgtcgagagactctgttatcctatgtattgtctaactgcaccaagaatatgttactggaaaagaacttggaagcacaggaatttaaagccatatagctgggaatctgggacaggagggatgtagagaaaaggaagacatggaaataataccagagagtatctgtcctttatgtacaggcatctcagaaacttttcagtcattaagtctctcgtggttttataattaccgttattcaactaaatgtgggccatctactcaagtccccagtggaccattcagaaaatggaacttttgttsttgcccttttgtagctacctggtggcccttcaccctgctttaaaatgtaaagtattttctgaagtgttatctggtaccatttaatgcttccagtagaaatataccaatgtacttataagagtttaacactgcaatgaaaactccaagaattaaatattcttttaggaagttcaattagtatgaacttttttttacatacagagctttttaaaagtcatatatgacaaaataaacttattatatcttacaaattatagctctatatttaaattgagaatcacctctagtctgaaatgtaaataaaatagttgtcacatatatatgcagaaaatttggagctactgatatttaattgatttaggcaacagttaagtggaatatcaaataaaaaagatgtgagtgaaaggaactttgttaacttctgctataattaaagttctgaagggagacattggcctactaatttcaccaaataactaatggcacatagagagactaagccattagaatgaatggacgcagttctcaagtggataagaccaagcaatagtgtccttatgacactatttttatgacctttttgtctcacttatgaccattttgtctcacttatgaccattttgtctcactctctccatgttccagtgaaaggcagttttgccttatccttccctgtggagtcagacgttgcccccattgcacgaatgttcatctttgccattttaccagatggagaagttgttggagactctgaaaaatttgarattgaaaactgtctagccaacaargtgagcgatttaacataaaattaaaagaacacaaataaatgatactgtaggtgccatctattttaccccagagaaaactaagtccagaaaagtaaaatgagttgcccaacagttcccaacaagtttatggcagacccaaatttctagggatctagtacagcactttttcaattacacaaagctgctaccaaataaaatacaatcagttttgtgttcatgatgctcttctctgctgattcagttgtgtgagtatgtaaaatgctaagactcaaaagttcccaaaacctgaagaataagtgtaaacacctagaattaccttatcatgtgtcagagataaagatggccatctaaaaatctaacaaggtatctatccttattctgcctcagttatctccttaggacaagactaagctaccgagaagctatattttgttaagattccccacttatgtaatagtcatgtttaaaagagtgagtaaattaatgtgtcgccaaagcattagataatttggatcctgtctaaatagaatcacttttgatcactggagtaggtaagcttgttataaaattaatacttgcaaacataagggaagtcatgtaccttttaacagatctaactatttatgtctctagagttgttgggatctgtgaaagtggtaataartgatttacaaattattttctatttttaaagtgaaggaaagttgtaaaaataggtttctgactgacattaccaacatagtcatatgaactgaatataagggtggcttaggaaatgcaggtgactgcaagatcacagaagtagggaaaacactggttgaygtttccttcatttcccacaggtggatttgagcttcagcccagcacaaagtcccccagcctcacatgcccacctgcaagtagcagctgctccgcagtccctctgtgcccttcgtgctgtggaccaaagtgtgctgctcatgaagcctgaggctgagctctctgtgtcctcagtgagtttccagtggccttggggaccaggaagggccattccagaggctcagatcaagaagcctctattagccctttgtcagatgagtaggttgcgaaaattttctcccattttgtaggttgcctgttcactctgwtggtagtttcttttgctgtgcagaagytctttagtttaattagatcccatttgtcaattttgtcttttgttgccattgcttttggtgttttggacatgaagtccttacccatgcctatgtcctgaatggtgatgcctaggttttcttctagggtttttatggttttaggtctaacatttaagtctttaatccatcttgaattgatttttgtataatgtgtaaggaagggatccagtttcagctttctacatatggctagccagttttcccagcaccatttattaaatagggaatcctttccccattgcttgtttttctcaggtttgtcgaagatcagatagttgtagatatgcagagttatttctgagggctctgttctgttccattgatctatatctctgttttggtaccagtaccatgctcttttggttactgtagccttrtagtatagtttgaagtcaggtagtgtgatgcctccagctttgttcttttggcttaggattgccttggcgatgcggrctcttttttggttccatatgaactttaaagtagttttttccaattctgtgaagaaagtcattggtagcttgatggggatggcattgaatctgtaaattaccttgcgcaccagcatggcacatgtatacatatgtaactaacctgcacaatgtgcacatgtaccctaaaacttaaagtataataaaataaataaataaataaataagcctctattgagagtaaaatataacagtaaaaatacgtaccacttgccgagtacttgatagtttctcaagctgtctcatataggttttctcacttaatctgcccaacattccrgagaataatagtcccattttaagattagaaaagtggattcagaatagttgagagatttgttcaagataagtggcacaagctgagatgtgattttgaaattctgaatctgcctgcaactttgattccttctatgacacagcttctatttctgtaaagaatcaaatcttaacctcagttattaatgtcttacagtgatcttaatgaaagctatattttgttaagattccccacctacgtgatagtcatgtttaaaagagtgagtaaattaatgtgttgccaaagtattagtttggatcctgtctaaatagaatcacttttggtcactggagtaggtaagcttgctacaaaattaatacctgcaaacataagggaagtcatgtatcttttaacagatcgaactatttatgtctgtagagttgttgggatctgtgaaagtggtaataagtgatttacaaattattttctacttttaaaaaatgacctactacacctttgttagcaatgttgattcacagactaaaattttaattatctgcttttgactatagttatattaattcatgggggtgacacttggcatgtcgtgatgatttatttattttattattattatttcaagcttactacatgctggatctattgtaaaagctggggaaacagaaggaaacatatcacagtccttgtccttagagagaggcaataaaaaaggatataggtggatcagcaaaataaaaggtgaacattggttaataattgccatttggagaaaatgatatctaatatggggtttttgaagaataattatcagaaggaagggaaaagttcagaaactacttgtctaacctatttaaaactagattactcgtgtttggaactttttaacataatgcaagaaaaaataatgttatgatttgatctttgataaaaagttatgagaaattttatagctttaactccctcatgaatcaccatttaaaagggtcaatcaacttatctgtttgggaggtattattacctttcaatgttggttggtaaattcgtaatatgaaattttcttttgtttattctagtttctacttcatgtctattaaaattttaaactgtgagataactatatctgagacccctgtcctatttttaattatcaaaattaacattcttcaggttggagcatatccactagtgccccctgatctgyaggggtgtgtcccaagaccttcagtgggtgtctgaaactgtggatagcactgaacccaatgaccatcagctggaacacatttctgttcctgtcttccacccacaaatttaatgccttttccatcttaacaaagcacttatcgcgtgctgtagccataatttttgtagtttgagatgtgacagcaaaacaagcatgattttctttttccttcttcaccatttgatagatagaagattcgttcttaccgtagatcttggcaacctcagcatacattattttttctttccttatcaagtggggaactttcaccttttcacctaaaggaagcactttacggcttctcyttcacctcccaattgccagcatcaatactctggtgcattggggccatgatgaagtaaaataagggtgacttgaacacaagcactgagatactgtgacaatcttgtaactgaggattctgggtgactaaggggcagggagtggctacagtgtggatccaccagaaaaacagaggattcatatcccgagcaagatgaagcaggaaagtgtgagatttcatcatgctgctcaaaatggcagcaatttaaaacgtatgaattgtttatttctgaatttgccatttaatatgtttggatcacagttgaccacagataatggaaatcttggaaaccaaaaccgcagattgggggattgctataatcaaaatttttcttgatcttgatttgtattttattaacaggtcaaaatatctcctcatagcgtaataattattaggcaagagacaatgactatatttctgtattttagttagaagaaacaacaagaagttaacccaaaacaagaaaactttctctctgagtgctttctttggtaatatgcctgatatttttacactctctgtttatggaagtctagtctaagctattaatttcagcatgtagtacaggaatttagtctacctttcaacagtttatgtctgtcttattccgtttagtcacataaatttaacagtcacttcagtaaggtttggtaaactttgagtgttgtggaagtgagaagaaactatgaacataactgaagatttcagatgataaagttatagaaacgtttaagcgtggtcgctttgaataataatagaaatcattagttcacccaatataaataatacatgttcatttatgtacctatttaattctactcaaaaacaaaggtaaataaagaagtagaaagggtgtttgcgttacctatctactgctgyataacaattttcttcaaaacctagtggcttaaaacaataaacatttattatcacatgcaatttctgtgagtcaggaattcagagcagcttagctaggtgggtctagcttgtgacctgccctggttgcgattaacatggcggccaaagctgcagccacctgacagcttgacagaggttggaagatctgcttccaagacargtttcttgagagctattggcaggaggcctcagttcctcaccacacagaggtcctagggctgctggtgtcccacaatgtgacaactgattttctccagagcatgtgatccaagagagctaatgcgttccaagagtgctaaacttgcaatatcttttatgacctaggcctgaaagacatgtcccctcatttccacaatatcccattggctacagaggtcaaccctattcattgtgcgacgaacaatgttcgggcatgaataccaggaggcagagattattgtgggcaattctggaagctgtctccacagcctgacctctgatccccagcaattcatgagctctcacatgtaaaatatactcgatcctctctctgagattctcattgtaaaataggaacagctsaaaggctaaatatcatttaaatcaggtccaagtacagataatgcctctcaggtgtgattcctcaggtacaatacctctagatacaaagacattgaactaaagtgtactcaagttatttggccccacacacttaacatgcaatggtggaactggcatagaataatcactattgacactcctgttcaaaaaaggggaaacaagaggcactcaggagttactcgtccataattactctgagatcaagcctggcaaatggaagttctctgattaagactcaatcttacatctgtccagggataaatattcaggcctctggccctgccctgtgggttcttgaatctgttgaatcatccattttccataaaaagtacactgcatagacattggtctatccaatataatggcataagttcatttatgtgcctatgtggttcttttatttttattttgaatatggactgcgttttatttatttatttctttcttcaacttttattttaacttcaggggtacaagtgcagaatgtgaagggttgttacataggtaaacatgtgccatggtgatttgctgcacagatcaacccatcacctaggtattaagcccagcatccattagttattcttcttgatgctctccctccccacaccctaccttctaataggccggagtgagtgttgttcccccatgtattctcatcattcagctcccactcataagtgagaacatgtagtgtttagttttctgttcctgtgttagcttgctgaggataatggctttcagctctatccatgtctctgcaaaggacatgaactcatcctttttatggctgcatagtattccattgtgtatatgtaccacattttctttgtccagtctatcattgatgggcatttagattgattccatgtctttgctatcgtgaatagtgctgcagtgaatatatgcaagcatgtatctttataacagaataatttatattcctatggctatacacccagtaatggaattgctgagtcaaatggtatttttgcctctgggtctttgaggaatcaccacactttcttccacagtggttgaactaatttacactccccacaacagtaaaaaaagcattcctttttctctgyaacctcatcagcatctgttgttttttgactttttaacagcagccattctgactggtgtgagatggtatctcattgtggttttgatttgcatttctctaatgattagtgatgttgagcttttcttcatatgtttgttggctrtatgtatgttttcttttgagaattgtctgttcatgtcctttgcccactttttaatgggtttttatttcttgtaaatttgtttaagttcctcgtagactctggatattaggcctttctcaggtggttagattgggaaaattttctcccattcttaaagttgtctgttcactctaatgatagttccttttgctgtgcagaagttctttaatttaattatatctcatttgccaatttttgcttttgttgcagttgcttttggcattttcatcatgaaatctttgcctgcgcctatctcctgaatggtattgcctagattttcttcaagggtctttatagttttgggtttcacatttaagtatttaattcatcttgagttaatttttgtatatggtgaaaggaaggggtccagtttcaattttctgcataaggctagccagcattcccagcaccatttactaaatagggaggcctttcctccattgcttgttttygtcaagtttgtcaaagatcagatggttgtaggtttgcggttttatctctgagttctctattctgtaccattggtctatgtgtctgttctttatcagtaccatgctgttttggttactgtaaccttgtagtaaagtttgaagtcaggtaacatgatgcctccagctttgttcttcttgcttagaattgtcttggcaattcaggctcttttttggttccatatgaattttaaaatagatktttctaattctgtgaagaatgtcaatggtagtttaatgggaatagcactgaatctataaaatactttgggcagtatggccattgtcattacactgattcttcttatgcgtgaggatggaatgtttctccatttgtttgtgtcctctatgatatccttgagcagtggtttgtagttctccttgaagaggtccttcacttcccttgttagctgtattcctaggtattttattctttctgtagcaattgtgaatgggagttcattcatgatttggatctctgcttgcctgttgttggtgtatagaaatgcctgtgatttttgcacattgattttgtatcctgagattttgctgaagttgcttatcagcttaagaatcttttgractgagataayggggttttctagatataaaatcaaataaagataatttgactttctctcttcctattcgaatacactttatttatttctcttgcctgattgccctggccagaaattccaatactatgttgaatgggagtggtgagagagggcttccctgtcttgtgccagttttcaaggggaatgctcccagctttttcccattcagtatgatattggctgtgtgtttgtcatatatggctcttatgaggtatgttccttcaatacctagtttattgagagtttttaacataaagggatgttgaattttatcaaaggccttttctgcacctattgagataaccatgtggtttttgtctttagttctgtttatgtaatgaatcgcacttattgatttgtgtatgttgagccaagcttgcatcccagggatgaagcctacttggttgtggtggataagctttttgacgtgctgctggatttggtttgcaagtaytttgttgaggatttttgcatcgatgttcatcagggatattcgcctgaagctttctttttttgttgtgactctgccaggttttggtatcaagatgatggtggcctcatagaatgagttagcgaggagtccctccttttcaatttttggaatagttttagtagaaatggtaccagctcttctttgtacctatggtagaattcagctgtgcatccatctggtcctgggctttttttggttggtagattatttattactgcctcaatttcagaactcgttattggtctattcaaatattcagtttcttcctggttcagtcttgggagggtgtatgtgtccagtagtttatccatttcttctagattttctagcttatatagacagaggtgtttatagtatttgcggatggttgtttgcgtttctgtgaggtcagtggtgatattcccctatcatttctgattgtgtctacttgattcttttctttttttcttctttattagtctagctagcagtctatctattttattaactttttttcaaaaaaaccagctcctggattcattgtttttttaagagggtttttcatgtctctatctccttcagctcagctttgatctttgctatttcttgtcttctgctagctttggggtttgtatgctcttggttctacagtccttttagttgagatgttaggttgttgatttgatatctttctagcttttagatgcaggcacttagtgctataaatttcccacttaacactgttttagctgcatcccagagattgcagtacattgtctctttgttctcattagtttcaaataacttcttgatttctgccttaatttcattgtttacccaagagtcattcaggagcagtttattcaatttccatatagttgtgtggttttgagtgaatttcttaatcttgagttctaagttgattgcactgtcgtctgaaagactgttatgatttcagttcttgtgcatttgctgaggagtgttttacttccaattatgtgtccaattttagagtaaatgccatgtggcaatgagaagaatgtatattctgttgaattttggtggagagttctgtagatatcaatcaggtccacttgatccagagttgagttcaggtcctaaatatctttgttaattttctgtcttaatcatctgtctaatattgtcagtggtgtgttaaagtctctcgctattattgtgtgggagtctaagtctctttgtaggtatataagaacttgctttatgaatctgggtgcttctgtattggatgcatatatatttaggatagttagctcttctggttgaattgaatcctttactattatatactacccttctttgtttgtttgatctttgttggtttaaagtctgttttgtcagaaactaggattgcttttttctgttttccatttgcttggtaaattttcctccatccctttattttgagcctgtgtctgtccttgcgtgtgagatgagtctcttgaagatagcatactgatgatgggtcttggctctttattcagcttgccattctgtgtcttttaactagagcatttagcccatttacatttaaggttagtatttttatgggtgaattagatcctgtcatcatgatgcttttttgcagacttgtttatgtgattgcttcatagtgttctggcctgtgtacttcagtgtgtttttgtagtggctggtaatggtctttcttttccaaacgtagtgctttcttcaggagctcttgcaaggcaggccttgtgttgataaatttcctaaccattcacttgtttgaaaagaatcttatttctcctttgcttttgaagcttagtttggccaggtataaaattctgggttggaaattattttcttttagaatgttgaatattggcccccaatttcttctggcttccatggttttggcagagaggtccactgttagtatgatatgtttccttttgtaggtgacttggcctttctctctaggtgyccttaacatggtttctttcattttggcattggagaatctgatgattttgtgtctttgggttgatgttcttgtggagtatcttactggccttctctgcatttcctgaatttgaatgttggcctgtcttgctaggttggggaagttctcctggatgatatcctgaagtatgttttccaacttggttccattctccctgtctctttcaaggatcccaatcagtcataggtttggtctttttacataatcccatatttctcagaggttttgttcatttcttttcattctttcttctctattctagtctgcctgtcttatttcagatagataatcttcaggctctgagattctttcctcctcttggtctatcctgctactgatacttgtgattgcattgtgaagttcttgagatgcggttttcagctccatcaggtcagttatgttcctctctaaactggctattctggctaccagctcctgtattgttttatcatgattctcagcttcttttcattgggttacagctcagcaaagtttattgttatccactttctgaagtctacttctgtcaattcttagcctcagcccggttctgtgcccttgctggtgaggtgtcacagtcatctggaagagaagagacactctggcattttgagttttcgttgtttttgaattaattctttctcatctttgtgarcttatctacctttaatccttgaggctgctgccctttgaattagatttgtgttaggtcttttttgttgatgctgttgttttctgtttgtttgtttgtttttcttttagcagtcaagccactctatcatagggctgctgaggtttgctgggggtccactccagaccccagttgctttggtttctcccrtacgtggaagtatcaccagcaaaggccatgaaacagcaaagatggcagcctgtgccttcctctagaaactccatcctgtgggggtactaacytgttgccagcccacatgcaactgttggaggtggctggagaccctcattgggaggtctcgcccagtcaggaggaatgggatcagggaccttctcaaagaagcagcctggctgctttttggtagagcaggtgggctgcattgggtgggatccttcctcacctggatcacctgtattctccaaagccagcaggttggagtggcagagtcaaccaaactgcagagatggcagacacccctgccccccaggagctcrgtcccagggagagatcaaagctctgtctttagaaccctggctggagtacctgaagcccccacagaaaggtcccactcgatgaggaggaatggatcagggtcccacttaaagaagcagtctgatcacaatctggcaaggcagctgtgctgcatcgtgggggaccgttcctcatccagaccatctgtattccccaagccttcaggctggagtggctgagtcctcagaaccacagagatggcacccacctctccctgcaggaactcaggtccatctcaggtggactccaacccactgccgtcggctggctgagattccaagacagtgagtcttaacctgtgaggtgctgtggaagtggggtccacaggatgatgctctttggctctctgaatttagcccccttcctagggatatatacaaacagatttcctgcctttccagggatcccagggccggattatgtaaaactccagggtttctgtgtgcctgagcwgctgctctgccaagactccacatagctttgtgtatcagacccaagaccctggtggcatgggctcacaagggtatctcctgatccatgggttgcagagatccttgggagaaatgtgatttcccaggcgaggtcgcacaatcactcaccgcttcccttggctgggggtgggggttccttccgttgccctcccccacctccgcccctgctgcttttcattgttctctgtggctcaagttgcttgcctagtcagtctcaatgtgagaacctgggtatttcagttgaaggtgctgcatttaataagctttttcattccactccgtaagtgctgcagaccgcagctgcttctaatgggccatctatacgattttctgtctgagaataagcctgagtagacatagatgtttaacaggtggcaataataatatgtagctaaattcctcagggcattatgtattaattaaacacagatgcaagttacgtcktctttctatatttggtctatttttacctctagactctacaatgaagttttaattaatccttcataayttaagattttgttaatctttggaagcattttcccaagtaggtttcatttctttataacaaaacaacactgttaaatataaggaaaatcttcaactatctctaaggtaccaactacatgaacgtactcaagaaaagattggtgataattattttatttctctcagttcattctatttcaaaagaaaagtaagtaacagttctgcctttgatccccccactgctacaggtatataatctgctaactgtgaaggatctcaccaattttcctgacaatgtggaccagcaggaggaagaacaaggacactgtccccgtcctttcttcattcataatggagccatctatgttcccttatcaagtaatgaagcagatatttatagcttcctcaaggtaaaattctcactacttattaacatgctggcttgtgagtttttgaatgttaataaaactctgtatctattcataatcttagtaattatgtagccttgcctctccatttttcagcagasaaaaatgaagccaataaaaaggttaaagtctcttgtraggatcacacaaaagctcagtatgtgagtcagggctagatctaacctctgcctattcatctggatactttttagttatatttaggtttttttwtttgcaaaccaaaaaataatgaataaagaataaaatcttaataatccataagtttagtaatttcactactctatatttactgtcaagtgtttcgccatagaattaatataaggatactggaattacatagagaagtctctaaggataatatgttttatatattctaatcaagcttacaagtagattgaacaattatttttttccaggggatgggattgaaggtgttcactaactcaaaaatccgaaaaccaaagtcgtgttcagtcatcccttccntgtctgcaggagcagtaggtcaaggrtactatggaggtaaaacagcaatttgcttttaattttatttcatgtccaacaatattactatgcccaaaatgctaaaatgaggtaatgtagccctatttccactttatacacacaaagaaaccaagattcaaattaattgtttcttgctgaggtgacttagctggtgatagctagaactgatcagagatttttttttagatacatccratacttcagggcacaaaatcagataaaatacaagattctgatgtactgtaagagagggaaaatgctgacaatggaaagaaagagtaattctgattatggaaacaggaaagacattcatagggatgctgtattttaaaaaacmtaaagaaggacaaagggcttcactggtgacaagaaacaacgtgaacatcacagaaatatctcataatccatggccaaaaccactattcaaatacagcagcctttttcaacacccttgaacttattaaaacatctgtcccatcaccaggtctacttacacttgaacactacccagccatttgtcatccctctctcatgaatccaactccctttttctccaaaatattcctgacatccatctgctcacaaatatttatatgctcggattggaaatcagatatcctatatgtgaagtgggtgtgtcatatctcctctctaagcctcaaatccttcattaataaattgaaggaatttgactaatggctcttcaagaccttgcaaaacgcccaataagataactaaatataatgcaccaacacaaattaagaactttgattgtttaaatagcattttctatgttccttggcatttaagattaatatccatctttaaatgagctttattattaagaaaatgacaccttttaaagggccatggactgtttaagtataccttcaatgatagcacaaatttcaaacaatttctcaaaaatggtaaatatgattttgtcttgtaactgagatgttatataaataacgagaataaagaataagggaaaggaaaatagccatgagatttacatagaacaaacttcaagtttaaaccattgaggtttggggggaaggaaatgttcttgaatttattaaattcaagatggaaaattgacggcatataataacactcaggaaaaaaagagcttctaaaatgtgtgatgaatacataacagggattgaaattagtagctataaatgaatcaggtatatgaggaaataaaagagctaagaaaactgaaatatcttgtgaaatttcttgataagaacttcaacaacatgaagccatttccatgactacagagaacaatgaaaagcagcaggggtggaggtgggggagggcaacggaaggaacccccacccccagccaagggaagcggtgagtgattgtgcgacctcgcctgggaaatcacatttctcccaaggatctctgcaacccatggatcaggagatacccttgtgagcccatgccaccagggtcttgggtctgatacacaaagctttgatgcagagactatgaaaggacacgtggaaagtcaagttgacagtaagagtaggaaggatatagccatggtccactaaatggagttgaaataacacataatgccatggtttgttaactgcaataactggaggagttggagggcccttgacatatccagtagaaaatggaaaatagttcatttaggtgcatcatccttttagatatttcaatatttaagataagagtgaagacagagaagacaaaacagtgagaaatcagagtcagagatagaaattgttaccacttggaaggacatggggcaaggtgtatgatattcactaaagaaattactactgatgctttcttcagtggagaaaactgttagggtgaaattgctagaaatatatttttccttgtaagtattctttcacaaggtatttctgaaatatcagatgggatacatggagggagatcttaaatcaaattcaattagtaagcatgatttcaggcacaacgtggacaaaattgctttcatgtctagctctccaccctctcacgttggtaaatgatttctttgtctgaaccacacagccattccaaatggaaatatctgtttttgacaactgaattgtttatttcagatgtcaaaaaataagtggaataaaatctaatgctctaatcttatttcccagagaacaacagttttgcaaagttccatacagtratttaaagtaaatttaatttatgtaaaagtaatttaatgtaaatcattaaattctgttcactccactggtaatttcatttttagtatagcaaccactctcaatgtctaaagagcattttacaattcctgctcagtttctctaagaatgaagcaatactgtctcaatttcaaaattggtccttcgccacaaaacccataaaactgtctccaagtgatctcrtttttccagcttccattcacatcaaattatgctatgtctaggatacatagaatttccacctttgacaaagactcctctcttttcagggaatgagggatcacaaagtatttcccaagttctacaacttctacaagacttttaggacagtctgagcaggaaaactgaaaattttgttctctaacgtctcacatgtgcaccatgaaattaatgaatgtttttccctaactagacaattttctcttactttagcaggtctaggagtagtagagagaccatatgttcctcaattaggcacatataatgtgatacccttaaataatgaacaaagttcagggccagtccctgaaacggtgcgaagctattttcctgagacttggatctgggagttggtggcagtgaagtaagtaactttactttcctccatttgctggaggggagggaatgtggttcctccaacattttcawttctaagacaatcttcctgaaaagttctgaataattatcttaacctcttcctctttaggatagacctaagtaaaatgcgcaattgcataggctcattaatacaattgtctcagtgctgagcaattctaaaataattatttctgatactgtcaaatagtagacatgagaactataaatattcagttctatatatactgcttaatgtcgttcagggagccttctgtaaatatcagggctggagcaggcacataaacaaatcaggctacattaatccagtggtctaattgttggtcatgattcttaaaaatgcttatttatgggattatacaatagcaagggaagttaaggactaaaatgaatcgcaattcaaatatttttattcaaagtacagacatgtgggatatgatcatttgttgataagggggagaggtaccattcagtggctttcattttcccaactcagatcccaggacataatctagtgttcacacgaatgcacactcgcatatacccttaagtggattcagttcttgacgttagctttatgcatattaattctcacttgagaaaaggtggcttacattcattatttctgttcttcacttgccctccyccccagctcatcaggtgtggctgaggtaggagtaacagtccctgacaccatcaccgagtggaaggcaggggccttctgcctgtcygaagatgctggacttggtatctcttccactgcctctctccgagccttccagcccttctttgtggagctcacaatgccttactctgtgattcgtggagaggycttcacactcaaggccacggtcctaaactaccttcccaaatgcatccgggtaaggaaaatgagggtgaacaggaaaggtgggtagaacaaaagattcctttgatcagtcagctactgattctgttcctgagactaaggataattcaagggattgtgtgttagcactgtgaataattagtgctatgcaaagcaggacatgatcagaaagataatacaatgatatatgtgctatgggtgcttaaatcacggctctctaagccacaccttgcttttctatttcttagcgcttgcagaattctttgctgcaagttaggttatatgccaggaacattcttgaagctgacacacaactcagctttctcagttccacgagagtcattmtccaacccgtcatcttgaaatctccaaaatatataattttaatttatcttatagcacttatctctttgtaaattatgtaatagtggttgtatatagatcatctttcttgtgacacaatatcctcaagatcgggagcctctcatctaccattcccagtgttttatgtcttgtatggattagacatgtaatatatgttgtaagaaataggagaagaaaggaaggaagaaactatgaaaatctacatagcagcagatagtattccctagggcaatatacaatcactgcttttccctttcctctgccactgccaagcctgcacgtccacaagctaccctaaggcaaatgccaaatcctcctaatacacaaccaatcttgatttgtatcattgccattgccatgcttcttaaagcatggatgaatctatgtgacatacatttttcttmcaaatcccaatttactgcagcatctyacacttggccccaattctatgtgttcrtgtcgttccatattctgatcatttctgtctctgcctcacatggggtgataggtcagtgtgcagctgaaagcctctccagccttcctagcttcccaaaatacaaagggagaagaatcctattgtatctgtggaartgagagacaaaccttgtcttggacagtgactcctaaaactctgggtgagtgacagtacccaaaagggcctatcaatcaacaaggacggtggctgtctgagtacttttttcatcatattctctcttttatttgccatagatataattctataaagttagttttttttcctatttctatccactatgacctcctcccactgttctcacccaagctagtccccagaatcactatcttggacattggctacttagtatacattaaccttgtgggtttctttttttttagccttattttctattctggacaactataagtttaaggtgcagcccttaaaggtgattggactatcaaagtggatactcatgttttcaatattccttgttttagggaatgtgaacttctcagtgagtgcagaggcaatgcagtccttagaactctgtggaaatgaggttgttgaggtccctgagattaaaagaaaagacacagtcatcaaaaccctgttggtggaggtaacatatttttgggagtccctaacamctgtaagaatgcaacaccgggcggtcactcttgagacaacaaagaaccattaatatcatgctcacacaatacatcctgtaagactaatggaatttcctgccctaaaagcattgcagcagacaacattgccagctattgtaaattttttttcacaaattatttgagtgcaatttccttttttttttttgagacggagttttgctctgttgcacaggctgaagtgcagtggtgcgatctcggctcactgaaagctctgcctcccgggttcatgccattctcctgcctcagcctcccgagtagctgggactacaggcgcctggctaatttttttttttttttttgtatttttagtagagacggggtttcaccatgttagccaggatggtctcaatctcctgacctcgtgatcctcccttctcggcctcccaaagtgctgggattacattgagcgcaatttcttgatctccacctctctcctaagattcacatatctctcatacccattagctttgatttactgcccttattatctcttcccattttctctctaccaccctccctggttcttcaatgttttatggatttgtaataattcaataacaagtaggatgttatgttctcacttataagtgggagctgaatgatgcaaacacatagacacatggaggcgagcaacatatatggggcctgtctgagagtgggagtgacagaagggagagcatcaggaakaatagctagtggatgctgggcttaatccctaggtgatgggatgatctgtgcagcaaaccaccatggcacacatttacctatgtaacaaacctgcacctcctgcacatgtccccttgaacttaaaacaaaagttgggaaaaaaagagtaggatggtaaacatcattcgtgtaaaccctacccatcaaagaaaggaatccatgtggttctcttgtcaccaggatgtttctatcttttctccttttctttcctttcatccaaggctgaaggtattgagcaagaaaagactttcagttcyatgacctgtgcctcaggtaagagtccatcttcataatcatagtgagatcaaaaccacaaaggggtataaacctcaagttacaatgcacattcattttatctcccagttttcagagtgttccatgaaagtcagcataatactaaatatttctttatgtatgttttacagatgaagacattgagcccaagagagcaagttaatgtgactcaggtggtacagacaggactaatacctgggctttcttggttcatacgtagcccttttacctggatagcccagtggctgctcactgacaagcccagctgcagaagcttagagtgtcccaggatgaggtagaaagagagcagggttggccgggtgtggtggctcacatttgtaatcccagcattttgggaggctgaggcgggaggatgacttgaggtcaggggtttgagaacagcctggccaacatggtgaaaccctgtctctacgaaaaaaacaaaaattagccaggcctggtggcgggcrcctgtagtcccagctacatggggggctggggcacgagaatcgcttgagccgggcagggggaggttgcagtgagccgaaatcacaccactgcgctccaacctgggcaacagagtgagactcttaaaaaaacaaacaagcaaacaacaacaacaacaaaaactaaagacagcagggtcatgataagtttgaatcccaagagatagtctctaaaacagctgctgacaaaacatatagcatttcctacccatctcactaaaaatgtgtgttttccgtgtagaaaataatttacatttaagttcatcatatcattaagaagtagttgtagcttttatacagaaccgccacattattagttctatgtccacagtgtatacagcactgtatttgtcatttgagaaggactaatttaaggtatattcatgttatctatttataaacatgggaatccattcaaatatagtgtaagggaggcagtaaaataacttgtattatcayggttataagtcttaatattgctacaaaagtggagagcgatagttcccccactaagtcttaggcttcttttagaaagctactgagcacagccatgcaaaaatatagttaaatgagaagaggaaggactctggaagtcacacagtgccaaaagcaattagactatcaaaggtagtctcatcattaagtcaaattcttattccttgcacccagagttccacaaggagatataataatattactgctaactctaataataaaataactgcaataataacaattgctcacattcgttgaaattgaatatgttgcagatactgttctgaatgttttacatgtgttttttcctcaaatcatcacaatttacccaaggtcacaaagcagggccagtaccatatccagggagtgtggctctgaagctctcactacattataatcactaaattatattgtaatcatagatgtcctcctttaacatgggctgtctgtttctaaaggtgctaatgtgtctgagcagttgtccttgaagctcccatcaaatgtggtcaaagaatctgccagagcttctttctcagttctgggtgagtcaccttccatttagtaaacctgggccaaaagagttgccactgtacatcttatctacgtatttgtatttgaattatcaagttcttgatagctgctattcttttttwtttttttgagatggagtctcgctctgtcgcccaggctggagtacagtgacgtgatctcggctcactgcaagctccgcctccygggttcacgccattctcctgcctcagcctcccgagtagctgggactacaggygcccrcyaccacgcccggctaatttttttgtatttttagtagagacggggtttcaccgtgttcaccaggatggtctcgayatcctgacctcatgatccgcccgcctcggcctcccaaagtgctgggattacaggcgatagctgctattcttattaggattctggaagtcacactctgtgtatataacttttctcttacctaaatgatagactctgaatataaaggccatttttgttaataatgttggctatttatgaactgaaattattctgacatctaatctttcacattccccaggtgacatattaggttctgctatgcaaaatatacaaaatctcctccagatgccatatggctgtggagaacagaacatggtcctatttgctcctaacatctatgtcttgaactatctgaatgaaacccagcagctgaygcaggagatcaaggccaaggccgttggctatctcatcactggtaagtgagacagagaaaaatttactttgttactctartgaaacttttcccaattaagcttcagttatatcatcaaatattaacccatgatgataatttttatgaaaacaacaatcttcccacactctaataggatgttgtgtttgatctatccataacattcacaaaactatggcagatcacagaaggtcataaaatgtccatggcgcctggatgcatgagcctaaacatatggatggcctgcctttctttaatgcttcatgaacaatctgaagccttccatttcaggttaccagagacagctgaactacaaacaccaagatggctcctacagcacctttggggaacgatatggcaggaaccagggcaacacttggtaagaaagaaaatctattctgagtttcaactatgagttcagaacgtgcacatagattacctgtcttagtccattttctgttgcttataacagaatacctgaaactaggtaatttataaagaaaagaaatttatttcttatagctatgaaggctgataagtcaaaagtctaggggccgcatctagttgagagtcttcttgctggtgtggactctgaggagtcccacggtgatgcagggcatcatatgactagaggattgaatgggctcacttgggtctctccttctcttcttttcttttctttgttttactttgtagagactgggctagcatctcctcctcttcttatgaagccaccagtccaactgtcatgatagccctttaatctaggaatagattcatccattcatgagagcagaaccctcatgagccaatcacctcttaaaggctccacctctcaatactaccacattggggattaagttttaacatgagttttggtggagaaacmatttctaaaccataatgttaccttatttaattcttatagctaccctgggaagtgagagttattagcttcattttacagaggagaaaacatattcagtgtggataaataaatgtgtcaggagcaaacatctaataagtggcaaaattgagaacacttttaggttgatttttttaatccaatatacccagaccctcttccttctcatgttgctaagggaacattataggtttgtaacttgcccccttaaattgttgctcagccctaagaggtgttagaaaaatgctagaataaaaccacaaccattactggcagagcataccttactaccttctactagatgatatcctttctctctctctctttgtagttttaccacacaggcaaacacaggggaaaaaagtggaagggcaggatgatggagggaaatatttactgaagcagaacattagaagttagctgattagagttaaaactacagaaagtaagctaagaaatctaggaaaggaaataaattcataragcccacagtgtaaaagcaaatgacttagttaaccaaccaaraaaactggaaggaacctgaacctctgaagtggcataraaatgctttaggaagcaaggacaagctggtaatgaattgaacaacatgtggcagcaaaaaaaaaaaaaaaaaraaaagaaaagaaaaaagaaaaagagatgtctaagctaaaaagaaaaagtctccaaactctcagtaacagctrattgactttcttgggkgcacactgtgatgsgggagcctgtgtgtacaaaacagagcagtaaagtgctcaatgaaaagagcctcagcactgcatttttcctccccctaggctcacagcttttgtactgaagactttcgcccaggctcgatcctacatcttcattgatgaagcacacattacccaatctctcacgtggctctcccagatgcagaaggacaatggctgtttcaggagctctgggtcactgctcaacaaygccataaaggtgaactgttccacaaacttctgagcctgacacacatcaacataacatcccccaggrgtgaagggaggaaggaggcacaaggaaattgcaaagatgaagtcctggatgatgtgggatggcatcagggaaagagtattacactttctacagagaaggaagaaattgggccagatgcagtggatcacacgtagaatcacagcactttgggaggccaaggcaggtggatcacttgagcccaggagtataagactagcctgggcaacatagcaagacccagtctctacaaaaaacattttacaaaattagccaggcatggtggcctgtgcctgtagttgcagctacttgacaagctgaggcagcaaaattgcttgagcctaggagcttgaggctgtcatgtgtgatagtgctactgcactccagcctgagctacagagcaagaccctgtcgagaragagagagagaaggaaatggtatactttgaatggaaacagatactgaggagcgtttccatcaaacaacagaagagaatatactaacacttggcactggaattaatcaaatcaatgttgtattcacagggaggtgtagaagatgaagcgaccctctccgcctatgttactattgcccttctggaaattcctctcccagtcactgtaggtaccagctcaatcccattccctaccatgaaaactgtagatttgctgtctggaatgccaccctgctaagggttgagtctcaagtatcttttggttcaatgatgagggatttctcagactgataagctctttggttgatgcattaagagagatttacacttgcccagtaatgcccatagactatgtatcaaaaccaatcctaaaaacasgttctctagtcttattctttaagactgaactataaagggaagagatcgaaatatttttctatttaaatatgatgaatatctagctgtctgcctatctgtctgaaatctattaataacatctgactgtcaatatccagctctcggcttgctctgccytctattcaccctagtttgacacaaccacattttgcctttacagaaccctattgttcgcaatgccctgttctgcctggagtcagcctggaatgtagcaaaggaggggacycatgggagccatgtctacaccaaggcattgctggcctatgctttttccctactgggaaagcaaaatcagaatagagaaatactgaactcacttgataaggaagctgtgaaagaaggtgagagcacttataagtgggagctgaacaatgagaacacatagacacagggaggggaacagcacacattggggcctgtctgggaggtgcggagagggagagcatcaggatagatagctaatgcatgggggacctaataaccaggtgatgggctgatacatgcagcaaaccaccatggcacacctatgtaacaaacctgcacatyctgcacatgtaccccagaacttaaaataaaataamatttaaaaaataaataaataaatagataaataataaaagtttttttaaaaactgtgcaaaaaaaggtgagagcaaacagcaaatggtaccaaatttccatttccatttacactgattctacaaaaagaagaaatatattccttctgaaatccacaagcttcatctgtaattccttagccaagtcatacattgtgagatcagagcacctcttataaaactgtcttctctgggattgcatatgttacacagagcagaacataatagacataatgctgcagataaataatgcagttttatttctacttgctaaaaccaatataatagacaaatagattcattttctcatgatttctctctacttacttgaatgaaaagaggtacaacagctcttccataccccctaaattcccacccaatgccgtcctggctgcaccatgctcacttcatgctctgggcttctcctaagctagtgctgctatagtctcctttcagctaccatcataattatctaccaggatctcatcagccacgctgagatgttctctgacatttacaagatccagagatggaggaaggactgtgcctggaggtggaggggaagatggtcagtaggacaaagggtgacattgatgactcgcttattggtggagatgccttcactgaagtttcccaaagcgaaggtactggaagcagagtaatcattggtgttgatattgtcatgaacaatcacttgcaggaactgacttcacaaaagaagcctacaagaagtacatcaaagctgacataaaatcaaagacaaacttaaagaacagagaccagaaacagtaaaaccttttataacaggagctgcagaacaaatcaagcacactctttctaatctcagaaactaccagttcttcatttgatcttagccaaaaggtcaagaagcaataaaaactaccagttctttattggtgaaaacatgaacccatatggcatggtgcctctgctggactaccatgaggatggtgtgactccatagatgattttccatggtttagaaatggaaaaatgttaacaaatttggcagttactttggatgtatcacctgtcataactggcttctgcttgtcatccatacaacaccaggacttagacaagtagaactgatgtcatcttgagatcttcatttattttgaccatgatttatttggagcagaggcattgtttttaaggaaaaaatgtcatagaggttgtctaaaaacaaaatgcattcaaactcatttgaaagagtgtcatttagtttagtacatatttaaactcaatctatcttgtagtgttcttggagaaactagagtctggttgtagaccactactagaaagaacacaactgccatgagataacttctacagtggaaactatttctgagtatggagtacaaaaacaacaacaacaacaacaataacaacaacaaaaaacaaaacaagaatcaaaagttttaattctgagttgaattagcaggaaagaacatgcttatagcagtgccaacatttgaagtggtgccttatacatttcatcacctacaatggaagtagttaactctggaagaggttacaaaacaacaaaaasggactgattcagttggagagaaaaaaaaagaaagaaaagaggtacaacaaacagaaaatgcaataacattttcaaactatttttatctctatttgccagagagagcatcacaaaagtcacatgaggtcaatagttaagttttatattctagtctatactgcaattctcagaaaatatcacgaacaataaaagaactctctctaccacttttctctttcatcagtccaactaaaataacattggagagattggtgagtatgctctatgcttcttcctccatcaacctaccctaccttcgtaccacaggactaaatcaagttcagcatagaagtgtgagttagtgagttttaggagtttatgacatagaagaccttgcttctcctgtattattttcagctccatgtattatgaatgtgcattctcttatctaccagttataattacttattgatgagttacaattatctcctttttctcacccttaagacaacctcgtccattgggagcgccctcagagacccaaggcaccagtggggcatctttaccaamcccaggctccctctgctgaggtggagatgacatcctatgtgctcctcgcttatctcacggcccagccagcccccacctcaggggacctgacctctgcaactaacattgtgaagtggatcatgaagcagcagaacgcccaaggtggtttctcctccacccaggtcagtggttcccaaagagtcttctgctccaggttcacttggcaattgggaggcttaaaagtagaacagttaatggaaaagagaaggcaattattaaatcattgaagaagtatttaggaatatttgaggaccatgagaatttaaaggaaagacttaagacatcccccataacacttttcactaagccctatgttaatatattagcaacatggagacktacaacgagcatctttaccctctaaagccacgctatggtcattggacacattctagaccagagtttttcagcatcaacactattgacatttcgagccacatcatcgttgtaaaaggaactatcctcagccttataaaatattcaatagtatccctggcctctccccattagatgccagtagcacgtcacttccagttgaaacaagaaaaaatttcctccagttgggaaccaatgttccagacatcttcagaatctaacaagaaatcctctaagatgtattccccaaaaaatgtgtgattaaaagtacagtgactaagtagaatccactttgatctttttggaatgagaagttccatttcaactactccaaggaactcagcttcttcattcctttctactttccctgagagtgctcttcttactttctctttaagttgatcttttttaagctgaagctcttgaaaatgtatttttctagcataattctaaaagtattttatcgagagtataaatgattgtattaaacacccagagtgtctggcttttccctcctacatgtcttctttcaacagttaggatctccatagtgaaacttttgtttttcagagagattaggtggggtaaataaaaacaagctagatgaaggtaaaaagaaactcaagaaagtgcaacttgtctcataccattttcatgtacagtaaatttttatcactcttccatctaactggtcaatcatctacttaaaaatggtcactatttttgtcttaacttcttagttttagacctattctttgaaggacatatccaaaaggactgtcaatgaaaataaacagtgacattaataaacattattagccttttatttcatttggagaaactgcagcatgattttgataatgtctgaaaggcagagaaaaaggaaaggtaattagtgaagatctaccttaggggtaaaaagccagcttccctcatggtaggctaacacagactttgggggaaaatcccagaygccaaaaatttactctttggggcggttgtccactcgtctcttccaggacacagtggtggctctccatgccctgtccaggtatggagcagccactttcaccagaactgagaaaactgcacaggtcaccgttcaggattcacagaccttttctacaaatttccaagtagacaacaacaacctcctattactgcagcagatctcattgccagagctccctggagaatatgtcataacagtaactggggaaagatgtgtgtatcttcaggtagggctccaagcttatatgggtgagartcaactttaaacttgccaattgaaatggaaactctgttccttccttcctgggaaagtaaaaggcacctctggagacgttaagtaatgaggaagtgaggggtccagaaaaagagagaaactgatagtgtctttgctgtttcacagacatccatgaaatacaatattcttccagagaaagaggactccccatttgctttaaaagtgcagactgtgccccaracttgcgatggacacaaagcccacaccagctttcagatctcactgaccatcaggtaagacgttctaacctaatcacctatctttggcccaaaagcaacttggaattaacagaaattaatagtccatttggaagctatgttattagattaatataatttagaattgatatatctataaatgaatttaggcttttatcattatgacgtgatcctttctctactaaaaatataaaagtaatatatactaaataacaaatgaactgtatagtgaggtgtgcaaaaaccatagatatgttaaaaatgccaattagcaagattcactaccaaagattttgatttgatagttttggggtgatgcttaaacatctgtaattttagcaagtggtagatctgatgtatatgcatgtgtccaatgtcagtgttgcacaagtccagggaacacagacctttgtagaatattagggacaacttcttgaagacagacaggcttaaagtgatgcttgaaagcagaaatttggctttctttcacgtataaaaccctaaattctttttcctttgacactacagttacacaggaaaccgtcctgcttccaatatggtgattgttgatgtaaagatggtatctggttttattcccctgaaaccaacagtaaaaatggtaggtgtattttaatcctaatagacttcatacaaaagtatgttctgtatccccaaactaagaccataccaatatcaaaaccatgtcaacatcatcctgcctcaaaaaaatatttttcccaaacccaggaagtaaatgaactatttagttggccgtaagctaagggacatatgtgataccagagaaatgcacaaggagtacctatccttaggccactcatagtttagtcaggaatttaaagcacatgggcacaaaacaataaaaccacccaagaaagataggatatggtttaaatcccaaactgactgatatgcactaaaaatttgggaaggaaaaaaaatcaacgtgaactaaaattatcaaagatgccagaggctctaatgtgttacttggatattgaagaattgtggaactcctgacctgaaaacaattagctttcttctcttcagagaatgaccatttgtcccttattacaatctgctctagatctcacaccattctcacatctgttctctaactttaactgaagttttctaattctctccagcttgaaagatctagctctgtgagccggacagaagtgagcaacaaccatgtcctcatytatgtggaacaggtgagggctctgacatcctggctgagactacatatgggtcgtctttctaagtgagtctctttactagaatagtcggtaacatgaggaaaacaatcattagtaatgcccttccagaaaggtttatctattccaagaagaataagaggggaaacctttgaactccatgtagtgttctgttctatttttaattgtgttaaaattggaatatgaatatttctatgaaatttaaagtacaaaatcaatagaaaaaaggtgtaccatgtattcctgttgttttaaaggccccactccctgacgatatgaataaatattaaacttgaagtgataaatcaataggactaaaggttatcatgcattcctgttattttaaagaccacctccacaaaatgaataaatatgaccccagtggttgcctaatgataatgttaacattctaaaatgtcaccataaaataaaatgaggattttatgaatattatcaaatatgaccataaaacaaagaaaatgttttatgtatccaaacagaaagaatacttcgttgttttaattacagattgtatgaaaccatgtttctccagcttagaacacattcacatgggcccagagagttaatctcataacaagggactacaaaagaatagggttggctcagttgtttagaagaaaatctgtgaaaatttgttgactktaaatagagttcccaaggatgcattctaaaacccatcttgacatccacaaatgtctggtcacctaaagacacyggtgaaaaagagtcaaagaacaataagaatatgttttgctcatgggagaaagaaggaggttttctaggttcttgattactcccacttttcstttcaggtgacaaatcagacgctaagtttttccttcatggttctgcaagacawcccagtaggagacttgaagccagcaattgttaaagtctatgattactatgagacaggtgagtgaaagaaaaatgaaacaatcttaaccagagccaagaaatggatcctgttgtgacagttgatcctcttcttagcccacttagtcaacattaatcttttgtttctttcctccaagatgtacactataaaaacgacttactacagtctggccaacatagcaaaaccccatctctactaaaaatacaaaaaattagctgggtgtggtggtgtgtgcctgtaatcccagctactatggaggctgaggcaggagaatcgtgtaagcctgggaggcagaggttgcagtgagctgagatcaygccattgcactccagcccaggtgacggtgcgagactccgtctcaaaaaaaagaaaaaacaacacaaaacaaaacaaaaacttactgaacaaatttatcaattagtgtttcttgagtcagaaacttaagaattaaaaagaatgataatatatagtcactgctttcaagtagtttagagacatagataacataatacagataaaaatattacataacaggaaagactattagtgacaaatgagtgttagtgagctaagcaataagtttgagaggcaaaaacagcacagaaggctggtgctcaggaagaacaaacaggaagaaagatctgatttggatcctagaggatgagtggagttttgggggtctatagaagtaggaggagtgtttcaagctggaacaataatctttgaaaagtaattaagggagcaagctgaacaaagtgaatagaagcagagaggtcatggaagagagaactacaggttagtgcaattatgatcatcttcccaagaatttaaaatttgaacagctgccatctgaacaggcttcagtccccatctccagtctcagggaaagagaatataaatatgttaatgatcctgtttaattcttgtctatttacatgaagttytgacaattctgatagggcgtgcttttctccagtagtaaagtgactagacagatttagcatggtccctagttcatagatctttcgtttcttccttcacccaacgttatctttcagatgagtctgtggttgctgagtatatcgccccctgcagcacaggtaagagttcaccacttatgaccagtrctagatggcattaacccactctccaagggcccctgcaatttaaattctctacaaggcttttcctacatctgagacaatccacatggcatgtcctcacaccaagacaaaactgtggcgtagcatgcctattctgtagcggactctccaatttcagatattcactcccagaaaagtcaataagctttgtttatttgtaggacagctatctctaaaagcgacatttcacttcacagctaattgggcttccttcaacacaatggtcaactaatcacacacctaaaaccaaatctagccttacacttaattttgtaaatgaagctttattggcacatggccacacttattattaacattggctatggctgcctttgtgtgctgattagtcatgacagaccacatggcatataaacctaaaataattaccatctggcctttcacaaagtttcctgaccctgcataagctcactctgctgcccacactcaactgaatgctcctcaggaaatgatacaacctccttacgtttttcttttctccatagatacagagcatggaaatgtttgaggaccatacaggctgtatattttggtggattctctgtcctatacatttacttagaaggaatggagttatttgtctctataaaatagacactaaaaatatttgctgaataaatatgtacttctggtcaaactatcacttgttgcatcattcattcatcagacattaataacatgttcacatgatgagttatattctttctgtttaattttggtgcaaaggttggattctaataggttagcattctagtaggaaagcagagtggaggttgcaggtaaagaaattgaatgaaaattcagttgagaaaggtggaaggtgagaacataaggggatgatagataatataaacgtggtaatataactggactggaagggtcagaagattagaagaagagacatcagaagagatgtttgagatgaggagaagtgctgttataggaaaaactaatatctagagaattgataattaaagtgcattttaggataagattattatatggattaaaaaaataaagagatgagagtgaaggatttagataaaccatctacaaacatggataataaaattaataagtttaaagataaaagtaacagtggtgaggatgcagtgactcaagggttaaaatcttcaaagaataaaaggggagtaacctgcatcctatagattattttaatagaaagagacatggtggctacagttaaccatattgtattcttgaaaaatgctaaggagtagagtttaaccatatgacaactatatgaagtaatgtacatgttaattagcttgacttaaccattctacaatgaatatatatttcaaaacgttgtacatggtaaatatacacaattttttctgcttaaaataatttctaaagtaatttttaaacatcatttaaaaataaacaaaggtatagcagatggtaaaatcaaatggcatgagagtagttaatgccttttatggagagaaaaaaaatcaagtatttgagaagaggcaagaatgacattatcctatctacagaaacagggataaatgtagtgtgggagaaaaaaaaaactggtcacctcttaatggagacataaaacaagtcaaggtctcaataggaagacatgcttcaaattcatacataaaggcaacatttggagaaggctataagatattttgctaataataggttctgagttccagaagacttagcttgaagggttcaaggagtcatagaagaatggtgggtggatataccagagtggagccataacacagtaagaaactggctgatgaaagatacatgagtggagaagtgaagtcagcaagatgacagagtaggaaaccctggtcttcccccaggcttcccccctgtcccacacatgaacaccagtttagtaacaatcatggacaaattccctttgtgagaaattcaaaggctaattgaaagactcctgtatcctaaacaaatgcaaaagcagactcaccgaagccagtaagattcaggacatgctacggcttatgagaggctaaaaaacagaaaaaagaagattcagaacactcccagcatagcataatacaattagaaagaggccccctagctcccagcttctcttaggggagagaaggggttacttcacacatcttaacttttctgagggttctccccagagaactggtttctatcttgccagtgatagagttctgacaggacaagcacagtctagctgcttgaaggagaatgaagatggcaagttggactggtaggcactatagatccttctccctggtcagcagagtgtgtggacaaaaaatttcctgctctcagctttcccttagggagagaaagagttgatccatgtgtctaatgccctaacttttctgtagatacccaaacaactgacatctgccttgccagtcggggagctcagatgagtctgcacagtctagccccaccttggaagaaaggaggtggcagcttggaattctagatgccattaatccttccccttgctagcagacagtaaatggatttttttaaatcccagctctcaacttccgcctgggaaaagaaagagttgatctttgcatccaatactccaacttctctgtggctgaccaaagaattggcacctatcttgccagtcaggtagttctgatgggtccagcacagactggctgcctgggggagaaagacagcattgatttgaagtggtgaacactataactcccctagctcatcacaaaacaagcagacaagaaccacagcttcctgcttctccctgagaagagaaaggattgttagaatctcccacaacctccaacaaggctgattgataggaaccttctcctatacaagactagtctgtgaagaatgggagaggtgccttcctttgtctaatgcagaggcaacaacacagagagtcaaagaaaatgaagaattaggcaaagatattcctttaaagaggaacaaaatacattctagaaattaacactaatgaaatggaattatgtgatttactttatggagaattcaaaataattctcataaagatgctcactgaagtcaaaagaacaatgtatgagcagtgagaatttcaacaaaaccacaaaaagtatcaaaaggtaccaagcagaaatcattgagctgaagaacacagtaacttaaaaattcactataagagttcaatagcaaactagataaagcagaagaaaagatcagttaatttgaacaccagtcattggaagtagttcagtcagaagagaaaaaaagacaaagaaataaaaagtgtagaaaacctaaggaacttatgtagcaccatcaaattgaccattatacaaattatgagagtcagaaaaggagaatagaaagagaaagaaagaaaaaacttattcatagaaataatgactaaaaccttctcaacctgaaaaaggaaatggaatccaggttcaaaaataactaagtaagatgaacccaatgaaatccacataaaaatacataatcattaaattatcaaaagtaaaagagaattttcaaagcaataagagaacagtgacttgtaagatagacaagatgcctgataagatgatcagctggtttttcagcagaaatttgcagtccagaaggcagtgaaattattcacagtggtaaaataatacaaacctgctaaccaagaatactatacctgggaaacctgtccatcaaaaatggaggagtaataaagactttctcagacaaacgaaagctgagggagttcatcacctctagatttgtcttaccagaaatgctaaagagagtttttcaactgaaagaaaaggacactaaacagcaacacaatatcaagagaaggtatgaaactgattggcaaaggcaaatataaagaaaaacacatgatactgtattactgtaatgctagtaagtcacttttacttccagttaaaagttaaaagagaaaagtattaaaaataacaaactaaaatatgttttaaaacataaaatagatatcaattttcacaaaaataaagtgtgtagggacagatgataaagggcaaagtttttgtatgtgattaaactgaagttgttatcagcttaaaacagactgctataactacaagatattttgtgtagactccaaggtaaccccaaaaagtctataaaagttacacaaaagacagagatttaaaaatcaaagtatattggtacacaaaaaaacaataaaacacaaggaagacaggaagagaggaaaagacagacaaaataattacaaggctaacataaaacaactaacatggcaaaaataaatcttcccctatcaacaattactttaaatgcaaattgagtaaacctcccaatgaaaacacatatagtgactgaaaagttaaaaaaacagacccaaatatattctatatacaaggtacttactttagatttaagaacacacataggctgaaagtgaagggatgaaaaagatatcccatgcaaatggtaatcacaagagagtaggtgacagggcaggagtatcatcatcttggacaagcactggcattttaaagttccccttaatcaaaaactgccccaaagggcattggcctaatggctaacgtcagcatgaccataaaccacaaatgacatctctgaccagaaacattccaacacgaaaataaaccctccccgaccagagatatgcctgccccaagataacctcccctccggccagagagatgtcagccccaagataactttccctctgaccagagacattccaaccccacaataaacttctcctccacacagaaacattccaagcctgtgataagctctctcaccctaaaacccttaaatactcttagtctgtaagagagagtggtcctgactaaaattggccagaagcccctctcaggtttattctccaaaataaacctgtctttgactgttgagccactaatcgtgtttctttcctctttctttaactcttacatttggtgccaaaacccaggacgggtgttgtgggtagaggctctcttgcaacccaggaagcagtgggcagcggcagctcatcccactggatcctgagagtctctggccaaccaccccatcttgcctcttacttcacttttcaagtgatttacatgagcaggacaactaacctgaagggaactgtgaggctcaggctggggctactctccagtgggctctcagagtcctgagacctgaccacttctgaccacccacagtgggtattttgctctctaacacttgtcccctcctcctccctcatcctcactttcctttctctctgtctctctctgtctctctctctctctctctcttcctcatgtggctctggttcaagaggccctttgccaattccaactggaacatccaatattggacactaatccagccaactggtaagatctgccttcccctgactttctcatggtacccgggaaagtcaggtatgccatcctgatcctcagaggaccagtgggactaggctagaagaaatcttggggacacccagtttcttctcagcttaattgttctctttagaaagaggattctgggtctctgtcttttgtctggggacacctacaacaaaaacagacaccctaggcttcttcttaccagtccacataggtgctcaacaatccaaaattcctatgtcctctccactgagctgtctccttcacagccttgccaaacttggcttatgggaagcataaagccaaagtgtgtggctttttattgcaacgtggccgggccccagtgcaaattagataatgacagctaatggcccgaaaatggcacctttgatttttcaaattctcagggaccttgacaactttataaccaggaacagcaaatggcaggaggttcttgcctgaatattcaggctttcttctacctaagatcctgaccctccctgtgtcaagcttgcacccctcatgaaatccttcttaataaaaccctccccaggtttctccttcctctgaaattccttccttctaaaccccttcctctgaaaccccttttgaccctacagatgaatgccctctctatcctcatccccctggatccacttcttgcctgtccgaaccctcagccccaaactccactcttcctccttctccacctgttactcattcaaaaactgcttcaaccagtcaaaccacctctgcctttctcctactctgggaagtggctagggtcgaaggtattgcttgtgttcatgtccctttctccatgtctgatttgtcacagattaaacagcaccttggatctttctctgaaaatccctctcattatcacagggaattcctgcacataacccaatcctttaatttaacttggtatattatttatataattctaacctcaaccctcacccctgatgaaaaagagcactcagcttaattaaaatcgatgtccaagctatgagtatattcaaaggcctttatgtttttctcttcataaatcttgttttcctggaaaaggttttttcccagtcaactgaattacttttctccattctttcttgccactcttggtgcaggtattaaagaccctaaaatgacttctggtggcctgggattccttgggaaaacagaaaagttgccacaaatcccatttggggaaaaacctttgttttcgtt

SEQ ID NO: 17961 - DNA, 31119 bp, Homo sapiens
cctggaaaaagcaccatttgattggctaaaaggcattgcgggagttctcacttgggtcttagattctacccagaactggcaggtgagttttcaggcttccggcggtctttgactcgaaggttggttttcaccagggacccgcccgtatctacctaggaatttgtctgcttcccaccactatcagtatctgtccatttatactaagttctaaaataggcaaaattaatctataatttaaaaaaaagaaaaattcaaaagaccaggcttgatggctcatgcctgtaatctcagcacttcgggaggctgaggtggaaagattactcaaacccaggaattcaagaccagctcggggaaaataaggaaacctcatctctacaaaaaataaaaaaaaattatcctagcatggtagcacactcctgtggtcccacctactccacaggctagctgggaggatcatttgagcctgggaggtcgaagctgcagtgagccatgtttgcaccatcgcactccagcctgagtgatagagactctatctcaaaaaaaaaaaaaaaaaaaaaaaaaaaaaaaaaatcagagcaatagttgcctctaggactaggagaagatgactggataggagcatgaggaaattttcttggatgatgaaaatcttctaaattttttgattacagataacagttatgatgcatttgtcaaaataaattgaattgtatccttaagagttgtatatttcggccaggtgcagtggctcacgcctgtaatcccagcactttgggaggccgaggtgggcggcacaaggtcaggagttcgagaccagcctggccaacatggtgaaaccccatctctactaaaaatataaaaattagccagacatgatggcaggcgcctgtagttccagctactcgggaggctgaggcagaagaatagcttgaacccagaaggcagaggttgcagtgagccaagatcgcaccattgcactccagcctgggcaagagatcgagactccgcctcaaaaaaaaaagaaaaaaaagagttgtacatttcatgacttatatattttgccttaacaagagaaaccagaactttaaacaaatatggaactcttactagtaggcttgcttcacacatcgtatggcttatcagttaaaaaatcacttcctgtgttttcttatatgtgaataaatgtatacatacaatgaatataatgggaacttggttcactcttggaaataaacaatttcctagctctgtctgctgacactgaagcagtgacacacaagtagcaacaaacacaactcgtaatcacatcttggtttttcaataccattttccactaaaagaaccaagaccccttggtgaaatgactgattctaggataagggtaagagaaccacaaaactttttaaaaatatacatttgaggcatacaagatattttgattgatacacatatacatagtgaagtgattacttcagtcaagcaaattaacatattcatcatctcatgtagttattttttttttttggtggtaagagtacctaaaatctactctcctggcaaagtaccagtatacaatacaatattaactatagtccttatgttacacactagaacattagaatctaaccgcaacttcgtaccttttgacctacatcttcccatttcccctaccccgcccctggtaaccatcttcctacactgtttctatggtgatttttttcaagactccacatacaaccgatatcatatcatatttttctttctgtgtgtgtcttatttcactcagcatgatgtcctccaggtccattcatgctgaatgctacaagataaaatcggaacatcttatgtgcctgaaagtaaagaattcctcaaaaaatcatatggacatgtcaaaaggataaaggaggcaccactaaaaggctcccactggctgctcaacagaggcccacaccctcccgcaacttctcggcctcatcagtgggtggactgcatgttcctgtggtaggaaacacaccctcccctcagagatctgaatctctaatcttgcaggtggggaagggagcatttcctttaacttaagtaactcctttattaactcttcttcagccctagaagtaacagctccttttcgtagctgcttcttctgtatcatagagtcctcttttagtaactgatcatcttttactagaaaataattctttaaatttttcctgttaaaatcgccaatatgatatctgtttctgaatggaccctgattgatataaaaacgtatcacttcccttgcatttctatccaaaaaaaatgcaaacttaaatataatcatgaggaaatgatagccgcaggaggcagacaaatgcctaggcagatccccagtgaaaccccatctccaagctgaagacagtttaaagcctgaaagccaagctacaagtcaaatccatggaccggattaaaaacctgtcttcccatttggcacatttttctttgattgatccccacctttcacccattttatatacacctaccctttcctaattggttttctacactgtcgtgcccacctttgagtggtgtcttcactttaactgtttttgcatactcacaaaccaatcagcacacacttcccattctgaatccataaatgcccagacctagccacattgggtgagaaaccacctgactgcaggggtgggggaccacctccacctaccgcatcccctctccgctgagagctgttccatcgctcaataaaattcttctccatccttctcatccttcaaattgtcagcatatcctcattcttcttggatgtgggacaagagttcaggaaccaccgaatgcagatacaaactataacacaggcagcaggtcaagtgaggcctgggggttttgcgggggggggtgtcactagctatggacgggtccctggttggcaaagtgaccgagaaaaatcctacatcagatatatcaaacaaaaccaaaatgaaagacattctacaaaacaagtggccagtacctatcaaaatttcaaagtcaagtaagatcaatgacaactaattacaatgtgtgactctggcttggctcctgtgattgttgggaaatcggaagtaactatacatagcatctattgaaacgtgataaaattttgaatacagactatggatttggtaatattgtattaatactgtagttcctgattttgatgagaggatgtccttgtttctaggaaatacacactgatatatttaatggtaatggaagtttactctcaacctgttcaaaataaactaatgtatatggaggggaaaaagatgaatttaggtaaaatgtgtaccagagttctttgtattatccttgcatcttctctataaatgataaatatattaaaattgaaagttaccaaaaactatatttagtccttgaaatatggaaaacatgatcattttgaaaagcatctgagccgggctcagtggctcacacctgtaatcccagcattttgggaggctgaggcaggcagattatttgagtttaggagttcaagacaagcctgggcaaaaatgtgagaccctgtctctacaaaaaatacaaagattagctgggcatggtagcttgcgcctgtggtcccagctacttgggaagctgaggttctaggactgttaattaccttcctctcttatgattatacagaacaggaggcatccttcccatttgatttcagaccaacaatcctagaactgctttctaaacaaggtgaacaatttaccttgtgtgagagaaggcagtgtgggtgtaggtttattgtggggagtgtgcttgttaataatgaggctaagaaaggaggcaggccagaaatgcaaacaaacaaacaaaaaaaaattctgctcatttcaatttttgccccagcaagaaccttgagctcagttctcagaggtgagagttctaacacagaaagcacccagaaagggcactgaggtctgagaagcaaggaagtgacccaggttgtttgcctctggtcggaaagggaaactacccctgcttccactctgacagcagacaagttaatcaacctactcaattgcatttttggcccattccccatttccaacatgaacagttcctcccctccagcccaatgccactctaggcagtcaccaagaggtaagatttctgaaatcaaaacttgaattaaccaacaaaggaacatcaattctagaacggattgtaacagggatttttgtcttttttctctgctgtatccccaagatctatattatatattctgtggttttggcacatagtaattgctcagtaaagctgtgttgagttacttgataaaaagtaagtcagtagaaataacttaaatgctcaacattaatgtcattggttaagtagcaatgcatagaactaaatattatgctattaaaaagtttatttgtaaagtcaaggatatggaaaaatatttgatacatacatatctttttgagataggttctcactctatcaccaaggctggagggtagtggcaagaccatagctcactgcagcctccaactcccaggctcaagcaatcttccagcctcaggctcccaagcagctgggactacaggtgtgcaccaccaagcccagctgattttttttttttgaaagaaggggtctcactatgttgcccaggctagtcttgaattcctgacctcaagtgatcctcctgccccggaatcccaaagtgctgggattacgggcatgagccacagtgtgggactgatacatttttgaaaaaaggaaacaacatatattcatgaaggaaatacacaccctcctggtgagtttatgtatgatttttgttttgttgttttctgtgttatctgatcacaaattactttccttttcaggaagaaaaaaatttaattttttttttattggggcaacatccaacccagatatgattactacctagcctgaactgaatgtattactaataaacaaagaaatgcagaatggcatacagtcggtaaagcgtagtgcttgagagcatggattatggagactatttaaatactggctccataacttaatagcttgggacccacggtgttacttagcttctatctgctttaatttactcatctgtaaacttgggataagatacttcctcataaggttggtgtgaagaccaagtgaattaactatcgtttaaagcacttacaaaagtgccgggcaccaccgagatatgcatccgttagcttttattattattagactcaaaacactgtagtagttctaatgagaggggtaagaatcaaaaatccaggcacctgcatagagccagagaggcacacatagaagcaacgtaagagtggaagcggaatgaaaacatgctaaagccaggtacaagccacaagcgagggtccacaggaagaaattgttaattctgaagagagtgaatgcacgaagttacaggaaaaataacatctgaacagagtttaagaatgagcaggacttcaacaagtggctagtaagacataaggaacctacaaaagatcttagcaaaggcgcaaagattaccatcgtattgctcgtttcttcctactttgcagaagtaacctctggcgaacagaggtggttgcagagcatgcttatcaagcaaaataccacgaagcagtaaggaacgacagagataacagtaacaataataattcaccccaaggtactcaactggaaaaaggaaatacagaggagaggtgtcgttaagaaagccaggacgcacatcacggccccgtcgctgcactactctcgtctaggggtcaacagtggagtcgagactcgaagcttccacgcggcggaacagcgtccctctcaggcggcgaacgggctagggaagcgcccggaggagacctagcgtgagaactacaactcccgcggagcccgagggcgagctgcctgcgtaacttccgcttccgccacctgcccctcgcaccctcttcactcgaaccctacccgggagcggtcaggcgcgtgaccccgcgtgaccggggtgcgcgagccgagaggccctggaagcgggactctgggaccccattgaaagaaaggcaaccagaaaaggcgaaacgacaacctcgatagtgattggagctgayggaacgagggcggagctaaagtcccagaatactggccaatcagagtttaagattatcagggagcccgggaaggggaaaggggcgaaatggttctatggtcacatgccgcggggtctggtgggaggagcggttgcccagcggcctcttggcgcttcctgtttccggttcccagagtggggcacagcgaggcgctagggrgaacgctggcctctgaaactagctctgggaccggggtctgcggccggcccctagctggccccgtctcccatccccagaagggtrttcactggggattctgagctttggctactccagtttcccacgacacgtgagtgtgaggggcgtggaggaggaggcgggctgggttgcgctcacacttaagcgtctgtgacaggagccggaatcgcattctcccttgaccatggttctagcyaaagatctggctgaggagccctaagggtagaatggaggcggaggcatgagagcggagagtcacggagttccgaaaggtgtgagggagaaaggacttccaagaccagagaggggatttacgatatttagaaagcagggaaaggaaaataccccaagtatggagtccgttggaggtgttggtggatttatttgtaggaggaattttggcctgcatcacggtgggaggtcaagtggcatcatttggagagggtatggctacaagcgcttggaaagtcgggacactagacagagcgagaatttctggcaccctgggagagctttgagggggatgcgactgtggtgtggataagaatggctgayggacggattatcttgtgttcctcgttgtggggagcttccgctcttgggacatagccgctacttgtctgaggctccttctctcttgagttctttcagcattaggccttttagccaattgaggctgcttttctaaacatgtaggctgctggagaaaaagggataaggactgctacatcagaaaggagccagcgggaagacagtagaaattccactggtaaatggccatggctgtcttaacagatggggaagtgagtgctacagaggcccagtggtgtaagctgcttcccagttgctggcttagtcattggccaccctaataaaggataatttttagcattgccaaataaaatagatctgtcgttagagaataagaaaactgaaagatttttcaagatcataaaatcctgctccttatttccaaagtatatagacaaactcttgtaccttgagaatctaattgtagcatattaaaagggggctacygggcccttccatttcattctcttcctgattgttgcacccctatgtttataagttttccagcagttatctttatgccacgaatcgtctaaattgccccagtaacttcacacacatttaatatctgtgtaatgtacagcaagtaatttaacaagtaattctgtaaagcatcagttttctcatctgtgaagtatgaaaaattatacctattttctgggttgtgaagatgaatgaacataatctagggaaaacatttagcgcatatgccactgaattaaagagaagcagcttaaatttaaagacaagccttaagcaggaaagaagaatacagtataaatttattatcctaactttttgaataataagcaaatgaaagatagttcaactcagctaatggctgaggtgtttaacctttcatcccttcctaattttgtgagattccttgttctaatttaggaaaagaaatcaactgtcagtttttaattaggtcctgagagactggaaaggaaaatggcaggctaagtcagtctagaagaaggagtctcctatttctttttagtgagtcagctggtcaagttgtgtgttgagcagtgggttaacttagggaaggtgggagttggaggtctgagttctttatttcacctcctattcagtcaactgtgtgaggaatcacttccccttcacttcttagtagaaaaaaaaaaaaacccacagttttggctgtctactctcatctccaaaaaattgttatgcacatagtggaaatatacatgtagttgttcaacacagaccatgagctctggagctagactctctggctcactccactagctgtgtctcagttttcttactggtaaaatagcaacaataattgtatttactcataaggttgtgaggattaattagttaattaatatatgttaagtgctttgaacagcacctggcccaaggcagtagtctgttgtttcctgctgttgtgtggtttcagtgcattaaatgtgttatgagggccttggacctcttggttagctatgattattctatggaaactaccataatattacagtagagaattgatgtttggggtacaggaagtcaggtagacaatttcccgggattttttgctttagtggggtgtgggaagtggaaggtcagatgttaggttgtttaggggaatggggaaagtgcattcacggccaaggttggagcttccattttcccatcttcaaactcattagtacccatgaaaattctgcctgtttcaagttttatattttaaaaatgaggtggagtaagtggacccgcatgaaaaagaactagagaactttaaagaatattcaaaccaaagtccagacttgcagcgttttttgtaagtgagaaaagtttagaagagttaaatcaggaaattgtccgtgatactcttggaataaacaagtagcaatggcctgagggatcattaacagataccagagtaaagtgttttgcaagggtaagtcagtctgtcctgggtatgaagatggataagagaaaagaaaatgttaggttttggtggggtttttttgccaaaaccayaatgacctttgcaccagtctagtaagtttgggaargagagctgtctgtgtgttttcattcctagagcagtacaagcagcaggtgcattgaatttactcaattgtaaagtggcttggtgatccccaatttgttgtcattgatttgtagtgtaaaagacaactgtacttatgggaagtctagaaacccttgagatttgtgacctgtagaggccaaagaggtttcagaagactacatcaagccatcaaacagtaaagaggcaaggatggctccacccaagctgtcatcattcttttttaagttctttcatttccctcttcccaactttgtagtttgttctgaaagactcacctatacattagactacaagttacatataaatgaattttctgctgcagatgctcttgttacagagatattaaaatgtactatgtgttgcatatgccagagaatcttgtactttctggataattaaaataccatcgatttattacacattcatacgctttatctctttcctctctctcctgatcctayctgccctccccaacacacactctctcccaaaggatgttccctttctacagctgctggaggactggactgctactactactcctggctgtggcagtgagagaatcctggcagacagaagaaaaaacttgcgacttggtaggagaaaagggtaaagagtcagagaaagagttggctctagtgaagaggctgaaaccactgtttaataaaaggtaaatgagaagaaccttaaagagcttgagaaaatatttatgttaaagtcttttcttcttactgattttatttcataatgtgctctcttttatgacatagagcaaattctcagcccagtttttagttgctgtgtgcagttttctcatctttcacagaagtgtagctatttccaagactggatccaagagaccagcttgtagaaatttaaggattatttgacacctacatataataggactttagaaatatcarataaacatatttaggccgacacatgtcattataagtgtcaggaaccttcagatatataaatctgaagttggtccctaagaaacgagactatccgatgaacatgggcccttattcattggaacatggttactaacaggcattctaaaaataactagaatattgagctatcaagatagctcaagtgtgttttaataattcatcatcagcaataaggatggtctgtcaaggttatgaatatcttaaaattaaacaaatattcactcagccatgacctcaaataaataaatcgagcatgttgtttgttttgttttaattaaggaaagggatgctgttattcctgaggctgatagctagtaactctcctcttctttcttcccacttctctttacagctttgagagcactgtgggccagggttcagacacatacatctacatcttcagggtgtgccgggaagctggcaaccacacttctggggcaggcctggtgcaaatcaacaaaagtaatgggaaggagacagtggtagggagactcaacgagactcacatcttcaacggaagtaagaaaactccccttcctaccatcgattgactaactgatcccaagtcaatccctctgacaatcctgtatgtcttggccktttctagtgtcttcagcatatcatacgtgtsgttcggcacacctgagactgtaatataccacaggatgcctaattccacagctcctctgtaagccacagctcaggacagttgtgcattaaaatcagtgaaaaacttaygcaaaatgaagactctagccagaattgttttgttttgttttgagacggagtctctctctgtcacccagcctggagtgcagtggcacaatctcggctcactgcaacctcagcctcttgggttcaagcgattctccagcctcagcctcctgagtagctgggactacaggtgtgtgccatcatgcccagctaatttttgtatttttagcagagacagggtttcacaatgttggccatgatggtcttgatctttgacctcgtgatctgcccacctyggcctcccaaggtgctgggattacaggcatgaaccaccgcgcccagccaactctagccagaattctgtagcctagagtccttttattcacccaaatacttttaatgagtttcacactagacttamaaataccaaccaccaccaccacttttcatcaaattaatcaaagtttaccagttaaattttaagagctcaaacttttttttgcaaactactcagtctgcaaaactttacccactgatttttgtgctatggtggtgatatttcttaaaagtcatattgctggagakgaccatgtaagcacctatggtccaattccctcccatacagataaataagttatacaaggtagctatttactcctggtaaataatacaataaaaaagtaacaaaagggtttggggctggggatcatgtgaccaggttctcctcctgtttcctaatcctgtgactgraaagtcgtatcaccttttgacsttgttttctcatatgcaaaactaggagcagaatctttaccttattcacctcacaattactgaatcaaatgatattttgcaaaagaactgaacacagtaaatactaaagaagagatatgcattccaatcttagatatccactctgaatttatctggggctaagttgaaatcttagatgggcttacccctgctgctcagcaattgtatggaacctctttttttgcttttagaaggtattcagaaaatgaatcagtgttaaggtatggatcataattggttttgcattgtcagttgcctacctttaatgttaaaaattaagattattcttaaatgaatatctgattcttgtcttaagggaacacaagtctttgtaagcaaacaagtttagcttggcatttctggtataccaagttcgtactgatgagggttgtttagttataaccaattgcaatgaattacgcaattccactctgccataccacccagatctgcctctgcttttcccccaccccatagctccattttccttgtccctcctcaggtaattggatcatgctgatctataaagggggtgatgaatatgacaaccactgtggcaaggagcagcgtcgtgcagtggtgatgatctcctgcaatcgacacaccctagcggtgaggcaccctgtgttgtataagccgagggaggagactgaaaggactgacctgaggttggggagaatatccagaggggacacratacgttgggatggacattagaaaactaggagctcagtttctctctgtgtcagacacgcatcttccatggaaaataggctgctgaaccaggaaggagcagatgttttttgggttttttattttgttggacaggagtcaaaacacytaaccacctgaatgtgttatgccatctcatcatcaggacaattttaaccctgtgtctgaggagcgtggcaaagtccaagattgtttctacctctttgagatggatagcagcctggcctgttcaccagagatctcccacctcagtgtgggttccatcttacttgtcacgtgagtatgccttcctttatcagaacagaccttccttccttttgtttttaaggtcagtaactatatggtggtacataagcacaaattgtatgtgtacattatgctgtaattgatggggataactttttaaatcctctggctataaaataattctgccaggacacagggctcacgcctgtaatcccagcactttgggaagccaaggcagatggatcacctaaggtcaggagtttgagaccaacctgaccaacrtgatgaaactccgtctctactaaaaatacaaaattagccagcacagtggcacatgcctgtaatcccagctacttgggaggctgaggcagtagaatcacttgaacctgggaggtggaggttgcagtgagctgaggtcgcaccattgcactccagcctgggcaacaagggcaaaactccgtctaaaaaaaaaaaaaaaaattctgactgcaagtttttgaaaaatgagatttaatgtttagttgccggtatagatttgcatttggaggtgcttttttcccctactgcaggactaggcaatttttatattatttcattagattatgagaacttctagagaaatggaakcatatacttaatggtgattattcttggccatagaatcacacgctgtcacattttgtctgggcctttgcttctcttggactgacagcactctaactggttttctaagagttaccagccccctttttcatttagwatcactactcatttttccttttcagggaatgtatcttaggaracagctgacaataaatgcagaggttatcctatctgagtttttactatttcccagttcttaagtatagatgtctttctctctctacaggtttgcatcactggttgctgtttatgttgttggggggttcctataccagcgactggtagtgggagccaaaggaatggagcagtttccccacttagccttctggcaggatcttggcaacctggtagcagtaagtaacagggcagctggttgaatttgtagcctgcaaacaaggttgggtgaccaaccatcctcgtttgttcacactgagggggttcctgggacacaggacattgagtgctaaaaccacaaaagtcccagcaaacaagacagttgccctagtacagagtagtaagtggcacagcatccatttctggccttggtaagacattgctgaaagagcaacactgttgaccagatgggctcttctaaatctgatttagcttttaagagggcctgggtgggaagaaggtgaggcctaataagaagaaactttttctcctgttgccccaaattgaatttaggctgattgtcagatcttttaggttttctcattatccctatagaaaaccaattcttgccacattcctagaccataagtacactttctcatatcctaaagttagatgctgcgaattatttccttyttttttytccccctacaggatggctgtgactttgtctgccgttctaaacctcgaaatgtgcctgcagcatatcgtggtgtgggggatgaccagctgggggaggagtcagaagaaagggatgaccatttattaccaatgtagattgcactttatatgtccagcctcttcctcagtcccccaaaccaaagctacacagccagatttctcaagcagtctcaactccagtccctcatctcacccttactattgctcttgcttyccagtttgcttttgatttgcatcttytcactagtaaaactgccttccctttgttccttattttctgttttttctctagagaggtacagttgtaagtcagagttaatataatagggcctgtgaaaacagaggcttttgcattgtctcttgacatcagaagttacaataggcatatgggcaaaatggtgtagcaggctcactggccgtttgttttttaaacacattttcacaagtttttgagacactggatttctttaattaaaaaaaaaatgccaagaaacattatttatacagggttgattgytttcatgttgttattctgtaccctatagtagcctccatgagaatctggtatttyttgctgcttggaactactttgcagkgattacttggttgcagtccaagtactctcgtttagtctgagcctggagatgttctagacttgcttctcccacctctgagattaggacaggaaaaatgtgaaatttcccaattacaggattatacggtaccatcacatcatttgtggaaattggggtgactgtatagctgggattgggctaaggactgtggtcttatctgtccacatacagccaaaatgcctatccagaaatccagttcgttggaaaggaaaattggtactcctgtgccacaggggttccagaaaagggaagtcactttaccttgcggtggtgggatcctgatgtctttcatccatttgtagtaaaagctggtaaagcttttcttaytcctggttccctaccagtatttctaaacatgtcgcactttctccacaggcatgtggttttgacctttttttcaatcttctagaaagggaacggaagcagaagtgggacatcgagggctctgctgtcctctgcgctgggtgtggaatgctgctgcacctgtcccttctgctggctcagggaagtgtcttcttgcccacatttctgtggggaaaggtttttaatcctctgatgcttccatcttcctgtttaggccatgtgcccagaaacctggactgatctttctttaatagtgaacccctgggccactgaagagtaacatgrctccactggacacaaaagagggatggaatcaayaggcaggggsccttttataagccttaggaaaagaaaatgaaactatttcatctttggacttttcaatactattggagtgattttttttctttctaaacagggaaaataatgttacaaaagcatcttttttgttatttgtttgcatcccycccccacaccctggtgttttaaaatgaagaaaaaaaaccatcacyttttgtacaaaaactcttaatgattaaamaacaaacaaaacatattggccttgtcatttgtgtgaaagtgggcaaagactggaatagagtaagacaactgaaaccaattttcatccttttactgaggaaaaaaatatttaatatttttgttatataaggaatagtgcctaaggcaggtacttatactcctgacctcagccccacacactctggttttataaagctayaggacagagcagagatggaactgaaaaacagggtagaaaataacataaattggaggggaacagtgggatgcagaaagaatgacaacagccacatgtgccccagtcaaatacttttagtccctgcagcagaagatgccaaccaagtctctataytggctggggatcctgccatggatgcaggagaaaaaattcaatcacaagggagtaagtgacaacaaaaaraaaaaactctgagccacagctacactgggagggggraggaccagattttgctacttctgtcacacaagctagaaaaaccctacctctcccattgggcaggcaacctgacattccacccagttccttgccttaccatactatgtattcctcctcttggagaattaagacctgggctaaatgctccactccrggataaggctgagcagtcctagttctctagactgcctcttttataaagattggattaaggtacgtgaaatggtgagaactgtaaagattttaaaaaataaagtagaacccagagaaaatgtcaaagctgccgccatgtagcaccagcaaccaattcttgcacttctcttccctgtctcagtaatcccctacagaaggttacatgattggaacaactctttcttccctgcaaagtctgctggtaccaggttataacctggacagtggagagtgtctgccttaggctggtttgtgcaagagggccaccttaggtctccttgaggacatttatcttggcgcagatcttgagggcagggcccagcttgatgttcatggcactcataagatgttcttctttaagtaataaaagggcctgtccatcaatctcctgtgagcgaaattcctctgcaatctcttggcagcctagaagaaatggtgagaacatgtaggtaatgccagatgataggagaagggaagctaaatgaaactgaggtctagcaatgattaattccaaagtacctgtcctaaattcagtaatatgaagtcagatggcaagctttaaaagcaaaatgaaattagaaagcaactggtatttaaaaaatggccaggtgcagaggctcacgcctataatcccagcattttaggagaccagggcaggcagatcacttgagctcaggagttcaagaccatcctgggcaacatggcaaaaccttgactctacaaaacatacaaaaatcagctgggcatggtgatgcatgcctatagtcccagctactcgggaagctgaggcaggaggatcatttgagcccaggatgcggaggttgcagtgtgccaaaattcatgccacagcactccagcctgggcaacagagtaagactctgtctcaaaacaacaacaacaacaaaaccaaagtccaagaccaagaaaggaaaagcaactaaattgttcaaccacagaaataacttcattcaaatagcttagagacaggggaaagggagagaacagaaataaaagcatgttttcttttatactggcaaaaagattctttgtgatatttttgtttaagggcccagaattcagacaaatagcaagaagggtagggtgattttcatttccgaaaaaaactctgtcaaaattgcatataggctgagtgcagtggctcacacctataatcccagcactttgggaagccaaggcagaaggatatcttgagcccaggactccaagaccagcctgggcaacatagggaatccctgtctctgtttaaaaaaaaaaaaaaaagaagactagcaaacaagccctctttgaagagtggggcaacaatggccacttagtttctaataccctgctccactgaaaaaaaaaattttttccccatgggaggtatcatagttaattacacaaaaacattttatccaaaaatttagtgaraaatgcagctacatcataagatgagaatcaaayactgtaaaattgctgacattacagaagataatgtcaacccagaaaaaaattaggaagtcaacttgaatattaggagtagagcctctatattagcattcaagctcctactgcttaaaagtcaattactttccctcttatcaaggcccctgtgggatgatgttaaggaaaacaacctgggttctgttgaagaragggtcagtaccttggagagaagcaataaactcgtacacctcctctacactccaacggctgggattactggacaggaacacagggttgatgccatgtaattccggtgtaggtggagctgtattgggattccccaggtcaygttctccatgcccagctcttactgataaaggcccaggagatgttggagagagtgcttcatcataactggaattatctgaaccccggctagagtcttcttgaccctataggggaaaagagcaaaccaatgaggtcagtgtcaaaggtttattcctctctctttcttcccaaaccaccctgggttgggcgtagaagaaaaactcatcttatcatatgtgaaataagcagcaytttatttgcaaattcccaaaatctactctcaaagtctttcaaatagaaactgtatcacttccttgattctccccatgacctaacaattgatctagattttctctcaagtacaattgagagaaattgagtacaattgagtacaattaacaattgtactcaagtacagtgtaaggattaatggaaacatgaaccagtagttgggtaagaggtcyggagacaaagggggtcaggatctcttggaatttgtagtaatgcaatcaatgtgaaaccagagttctcatctcacaccctcttacctgggcaaatgaattgccctgcagggaaagaaaaaaagacccagtttaaaggcatctggctctacaacaagcagctcacccggtggcacttgccctgaatcttggcacgggcaatgtcagaggagctgcggcggggtccacgcctgcgaacgcgagcatagttggcttcttgaaactctttcatttttttcctcttcagccggaactgatggctacagctcacattgtacctacaggacagggcatatataggatgtcaatagygccacagargaccaccctgctctaaatgtgaatttctgcttatgagctgatttggggaagggaataaaagcaaggagggagacataaaatatcagctakgagacgatcctggggaaggggtgtaacattagatggagataccagtgctgagggcaaggaggagggtgcccagagtacctcttagcgcaagtcatggagcagaacctcttagagccacgaaactgctctgcgggggcgtacttcccacagtactcgcacttcaggagattcgccttcttatctaactctaaaaaacaaggtattgctggacagtcaccatgggtttctgctgcccctcaggcaatcattaggctcagagctggattctaaaattattctcagggttcacccccaaaaacctacacaacctagttgagaatccctaaaacgcaaagttcaaaacctaaaatcacgaagacttgtcccktgagaactttatgacgtcttcctaaccttaagccgaactctctccattttagatgtcttactaattttatcctaattcatactcttagatttcagatatgattcaatttctgaggagagaggaactactaatgcctagaaagatataagatccttctaccacaaagatttccaaaagcagtgggaaaatcagtaagagtccttaagatagattataaaatctagaataaggagaactggaaattaaagatayaaatgtcctattttagatcatcttttggaaaaaaaaatttttttgagacagtctcactctgtcacccgggctggagtgccgtggtgctatcttggatcgctgcaacctccacctcccgggctcaagcgatcctcccactttggcctcccaagtagctgggactacaggcatgtgccacaatgcccagttaatttttatatttttttgtagagacaaggtttcactatgttgctcaggctggtctcaaactcctgagctcaagaaatccaccggccttggcctcccaaagtactggaattataggtgagagtcatcacactcggccaaaaaatacatctatagagtaaagaataattcaagggccaggcgtggtggctcacgcctgtaatcccagcactttgggaggccaaggcgggcggatcacctgaggtcgggagttggcgactactagcctgaccaacatgcagaaaccccgtctctactaaaaatacaaaaattagccaggcgtggtggcgcatgcctgtaatcccagttactcgggaggctgaggcaggagaatcgcttgaacccaggaggcactggttgcggtgagccaagatcccaccattgcactccagcctgggcaacaagagcgaaactccgtctcaaaaaaaaataataataataattcaaaagattactttagctggataaattcccctcaccttatgtaattccttttccgtgattctacatactctgatatataatatggtttctatatgtagacagacttcattttattcctacttttttttgagacagagtctcgctctgtcgcccaggctggagtgcggtggcgtgcagctcacttcactgcaacctccgcctcccaggttcaagtggttctcccgcctcagcctcccgagtagctgggactatagacgcatgctgccacaccaggctaatttttgtatttgtagtagagacagggtttcactatgttggccagactggtctcaaactcctgacctcaggtgatatgcctgccttggcctcccaaagtgctgggattacaggcatgagccactgtgccaggcctcatttctactttaaataaataggtaactactattttacaccgagtcctcaaacacatctccacgagtctccttcccccaaatgagtctctaaataaatgctcaccagcagatgggctgtccactcccaaagggccacctgactgattctcagtcagccctgtcggaaggccagtctgtagtggcttctcagactccttcagtaactgagaacaacccacctgtcccagaaaacattgagagttaagttagcctgatccccttctgcttctctatagctttccccaacatttccccatcaattatgyctctgcttggatctctgagttaatgaccaagtctggttcagagagaatcactttcaatacggtaatcaagagtagtaactggtctctatacaatgtttggaaatgagaaaaaaaaaatagtaactggctttttttccagataagccattggagaacaggttcctacgctggctccctattttgtcctcttccttcctatggtgctgagaatgcactaggagtcaagacacctcagttctagtcctggttctgcaaaccctaggaaagctccttaacttcattactataattttattcattataaaacaaactagtttatctaactaaacattacagttttaaaggttactttcttcctttttttctcctcttcctaacattttcattttatggtccacacactcttttccctttccttctttataattaaataaatagcgtaattgaaccattctttcattaaatagttctgtgccttttacttttactggagtttgaaaagacaacaatcagaccaagtccccacttcaaagtcccaccttatggccctgycctcaccgggaaaggttctgctccttcctggataacaaagccttcaatgatgtgggtgagaatctggggcttcacgatggcctgtgggggttttgagtcacccatttgtctagacaccatggctagtgtaggaggcggtactgaaggggcgggggtcaaggctactagttcactgcttggagyattagcattcacattagccactgattcagctttttctggaaaacaaacacagattaagcaacagacatgagatgacatattgatccatctattagttgagccagcatgatcttccataataatctatgtccacccttgacaattcacctggattccctgtttttggatctattcatttgtccaccaacttctggcccattttctactcaaccagwtttatcttttagctcactcagaacattcctctactctgtgtgctctccaacagcattagaagtcagttactcacctccaagactgctcttctcgtccatgacttttgggctttctgctactggagatgcyttggcaggaagcattgaacccaatgtggagacatcatctctctcctcctcagagtcagccttgcgtttgacagccaatgtctggggtttaccctataccgtaaagaataggaaagaaacaaagatgtacaaatgaaggataataaggaaccacaattattaccatatgttcaaagaaaattttcttagttccagatttcccaatttatctacttcccatggtacactaaaattcctggtcattcctagtaactttccatcaggacaaaagaaaatgtaacatgatttagtcctgacctaggtcttgagaccctgtattcacgtagaccaaccaagaactgttgttttttcaaagactgatttggttaaggctatcttgatctaacttattacatacccaaaaacccagaatagtatcagcaacaaatttaggartataaagttcagatattatataatgtgtcactctcttacagaagaagcagataaataccaatattaaccctcttaactctttattcccctattcaattaagctctatttccacttagcccaggtccactctcatgcataatagtgccctcaaaaccatcagacatcactcaccggcaagtgcacagactgcatatagaaggcagcagggacctgggctacaacaggtgaggaggtggtagccccaccctttaccacatgtgctgtcccctgcacaggagcaagggtcatcccaggggccaatgtgggagggcactcctgcagtgcaccaggagcctgggatgaaggtggcgaggaggccaaatgggcctgaccagactgcactgtacctggcatcccccgggaagtaggtacagcagctgccagctgtgccaaccccaaagcctgtgcctgggctgtacctggctgtcgagtgcctacaacttgcacagggatatggggtggtggttgctgggcagctgacatcttagcrgcccctaactgaggcggcttgataggtgctacaggtggtttggattggatgggaattggtggcttaggggctgcatcaggtggaagagacaagggtgaagactgaagcatgggctgaacgaccagggtttgggcttkctgctgggactgggaaggtgggacctgctgagtaggtgggacctgtggtggctgaggggcagtgagggtggtggcttgcggctgctgctgttgctgctgttgctgttgttgctgctgctgctgctgcgccaactggaggtgtgtagctgtgtgaaggagctgggactgccggtgctggaactgctgctggtggtggatggcaatctgctgctggatcaccacctgtttctgctggaggtggatctgttgctgttgctgaatcagtgaatggggctggatctgtgtgtaggtggctataggaacaatcccagaatacaacagagagaaaaaagagcagagaataataatcattytaaattaaaagtaaattcatttttccaaggtataacctagttttggaattatgcggtgaaaagaaatctagtcagtatgaaacttggacatcacttcgtccatactcttcccactcaatcagacattaccaactactactagtcttaaagatctcagagaaagaactyccttgctcagtcatttcagatcctgagtaatttcttgtgtctcttatctttgccatacttaaatattgtattcttttactctgtactcagcaaagaagaatggttagcccctcctccattagacttggagtttctcaaaggctgaatccatgttttattcattttcacatccctaaaacacagcccagggcctgacactgcagaagcacttaatattcactgaaagaagagatacccacagagttaaagatgycaacgtcwtcccacaaatgacttggattttacaaatcatcagcttagaccaccatctgagtcttgagagtcagcacctgtcagctctgacctaactcagtttcctccactgtaaactgggagtgacaaactctacttctccatrttgtaccagattgtccagagatcaaagcatgtgatgataaagcaatttagaaatagaactgctagagtatataaataccaagtatagtaataactaactcttaatttttttgtgagtaaattatctaaatacatcaacaactaaggtactagaaacaaraaaaggcaaaaatcaacatgaccaaataagatacacacatctaactacatcttacccgcagtctgaaagcaagtataaactatcagagtcttgccctgtcacccaggctggagtgcagtggtgtgatcccagctcactgcaacctctgccaaccgggttcaagctactctcctgcttcagcctcccgagcagctgggactacaggtgtaaaccactacgcccggctaatttttgtatttttagtagagacggggtttcaccatgatggccaggctagtctcaaactctgacctcaagtgatccacctgccttggccttccaaagtgctgggattacaggactgagccaccgcaccccgcctctccattagtcttaagtgctctaaggcattgtactgtatctgctatacactggatcaagtaaccacattaaacagtgaggtgagaattcatcccttatagtaaatgctaagttacatgaagacagggaatctacttttcaaaaatgtatccccagtaattcctagaaaacagtaagcaattcagtaagatgtgatgaatgaatagacagagtgataaaactgaagaactcacagcctaagaaagcggacaggggaacttgtaagctgactactgcctggtagaaacagataaaatctgtatctgtcacttgtcctcctgaccctgaactaatatgttcaaggctgatattattcccattccttccactattcaaggaccaacagaagcggggaaaaaacaaaaaggcaaagaaaaaaaggcaaaaaaagaaaaaaaggaaaatttcacatgaattctgagagaataatgacatgaggaatgacaatttacctgagctaataagtgtctggctgggcgcaggtgtggctgtccgtgtcaggttcatgcccacattctgctggccactcccatctgcttctgccttcttggcwkctgcactttctgcctctgtctggctgccctggctcacagtcactgtttgggctgcaggcaagggctgcaccactcctgtacccttcctgggacagctcccaccacccattcctgaggaaggcaactgacccaaaccaccatgtgcctgcccacctccacctggacccatggaccctgggatgctattcccactgcctccaccagcttgactaaggttgagggactggtttgtggccccagaggaagcctgtgccaccgctagggcctggctagaggcctgggagaggctagagacaggggaggctcctggaggaatggccttctgagtggagccttgcatctgaggtccttgagctgaggcctgttgattccttactgccaagttctgaacctgaaagatacgaaaaaacagattgagaaaaggaggactggaggcattaaggttaaagattcaaaagcagccaggactgctattgtgtcgtattccacagaatacctcagctcgtatctctgcctttaccatatactttaaggccttcctacctcctaaggaggaactctggctccgtatctgattcttcagccatcttcactcactagcaagtttatcatcaagtgtggtcttttattccttcaaaatatctcttcaattatccctttcctcgccattcaatcattcagcacctcccaaaaacctactatgcttcaggtactacactggatactggaaatgcagaggaaagacacagtctctgctcttaatgattactttctactacagaagacaagaaaattatcacttatgacataataagatgtatagatatgcacccagtaccataggagtacagagaaggaatatcaactaagactagggagatcaaggaagggcttcctaaaacaagtgatactgatgtgacactcagtaggtaatggtgaaggtgggggtttaaagatattgataacagcatttgcaaggccagaaccaaaaaaggattattatttaggctgggcgctatgactcatgcctgtaatcccaacactttgggaggccaagacggacagactgcttgagttcaggagttcgagaacagcctgggcaacactgcctctacaaaaaaatacagaaaattagccaggtatggtggcaaacacctgtagtcccagctactcaggaggccaaggtgaaaggatcacttgagcctgggaggcagagactgcagtgagctgagatcacgccactgcactccagcctgggtaacagagtgagaccctgtccagaaaaaaaaaaaaagacattattttaaaatattattaaaaaaaatgtataatttctaaaaagactgtatttttagaaattataaatatttcattatgtttggggagagttacaaggaatggaaagaaataaagcaaggaaggcaggctgtggataaggaggtaggaaggtgctgggccagtaagggcctggtgtattgaaacaaggaatctgaactttagtttgggaacagcaagtttatctgtcttattcattgttatattcctagcaccttcacagttccggcacatagtcagtactccaaaatatggataaagggaaagaatgatgtctgcttaactgattataggaagccaataaagcttattaatcaaaataaacattcacttatacatttatacatttctgattgaagtataaatcaatacacttcctattttagaaaatatttgttatcatatcctaaagttgaacattcacacaccctctaacccaggaattccacaagacaaactcttgccatgtaccacaggaggcatgtgtaggaatgttcatggtggcattattcattagcaaccacgacctggaatcaactcaaagggccatctacagaagagaagatgaataaactatagtatattcatacaatggaatagtatatagaaactacaattaataaactccaatgactgcaacaaaacaaatggatcgtgacaatgttattaagaaagcactctccaaaagtgtacatacagcacgagtaccttacacatttcaatacaattaaaatatatacatggtgtctggggtttgcttcaaaatattccacaggcagagaagggcctgaatgcattggtcatgtgtcgataattgttgaagctggatggtaagtacacaggaattcatactttttctgtttttgtgtacctttaaaattttctataataaaaagggcattttagaaacatagagagatgcaataaaaccatataaaaaaggacccgagggaagaatggacttagaaatcagaaggctcgttactgtgggtaatggaaggcagtagacggaactgcacactgcttattacattattaaaaattacagagtaaataaattttaacagttatgacgagaccaacagtgagagagtgtcatgatccaaggattacaattttatcaaattctgtgtaccagaagtacgattaaaaaattagtagtaacaacatatattttcttatttaaaaaaacatagtaaaagtttcctgatagtaatgtggaaaagaactacaagtaggttaagactgaagtgaagaagaccatgtagaaatctagtacaataggccggtgcagtggctcacgcctataatcctagcactttgggagaccaaggtgggcagactgcctgagctcaggagttccagaccagcaggagcaacatggagaaaccccgtcttctactaaaaatacaaaacattagctgggcatagtggcacgcgcctgtaatcaagctactcaggaggctgaggtacaagaatcgcttgaacccagaaggcagaagttgcagtgagccgagatcacaccacagcactccagcctgagcaacagagactctgtctcaaaaaaaaaaaaaaagaaagaaagaaagaaagaaagaaagaaagaaagaaagaaagaaagaaagaaagaaagaaaactagtacagtacaggttaaaataataaaaacctgaattcaggcaggagcagtaaagagttgatggcttttgagagatattgacaagaatcatcaggattgggtgctagagcacataatattatctggcaattattaatatacagtttttccaatcagcttcatttccataatggctatttcaaactttcccactctctccctatacctcagactaccttctctttctcctcctactcttcacctcttcagagaaaacaaaaaccattatatgagcattgcttcatcagttccaccaccgaatctatacatttatctgcatacacacccatcatttcccccttctctcctcttcctatcaaaaggcaatcagtccttctctgcactctatattccacctcctcctgccatctcaagcagcatataatatccactgcctcctcttccacttcttctccactggctccctcatcaccatgtaggaactgcacattcccctccccagttccaccttcctttcctggtgctgctaaactcttaatagctgtttacagtcactgtattcattcccaccagccattcacacccctcaaactcatactactttggattcaccaccccccaaacaactgaaacaactctccctccctgttaataaaaccatctttctttctctctctacattagaaagagatgccccctgcccacgcatgcgcgcatgcacacatgcacatcttgtaacatttggttcccttgccttcgtgacactacagtccagattttcctatctgctgctctttcccattcgcctctgtcagcccacgatcctctgtcgaccttgaactgcttttccaaagtgggggttcatcctacctcagggccccatattaaacgttcctctcctcaacctgtactatctccccaaacatttttttttttaagatggagtttcgccctcgttgcccaggctggagtacaacggcgcgatctcggctcactgcaacctccgcctcccaggttcaagtgattctcctgcctcagcctcccaagtaactgggattacagggatgtgccaccacgcccagctaatgtttgttatttttagtagagacggggtttcaccatgttgatcaggctggatggtctcgaactcctgacctcgggtgatccacccgcctcagcctcccaaagtgctgggattacaggcatgagccacagcgctggcctttttttttaagatggagtctcctctgttgaccaggctggagtgcagtggcacgatcttggctcactgcaacctccacctcccaggttcaagtgattctccttcctcagcctcccaagttaactggggctatgggcatgcaccaccacacccggctaattttttttctatgtttagtagagacagagtttgactacgctgcccaggttggtctcaaactcctgatctcaggtgatccgcccgcctcggcctcccaaagtgctgggattataggcatgagccactgtgcccggcctccccaggcaattttaaagactgaggagagtaaactaatttagtagatgggggacttcaattatcatctatatgcctactactctcaaatgtttatctccaacccagacctctcctctgagctcaagaaccacataataaaactgcagtctcagtatctcctcatggatggctcacaaacacttctaattaggtctgcatgtccaaaactgaacgtcactctaaatacactcctacattcttcgtctcataaacagcaccaccagccaccccacagatttcctatctggcatctcctttaattcccccatctactaaattagttcaccctcttcaatgattcttctaagttatcctcaaatctatgcatttctgtccatctccattgctacccccagtatgaacatcgtctgtcccttaaactgttagaacagttattctccctacagtcacactcacaccatatccgtttagtctccaaagaggaaatcaacatggtatttaaaaagcaaaacaaaacaaaaatacatccaaatctctctatgacacttccatatttaaaatccttctatagcttccaattgctttttataaaaagcccaaaatcctaaacacagcccccaaagccctgaaagataaggttcctcctacccgtctagccccactatgccaaactccaagaatacaagacttttaattcctctaacaaatcaagttcctgccctcctcaggacctttggacacactgttctcctgcctccaacactctccttccacattcttatctggctaacttctacacaccccaagttaaatgtcacctccttgacttttacaccccatgccaaagctaagttaggtccctttctaaattctcagaacactcggtactttctcaattatttccccattcaggtgactatcagtttaatgtctggtgtttcaatggtctgtgagctccacaaatgcagtgatcgtgactttcttgggcatccaacgctaaggaatgtttgatatattaatagcagtagtttctcctaaacactcactacgtccaggcattcttcaagcagtcaaacgcagcaactcacttagtcctcacaacacatcctgaggtaggtatattacaatacctattttacagatgaaaaaaacgataacagaaagatgtcagatcatttgcacagggtcacacagtaagtagtggagctggaatctgacccatcagatgcgtatttttaactactgccctctgttcctccacatattgacactcaaatatctgatgaatgaatgagcggataaatcaaagaactggatatggaaatggaaccaacctcactcgtggctcccattgctatcaccagagtctaaaacaaagacttgccttacagctagatgaccacaagagtttcttagcaagttccctaacttctcttctccaggaactgttagaacagttattctccctatagttcttcctaagtactttcctcatcttgttaatctgct

SEQ ID NO: 17962 - DNA, 33174 bp, Homo sapiens
agctaatttttgtatttttagtagagacggggtttcaccatgttggccaggctggtctcgaactggtgagctcaggtgatccatgtgccttggtctcctaaagtgatgggattacagccgtgaaccgccgtgcctggcccattttaccattttaaagatgacatctcattgcttttctccttttttgtttctgatgagaatttagctatcattcatgtgttgtttcccattattaatgtgttatttattttcctctggctgttttcagtattttctttttatctttggtttttattagttttagattatgttcttaggagtgattttccttctgtttatcttgatgcggattcagtgagtttcttatacctgtaggttgtatcccaaatttggggaatatttgatcattactttttcaaattcctttccgatttcattatatgtcccctttattttgggggacttcagtttcacttttgttatactatttggcattgttcataggtcactgaggttctgttcatttttttctcccattttttccctctattcttcatattggattatttttagcaatctgtcttcatgtttactgacctttttatctgccctcttctatttgctattaatctcattcagctattattattattattattgagatggagtctcgctctgtcacctaggctggagtgccgtagtgcaatctcagttcactgcaacctctgcctcctgggttcaagtgattctcctgcctcagcctcctgagcagctgggactataggcatgtgccgccaggccaggctaatgttttatatttttagtagagacagggtttcaccatgttggccaggctaatattttatgtttttagtagagacagggtttcaccatgttggccaggctggtcttgaactcctgacctcaaattatccacctgcccccgcctcccaaaatgctggattacagctgtgagccaccgtgcctggccctcattcagttatttttaaaaattatgaatgctgttctgttctggaatagtcacttgattctttttggtagtttctacttctctgagattcttcaaatttttattcattatgactatattttcttctaagtctttgaacgtatttatgcagatattaaagtccttgtttgctagttccagcatctatgttacataagtttcttttctacttactgacttttctttgatccatggcccatatattcttatttctttggattctaataatattttattgtatgctagatattaaatgtgatgcattatggctaatctgtgttatgtatcctcttttttgaagaaaagttttattggggaataatttcagatttacagaaatgtttttaagatagcacagaacatttctttatacctttcaccccatttcccctaatgttagcatcttaaaaaatcatggcacatttctcaaatgtaagaaatgaatattgctacattgtttgaattttaccagttttccactaatgctctttttgctgttccaagatccaatccaggataccacattacatctagttgttatatttattgttttcctctggtctatgacagtttctcagtgttttttttttttcgtgaacttgatatattttaagagtattggtcagatatttagtagagtaccactcaatttagaattatctgattttttttttgcatgtttacattggatgtgtaggggaaaactttcttcagctgtgtttttcttctgctttcacaccagcactaccacaattatcaacacagaagaagacttgtgtgaccaaatgtggtaggggtgttccccacataccaattagcagacaccaactgggtatcctctaattcaattccgacattatctacctggagatagtgttagatcttacatttcagggattcaatatgcaagatcaccccctacacccacagacaccagtcacaagtctgggcctctggaacatctgaccaataagcttcaagttgggatttccacagcttcccctttgagttcagttaatttgctggagcagctcacagaactcagggaaacccttatgtttatcagtttattataaagtatattacaaaagatacagatgaagagaactgtagggcagggtatggggaaaggggtgtggagcttccatgccctttctgggaaggctgctctccaggaatctccacaggttcagtcatctggaagcattctgacacagttctcttgggtttttatggaagcttcaggacatcagcattcttgctgctgaccccctccccttgtcaccccagtaaagggcaggaccctctctggggaaggttttaagacccacaatcagaaaggcaggggaaaattagagtcctgccttgaggcagatgaaaggagggcagaagaaggccagaggccttccccttggggcctgacacactcaacattataagaaaggactgtaacagggaccataggagttaggagccagaaactgtggatgaaaaccaatatatacatatgtataataccaccctggggttatggattttggggaacaaaccttactggttaggtgcttttatcattgcatcatattagggggtacatgatatcaacaagactcatcactggtggttcacgcagtgaaccctgttcatgtggttgaggtggtatttgccaagattctttaatgaatagttactatttccttttatccatagtgtactctttggaagtgagtctcttatccctgactaccctcaaagggaggagagttaaattccacatcctgaatggggagtatctacatatattatttggtattttctgtaagcaagatttgtcacttctcacctatttatttatttaaatcagtatggatttatatagtttttccccttgtgttataattcaacactgtcatttattttgttgttcatattgttccattgggagcttttccaggttggtttctgtgtcctgatatgctcccatctttttttttttaacttgcttattttttaacattaaaagactggaagatcctccaagcttattttgtactttccctgtcctggccctagaattagccatttcttcaaagagcccctgattcctatgttgccttctgatgtggtttggatctgcatccccacccaaatctgacgttgaattgtaatctccagtgttggagatggggcctggtgggaggtgattggatcacgcggatggtttttcatgaatggtttagtaccatacccctagagctgttctcctgatagagttcctcacaagacctggttgtttaaaagtgtgtaacacctccccgcgtctctcttgctcctgctctggccatgtaagacatttccctttgccttccaccatgactaagtttcctgaggcctgcccagaagcagatgccactatgcttcctgtacatcttgcagaactgtgagccaattaaacctcttttctttatcaattatttggcctcaggtatttctttatagcagtgcaagaatggactaatacaccttcctttttttaaaaaatgatcttaattattttaaagcatacaattcagtagtgttaagtattattatggactgaatgtttgtctcccccagattcacatattgaagccctaatcctcagtgtgactgtatttggagatggagtgtttaaggaagtaattaaggttaaatcaggttacaagggtggggccctgatctgataggattaatgttcttgtaagaagagagaccagagccctctctctttcttcccttgtgcacacactgaggaaaagccacttgaggatatagtgagaagtctgcaacccacaggggaagcactctccaaacaccaactctgctggcatcttgatcttagactttcagtctgtggaatgatgaaaatataaataaatttctgttgtttaagtcacctagtctatggtattttgttgtgatagtccaagcaagtgaatacaagaatattcacattgttgtgtaccgtatctccagaacttaatcacactgcaaaactgaaaccctgtacccattaagcaacttccttttctttttccctccaaacttctttcagtaaccattcttctttctttgtctatgggtttgactactttagattcctcatataagtggaatcacacagtatttgtcattttgtgatcagttcatttcacttagtataatgttttcaaggttcatcagtgttataaagtatgacaggatttcctttctaagactaatattccattgtatgtgtagaccacattttgtttgttttgccttcatattaagggcgtgaaaatttgttctcagaggcagctaaactattgatgactctttttggcaatgttaagttttgctctgtttttggttggtgctactaagcaatgcatcacctctgtcctttctgttcagctcttggccctgcaggaactatctcagcttggacttgcagagttttgtcctatgtctgcgcagcctagaacttggccacagacatacagtgaattcctacagtcttaagggtgcctctctcttgtgaattatcctgccctgcaaattccagccatttaagcagctcaaaactccaatatctgcctcctcattttagtaagactgctgttctgtttaggattcatttttgtgctctgtactagaaagtggtcctagatagaaagctagggtgatcattgcactcacctttgtattctctcaaggatcacaatgctgcctgtgtgttcctgaaaatagctgccttgtgtgtcttgccatgtgttgtattttgattggagagtaagtctaatgccattctgtcatggctggaagcagaaatatatttgtttttattaatataaaacaaattaatataaagcactccctgtttctcttcttttatccttatgcagtctatcttgatgatcttatccactcttaagagtttcaatactctttctgtttccttactttaacttttgttttttttagacggagtttcactcttgttgcccaggctagatagagtacaatggtgcagtctcggctcgctgcaacctccgcctcccggtttcaagccattctcctgcctcagcctcctgagcagctgagattacagcccccaccaccacacccagctaatttttttgtatttttagtagagacggggtttcaccatgttggccaggctggtcttgaattcctgacctcaggtgatccaccctccttggcctcccaaagtgctgggattacaggcgtgagccaccacacctggcctactctaactttttattaacttttcacctactaaaaacaaattactaagatgttagaatgtatttgtttactttgctcttctttttagttatctttgcatgaagtataataataaaaaaaataagacaacaaagagaaaaaatataatggaatttctgatactgtgaagggtaaagaccatcacacaatttggacaaggttttggggaagatgtggtcatgtcatattcacaaaatatatctgggtaatagtctatttctcccgtgattccaggcatatgcacccaacagtccatttcgttattgcttatcactgcccaaaagttccaagaaatgatgaagtcagtctcatttggcatacatctactttttcagaaggaaacaaagcagagaaaaaattccgagagaaattcatagctagtaaccactctcacttttattttagtttccataactgaaattgctggacttgagagcaatttttccttgctcaacagaattaggtgagatggggaatcaatttaatatatatttagtgagcatctacagtgtcatggggcaaaaaaatagcaacttacaatattaatttctataggcagcccccaaatttgaatcatttcctgaaaaattacttctgcttttgtgaagtttcctgctagcagtttagagattgggctgtttcctcactgatacatatcccttcacacttctataatttaactctctcaactgcatgtgaaagatcttagctgaagatgactgacagtgttatttattccatgttagagttgcctacrgcaacccaagcccagaatgactayggaccacagcaaaaatgtgagttaaccaaggtagcatggaagacgatgcatagcarcagtaggctatggatgaatggggagtagaataagtttaaagcagagggtgcagaagaattgaggataatttgaggaaatacttttggttcagtttaaagtccagagttggaatatgaaaagttggtgtatggtacaggatctgatcttaggtctcaggtaaactcttttctaactgttcacttctttgatcgcatcttagaaacccaacttagggcattgccgttattccttcttgctcttagctaaagcgggaactttgttgggagaattttatctctttagttatattcggagtaaccttggaccagctgtttaaattctaggtatggctgtttttctgactatggaatgaggaggacaccaatagttttgctggtggatacgagtaagatttttgtcaggaaagaaactgatttacatatctagttttgttttttttttttaacttcacagtgttgcactagaatggtgacagggaagaaaaagtatcaagaaactacagataatagtctctgtgactgaggatttgaaggcaaaagagccatttttacatagagccctgagagaatattatctgagacagacaggtaatagtgtaaatgccaaaattaatccttgattttgtatcgtaggcagtgaactcccacaaggtgtattctttagggtagttccctaagctttctctctttttactacatagttttactattataatttttaatgtcttttgagagtgttgccttaatttgctaaatcattctagtatacttgggatatttagacctatttctattaccataaattatatagcattggatatctttatttgtgtaaccttttcctatttttgaattgtatctatgttaatttctaaggaatagaaatattacgttagaagtaatgcatatctcaaagtatatgttcaaggtcacacacacaactggtgataaattggaacctagttggaactatttagaggctttcaatatatacttaaagtaaattttaaaaatttactttacttcttgaattggcttgtggttacacaaattcaattatggtttgatacctttttaaaatttagcataacataaaaatgaacatttgtgtatttcattaaatgttctcctgtgatgcaaatgtatttttaaaagtttttctagaaatcttaatgcttttggattcatcagtccaaatatttattatgcagaattctctatttatgaaggcatctctcattatgaatttttttctttaagaagttcagaatactccatagatacacacatatatagaataatttatctaaaatttaatcagaaaattgaagcccaaataggcaagtttaatttcctaattaaatgttattaagcaaaggaatcaaaattagaagttaaatatcatcttacttcacagagttttgctcgttacacgtaatttctacactattgcactatgagatacctttgattttaaaataaagatttgctgaaaatacttccatttttcaaatttaaaatttagatttcggttgtatgcaacagctaacatgaagtagtgtcctattcttaaacttggcatcaacttaaacttactgctcttttaataacgacagtttacaaagcacttctgaaatgtagattatttttatttaaattttatgtatttcaatttcgagtagataatrtgtttacatggttcaaaattcaaaaggtacaaaagaaaatagggtaaaaagtctttttcctattttgtctccagtgactgttttttccattccagaggcaaacaatgttatcagattcttgagtgtgcttgcagagatatttgtatatcctgttctgcagaatgtttctttgtcttgactatatatcttacaaaatattccatatcagttaaaaaaaaaagccagtttttattagaagctatatattcactttatggatatatcaaaaatgtatttgactggccttttactgatagaatgtagattgtattcagtcttctcctcctacaaatattgctgccacgaataaatatgacattttgcacccgcgagtatctgtaggagaaatttctaggtcaaagggtacatgcctttgccgttttggtagatattgcccaattgtcctccaaagaggtaccaatttgtattctcaccacctaagtatgagacagtgtaagtcacagtttcaaaggaaaaaagcattctttatcttgataaatatagtaagttctttgatacaggtgttggtggttaccttagactttagagcaagttcctgacacatctagaaaaggaatctttatggcctggatctcagttcccactaggccaaattrctttaagatgcgatatccttccctgactttctcttttctttcaacctgtcatctgactcaggattgtgctttgactctgttgttgcagcttcctcttccaggccttcttgttcttgccttgtggcaatagctttggggcttctgactgcagttcttctgagtgtgctgctataccagtggatcctgtgccagggtaagtgcaaacttaaaccaaaattaatctttcattttatattataaaagcaatataacatagcagaagctttgaaaaatcaaaaaataattcaaacaaaataactctccatctgtatacagctatttcctgggtatagcctttgaccaygtgcacttgtgtaagcttgtattttcttttttctttttgttttttgagacagggtctccctcaatcagccaggctgtaggtgatagatttgtgtgctgctataccagcggatcctgtgccactgtacagtcacagctcactgcagccttgacctccttaggctcaagtgatccacctcagcctctcgagtagctgggaccacaggcacataccaccatgcctggctaatttttgtattattattattattwttttttttttgtaaagacatttcaccatgttgcccaggctgatctcaaactcctgggctcaagccatttgcccttcttggcctcccaaagtgctgggattataggtgtgagccactgcacctgaccatattttcttaatagaactgcagtcaagtcctcttaaaatttctcccacctttctttcttttaatgcaaggctgagaatagttcttatcgtagtatgctcataattttgtatattgctttttaattttatgttgccagaaacatttccttactgccatatttattgggatgattgaattataatattaatgatgtttaacttttcacataatagatatatcataatgtaatgaaacattctgaatttttttttttttttttgccattcaggtgctttcacattttctaaaactaatttttaagtttagttcttctaggaccttaaatctggtgatctagaggactctcagtttgttgttttacagtctagagtcctagcttaggtttatatttttaggggatgatagtgaccgattacacagaagtgatttattagggttcttttttaaatttttttaaaaattttgagacagaatctcgcaatgttgtttgggctggagtgcaatggcgtgatctcggctcactgcaacctctgcctcccaggttcaagcgattctcatgcctcagcctcccgagtagctgggattacaggcacctgccaccacgcccagctaattttttgtatttttattagagacggggtttcactatgttggccaggctggtctcgaactcctgaccttgtgatctgcccgccttggcctccccaagtgctgggattacaggtgtgagccattgcgctctgccgatttattaggattctaagagttcagctccagggcttctacctcagagccaagtccgacctttgacaaaaaggaactcctagggaagttgggaatttctaatccaggctgagtaatgtcacagttgtatggaaaaagcaaaatctataaggtgccaatttaacagcttgatctccagaacttatattggttgtatgccagtacttcctagagaacaattatctaatatttatatgaaaaatactactttccccactttgtaactcccaaatctagagtagatatatactctattctgcaattatatatctacacatgtgctcatggagtataatggctcatacttgctcactgtagaattgtgcttatggcgagtttatgcacatatgtttaagtattgaaactgaagtagaaaaatcaatagaattttggaatcttggttggaattaccttgaaagcatattcagttccctttcatctttgattgtttgtttttgagacagtgtcttgctctgtcgcccaggcaggagtgcagtggtgtgatcttggctcactgcaacctctgcctcctgggttcaagtgattctcatgcctcagctcctaagtagctgggattacaggcgggtgccaccatgcccagctgatttttttgtatttttagtagagatgaggtttcaccatgttggctagactgatcttgaactcctggcctcatgtgagccacctgcctcggcctcccaaagtgctgggattacaagagtgagccaccatgcctggtcagttccctttcatcttgacagaactatgaaccaaccattttaaaggaatgtggatcttccgtatttaaaagagctcggttagggcattctatcacttttcactttagcacctgttatgcttctctgccagaaaacccttttgaaaaatatcaaagtaagttctttttgctgaggtataagggtttttttccagttttcaatggtgagggacagttacatctgtgataataaaaaagcaaaacctttcattctagttaagtttgcttttcctaatttctttttggcattttcagttgggcattctgaatgattctgcctgatttaagcaatatacattatgcaattatgcaatatatacacagagcaaagacagtacacagatgcatatcatatgaattcacagttatctggtgtgtgtatattacatgtgcacagagatctctagcacaagtcaagtacttgctccagagttttcaggcagattgttgtatgctttcttctttgttccttcagttatagtcatattcttgtgtagtggaatatatacttagtagatgatggagttggacattatgaggacattatgaggtattcaaattgacaccacrcattgttacacatttctctaacccttaatctgaaaagtggtggagcagggaagacccagggctgccatattccattttatctcccatttcatttccaagactgagtggtccataaagatgtgaaccaggtcctcttctctcctaggctccaactactccacttgtgccagctgtcctagctgcccagaccgctggatgaaatatggtaaccattgttattatttctcagtggaggaaaaggactggaattctagtctggaattctgcctagccagagactcacacctccttgtgataacggacaatcaggaaatggtaaatgcaaacatttagaaaatgtagggtttttgttttgtttttgtttttgtttttaaactgctatttaaatgtatcatgtatcctcttttaaggaacagaaggaatctgtgatttgggggggatactatattcttccccttccctcttcttctctttcctcttctacttctgccttcttccctctccctccccactctttacccttatgctgtctgacccaacaaacctcagttacagcaacccagatgcttgtatagcatgtaagtgtgtatgtggggcaaggaggcagaaggatggtgagtgttttggagaggaatgagacctgaaatacaggtctagttaaaagaagtcttaggtccggaaacctacaggtccaacaacaaggcagcagattctttttttttttttttgacagagtctccctctgtcatccaggctggagcacagtggtgtgatcttggctcactccaacctccgcctcccaggttcaagcgcttctcctgcctcagcctcccaagtagctggaactacaggcgtgtgccaccatgcctggctaattttttgtatttttagtagagatgggatttcaccatgttagccaggatggccttgatctcctgaccttgtgatctgcccgcctcggcctcccaaagtgctgggattacaggcatgagccaccgtgccagtccttatatagtggaacttgggagggagggaaagatagagatcacggggacagagtgattgtggcaagggcttaaatgccttcttttaaaaagttttcccttaattcactggaatccaataagttccagactgcaatgttgagaaagttgggatataaggaagaaaacaygcgtgcacgtgcatgtgtgtgtgtgtgtggtggcctccacttccttcaggcccctcagatccttcctatccacccagcaatctcttggaaaagagcttgctattggtcctagaccatctcaaggcaatacaaggaactgacatcctgaggttgcctagtataaaaatcaatcaaattctaatttgtcaacataaataacatctataaggaaaacaagaaatcttagttttgtgttagtgctaatttgatactgatttttgtgttttgctattgttttctgttttcttttattgggtaggatctagtcacagagaacaatttattgagaattaaactatattaacttaccttgggaaaaatccagaggttactctaaagcagtgggggagaacatatagttcctaaattttatagctacctatataactacctatataaagcatacagattcttgttttctgccaaaggaacacttactcctttggaattccacatagaatctaaactctaaatcattccacatttgtgactaacttttttttttaaagccttctctaagtgaggtggcagaatgcattgagttgtattaattaaacatgagttcttagttttatggcctccagcaatatagccttgctttctggaccttgttgtagcaactcctattctcattctgatatagtgactctcaggatttgagctgactaaagtcagtagcagaagtgagccatgaacttgaaacattgagggcaaaactgataaacaggagtygtgagtcatagcacaagacactgccacagaaaattgtggtgtagcagctgctataaatttcacagtgtgatcatgagaggtgaggagggaaaggatgaagggcacagaatatctgggaaaatggcaatatttctgtttctctgaggaacccagaggaagggcaggatcattagagggattttgtccttcctctgcttcctgacatgcccccattccttagactattgttgagtaaaaccagcagagttacattcactgcatttccaaattgagtttattttctcctaaggctccttggggccaagtcagtgctggagagggcggaatgtccctgctagatgtcataagttttacttttaacattcctgtggaatcttacttgattctctggtttaattctttttcttgctccggcttttgtcagattctgtagaaccaaattgattttacgtgccctgctgcgtctgttgttctagtgttattattcttttgttctcagggcaagatttacatactattttgaggtatgtacaatgtttctagtatcatactggggtctgagccactaccaaaaaagcaagaagtaaaaataaaaaagagagctctatggatctattaaaactgaagtttttcaaactgacattccattggtggagagtgctgctagagaattttgttgctatatgtagaatctacaggcctatggaaaatatccctcttatgctgttaaacggtcatctttcagtgagatgcttacgtagagttcacctcctatcttagatcacttacggcaaagtgtacaataataacagaggctaccatggattgagcacttgctttttgccagatgttttatgtatagtattctttttttttttctttttgagatggagttttgctcttgttgcccaggctgaagtgcagtggcacaatctcggctcactgcaacctctgcctccagggttccagcaattctcctgccttagcctcccaagtaactggggttacaggcgcctgcctccacgcccgacctttatgtatagtattcttaatcgtcacagcaattctaaaaagtagagttcaacatccccattttgttggtgaatgaataaaattcagaggaattggctgggcatagtggctcctgcctgtaatcccagcacttttgagaggctgaggtgggtggatcacttgaggtcaggcgttcgagaccagcctggctaacatggtgaaaccccatctctgctaaaaatacaaaaattagctaggcgtgctgttatgcacctgtaatcccagcttcttgggaggctaaggcacccgaatcgtttgaacccaggaggtggaggctgcagtgagctgagactgcaccactgcactctagcttaggcagcagagtgagacactgtctcaaaaaaaaaaattcggagaattaatgagtgtaagtctaaggctacaaatctggcagagccaaattttaaattctactccagtgggcatggtggctcacacctgtaatcctagcactttgcgaggccatggcaggtggattgcttgaacccagaattcaagaccagcctgggcaacatggcaagaccctgcctctacaaaaaaatacagaaattagctgggtgtggtggcgcacacctgtggtcccagctactcgggaggctgaggtgagagaatcccctgaacccaggaagtagaggctgcagttagccgtgatcacaccactgcactccagcctgggcaacagagcgagactctgtctcaaaaaaaaaaaaaaatccacatcaactcaccttcaaagtcacttatagaaatatcgtatttgacagcttccagaatccattttgcatatgttcaacaagacaactttttctactaattgtcttctggtttcttttctatacatatttaaaaatttttttgaattgacatacagaatgtacrttgtatgaccgtggatatttaaatttatttattgtgatgaggtctcactatgttgcccaggctggtcttgaactcctgggctcaagtgatcctctcgccttggtctcccaaagtgctgggattataggcttaaatatatttaaaatagtgagatgctttcttattatctcttttttttttctatctgggacttcaagattattcttgatagagaaaataaaatggaaattaaatttctctgttattttctcatttttgtgttaacattatggcatcagcccttgcttcttcttgccctatgagtatatctttagatgtttggatatattcaaattcttgatttttcttgccatttttcccccaccaagctcagttcatcctggatgttgttagcctggttccttatagttattggtatgttattttaaagtatgcattcgttagtgagttcccagtgaaactgctttgatttctttaaatctattctgatgctccttgccctataatatctctcttcctcattatcataatttggaattatatgatccaactttactcttgcaacaacctctcattcaactttacctatcttcctgaccttgggattccccgagcttttgatgtcggcttctcacatatttaggatttacatctaataatatccaaagtttccttctttgggtgcagcaawgcaaacactatggtaacatggtcacttttctgtatatttttaatcaggtaatgaaaacagcttggtttctttcagacagtcatgagtgtgcttttactatatttcttactagctatgcgaacttcaacaactttcttaacctttttgactctcagtttcctcatgtacaaagtgaagataaaactttctagactgtccgggcgtggtggctcacgcctgtaatcccagcactttgggaggccgagatgggtgaatgatttgaggtcagaagttcaagacctggccaacatagtgaaacctcatctatactaaaaatacaaaaattagctgggtgtggtggcacgtttctgtaatcccagctactcaggaggctgaggcaggagaatcacttgagccccggaggcagaggtcgcagtgagccgagatcaggccactgcactccagcctgagagacagagtgatactctgtctcaaaaacacaaaaaactcaaaaaacaatataaagcccagagccaaaaataacttttactttgctcttctgtgtcccaagacatacaatttcagtaaaatatgcatcacagagtaaattatgacttgttgaattgagtatattgtttatgaggaaatctgagatgacatgtcagaagattcaaagaaatggctggaaacacagcatagatggtaggggaattgctttactctggaggtcttcacagtctggtaatgtgcatcttttgtcacgcttctttataatcagattaagcagctagtgtcaactgcataacaagggatgggcatgataagctaggatatttccactattttttaacttaaaaaattgtgggaaaatatgcatagcataaaatgtactattttaaccattttcaagtgtacaattgagtggcattaagtacattcacattgttgtacaaccatcactaccatcatctccagaactttttcatcatycccarttgaagctctgtacctcttaaacaataactcccctccctctagcccctggtaatcactattctacttaccatatctatgtatttgcctattctgtcctttagtgtctcacttattcacttagaayactgttttcaaggttcttccgtgttgtagcatgtatcaaagttatggctgaataacattctattatatggatatactacattttgtttgtccatttattcatcagtggatacctgggatgcttcaaccttttgactgttgagagtaaggctgctgtgaayttggatatccatctattgacagacactgtttccacaagcttttaaaaagtggagcaaatgatggtttacggagcagggcttactgacttttagcattgtgtacttacacaaaattatagggaaaattcttattgatattaasctctagtaatttgtaacctgtcagattttcctttgaaatttcttaacgttatttgcatgtttttagatgatggtaattaatgtgttcatattataggatatctgaaaagtctggaaacaggctaaacttatttttaaacagtatgttggttacattttcaagtaatatgctctatatttttactcaatcttgagacatgttttcaagtgaaacatctctaaatttaaagcaatagatataattatttttagaccttatgagtactctgtattgtaaatttttttcaaattagtaattacatcctttgctttaaatacttcacctgaaaaagtgtctgaagaaaaacatattaatgatattattttaaaatatragactgtagggttccccagtgcctggctttctttctgtgtattggctgaaaatcgcagagggccttgaccgctctgtgacccgcccagctacaggtttttcccctgcaggctctacccaaaccccagccttgaacatttccagtcactgataaaggtatctaggttgctgctcaaaacactgaaataaactagccccagccctaagtcagattccttaaaccctcataaaatctccatctctgaccccctggccgtggacatatgtaggtcaaatgctccttttctctggctgtccatcgtgagtgttgctgcagccctctgtaacttcccctaatagatgctttgcacagatcaccttgacatttagtgctttattctatggtatcccaaccaaccccatctcatgatgatttggggtcctcccttgtgggaattcccctgtcgctgcttttgggatgatttcagccatgggtttggtgggacaaaacagagatatactgcctaaaaatacatttatcctatgtttttaggtgttttggaacccattattttgtattctgcttttatcaaatagcattatttcattcttggtttttgctaagcattaaattattccaggtaataaaaagttgcaaccagattttattttattttttatttagttttaaatattatttttatacgtcttgcatcattccactattgcttaaatcttttcatattcttagataaaattctccttgttttcaattgtcatgagctgtgagcatatttatagaaatcattttgcttgcagttatttatttacattatattccctaaaattaagttggctaatcaaaagataagattttatagttttgatgtattattagtttttcttaatatgggttgaaataacttacatacattctgtaaaccattttaatttggaagtttaaggggtatgctttgtgccttaatgatattttaatttcaattaaaaatactacatacagaagtgtatgtggaaggtataaatgttgaactaaaaaagcaaaaaaggaaaagaaaagaaaaagtgcccttgattttatttgtttgggttttatcttcactttgcttttagggtttgcattttttctaaaatataagcaaacattacaaactctaagtgacataacacctaagtgttctagctcacaccctctctgggtgacaagagttctcagttaccacctttacctatacttttgttgttgttgttgttgttgttgtttgagactctcacccaggctggagtgcaatggcacaatctcatctcactgcaacctccacctcctaggctcaaatgaccctcctgtctcagcctcctaagtagctgggactacaggcatgtgccaccatgcccagctaattttcatattttttgtattaatggagttttgccatgttgcccaggctggtctcgaactcctgggctcaagagattttcctgccttggcctctcaaagtgctggaagtacagatgtgagccactgcaccagaccgatttgtactttcatgctgcttctatattctctctctttctaatacacacacacacacacacacacacacacacacacattatccatgagtacatagaatataaggttattgtactatggttttgaaggcctcttccaagtgggaagattttcgagtgaaagtgccataataaacattttcaatatccagcctcaccaatgagaagttgtaagaggactgactgatcaagtgatttagaattatatgggtcttgagggtagtaaatgagcacaggattggggtttgtacgtgggcattacctaatcctagctctgcagattctaactgaaatttctgagcaaatctttatcaatttctgtgcttcattagctgccgttcctcctcttgaaatgaaagaaaaagaaatggactgtttttctcattatcagtggagaaatggggaatcactctttttttccttttgttaattttatttattttttcaaatatttagcttacaatttttgatttgaatatactcaaattttatatactttgaatgcagtaacatttatttttgaatcttttagatcatggctatcattcacaccaattttgtgaaaatattaaaaaaaatccattctttttttcctaatttaaataattctttaaacaagttggttaagaaatgcaaaaattttaagctatcttgaaaattacagtgtcatttcatctgtcgtatacttcattcactctccggtctaccttcttacccccagcatgcacagttaagtgctccacagagagaaagtaaaaaatacagagtttgtgttcagagggttttttttttctttttcttttttattattattatactttaagttttagggtacatgttcacaatgtgcaggttagttacatatgtatacatgtgccatgctggcgtgctgcacccattaactcgttatttagcattaggtatatctcctaatgctatccctccccccttcccccaccccacaactgtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacacacgtgtgcatgtgtctttatagcagcatgatttatagtcctttgggaatatacccagtaatgggatggcagggtcaaatggtatttctagttctagatccctgaggaatggccacactgacttccacaatggttgaactagtttacagtcccaccaacagtgtaaaagtgttcctatttctccacatcctctccagcacctgttgtttcctgactttttaatgattgccatgtgttcagagagttttaacttcttgcagcataatacctaattgtgtgttctttatttctatagatacttattaaacataattttttaaaaaagagatgggatcttgctctgttacccaggctggagagcaatggcatgatcacagctcactttagcctcaaactcctgggctcaaatgatcctcctccctgcctctgcctcccaagtacatgtcaccaagtacaagcacatgccaccatgcctggttggctacattttttacttttcgtaaagatagagtgttactatgttgtccaggctggtcctgaactcctggcctcaagtaatcctctcaccttggcctcccaaattgctgatattacaggcaggagccactgtgcctggtctgcatttattgagtataattttatatatttttctaggtgctagggatatggtagtcgagttgttgctattataatgtttacattttatttattatttttaaggaaaatgatattttaaatttagttttgttattaacatttttttaaattggcacataataattatatatatagggtatttatccgaaggaaataaaatcagtatgttgaagagatatgttcactctcatatgtattgtagcaatattgacaatagccaagatatgaaatcaaccaaaatgttcaacaacaaataaatggataaatgaaactaacacaagaacagaaaaccaaacaccgcatgttctcacttataagtaggagttgaacaatgagaacacatggacacagggaggggaacatcacacaccgggcctgtcggggggtggggggcaaggggagggatagcactaagagaaatacctaatgtaggtgactagttgatgggtgcagtaatccaccatggcacgtgtatacctatgtaacaaaactgcacattctgcacatgtgccccagaacttaaagtataataataaaaaatgaaataaagaaaatgtgtatgtatacaccatagaatactaatcagccatggaaaataaagaaatcctgtcattcatagcagaatggatggaactagaggacactgtgttaagtgaaataaaccaggaacagaaagttaaacactgcatgttctcgcttatgtgaaaactaaaaaaaatgttgacctcagaacagacgatacaagaagctgagaatggctggggatggggaggttagggagagttatgttaaaggatacaaaattacagctagataggcagaataagttctaatgttctatagcaatggtctccaagatgtttagcaccaggcaccagtttcgtggaagacaatttttcyatggaccgttgctgggggctggtttcaggatgaaactgttccacctcagatcatcaggcattagttagattttcttaaggagcaggcaacctagatccctcacatgtgcagttcacgatagtgtttgtactcctatgagaatccaatgccaccgctgatctgctgatctgacaggggtcagaactcaggcggtaatgctggcccgcctagccgctcacctcctgctgtgcagcccagttcctaataggccacagaccagcaccttgcatggcctgagggttggggacccttgttctatagcactgcagggtaatctatagttaacaaccatttattgtatattttcaaatagctagaagagaggattttgaatgttcccaacacaaagaaatagtaaatgtttgaagtgataggctaattatcctgctctgatcattacacattgcatacatgttacgtgtgctttcattttcttcggaagagacagactaaataaatgaatatggtgatatgtgctttaaagaaaatgaaacagtatgatataatagtaaatgtgaatactattttagattggttagttaaggaaggcctctttggggagggaacatttgagttgatatctagacctgattgacagccatgtagaaatctcgggtaagatattccaggcagagggaaaagctatgcaaagaccttaaagcaagaatgaccttggcatgttaaaggaaaagaaagaaggctcatgtggctggaacctaggaagtgagtaaatggttagtaggggctagattgtgtaggactgtgcgtacatagtaaggattttagattttattctatgtgaaaagtgagactactggagaacattaatcaggggcacagagtgattaaaagtttagcactgggagagaaaagttggatgattatttgaaaaggagacttggatgaattctttcacccacatgaccttgtcttctcatctctaaaggtgaggataataatagttgcctaccttccaagattgtcaagaatttcataactggaaagaatcctagaaaatatctaacctaaatcctcataaagaagttgacgctcagccagattaaaccacctgcttatcttcagataggaggacagagctaggaggctccagaattttgtttctgctttgttttcctaaatgccatactgtatattcagtatttcaaatgatactgggaatgaacgcaaagggattttgcaaaccttagagtacaatacaaatgtaagagataattgttttcaggatactgggctctgagagaacaaagttatcataaggaatagattatttgggaagaaaagcactgataaacaagttgtactgatttttcaaatgctttgtctaggagccaccacagtcatgtcctgaatggaaacaggactgaaacccagtgaagagaaaatagaggttattctgaccatgagaaatagcacaaaagactccttttctctcctgtagtgtctccactagaagtgcaaagaggctttttgcctctctttattttattttgtttttttgagacagagcctcactccgtcacccaggctggagtgcagtgatgccatctcggctcactgcaatctctgcctcctgggttcaagcgattctcatgcctcagtctcccaagtagctgggattacaggtgccmgccaccatgcctaattttttatttttatttttgtttttagtagagacaggctttttgtaccacattcaccaggctggtctcaaacttctgacctcaagtgatccactagcctcggcctccctaagtgctgggatcacaggtgtgagccactgtgcctggccctcccttaactttagaagagcaactctttatttgtgctgatgcagggtccaagtaggcaaagagacarttaagagcagagcccataaatgtttactcttcagcaaccatctttcaggagtggaataaaaacaacatcaaaatgggacatctggtggtatcataatcaccataggcagttgaaattgtattgctttcttagtagtttctagataaaaaagaatattttattccaaaggtatttaaccaattaagctgtcwttagaaaatattgaaagtgtaattgttaattacaccaacactaaatcctacaacaaaattaccttggattatctttctaaccttttattttaatctattttaatctttaacattttattttatttcatttatagaggcaattctctttggatataaacttcttcatttgaatgtcagactttgcagatcaaagtcttttatctctgttctgttgggtaacgtggcacacataagtggtgtagccaatttacctttaccttaaacttgttcccttaagaactgtttttttcttgccacatacaagattgatgaggatgcggaaaatgagacctcagtggggaaaaaaacaagaatattgctataggcttaatcrtaatttatatatttaaggatgatgggaaagatgaccacttctgcagcaaaygtttagcttctttcttttgaaataatctgaatacctatcaggtgctccctttaattaaggagaaaattgcaatggaaggtagagatgtaatattatcttatttgctacattataagaatccagttattgacagaaaggtcaattcyaggatgctgctcctctctacagctaacacatctttagaattagatgttaaatgagaaattagttatttagagtgaataattgtcttagcttgggctgctctaacaaaataccatagactggatcgcttgaacaacagatgtttctctctctcagttctgaaggctggaaaatccaacatcaaggttctctggctcctggtgaggacctacttctggcttgcacatggctgcctttttgttgtatcctcacttggcaaagagagtgctttgatctcttcctcctcttataaggacactaattgcatcatggaggccccaccctcatggcctcatctacacctaattacttgctaaaggcttcaccagcagatttcatcacattaggggttaggggttcaacatattgattttaggacgcattcagtccttaagagtggtgatgatggaggctgtaaggaatgctagtttgtcttttaattaattacttaacttagtattaggaatccaatgtggaaaggaataattgtttgactgtgacactaggtcccttttttggttttcaacctctcccttagagcctgctccaagttttcctcagtgaggccttttgctggattggtctgaggaacaattctggctggaggtgggaagayggatcacctctaaacttctcaaggtaaggggcttcaaaggaatgcaaaaaaagagagagaggaaaaaggaaagccaaattatgatacttggggaatagataaagaagagcagatggagaggagaggaaagaatgaaaaggagaggaaatagggaamaaggaagggaatgaacaatgggtaagggcaaaaaaaaaaaaaaaaaggataacattttaaagagaggctgatgaacaattttaattcttctgctgtttgggggaattaggggcctgaatagggagacagaatttgcttcatttttatcccttcatgcctttcaactccttttctgtgcatgyggccttaagtgattgacttttctgatttcttacaggatttcttctaatagctttgtgcagacatgcggtgccatcaacaaaaatggtcttcaagcctcaagctgtgaagttcctttacactgggtgtgtaagaaggtcagactttgatagatgaccactctgtcctgaccctcagatctgtcatgtatccctaaaaggagggagctggccactggctgttgggaaagccatgagtatatagttagcaaatactgaactttctcagatatggcattagatgcaagacaacctcctagggattgatgcctaactgatggattctctttgagactatttagatattatgtgagcaatttaaagaccagatytaagcaaattttgaaatagatgtttgttttttgtatttctcagtatggaaactaatgctgccactctcatccccgtcccaaccatctctgtcaaaaatatacctttttcatatgatattctgagctaatctgataaaatctatgccaatatatactattgcttgtgtactagagaagtacattattgctgtactcctctgtacattactgatccctgatggtatatttctatcctaacagtgtccctttgcagatcaagctttattctgaagaataaacctagctggcatgctggtgtgtacctgtagtcctagctatttgggaagctgaggtgggagggtcgcttgagcccrggagtttgaggctgcagtgagctatgattgtgccactgtactccagcctgggagatagagcaagactccatctctaaaaaaaaaaaaaaatgctaatgtgagaatataaattgtgggaaatgagtgagggcaaggtggtacttcctcyttctgagctcttcacacgtaatgcaaaaacccggtcttaaytgattttgttttttttctgagtatgcatatatgtggttgaatgaaccaatgtgtgattgtatcttttccattatgtgactgtttgacctgcatattaatttcaagatagcagtcaattcgataaggcattttcatagaggaaagtttacagaaacagtttatrtggttggatcaccaaattatcttaggtactaaggcctcaaaaataagaaaaactttattatttctcctcagtagagtttggacatacataaggagagaaggtacagtgatgaaggagrccataattctgtagtgttgatgatcctggattataatctttttctctttatctttcatagtttttttaaaaacatggactgtatcttatctaccactatatcccaaatacctaagatagtgcttaygttcagtgactattaaataaataaatggatgaattaaaaagtaagaatgaaaactgttcattctagttatttctgttagcccataaattagaggaattgaagatgagaaaaacagtatatcctaatcctccctaactcaccaatatgagtcttcagtagctaactctacaaaggcaaagggccagttaatctggatacaatgctcatagaaggaagtcgtggaaacaagctcccatcccctagtgatctcttccctttggttctggtgcaggaagtatcccttagttatgaatattttggtagtgactctcaattaaggatgtaatgatagcgattccatgtgggccatggcttggctactacagggtgcacaatttcatttacttattgaaagataagaaaaggagaactacagtcgggtcttaaattctcatctgagcaggcaggatgtgtgcagacctcctctgtgactagggttcaggccttttataaggattcatccacctattgtcagaattgggtgtagttcttcactgctttgtctcccttaaggttgttacaagagaagtaacagtttacttcctggttgcttatttattccttagacttatttatgaagggctggggtcagttagtaactcaattcttgcaccttacctagtgaaataaagtttggtaaaactagaaactaacattttttgattagcacttacattgcacagtggacttctttgatgaacattatacattaaacatatctgggacattcagtgtttggaataggacatttattaaagataataacagagcagtcacaaaattaaaatgaagaaaatccaggaacacacaggaggaggtggagcaagaacaagaagcctccactgatttttcccccgcaggaatacaaatggaacaattatccgcaaaagaaagcaccttcataagaaccaaaaatcagatgagcagtcacagtacctggttttaacatcatatcaacaaaagaggcactgacgaggacaggagagacagtcttgatttgccaatgccaccccttccccatctcccagcagcacagtgtggtgtggagagagagtctgtgctttggggaggaagagtgctgtgattatgggactttgcagtggaactcggtgcagctctgtcaaagcagatagcgacatgggacagaaatcagccagtgcccacagagggagcatttagaccagccctagccacaggggaatggcccatcccagtggtcggaacctgagtttctgctagtcccaccactgcggctaaaacactctgggatcctaaataaacttgaaaggcaatctaggctacaaggaccacagttcctgggcaagtcctggtgctatgctaggctcagagccagtggacttggagggaatgtgacctagtgaaacaccagctgggtggccaagggagtgcttgtgtaacccctcctccgaccccaggcagtggagcttgcagctctgggagagactccttccttccacctgaggagaggagatggaagagtaaagaggactttgtcctgcaatttggatacagctcagctacagaaggatagggcaccaccacgcagagtcctaaggtccctattctgggacctagtttctggatgatattttaagacccactctggaccagaaaggaatgtgctgccttgaaaggaaggacccagtccaggcaggattcatcacctgctgactaaagagccctttggccctgaataatcagcagcagtacccaggcagtgtttgccataggtattgggtgagatccagtgccatgcggcttccagtgtgacccagcacattgttagctatggtagccatggggagagacttcttctgcttgaggaaattagagggagtttggacatagataaggagagatttaacccaagactaatggggactctgtcttgcagcttaggtattagcttggctacagtggggtagagcaccaagtaagcacctggggtccttgattccaggctcctggacagcatttctggacctgccctgagtcagaggggagggagcccattgccctgaaggtagagacccaggcctggcagcattcaccataagcttactgaagagtccttgggccttgagggaacattagtgatagccaggtagtggttaccacaagccttgggcgagacccagtgctatgctggcttcaggtctgacctagtgcactccaagttgtggtggccactagggtacttgtgtcactattccccaagctccagatagctcagtatggagagagagactccatttctttggggaaaagtaacagaagataacaagaggctctgcctggtaatctagtaaattctcctgtatcatacccaagaccaccaaggtggtacttctataagtctgcaagagtcacagtgttactgggtttgtggtgcttcctaatgcagatatagctgcagtggccaaagacttagatcataacactcaattccctttgaatgcttggagagttttcccaagaaggatgggtacaaacaaacccagactgcaaagactataataaaaacctaactctttaatgaccagacacaaataaacatccacaagcatcaagaccatcgaggaaaacatgacctcaccaaatgaactaaataaggcaccaatgaccaatgccagaatgcagagatatgaccattcagacagagaatgtgaaatagctgtttagaggaagctcaatgaaattcaaggtaactgtgttagtccgttttcatccttctgataaagacatacctgagactgggcaatttactaaaaaaaaagaggtttagtggactcacagttccatgtggccggagaggcctcacaattatggtagaaggtgaaaggcacatctcacgtggcagcagacaagagaagagaacttgtgcagggaaactccccttcataagaccatcagatctcatgagacttattcactataatgagaatagcatgggaaagacccacccccatgattcaattacctcccaccaggtacctcccaccaggtccctcccacaacatgtgggaattgtgggagctataattcaagatgagatttgggtggggcatagccaaaccacatcaataacatagagaaggaattcagaatcctatcagaaaaacttaacaaagagaacaaaaatttaacaaaaataagtttgaaaaatcaagcagaaattctaaagctgaaaaattcagttgacttactgaagaatgcatcagagtctctcaacagcagaactgatcagttagaagaaggaagctcaaagacaggttgtttgaaaatatacaggcagaggagacaacagaaaaaagaatagaaaagaatgaagcatgcctacaagatggagaaaatagcctcaaaaggccaaatctaattgttttgaccttaaagaggaggtagagacagagactggggtagaaagtttattcaaagggataacaacagggaactctccaaacctagagaagaatatcactattcaagcacaagaaggttatagaacaccaagtagacttaactcaaataagactacatttaataattgaacttccaaaggtcaaggataaagaaaggatcctaaaagcagcaagaaaaaagaaacaaataacatacaaaggagctccaatatgtctgacagcagacttctcagtggaaaccttacaggtcaggagagagtggcatgatatatttaaagtgctgaaggaaaaaaacttttaccctagagtaatgtatccagtgaaaatatccttcaaacatgagggagaaataatgactttcccaaacaaacaaaagcagaaggatttagtcaacactagatctgttgtataagaaatgctaaagggggttcttcaatctgaaagaaaagaacataagatgcaataagaaatcatctgaaggtacaaaactcactggtaatagtaagtacacagacaaacagaatattataacactgtaattgtggtgcataaactactcatatcttgagtagaaagactaaaagattaaccaaaaaaaaaaaactaccacaactttttaagacatggacagtacaataacataaatagaaacaacaaaaagttaaaaagtggtggcatgaagttaaagtgtagagtttttatttgttttctctttgcttctttgtttattcaatcagtgttaagttgtcatcagtttaaaataatgggttataagatattatttgcaagccttatggtaacctcaaataaaaaaacatacaacagatacacaaaaaataaaaagcaagaaattaaaacataccgccagaggaaatcaccttcactaagaggaaaacaggaaggaaggaaagaaggaagagaagaccgcaaaacagcaagaagacatataacaaaatggcaggagtatgttttatcaataacaatattgaatgtaagtgaactaaattctccaatcaaaagacagagtggctgaatggataaaaacacaagacccaacaatctgtcacctacaagaaacacatttcacttataaaaacacaagtagactgaaaataaagggagggaaaaagatgttccatgccaatggagaccaaaaagagcaggactggctctatttacatcagacaaaatagatttcaagacaaaaattataaaaagagacaaggtctctttgaccttatgataaagatgtcaattcagcaagaggatataataattaattgtaaataaatatgcacctgacactggagcacccagatatataaagcaaatatcagagctaaagaaagagatagaccccaatgcaataatagctgaagatttcaacaccccactctcagcattagacatatcatccagacagaacatcaacaaagaaacatcagacttaatctgtcctatagaccaagtggacctaatagatatttacagaacattttatctaatggctgcagaatatgcgttcttctcctcagcatatggatcattctcaaggatagatcatatgtttggtcacaaaacaagtctttaaaagttcaaaaaaattgaaatcatgtcagttatcttctctgactataatggaaaaaaactagaagtcagtaacaagaggaactttgaaaactatataaacacatggaaattaaacagtatgttactgaatgacaggtgagccaatgaagaaattaagaaggaagttaaaaaacttctgaaaataaatgataatggaaacataataccaaaatctatgggatacaatgaaagcagtactaacagcaaagtttatacctaaaaccacctacataaaaaagtaaaaatgcctcaaatatacaacttaacaatgcgtcttaaagaactagaaaagcaagagcaaatcaaacccaaaattagtagaagaaaagaaataataaagatcagaggagaagtaaatgaaattgacatgaaaaaagatacaaaaggtcaatgaaaccacaagttggtttttttgaaaagataaaatcagcaaacctttagccatactacgtaagaaaaaaaagagagacgatccaaatgagtaaaatcagagataaaaaaaggagacattacaacaaatacagcagaaattcaaaggatgattagaggctactgcaagcaactatatgccaataaattgaaaaacctagaagaaatggataaattcctagacagataaaacctaccaagattgaaccgtgaagaaattcaaaacttgagcagaccaataacaggtaatgaggttgaagctgtaacaaaatgtctcccaggaaaataaagcccaggacccagtggcttcactgctgaaatttcccaaacatttagagaataactaataccaatcctactcaaattattatattttattttattttgagacagtgtcttgctttgttgcccaggctggagtgcagtggcacgatctcggcccactacaacctctgcctcctgggttcaagtgattcctcatgcctcagcctcctgtgtagctcagattacaggtg

SEQ ID NO: 17963 - DNA, 26512 bp, Homo sapiens
  misc_feature (1)...(26512): n = A,T,C or G, or insertion/deletion polymorphism (see Tables 1-2)
tcagggaaacatggaatcaaggcagaatcaaggagatctggagtggcccgagggccctgactgcagcctagggctcatctaagactagcctgaagttggtcagataggatggcttcttctctatcaagaggccaggtgctgatgaaaataacactggccaggggcagaatccaaatcctaattctgttgctcactttctgagtgtccttgcacaagtcactcctccatgggcctcagtttcttcatctggaagcaaagaaataggatgaacggttgccttctcttttccagcacctgtcaaggtgccctcgggttttttcatagtacacagatgcttccagcctttctctgtctgatcccagccctcccccaaccaaagctcttgacagagaaccccctgccctacagctaatcctctttcagtctcttagccttcttcaggggttgagcccagtctaccgagtctaggatccctgcatgcatgtgctcaagcacacatgcacacacacacgtacacacacccacacatgcatacacatgcacacatatccccccacacacccacatacacacacacacccacacacccacacatacacttacacgcatgcacacactgctttccaaatcagcttggagagacaggctgactcctttccctcttcctcaggcatcctctctggccacgataacagggtgagctgcctgggagtcacagctgacgggatggctgtggccacaggttcctgggacagcttcctcaaaatctggaactgaggaggctggagaaagggaagtggaaggcagtgaacacactcagcagccccctgcccgaccccatctcattcaggtgttctcttctatattccgggtgccattcccactaagctttctcctttgagggcagtggggagcatgggactgtgcctttgggaggcagcatcagggacacaggggcaaagaactgccccatctcctcccatggccttccctccccacagtcctcacagcctctcccttaatgagcaaggacaacctgcccctccccagccctttgcaggcccagcagacttgagtctgaggccccaggccctaggattcctcccccagagccactacctttgtccaggcctgggtggtatagggcgtttggccctgtgactatggctctggcaccactagggtcctggccctcttcttattcatgctttctcctttttctacctttttttctctcctaagacacctgcaataaagtgtagcaccctggtacatctgtgatgtttgccttctactctcttctgttccaaaaagacccaggtcccatttaagggcagtaatgtgttacaggtgctgtgataaaggctgggtactggatagcttgtgggcttatgggaggaggcctgagatgggtcagggggagaaggtattcagcaggtggctgggggactgtgtgcagcagttcgctatggcctgcctgtggtgcccatgtgtttgtacgggagggttagcttgagaaggaatcagattataaaaggtcttgaatgtcaagccagagagtccagactttttcctaagggcaatgagaagccattgaggagttctgagcagagtagtaacatgatcagttatgcttctcagaaagattgctccagatctttcagaaagaagcagtgtaggttgatgaaagggagggactggcactggggaaacaaggtaggaggcaggtggcaagaaatgcaagagcgacaggacagaggggttagggagagggattaggaagagattaaagatgtggaatcagctggaacagtggctcatgcctgtaatcgcagagccttggaaggctgaggcagaaggatctcttgaggtctggagtttgagacaagcctgagcaacatagtaagaccctgtatctacaaaaaaaattaaaaattacctgggcaggctgggcatggtggctcatgcctgtaatcccagcacttcaggaggctgaggcaggcagatcacttgagcctaggagtttgaaaccagcctgggcaatatggcaagacctcatctctataaaaaaaatacaaaaattagccaggcgtggtggctcatgcctataatcccagctactggagaggctgagacaggagaatcgcttgagctcaggaagttgaggctgcagtgagctgtgatcgtgccactgcactccagcctgggtgacaagagcaagaccctgcctctaaaaaacaagcaaacaaacaaaatgtggaatcaccaggatttagtgaccaaatgctaggatataggacattgggagggaaggattcgagataatggccaaggtttgggtttggtggctgggtagataatgctgtcattcacaaggatagggaagagggaatgaggaatagcttttgggggaagatcataaattcagttttagacaaactgactttgaagtacttataaagcagctggataaaggtcagggttagagagagagacctgaaagttaccagaatatagggaagtgatagctaaagccctagaagtaaacacccagggagagcagggccaaggacagagccatagggacaccatggttaaagggagatgtgcaaagaaggctcagagcatcagtgggctcaggccagggaacgcaagctctctaggccgccattctacacacagaaaactcggtgcaaggtttacatatacctttttaaagtaacatttaaaattacttcctttaatataaaagaaacacacaagacacaaagaaagcccaataaagctgtgagtcccagtttggtagctgaggaggagtctaagaaaacaagccattcctcagtatccctgggaaagaaggggtgagaggacacagatatcaccaggccctgggtgactgcattgctggggccatgcagggcctagctctccaccaagggaaagtgctgattttccttgtcatggtcctggccttgctcccatgctcgtcctccagttttcagaagtcgtccagttccaagaatggctccttcctttagttcactaacattttcacttaggggtgaaggccgcttaccctgaaaacggcagtgtatgagttggggggagttgctgttcagaagagggaagatctgggtaaaagggtctcccaccctctacgttggatatcctagtaacagcttgcactttctcttcctttacctgtcgtagtgtcagggtgccaggggagttgtcatcctgcaggatggtgaggggggatctccctagtaccttgctgctgtttggtttccatctattgcgcatagaacctggggtgggtaaggcgttaaagcaaggacccaaaactaggacttacagtttattcctcccacactcacccatggaccttatcccaaaacattatcctagtttatcttccctgcatcttgccttagattctgtacctgaagatctgggagtctcagggtcccttgagggcttgtcggagctctggctggccacaggggtttctgtgggctgtcttgcttcctccttggaaaacacctgtttggaggggaactcagtctggttccaaggtggcatctgttcctcaacagataactgggtacccagaggcaagtccaattcagaagataaaggtgcctctgggggcagaacaggctctgggggaagatttgatttagagtcttcagtttcaaatacttcactcagctgtttcaccagtgggcttggggggtctagaggaagaaagtgaagtgaacagtgaccttctgatacacaacattcagcaaggagcaaaacatacagaaacccaggactcatgcccaggagggtgagcaagtgggaagagagaaatcaaggaaatcaaggtgaaagggagcaattttttttttttttgagatggggcttgctctgtcccccaggctggagtgcagtggcgtgatcacagttcactgcagccttgaccttgtgggctcaagcaatcctcccacttcagcctcctgagtagctgggatcacaggcccatgccaccgtgcttttgtgtgtgtgtgtgtgtgtgttatgtgtgtgtattttttctagagatggggttttgccatgttgcctaggctggtcttgaactcctgggctcaagcgatctgaccaccccggccttccaacgtgctgggattacaggcatgagccaccgcacccaggctgggaacaaaatattgagataagagtgagatgggtccgaagcaggaggatagaggcccctttaaggaaccctgagagaatggcttcatggaccctacccaagaataatagatgacagcttcatcagcattccctgggcccaacgcttacctccactgctggtcttcataggtgtccgtgcaataccaagagtaggagagcggggatctgagtcctgggcatgtttaagaccctccagttgctcccctgctggtaggcctggctgtggagagctctccacctgtcaagaccataggctagaacaagtctgggccctgactcttctctcctctcctccccatattccaggaaggaattgccaaggccctcagatatccagcctaccccacacagattgagattgcagaaaataaggctaggataagggtggggtcatgacggctctctcaaaatcaggttaggaagagacccaagaattcagacattctctgcctttcccacgctggcccagagtacctggatgggagtgcgcaggatgccagcactaggtgaacgggggtccgccactcgagccagatgcttgttgtgcggcggaggccgcgctggtgtgactgggacgctcttggctgagcccatctcaaccaggagttgcagggtgggggcaagggccagcccgggacgaggagggaatgcctgtgagaagtgactcaggtctcagcccttatctcttccacgtcggaccttcaaccctaaaccaccctgtcttcccagtttccagtgaagaaacttcctggcgagggaccagaggcctctgcggagttaatgactgctgcagctgacaaaatggctcgttctgggcctgctgagccctctaacttatttattaaattattcaaatcacttaccgggccccaattccacctctggatgcacaacagctcgtggctcaactcccgaagttaccagtttcaaacttcccgccacgccccctgccctgaccctattggctgagccgacgtagttcccataggccctccacgtaagacccgcctcgagccaaaggaagctgttggtctgggagaacgtctatcatggtgactgtaggtgtcaatggactgatgctaggcttgcccaggggtgacgcctccttgataagggtacttctgttcagtatcggcctgcgagccgtccgtggcaggctgaggagtgccagtcttcgctttcgagacgtctagtctcaagaacgaattattaaacaaaatagaatcatgagtgattacactattatgcgcacatccagctggagttgtgatggttttcctgaggcgagcgatagtagctttattggttgacagctgtatcagtcactcgacacaaccccctcaagctccgcctcactggataccccctttacaaataccaagacaactgtccctcgactttccgaccggacaggtccccaggaaactttctggaattgagaggcctaaaacaaccgtcagttcctgctcttcaatagaaggcacgcgaatggactctaagggtcccggagccggagcagctgcggagccgcagcagctgcaaccccgaagcccacctagctgctctacgtgcgctcccgccctggaggagtgggattggttctttcaaccatcaattgccttaggagcgcttctcattggcgtcagtcaagcgcggggcaggggcggagcaccggcaggcaggctccgtccaactgccattctcgcgcgtcgtctccgcggcgcatgcccctaacgagtggcgctcattggacgggaggggcaggggaggggactgggaacggtgggagccgccgtgtgtggagaagctgctgccggtgtcatggcggagctgagtgaggaggcgctgctgtcagtattaccgacgatccgggtccctaaggctggagaccgggtccacaaagacgagtgcgccttctccttcgacacgccggtaagcccattccccacgcccgcaacgagcacgacttccttccatcgccctggtcattccgctggggcctgcaaggcttgggctaccgcctccctgcgatgcaccatgggacttgtagtctcccacgctccactctgccgttgcctttcattaactrcggctgtcgtgtgactaccgtccccggaagccgccgcgctcacctctccggctccccgcttcgtgragcactgtgggcattgtagtcactcactgccttcgttgccgttctaagctaggggcgcagcccgaccgtcggactacatcccccaagtggacccttgagaaaacctggcagtcggccttgtvtgccgcgcacggctctccgggttttgtagtctcgtgtaggagtgatggggacgactccccactgttctcggccggggttggagttggggggtggggaccgcagttcctaggcggttaatagtctgggagtggactctcaagaagtccgattctgagaaaggcagagagcctccaccccgtggttaaaacagacagggggcggggaggggaggaaagaggagaggaaagctctagtcgtttctcctttgaagtgagcaatggccgcagcccccacccttccccccgccccccagcctatcacagacagctgagataaccccttttaaagtattcctagagaggtggtttctttctcggaggatgctaaggcctctttcccatcccgctcccactcttggctagttacacaaagccacctcccacaccatgcttcacgttttgcaggctccacctggtacctcccttcctgcagttctgccttccctatgtcaccctcaagcsgaggccctttggggcctgaactgagaaggcagcagcttggttgggatccgcccccctcaccacccctcccctcaagctgctgtgccctgcccagtgtattctgccagaaccagctcatggcctgaaaactgcaagtcagagtggaaagccttcattactgcatcaccagtactgagtagaacagcatgatgtgaggcccagttcaggatcatcactgtgatttgtggtttgcttggtttgctaggctttgatctgggcctcagacaatgtgctgcttctctgaagtctggctttggcagaggtaaaagagcactgcgcggagcagagctccggggttcccaatccttggtgaaatcagcatctttaatttccaacagaggagtttaatcacttcagagctcccacattcttcccaggagggaaaggtttttcttaaattaccagcaggtggtagaagtcagtgggtccctctttacacttttattcactcctgtctctctccttagtaactgctttgaataatccaaaaagggtttttgtaatcttctgaaactttccctttttcaccccaagtcaagagattttcagtgtgccctagttctttgctaaccaacttccagcatatttggttaccttcaaattgggctcatggtagaaagagcttagttgacctccccrgtgagaaatgctctatttgttcatgaacttgcagtacacactgttcctaggaagtggtacagagcaatctatgggaccaagaactaccttagmcagtgcactatttttcatatcacagcagagaaatgttcaaggccactgagacttttattcctggaagaggatrtctgttgttgctcaaagccttggatctgagggaagacccttattgtctccaatttcctcctccaccttctccatcactctttacaaaggcactggaaaacttggtcagctttgggggaagcccatcctcccttctcagctgtgtttctgggtggacacccgtctgtccctgttttcacgggttatgtgtgttctagctatctcagcaagtgttgcgagattgttgtcagaacgggatggctttgagattggtgatttgttgggacttcagcagggatcttattggtcggaggggaggcagaggagagagggtggtggctatggaatgctggacttcatgaccctgccagactgggtgcatgtttagctgtgagtccctaacaagtcattgttcccctggaagccacacttcagcaggagaggagggagaagactcacagtgtggaccagggttcgactacctggtagaatgtggtaaaagaaaggtctttttcgctggatgtttagtctcaccgctgtaatcccagcactttgggaggccaaggtggaaggattgtttgaggccacacaagttaaagaccagcctaagcaacatagcgagaccccacctctaaaaaaaaaaaaaaaaaaaatctaggcatggtggcatgtgcctgtagtcccagctcctttggagactgaggcagaaggatcacttgagccggggaggttgaggctgcagtgagctatgatcgtgccactgcactccagcctgggtgacagagtgcagtgtctctaaaataaaattttttttttttttaaaggaaaggtaattttgcttgctggcacactcgggtcagatatactgttcaagtgctggaatctctgctcctctggtctggaaggttttctgaatcatggagatgagatagggtttgtcttaggtgtcccctggtttgggttcagtgtctcacatgaaagtctttcctctcccacgaagggaccctttttccctttgaatgtaatctccagcactggaagtccacagtatttgatccccatttactttctggatctgttagccccaggacagaggtgaaggaagtcctctgtgattgattaaagagctccaaagcccaagaaggagcaggtggaaagataaatggtgactggtgttgctgttgaatggcgacgatgagctggtgttcctcagccccctgatgtccttgttggttgttatcaaagtcatgggaggaaatggggagaatcttagctatgtcccaggtcctaaaaggctaaataacttgccaagggccacacagtgttagagaacagaacatttcttctggaacccagcagtttctgactccaggttttggtttcctcacctgaccaggcttcataacatcctcrtgttttcacccttacctcttgtcccacaggagtctgaggggggcctctacatctgtatgaacacgtttctgggctttgggaaacagtatgtggagagacatttcaataagaccggccagcgagtctacttgcacctccggcggacccggcgcccggtaggagcagggctggggcaaggcctgggtacattgtctgttccattctgacctcctattggactcagtttctttttttcacctacttttgtgtcattaaagcttggcacagatgttttttagctttattccgttctgagatgaagcactacctccttccgtccctcctcccgacttgttccttcgctcgtgctcattgctgatccagcccttcctgcttctttacagaaagaggaggaccctgctacaggcactggagacccaccccggaagaagcccacgcggctggctattggtgagcaccgctgcagtcctattcttctccctgagctggtctttctggctctcagcagcaccaggaaagccccaaagagtgggcctgattgatggccctagaactctggatggggcaagtgaggtgctggctcggaggagggacattgacctgttgtcattgctctactctccctcttcttccctatccttccaggtgttgaaggcggntttgaccttagcgaggagaagtttgaattagacgaggatgtgaagattgtcattttgccagattacctggagattgcccgggatggactggggggactgcctgacattgtcagagatcgggtatgactgccccctatgctacccaagattctagagcaagatgggccagggtagtggtgtcttaggcaagcactgacaaagctgaaggccaaggggaagaggggcatgtggggcagggggttgggtattgcctctgaccctctgcttcccccaggtgaccagtgcagtggaggccctactgtcggccgactcagcctcccgcaagcaggaggtgcaggcatgggatggggaagtacggcaggtgtctaagcatgccttcagcctcaagcagttggacaaccctgctcgaatccctccctggtgaggcctggcccctctgcctcgggcaccacccccagagcaaggacaaggagcccacttttctgggggatctggtgggagagagggtagggagcaggacaggaagggaagcttggaaatgaacamgacatggggatggccagaggagaagagagagagaccttggattggcggggggcctgcagagccctctctctctgccactccctcaaatccccgacccacatttctgctgattctcttctctgtgggttagtggctggaagtgctccaagtgtgacatgagagagaacctgtggctcaacctgactgatggctccatcctctgtgggcgacgctacttcgatggcagtgggggcaacaaccacgctgtggagcactaccgagagacaggctacccgttagctgtcaagctgggcaccatcacccctgatggagctggtacagcctcccctcctccagccactctcatgcttaaatatatttcatttgttagtaatttcgtgtgacatgtataatacatgaatgcattatcttgataagaaaggaaagtagtcaggtgcggtggctcatgtttgcaatcccaacactttgggaggccaaggcaggagaattgcttgagcctaggagttcgagaccagcctgggcaacatagtgagacctcatctctccaaaaaagaaaaaaaaagaaaaattggctgggtgtggtagctcctgcctgtagtctcacctactcaggaggctgaggcaggaggattgtttgagcacccgggaggttgaggctgcagtgagctatgattgcaccactggactccagcctgggctacagagaccctgtctcaaaaaaggaaaatactgcagatgagactaaatttttgattactccccactcaaatcctcatccctttcctaccaagcctgtcttaccttatcctatacaggtagaatcagaatcacaagtaattccaaccctcacccggtttcatctgtcttccctgaccgtcagccccagaagggccatgaccgcactcatattactcatattcaagggaaccaagagggtggaccttactggctctccttctgtcccctcaagtcccttctgtgcaagggatgggatggtggcctggctagtcctgagccacttcccctgattctcttcctgcctcctgctctagacgtgtactcatatgatgaggatgacatggtcctggaccccagcctggctgagcacctgtcccacttcggcatcgacatgctgaagatgcagaaggtgagacccccttcaacttcagattcttctacttcctgcccctgtgagggcccttcctctttgcctgaggctgaggtagggttttggagaaatcttctagttaaccccatccccaagatacacaggcttcttttaaatatctaaaatcatttattcagtgaatagtactgagtacctactatgtgctagaggctgtgtgaataagacagatgtggtttttgcttacaagagttctactctagaagaaaaggcagacattagtcacattcccagataaataagtgaatagttgcaaactggtgggcactgtgaaagagaggcggagggtactacagtaattgacagcagggtggcctggcctagtttagggatcagggacatttccctgaggaagcgatgcttaactgacaatgtgaaggaggttaggggtaacttaaggatgggaaaaacatttcaggtagaaggaaattttattcctcattcaagcagaggccctgatgactaacgggcctctgggacaattatgtgtggccttccagaacttgaactggacgatactcaacatacctcccatgtttgagcctgtaattccacaaattctaggccacagttgagtatcatcctagactcagtgagagatcgaggtaaaaactacagggttgagtttctcactcagtctgaagtgccccttctcacacagacagacaagacgatgactgagttggagatagacatgaaccagcggattggtgaatgggagctgatccaggagtcaggtgtgccactcaagcccctgtttgggcctggctacacaggcatccggaacctgggtaacagctgctacctcaactctgtggtccaggtgctcttcagcatccctgacttccagaggaagtgagtagtgccctctccttccccaggccccctcctggtcagcaccctctgggcatactcctccttcagcttccctcagcacctctgtgtttgattctagtcttagagtagttcctatcggctgggtgtgttggcccacacccgtaatcccagtacttcgggaggccaagatgggagaattgcttgagcccaggaggttgagaccagcctgggcaacatagcgagaccctgtcttctcttaaaaaaaaaaaagaataattcctgtcacactctggctgacatgctgtgaggggagcaagttagggagctgcaccaccagcaccccaacacacaaaccccactgatagtgcagagtgccaagtcccagggctctgtggccttctgacagactcaagggttagcaggtggtctttattttagggcagtgacatcagatgagcacctaacatggacatgtagcacttggggaggaggggggcttggcacactaagaataaaggcaggttctcagcagaaatgagtttactttcgaatttggggaacaattagaatgtgaatgctcagaacatgtcaacaggttctgtccaatagaacgtgaactgcacttatcctaatcccaggctaccttccccctccccggctcctctgccgccgagcgtgcttgcacattggacatagctgagaaggggagaacaggcaggttgctggagagaagcgactccaaggttcacccacagcaactccccactcttgaggggagcccgttcacagagttagtaaatgtttgcttccttcccttttcctcggcgctcaggccagagcccctccaactgtccttcccttgacttttaggtatgtggataagctggagaagatcttccagaatgccccgacggaccctacccaggatttcagcacccaggtgtatgtaaccaggtcctatgtaggaaagctgttgasagtcatggccgtataccttcctcctccctgaccgcctrgggggcacagcactttaacccctggcctttttttgttttgttttgttttgttttttgagacggagtcttgttctgttgccaggctggagtgcagtggcgcgatctcggctcactacaacctctgcctsctgggttcaagtgattctcctgcctcagtctcctgagtagctrggrctacaggcacatgccaccacgcccagctaaattttttttgtatttttagtagagacggggtttcatcatgttggccaggatggtctcgatctcctgacctcgtggtctgcccacctyggcctcccaaagtgctgggattacaggcgtgagccaccgtgcacggccaccactggcctattaggagcattcgggtgactgtcttctggacgtgttgtctgtcttgagctgggttcctgtagaatctaaggtttttcacgttgttgagagttagctagggagagccacgagcagggggttgagctggggacacacagggtcgttagttgactgaagtgaaatgttttcttggatattaatgcagggccaagctgggccatggccttctctccggggagtattccaagccagtaccggagtcgggcgatggggagcgggtgccagaacagaaggtgcgtctaggaccctgtccctttcaggccctgggattgtggggaagctgaggtctgggagatgtctaargaaggcccctggatggccactgagccccagctgagtccctgccctgactcttcccaggaagttcaagatggcattgcccctcggatgttcaaggccctcatcggcaagggccaccctgaattctccaccaaccggcagcaggatgcccaggagttcttccttcaccttatcaacatggtggaggtaagggctggcaagatggcacacccccatcttcctgcaatttactmgctctccttcctgcccatttctccctctrtcagccccaacccagtcccatccctgaaccccaacagtctgtgtccctgtgaacagtgcttgcacctgaggaggacagtgaaggtgatgatccctacccttgatgggcttgaagcccaattcagattatgcccaaagacaatgataagagaatacttgctgcttataaagaaaaatacaagcgtgttctaacacagtccctcagtgcagggatggggccagaaatggggaggggttggtgaattagggaaggtttctgctctgctcttgtgtccctgagttccgagtggtagtctgccttctctccctgactctcccatgaacctttcaggccccattctgttccctggctgcccagacctccctaccctgcctctttcccatagaggaattgccggagctctgaaaatcctaatgaagtgttccgcttcttggtggaggaaaagatcaagtgcctggccacagagaaggtgaagtacacccagcgagttgactacatcatgcagctgyctgtgcccatggatgcagcccttaacaaaggtaggctgctccatcagcaaggccgtggcacggtgggaggctaaggtctaggaggaatgcttgggcacctcatgggagcacagcccagggaatgccctgcttcaccagccaaggttccagtctgggccaccaggagtaggtagattaacctcgtccagtggacactcagcttgttagcagagctgcatggaaacaggcgagatatattggacatgtgtcaggggtgctttggaagggtagaggaactgaaatacggacacagagccagtagggagaggctaaggaggcaaagaagcagcaccctccgaaggatccaccaacccattctgtcaccagaggagcttctggagtacgaggagaagaagcggcaagccgaagaggagaagatggcactgccagaactggttcgggcccaggtgcccttcagctcttgcctggaggcctacggggcccctgagcaggtcgatgacttctggagcacggccctgcaggccaagtcagtagctgtcaagtaagtcctctggtcggggcctgaggctgtgggtctatggcagagctatcccagaggatacttctgtctcttccctgttctttcatccctttgtggttggaacctcagggttgaatcagttgggctggtaatctggccctgatggaaccaaggggccctggtaggggggacacgggtactgactctatctgtcaccttgtcctgccccaaccactccctcttctgtggcacagggtctctttgtagtgtagcctctcttcattgcccctcagtcatggctgagcacaggcacttaggatcagctgtgggcagaatttggatttccagcaaatagccacactttgagcctagccattggcacctggcatgggtgtgagacctgaaaaagggctttggtctcggggagtcagctacccagccctttgctgctcctgccagtgaaacagctcttcctctctgtgtgggttttttttttttttctatgtgtgggtcttgctatgtttttttccctacgtgtgggtcttgctatgttgcccaggttggtctcttaactcctgggctcaagcagtcgtcctgccttggcctcccaaagtgctggaattacagatatgagccaccatgcctgggcttttttctttttcttttttttgttgacagccttccttctggcctctactgctcctcgttggccgaggacaggcatcagacacctgcccaggggaagagaagaatatggaggatcttctgggttattgggacttctacccatgaggggctgaaccccaggtgggagtttcaggagaggaaaaccctggggattgtctgggtaccagcacagtctctcttccctaggaccacacgatttgcctcattccctgactacctggtcatccagatcaagaagttcaccttcggcttagactgggtgcccaagaaactgggtatggctgctggaatgagggaggttacacagaaaatgctagaaaaagaaggggctttaacacatataaactagtgtttctcmaagtttcctctsaaagaggaaaaaaaatcaccttcaatgtttcaaaatttatctagtttgaaagcactaactaaaaatattaaaagacttctttgattgttataggtatgatttacaaccaaaagtgatttttgtagttttttaaaataattggtaaaatgttttcattttgataatcttgaaacaattaattctcgtgagtcttacaggtccctgactgtcatttgagaactcgtgatgtaccttcattttctagataaggaagttgagactcacaggaatataaaatcattctgtctcacaagttctaggccccctgccctgtccatagattatttatggtagatctaggaccagcatcctggcctcccaactcccaggcttagtattatttgtcttatactgggacccctaagatgggtgccgtgcttttagyagctcctctttacagagcagttctgacatagggggcaggggattgaggttcccgaatcactttccaggtaggcctccgggagctgctgaggtgacccttttcccacagatgtgtccatcgagatgccagaggagctcgacatctcccagttgaggggcacagggctgcagccyggagaggaggagctgccagacattgccccacccctggtcactccggatgagcccaaaggtagccttggtttctatggcaacgaagacgaagactccttctgctcccctcacttctcctctccgacatgttagtgactcttcttcctgcctgtctctctcccgtgctgatgggggcctctctgccttgcatcccctgcccctgtcctttgtgtttctcctgtcctccctttcaaatttcctctgccctctttgattgacatggggcctccccagcgcactcctagccaccttctgggtgtggatggcagcagtgccagctagtggcctctctgcccttgttacctccctggtttgggtagggtgggggtatcatgctccagaaacagggcccattctgtgagaatgggcagggacccacattacaattgtgtggtcattttggttttgggataaggtgccaatccatgggagaaaaatgcatggaatgggtgattggaagagggctgggtcctgggggagggaggaggagcaaacagtggcccaatcagtckgtccgtgtacccacaattcccattacagcgcccatgctggatgaatcagtcatcatccagctggtggagatgggattccctatggacgcctgccgcaaagctgtctactacacgggcaacagyggggctgaggccgccatgaactgggtcatgtcacacatggatgatccaggtaggctggggtggggagcagggtggggcagggcctccatcctcccccaaacacatcaaccccttcacatccacagattttgcaaaccccctcatcctgcctggctctagtgggccgggctccacaagcgcagcagccgacccccctcctgaggactgtgtgaccaccattgtctccatgggcttctcccgggaccaggccttgaaagcgctgcgggccacggtatgggctgccccagctaaggacatggggccagtggggaagaagggggtgggaatgaggggccatccttcttgagcaagaccaaagacaacaggtgtggtctggccgaggttgggcaccactcttttgtggctgcgatgaaggagctgaagcctgcgttcactgctgggttttttgccccagaacttgttaaaaatgtaatgcttctgtttggccgggcgcggtggctcacgcctgtaatcccagcactttgggagggtgmggtgggcggatcacgmggtcagcagatcargaccatcctggctaacacggtgaaaccccgtctctacgaaaaatacaaaaaattaaccaagcgtggtggygggcgtctgtagtcccagctactwgggaggctgaggcaggagaawggcgtgaacccgggaggcggagcttgcagtgagccgagatcrcgccactgcactccagcctgggcgacagagcaagactccgtctcaagaaaaaaagtaatgcttccttcctctccaagaacaatagtttagaacgggctgtggactggatcttcagtcacattgacgacctggatgctgaagctgccatggacatctcagagggccgctcagctgccgactccatctctgagtctgtgccagtgggacctaaagtccgggatggtcctggaagtgagtatccccaggaagcaggacaggcctggtggaatctggtcagtctactacaccagatccctcattcaggcagctctgccctcctcaggagtcaggggcttctttccacctcaacgtggcatctgagggtggggttctctgacatggagacaggctctggcccagtacctgcctcacattccctgaaactcctgtcctgagtctgagctgttgtctggatctttgggccatcactcaagcmttcctcttctgtttccttctctgaccccctctctcctttcctagagtatcagctctttgccttcattagtcacatgggcacctctaccatgtgtggtcactacgtctgccacatcaagaaagaaggcaggtgagtgctggccacatgcgttttgaatggagaatggtggtgggaatgaggagggccatttggaagtccttgggatagctatgggagaaggtgaagggactgcctgatggggacataaagtgccagagagtgacagaaggtcttgcagcagtgattggcccaagggttggatctggccaccagctttttttttaaatagagatgggatctcactatgttgcccaggctggtcttgaactcctgagctcaagtgatccttctgcctcggcctcccaaagtgctaggattacaggcatgagctaccgtgcctggccaggccccctgcctttgtaaataaattttcactggaacctggacacacttgtttatgtgttgtttgtgcctgttttcacgctgcggcaggaaagttgagtcgttgtgtcagagaccagagagagagcctgcagaacctcaaatactatctggcccttgccagaaaaagtttaccaaccccctgcctccctggaatgggtggagggtggttgtaaaggtactggaggatctgaagacataatagggtcygtgacccttgtgaggttgtgaagctcccttaaggcacatggtggctgggctgtggatttggggtatgggcagagagtgtggagagcacttccaggggccatgtctgagagactacatgatgccactttgaatgcccagtttgttcatccttttctgttttccccacttccccagatgggtgatctacaatgaccagaaagtgtgtgcctccgagaagccgcccaaggacctgggctacatctacttctaccagagagtggccagctaagagcctgcctcaccccttaccaatgagggcaggggaagaccacctggcatgagggagaggggctgagggatggacttcagcccctctgctctgtaccctttttccttttgtccccggcagcagggaagaagctggaggccgtgggagaatggctgggcagagcagaggggcagcgatagactctggggatggagcaggacggggacgggaggggccggccacctgtctgtaaggagactttgttgcttcccctgcccccggaatycacagtgctctgcttctctgtgtcgccccgcccagccccctggtgtggagggaggggtctcgtttgtgcgcgtgggtgtagctttgtgcatcctctcccagtggagcgatcacctgtgcctcccctccccctttgtttgcccctgtgtggttggtcaaggagggatgtgagggaaatagggaccccccgacttgccctcctgcctcagtctttcccccaccctgtctcttccttgtccttctctggaaaatgccaaaatacacgatgtgaataaaagtacaacggctaaattgtgtcctgtttgataccttgggggagaggcttaccttcctggggttagcaggagggcgcttaagaaaactcctaactctggccgcctccctgccaaagtcaagtctccacttttcactggttctagagctctaggaaaattggggttgggtggggaggtggagtagagtgactaaatgccgacacaaagccaaggaaagatggagtgaagaacccttccctctctttattcacacaggagtggaggatttcccaaatgtccctaactggctagctggcttcaggctgggactcagtccctgcagttcctgccaggccttgccagccggggcgagggttgggatgatcctggcggcctatgcctgtgtgggctgcccctcccgctgtgaaccctgcatttgtcccgcaagttttcactcaggtagactccctgggtacaagggtgcctgctcagcagtcgggcatgagctgctccgatgggcgaaggaggttgtctatcccacagttggagaggggccctctctgccccagtgggcgatctgggctacggccaagttgccaccagctagttccgcttgaaaaccacttctggccccgtgggggactcaagtcgccaagcgagggttcccctgagcgccggagctcacaggtctcgccttgtcccgaaagccccgcaatcgaggcggaggcgaccgagcccccgactctcctagaacgttgccacaagaagggggaacgtcggaacagtgcatcatcgggcggcggccggggcggcggcaggagggcgggcggggggcagggctccgggggactgggcgggccatggcggaggacggcgaggaggcggagttccacttcgcggcgctctatataagtgggcagtggccgcgactgcgcgcagacactgaccttcagcgcctcggctccagcgccatggcgccctccaggaagttcttcgttgggggaaactggaagatgaacgggcggaagcagagtctgggggagctcatcggcactctgaacgcggccaaggtgccggccgacaccggtaagccctcgccgaggaggggtctggccgggccggggccggggccggggcaggagtggcagcgccctctcccgaggccccgaggccccgaggccggtatccgcgcggacctgatgcagggctgtgggacgagggccgctggggtccgggcaggggcctcgcagccgcagccccgtcggtgcgtcgagggggcagggcggagcacatgatgccccttggactatggggcaggtaaggacgttttgggtctcctggaggaaggtggccccggggcgcgcactggggctgtgcccgccaggcgacggggttaggagcggagcccgaggctctgcgggagaccgggggaggctgggccgcgtgggcttcccgctccctgcgccctggcctcccgcgccgtgcgccgccgcacgtagccccagactcctccccttcctcgccggcgtccgcgtccccgcgccgagctgctcgggctccctgagcccccagatctgaccccttcccttcggcaacctgaacgactcccgccttccacggaagggaccgagcccgtgccaaacaggctgagcgatttgggagtgaggagccatcctaccgctttccccaacctggaaacagcaaagcgcaaggcctctgagtcagttaggtctctgccacccacgggcaaaggatgctctcctccatcctccttcctccctccaccgaaatcggagagccgcgggcctgatccaaagaggcatccccttctcgttcattccccagaggcctcaatacaaaccccaggagttggcccctctccttttgctacaaatccttgccttgcaaaggggaggtgaggatgggctattttagaagggaagcagggttgctccctggagaatgctgagtctgtgaggtgcctatgccgagaatagctcgaggaaattggagccccagctgttaaaagagcagagggcagggtgagggccgtggcctctcaggggtatctggaaggctcttcgagttgagtgcagacccagcctgggctggaaaatggacaaaggtcatcttgctggggtgaaaagggggagagcagaaccaagaagaagagggtgagggctggggggctccagggcactggttaggaattgtggggaatgaaggctttctttagtctcatccccctgtggtaccatcttgtcctcagaggtggtttgtgctccccctactgcctatatcgacttcgcccggcagaagctagatcccaagattgctgtggctgcgcagaactgctacaaagtgactaatggggcttttactggggagatcaggtgagatcgaggtggagaggggtgtgtgggacccttccctcactttcctcgttgaggggaaagccacagggtgggctccctgctgaaccttggcttcatctcttcctttagccctggcatgatcaaagactgcggagccacgtgggtggtcctggggcactcagagagaaggcatgtctttggggagtcagatgaggttagtagccaagagagaagataagggatgtctttttccaagaaggatgtctcaccaagtctgtttctcaacagctgattgggcagaaagtggcccatgctctggcagagggactcggagtaatcgcctgcattggggagaagctagatgaaagggaagctggcatcactgagaaggttgttttcgagcagacaaaggtcatcgcaggtatctctggagaaagggacctttgagcctatccagggccacagagactcagagggtagggtcaggccctggagcctgtcttggtccccatgctgatccagaaaaggaaaaaggggagggggagtgacaatctttgcttggggcctatgacttctccagccccaaggtagatgccacctggaaatcccccaatgtccactagggggcagtaggccaccgttcttcgtactccggagaacctggctggagagctctttcttgttcacccttccctccatctgtatctctgccctgcagataacgtgaaggactggagcaaggtcgtcctggcctatgagcctgtgtgggccattggtactggcaagactgcaacaccccaacaggtaaccgggcccaggagccctgccctcatcccagcctgcctcaataggtttggacagacacagcccacatggggcaaccccttatttcaaagacacagagaccttgaacccagagacagtgacttgtccaagggcatccagtccagggcctggcttggatcagagccctggtactctgactcagtcagaaaccacactaagtgtccactggtgccagtgatttttcctcttagagaggcagaaaaggtcttacttaggccagcttcttgttctaggcccaggaagtacacgagaagctccgaggatggctgaagtccaacgtctctgatgcggtggctcagagcacccgtatcatttatggaggtgagtggctttggttcccggctgaggtggagtgggctgaggactagactgagccctcggacatggaggtggggatggggcagactcatcccattcttgaccaagcccttgttctgctcccttcccaggctctgtgactggggcaacctgcaaggagctggccagccagcctgatgtggatggcttccttgtgggtggtgcttccctcaagcccgaattcgtggacatcatcaatgccaaacaatgagccccatccatcttccctacccttcctgccaagccagggactaagcagcccagaagcccagtaactgccctttccctgcatatgcttctgatggtgtcatctgctccttcctgtggcctcatccaaactgtatcttcctttactgtttatatcttcaccctgtaatggttgggaccaggccaatcccttctccacttactataatggttggaactaaacgtcaccaaggtggcttctccttggctgagagatggaaggcgtggtgggatttgctcctgggttccctaggccctagtgagggcagaagagaaaccatcctctcccttcttacaccgtgaggccaagatcccctcagaaggcaggagtgctgccctctcccatggtgcccgtgcctctgtgctgtgtatgtgaaccacccatgtgagggaataaacctggcactaggtcttgtggtttgtctgccttcactggacttgcccagataatcttcctttttgaggcagctatataaatgatcatttgtgcaagaaaaaaaaaaaaacaagaacaggtttctataacaacatctcttactatttttacttgaaaaaatgttttgcgtagcagactgtcatagccttgaacgccggctccctttcttcctccctccaagtggctctggggctgttgatttccgcagagcttgggttggggtaggggctcagcctcaccagctttcagcagctggtctaggccagcagtgcctccccacctccccaaggggaggggtggtggcaagacctcagcacagtctgtggtatcacagggctcactggtagagcaggtagcgcttcatggcagggggcaagggcagggcagacacctggccgagccgggtatcccccaggttgtggcgcacacacaggcggctcaggtgcagaagggagtgtggctccgctgggagagagaaggaggggaatgtaagtatgggtgcagccaccagccagatgtcctcaaactacggggtcctactcagatgcctttctgctttcctgcttcgagtgtgcccacctggctgaaaggggaatttgagatacccggaagttctgcctcccagataagatttcacacatccctagtcagagctgggggtgaagagctggctaaggccctctaaacaacaggccaaggtggctctgacagtggtggagctggcccaggctttgactccagaggcttgggagctggggctgaggtgaggagggatggccctccactctacagcccacacaactgcagagagcagctccaagccctggacccagtcagttcctggggaggctcctcccctgctgccccaccctaaggccctgcctcctccactgctctcctccctggtgcccagggccccagtgtctccatcctgaggtgtggctgaggaaggaagtaggtatgtggcacagagacaggttagagcccagggaatccggtatacagcctgggtacctggctctgcccatccttcttttggacctgtacatcaaacccagtacctaacgctttgcacctcttgctcaggggttgatatctcctgaattctctcatccctgcagttcctccctccattctgaaggttcaccatttactggccaagagaacttgagaaagttgctttctcaagcctgtttcacctctattgctgttgggttaaattaaataacagctgtgaagacccctagcctttcccagcactgaacagaggttgaggcaggctggatgaaggtccatcccctctgctcttgtcagaagagtttccatcccaaaccactgccaccagggacagaaagttctccccacgtctgccccaggcctcacctctcctttcgcccaggtagcggatgcggacctggcactggccccagacagcgcttactgccggatagagggtcctgcccttcagtccgcggaatgctggccccaggtaggtgcccccaatagcgtagcccagagttccctcctccatgtccagaaccaccagcagtctctctggcacctccagctgctcaccctgagttcccgctggatactggggggctccgggccccttgctctgatggtacagcttcccccgcccgatgtcccagccccacgactcgctgttgctgcccagcagcgccgcgtagtggtcagtctgcagcggggcgagggccgtggccacgcccaccacggcatgcgtgcccctctgctctaggggccagctgatctccc

SEQ ID NO: 17964 - DNA, 15511 bp, Homo sapiens
cagcctctagcacatagtaggtactcagtactattcactgaataaatgattttagatatttaaaagaagcctgtgtatcttggggatggggttaactagaagatttctccaaaaccctacctcagcctcaggcaaagaggaagggccctcacaggggcaggaagtagaagaatctgaagttgaagggggtctcaccttctgcatcttcagcatgtcgatgccgaagtgggacaggtgctcagccaggctggggtccaggaccatgtcatcctcatcatatgagtacacgtctagagcaggaggcaggaagagaatcaggggaagtggctcaggactagccaggccaccatcccatcccttgcacagaagggacttgaggggacagaaggagagccagtaaggtccaccctcttggttcccttgaatatgagtaatatgagtgcggtcatggcccttctggggctgacggtcagggaagacagatgaaaccgggtgagggttggaattacttgtgattctgattctacctgtataggataaggtaagacaggcttggtaggaaagggatgaggatttgagtggggagtaatcaaaaatttagtctcatctgcagtattttccttttttgagacagggtctctgtagcccaggctggagtccagtggtgcaatcatagctcactgcagcctcaacctcccgggtgctcaaacaatcctcctgcctcagcctcctgagtaggtgagactacaggcaggagctaccacacccagccaatttttctttttttttcttttttggagagatgaggtctcactatgttgcccaggctggtctcgaactcctaggctcaagcaattctcctgccttggcctcccaaagtgttgggattgcaaacatgagccaccgcacctgactactttcctttcttatcaagataatgcattcatgtattatacatgtcacacgaaattactaacaaatgaaatatatttaagcatgagagtggctggaggaggggaggctgtaccagctccatcaggggtgatggtgcccagcttgacagctaacgggtagcctgtctctcggtagtgctccacagcgtggttgttgcccccactgccatcgaagtagcgtcgcccacagaggatggagccatcagtcaggttgagccacaggttctctctcatgtcacacttggagcacttccagccactaacccacagagaagagaatcagcagaaatgtgggtcggggatttgagggagtggcagagagagagggctctgcaggccccccgccaatccaaggtctctctctcttctcctctggccatccccatgtcgtgttcatttccaagcttcccttcctgtcctgctccctaccctctctcccaccagatcccccagaaaagtgggctccttgtccttgctctgggggtggtgcccgaggcagaggggccaggcctcaccagggagggattcgagcagggttgtccaactgcttgaggctgaaggcatgcttagacacctgccgtacttccccatcccatgcctgcacctcctgcttgcgggaggctgagtcggccgacagtagggcctccactgcactggtcacctgggggaagcagagggtcagaggcaatacccaaccccctgccccacatgcccctcttccccttggccttcagctttgtcagtgcttgcctaagacaccactaccctggcccatcttgctctagaatcttgggtagcatagggggcagtcatacccgatctctgacaatgtcaggcagtccccccagtccatcccgggcaatctccaggtaatctggcaaaatgacaatcttcacatcctcgtctaattcaaacttctcctcgctaaggtcaaacccgccttcaacacctggaaggatagggaagaagagggagagtagagcaatgacaacaggtcaatgtccctcctccgagccagcacctcacttgccccatccagagttctagggccatcaatcaggcccactctttggggctttcctggtgctgctgagagccagaaagaccagctcagggagaagaataggactgcagcggtgctcaccaatagccagccgcgtgggcttcttccggggtgggtctccagtgcctgtagcagggtcctcctctttctgtaaagaagcaggaagggctggatcagcaatgagcacgagcgaaggaacaagtcgggaggagggacggaaggaggtagtgcttcatctcagaacggaataaagctaaaaaacatctgtgccaagctttaatgacacaaaagtaggtgaaaaaaagaaactgagtccaataggaggtcagaatggaacagacaatgtacccaggccttgccccagccctgctcctaccgggcgccgggtccgccggaggtgcaagtagactcgctggccggtcttattgaaatgtctctccacatactgtttcccaaagcccagaaacgtgttcatacagatgtagaggcccccctcagactcctgtgggacaagaggtaagggtgaaaacacgaggatgttatgaagcctggtcaggtgaggaaaccaaaacctggagtcagaaactgctgggttccagaagaaatgttctgttctctaacactgtgtggcccttggcaagttatttagccttttaggacctgggacatagctaagattctccccatttcctcccatgactttgataacaaccaacaaggacatcagggggctgaggaacaccagctcatcgtcgccattcaacagcaacaccagtcaccatttatctttccacctgctccttcttgggctttggagctctttaatcaatcacagaggacttccttcacctctgtcctggggctaacagatccagaaagtaaatggggatcaaatactgtggacttccagtgctggagattacattcaaagggaaaaagggtcccttcgtgggagaggaaagactttcatgtgagacactgaacccaaaccaggggacacctaagacaaaccctatctcatctccatgattcagaaaaccttccagaccagaggagcagagattccagcacttgaacagtatatctgacccgagtgtgccagcaagcaaaattacctttcctttaaaaaaaaaaaaaattttattttagagacactgcactctgtcacccaggctggagtgcagtggcacgatcatagctcactgcagcctcaacctccccggctcaagtgatccttctgcctcagtctccaaaggagctgggactacaggcacatgccaccatgcctagattttttttttttttttttttagaggtggggtctcgctatgttgcttaggctggtctttaacttgtgtggcctcaaacaatccttccaccttggcctcccaaagtgctgggattacagcggtgagactaaacatccagcgaaaaagacctttcttttaccacattctaccaggtagtcgaaccctggtccacactgtgagtcttctccctcctctcctgctgaagtgtggcttccaggggaacaatgacttgttagggactcacagctaaacatgcacccagtctggcagggtcatgaagtccagcattccatagccaccaccctctctcctctgcctcccctccgaccaataagatccctgctgaagtcccaacaaatcaccaatctcaaagccatcccgttctgacaacaatctcgcaacacttgctgagatagctagaacacacataacccgtgaaaacagggacagacgggtgtccacccagaaacacagctgagaagggaggatgggcttcccccaaagctgaccaagttttccagtgcctttgtaaagagtgatggagaaggtggaggaggaaattggagacaataagggtcttccctcagatccaaggctttgagcaacaacagacatcctcttccaggaataaaagtctcagtggccttgaacatttctctgctgtgatatgaaaaatagtgcactgtctaaggtagttcttggtcccatagattgctctgtaccacttcctaggaacagtgtgtactgcaagttcatgaacaaatagagcatttctcaccggggaggtcaactaagctctttctaccatgagcccaatttgaaggtaaccaaatatgctggaagttggttagcaaagaactagggcacactgaaaatctcttgacttggggtgaaaaagggaaagtttcagaagattacaaaaaccctttttggattattcaaagcagttactaaggagagagacaggagtgaataaaagtgtaaagagggacccactgacttctaccacctgctggtaatttaagaaaaacctttccctcctgggaagaatgtgggagctctgaagtgattaaactcctctgttggaaattaaagatgctgatttcaccaaggattgggaaccccggagctctgctccgcgcagtgctcttttacctctgccaaagccagacttcagagaagcagcacattgtctgaggcccagatcaaagcctagcaaaccaagcaaaccacaaatcacagtgatgatcctgaactgggcctcacatcatgctgttctactcagtactggtgatgcagtaatgaaggctttccactctgacttgcagttttcaggccatgagctggttctggcagaatacactgggcagggcacagcagcttgaggggaggggtggtgaggggggcggatcccaaccaagctgctgccttctcagttcaggccccaaagggcctccgcttgagggtgacatagggaaggcagaactgcaggaagggaggtaccaggtggagcctgcaaaacgtgaagcatggtgtgggaggtggctttgtgtaactagccaagagtgggagcgggatgggaaagaggccttagcatcctccgagaaagaaaccacctctctaggaatactttaaaaggggttatctcagctgtctgtgataggctggggggcggggggaagggtgggggctgcggccattgctcacttcaaaggagaaacgactagagctttcctctcctctttcctcccctccccgccccctgtctgttttaaccacggggtggaggctctctgcctttctcagaatcggacttcttgagagtccactcccagactattaaccgcctaggaactgcggtccccaccccccaactccaaccccggccgagaacagtggggagtcgtccccatcactcctacacgagactacaaaacccggagagccgtgcgcggcagacaaggccgactgccaggttttctcaagggtccacttgggggatgtagtccgacggtcgggctgcgcccctagcttagaacggcaacgaaggcagtgagtgactacaatgcccacagtgctccacgaagcggggagccggagaggtgagcgcggcggcttccggggacggtagtcacacgacagccgcagttaatgaaaggcaacggcagagtggagcgtgggagactacaagtcccatggtgcatcgcagggaggcggtagcccaagccttgcaggccccagcggaatgaccagggcgatggaaggaagtcgtgctcgttgcgggcgtggggaatgggcttaccggcgtgtcgaaggagaaggcgcactcgtctttgtggacccggtctccagccttagggacccggatcgtcggtaatactgacagcagcgcctcctcactcagctccgccatgacaccggcagcagcttctccacacacggcggctcccaccgttcccagtcccctcccctgcccctcccgtccaatgagcgccactcgttaggggcatgcgccgcggagacgacgcgcgagaatggcagttggacggagcctgcctgccggtgctccgcccctgccccgcgcttgactgacgccaatgagaagcgctcctaaggcaattgatggttgaaagaaccaatcccactcctccagggcgggagcgcacgtagagcagctaggtgggcttcggggttgcagctgctgcggctccgcagctgctccggctccgggayccttagagtccattcgcgtgccttctattgaagagcaggaactgacggttgttttaggcctctcaattccagaaagtttcctggggacctgtccggtcggaaagtcgagggacagttgtcttggtatttgwaaagggggtatccagtgaggcggagcttgagggggttgtgtcgagtgactgatacagctgtcaaccaataaagctactatcgctcgcctcaggaaaaccatcacaactccagctggatgtgcgcataatagtgtaatcactcatgattctattttgtttaataattcgttcttgagactagacgtctcgaaagcgaagactggcactcctcagcctgccacggacggctcgcaggccgatactgaacagaagtacccttatcaaggaggcgtcacccctgggcaagcctagcatcagtccattgacacctacagtcaccatgatagacgttctcccagaccaacagcttcctttggctcgaggcgggtcttacgtggagggcctatgggaactacgtcggctcagccaatagggtcagggcagggggcgtggcgggaagtttgaaactggtaacttcgggagttgagccacgagctgttgtgcatccagaggtggaattggggcccggtaagtgatttgaataatttaataaataagttagagggctcagcaggcccagaacgagccattttgtcagctgcagcagtcattaactccgcagaggcctctggtccctcgccaggaagtttcttcactggaaactgggaagacagggtggtttagggttgaaggtccgacgtggaagagataagggctgagacctgagtcacttctcacaggcattccctcctcgtcccgggctggcccttgcccccaccctgcaactcctggttgagatgggctcagccaagagcgtcccagtcacaccagcgcggcctccgccgcacaacaagcatctggctcgagtggcggacccccgttcacctagtgctggcatcctgcgcactcccatccaggtactctgggccagcgtgggaaaggcagagaatgtctgaattcttgggtctcttcctaacctgattttgagagagccgtcatgaccccacccttatcctagccttattttctgcaatctcaatctgtgtgrggtaggctggatatctgagggccttggcaattccttcctggaatatggggaggagaggagagaagagtcagggcccagactygttctagcctatggtcttgacaggtggagagctctccacagccaggcctaccagcaggggagcaactggagggtcttaaacatgcccaggactcagatccccgctctcctactcttggtattgcacggacacctatgaagaccagcagtggaggtaagcgttgggcccagggaatgctgatgaagctgtcatctattattcttgggtagggtccatgaagccattctctcagggttccttaaaggggcctctatcctcctgcttcggacccatctcactcttatctcaatattttgttcccagcctgggtgcggtggctcatgcctgtaatcccagcacgttggaaggccggggtggtcagatcgcttgagcccaggagttcaagaccagcctaggcaacatggcaaaaccccatctctagaaaaaatacacacacataacacacacacacacacacacaaaagcacggtggcatgggcctgtgatcccagctactcaggaggctgaagtgggaggattgcttgagcccacaaggtcaaggctgcagtgaactgtgatcacgccactgcactccagcctgggggacagagcaagccccatctcaaaaaaaaaaaaaattgctccctttcaccttgatttccttgatttctctcttcccacttgctcaccctcctgggcatgagtcctgggtttctgtatgttttgctccttgctgaatgttgtgtatcagaaggtcactgttcacttcactttcttcctctagaccccccaagcccactggtgaaacagctgagtgaagtatttgaaactgaagactctaaatcaaatcttcccccagagcctgttctgcccccagaggcacctttatcttctgaattggacttgcctctgggtacccagttatctgttgaggaacagatgccaccttggaaccagactgagttcccctccaaacaggtgttttccaaggaggaagcaagacagcccacagaaacccctgtggccagccagagctccgacaagccctcaagggaccctgagactcccagatcttcaggtacagaatctaaggcaagatgcagggaagataaactaggataatgttttgggataaggtccatgggtgagtgtgggaggaataaactgtaagtcctagttttgggtccttgctttaacgccttacccaccccaggttctatgcgcaatagatggaaaccaaacagcagcaaggtactagggagatcccccctcaccatcctgcaggatgacaactcccctggcaccctgacactacgacaggtaaaggaagagaaagtgcaagctgttactaggatatccaacgtagagggtgggagacccttttacccagatcttccctcttctgaacagcaactccccccaactcatacactgccgttttcagggtaagcggccttcacccctaagtgaaaatgttagtgaactaaaggaaggagccattcttggaactggacgacttctgaaaactggaggacgagcatgggagcaargccaggaccatgacaaggaaaatcagcactttcccttggtggagagctaggccctgcatggccccagcaatgcagtcacccagggcctggtgatatctgtgtcctctcaccccttctttcccagggatactgaggaatggcttgttttcttagactcctcctcagctaccaaactgggactcacagctttattgggctttctttgtgtcttgtgtgtttcttttatattaaaggaagtaattttaaatgttactttaaaaaggtawatgtaaaccttgcaccgagttttctgtgtgtagaatggcggcctagagagcttgcgttccctggcctgagcccactgatgctctgagccttctttgcacatctccctttaaccatggtgtccctatggctctgtccttggccctgctctccctgggtgtttacttctagggctttagctatcacttccctatattctggtaactttcaggtctctctctctaaccctgacctttatccagctgctttataagtacttcaaagtcagtttgtctaaaactgaatttatgatcttcccccaaaagctattcctcattccctcttccctatccttgtgaatgacagcattatctacccagccaccaaacccaaaccttggccattatctcgaatccttccctcccaatgtcctatatcctagcatttggtcactaaatcctggtgattccacattttgtttgtttgcttgttttttagaggcagggtcttgctcttgtcacccaggctggagtgcagtggcacgatcacagctcactgcagcctcaacttcctgagctcaagcgattctcctgtctcagcctctccagtagctgggattataggcatgagccaccacgcctggctaatttttgtattttttttatagagatgaggtcttgccatattgcccaggctggtttcaaactcctaggctcaagtgatctgcctgcctcagcctcctgaagtgctgggattacaggcatgagccaccatgcccagcctgcccaggtaatttttaattttttttgtagatacagggtcttactatgttgctcaggcttgtctcaaactccagacctcaagagatccttctgcctcagccttccaaggctctgcgattacaggcatgagccactgttccagctgattccacatctttaatctcttcctaatccctctccctaacccctctgtcctgtcgctcttgcatttcttgccacctgcctcctaccttgtttccccagtgccagtccctccctttcatcaacctacactgcttctttctgaaagatctggagcaatctttctgagaagcataactgatcatgttactactctgctcagaactcctcaatggcttctcattgcccttaggaaaaagtctggactctctggcttgacattcaagaccttttataatctgattccttctcaagctaaccctcccgtacaaacacatgggcaccacaggcaggccatagcgaactgctgcacacagtcccccagccacctgctgaataccttctccccctgacccatctcaggcctcctcccataagcccacaagctatccagtacccagcctttatcacagcacctgtaacacattactgcccttaaatgggacctgggtctttttggaacagaagagagtagaaggcaaacatcacagatgtaccagggtgctacactttattgcaggtgtcttaggagagaaaaaaaggtagaaaaaggagaaagcatgaataagaagagggccaggaccctagtggtgccagagccatagtcacagggccaaacgccctataccacccaggcctggacaaaggtagtggctctgggggaggaatcctagggcctggggcctcagactcaagtctgctgggcctgcaaagggctggggaggggcaggttgtccttgctcattaagggagaggctgtgaggactgtggggagggaaggccatgggaggagatggggcagttctttgcccctgtgtccctgatgctgcctcccaaaggcacagtcccatgctccccactgccctcaaaggagaaagcttagtgggaatggcacccggaatatagaagagaacacctgaatgagatggggtcgggcagggggctgctgagtgtgttcactgccttccacttccctttctccagcctcctcagttccagattttgaggaagctgtcccaggaacctgtggccacagccatcccgtcagctgtgactcccaggcagctcaccctgttatcgtggccagagaggatgcctgaggaagagggaaaggagtcagcctgtctctccaagctgatttggaaagcagtgtgtgcatgcgtgtaagtgtatgtgtgggtgtgtgggtgtgtgtgtgtatgtgggtgtgtggggggatatgtgtgcatgtgtatgcatgtgtgggtgtgtgtacgtgtgtgtgtgcatgtgtgcttgagcacatgcatgcagggatcctagactcggtagactgggctcaacccctgaagaaggctaagagactgaaagaggattagctgtagggcagggggttctctgtcaagagctttggttgggggagggctgggatcagacagagaaaggctggaagcatctgtgtactatgaaaaaacccgagggcaccttgacaggtgctggaaaagagaaggcaaccgttcatcctatttctttgcttccagatgaagaaactgaggcccatggaggagtgacttgtgcaaggacactcagaaagtgagcaacagaattaggatttggattctgcccctggccagtgttattttcatcagcacctggcctcttgatagagaagaagccatcctatctgaccaacttcaggctagtcttagatgagccctaggctgcagtcagggccctcgggccactccagatctccttgattctgccttgattccatgtttccctgaggctgtcttgcctctcagtgggtgcccctgaaatgccaggaacccagaactgactggacagtcatggtccacagatctcctagggcagggagcagtcatggcattgggcagtggagagaggctgcttagagcaacactgagggaaaacagtcctagttgggaaccaaggggtactggattccaggggtggagtcacccagtgacaagggacagcagtaagagagtccgaaatgggagctgatggggggtacagaatggggagggagggctggggagggtccttccagctgaggaagcagcagccagggctggcccttacccacacgctcagacttcatggagtcccagacattgcagttgaagtcgtcgtagccagcgaatagtaggcggccactgagggagaaggccacggacgtgatgccgcagatgatgctctcgtgggagaagcagatcagctcctggtctgcccgcaggtcaaacaagcggcaggaagcgtcatccgagcccgtgcagatggcctctccattggggaagaactgagggcacgggtggcaagtgggtcagggatcagacctgggcagcccacagcctctcccgccctctgcctcccacctgacagctccagggcaagccgctgctctcagcctccctgcctgtccctcccttggtttggggtgagaagcagccctgccaacacataccacgtgccagtgacttccctatgcccctcgcccgctctgcactatacagcgctgcaggcaggcatcatttccacgtcgcaggcaagagcaccaaggcttgcctgcagtgacccggctagaagggcggacggaggttgtcccagactcccagactacacaagtgggctggatcagggtgtgtaagaacagggtccagtacaaatgcaaggcctggatctcacggcgagcaaatgtcagataagctcaaacggagggagagtctacagaaaactggtttgtactcttcaaaaacgtcaatgacataaaagacaaaggtgggaaaacagttccagtttaaaggtggtgacgaaaaagatatggcgaggaaaggtaatgcacgtttctggattggatcctggacagaaaaaaacatgagctattatggacatttttgaggctattggtgaaatttgaatatagactgtagactgtagtattgtgtcaatgttgagtttcctgatcttaagaatcatacagtgattatgctacagaagggctttgtttcgggaagtacttaaggggtaaagaaacatgatgtctgcaacctactttcaaaagacacagaaagaaaatgtatatctacatctaagtgtgtatgtgtgtgtgtatctatggctatttctctacagagaaaaaatgataaagcaaacgtgataaaatgggctaggcgtggtggctcatgcctgtaatcccaatattttgggagactgaggcaggaggatcgcttgagctcagaagttccagctcagcctgggcaacatagtgggaacccatctctacacaaaaatcaaaacattagccaagcgtggtcacacgcatctgtagtcccagctactcaggaggctgtggtgggaggattggttgaaccctggaggttgagactgcggtgagctatgatagcaccactgcatccagactgggcaacagtgtgagactctgtctccaaaaaaaggaaagaaagaaagggctagggaagactgggcacagtggctcacatctgtaatcccagcactgcactctgggaagctgaggtgggaggatcacctcaggtcaagagttcaagaccagcctggccaacatggcaaaaccccatctctactaaaaatacaaaaattagccgggcatggtggcgcacacctgtaatcccagctactcaggaggctgaagcaggagaattgctccaacccaggaggcagaggttgcagtgagccaagattgcaccactgcactccagcctgggcgacaaagtgagactctgtctcaaaaaaaaaaaaaaaaaaaaaaaaaatacagtaagaaagggctagggaagctatgggaggggcagaggatgtgtattgtatgtgttgtggggagtgtcggggaaggagttggagtgaagctggggtggggggtgcactcacacagatggcgttgatgtccgactcgtggccagtgaaagtctgacggcaggtcccctctcgcacatcccagagcttggcactggcatcacaggcccccgaaatgaagagattgaagtcaggagacacagccaggctcatgcagtcacccgtgtgtcccacaaatacagtcttctgctgcccagtctcaatgtcccacaaggcactgccaaaatggagggagactgttagagaaaggccgggcccactcccaagccccagcaccagcaatgttcagcctcaccacgtggtgtcccccgagctggtcacaatattgttgtcatccaggaagcggcagcaggagagataacctggaggcggttagaaggacagtgccctggctgcagagccacagcccactggaagcccagggttccctgaacccctcaggaggggaggagagggtctctccctcacctgtgtgagcagaaagctcccggctgaccttgacattgccctcacgggatttgaggttgtagatggaacacatgttgtccagccccccacatgccacaaagttccctgatggggcataggcacaggtcatgacccaggaggagcgcagtgggatggcgtgcacctgcagggagggtggtttgagcagagatgggaccggagccaagctcccagctgggcacaggagggtaggcatggcgcccttaggaaggatgcagtggtggaggctcagggaggcagggctggtaccttgttggtggtgtagctgtcccacacgatcagcttcccatcttgcgaggcacttaccagcagcctggggagagggcatcccatatcatgcaagcctccccttcccgccttcctcactcccgctctcaccctcccattctcggttcccccccaagcctcacttagaatcagtggcccagtgcatggcgtaaatcttggccaggtgtccccttaacgtccgccgcgtccgcatctggactcgtcccaccacctctaggccagacaccagctgcagagagaggggcactgaatatcagggtgagcaggttacgtgcccagatgtctgtcactgccactgatctatacaagttcccgctctgtgccaggctctaggtcaggcccccagccttagagaaataagtctctgccctggagtgtcttagactgatgtgggaaagagatgcatgcatggccagaggtgtgttgcttgtaagtgtttaacaagcacctctccagtgttggtgaggaaggtgggaaggtgatttccacgatacgaatacttgcactttgaccagtttccagctgccaatgtgaggtcattggaaacagatttgggaagagatgcacagagctggctctcccaagccgagaggagcctgcttgcacccaccgctgcagcacggctagctttttaactgggtgcctggggcatcaccatgaccctgaactgtacctcctgaaatctgtggtactatgccccttgagctctaaccacattttagacttaggctgggggtccagagtgaacagacttgatttgccatcacttgcattgctatctttttttaa

SEQ ID NO: 17965 - DNA, 28553 bp, Homo sapiens
gaggtggaggttgctgtgagccgagattgcgccacctcactctagcctgggcaacagagtgagactccatctcaaaaaaaaaaaaaaaaaatcttcatcccttttcaggctctaatcaatcgtggggttaacctggatcccctgggcaagtggtcaaagactggactagtggtgtatgattcttctgtgcccattggtaagtctcccccacccaagagcccttctacctctgtccctgtccctaccgcatgtcacagggtggtccttctccacaggtgctacccccgagtacctggctgggcactacatgctgcagggagcctccagcatgttgcccgtcatggccttggcaccccaggaacatgagcggatcctggacatgtgttgtgcccctggaggaaagaccagctacatgggtatgagaggggcaggcaggtgggattcatcgggctgtcttgcttttgaaagtagatggggttgctggggttgctgactcactagtgctcatggaacacaatgtgcaggtagctagcagggtggtgaggaccagtttctggagtcggcctgggttccagtgtgccacttactacccatctgactatggattctcttttgtcatccataaaatgggatggtaattgtgcttgggttggcccttgtattacgcttggattgtgagggttaaaatgatgcgtttagaagtccttggcagtgttcagcacatagtcagcagccataacttttattaagctgctgtcacttaaaagaagtaatttagtatgtaggaccacataggtgtttggtaaaaatgggaaaaccacatcggtagacttgccgatcaccaggggctagtgcagagtggatcagcctatacagtaggcaggcttgttgggagcgaagttgccttgaggtgatgacacttctcatgtggattcctggacaggagggtgggagcaagtgtggagacagtggaactggctgatcagcactgttactgccctctctttagcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtgagactcgagctgtgtgtcttctgaggcttcttccggttgaccttctcccttcctgacctcaatgtttagactcgaccctagtaaatattgccctgctggttgcagaagagacatatgattcatctgtatcttttctccaggtggtggggggctttgaccgagtactgctggatgctccctgcagtggcactggggtcatctccaaggatccagccgtgaagactaacaaggtgaggagtcaggtggtgggcccctgagaggccttggctgggtctcgtagagctggaaactgagatggggacaccctctgggctcccctctcctcctgaggctgcctttgggtctctttttgggacaggatgagaaggacatcctgcgctgtgctcacctccagaaggagttgctcctgagtgctattgactctgtcaatgcgacctccaagacaggaggctacctggtttactgcacctgttctatcacagtgagacctctgccatggcagagcaggggaggctgggctggggggctctttgccccttagagctcccttcagctccagctctgctttttcctccgttctttgtcttccccccacatccaggtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacaggtaagtaatctttttcttcccttcgtcaccacctttgctctttccacctttcaggaggctttatggtgtgacaagaggaagggaaaggaaagattcatgcatcccttactccagcctttgcatgcttggctgagagaaccctctcattccagctagaattgcttttgagtgctggaccccatgtgaacaggctaaagtgttcatatggatggaggcctgttcctttattctgccaagtggctgcagttgttcagcactaaatgcattccaaatgcaggttgtggtttcttttccttcttggcacagggtggacttactggtactggacctctgctggtccagcaatctcagcactgggttggaacagagctccacagagctttgtcagcagttctctgagcccttcacactcattgcagattgttttctcagccatcttgaggagtctggcctggatctcaagggaagggtggggttttctgaaacagccttgagagcactgcttactgggatataaccctgggtttagttggaagagggagagaagtgctactttagaaatagtagaatttgtctgggcgtggtggctcatgcctgtaatcccagcactcacctgaggtcaggaattcgacacggtgaaaccctgtctctactaaaaatataagaattagctgggtgtggccaggcacggtggctcacgcctgtaatcccagcactttgggaggccaagacgggtggatcacgaggtcaggagatcgagaccatcctggctaacacagtgaaacccccatctctactaaaaatataaaaaattagctgagcttggtggtgggcgcctgtagtcccagctactcgggaggctgaggcaggagaatggcatgaacccgggaggcggagcttgcagtgagctgagattgtgccactgcactccagcctgggcgacagagtgagactccgtctccaaaaaaaaaaattagctaggtgtggtggtacgtgcctgtagtcccaactactcaggaggctgaggcaggagaatcacttgaacctgggaggtggaggttgcagtaagccgagatcacgctattgcatttcagcctgggcaacgagcaaaactccatctcaaaaaaaaggaatagtaaaatttgctataacttaaaaagtacatattttaattatcccgcacttcatcacaattcacatggaaagaaacttctctgatttaaaaaataaataggccaggtgtggtgatggctcatgcctataaatcccagtactttgggaggctgaggtgggaagattgcttaagaccacgagtttgagacctgtctgggcaacaaagggagacagtagttccagctactctggaggctgaggtaggaggatcccttgagccccaggagtttgaggttgcagtgagctatgatggcaccactgtactccagcctgggcaacacagtgagactctacctcaaaaaaaaaaaaaaaaagataaataaagcctagtgcttcaaattcatttagaagaccctgcgaggccgggcgtggtggctcgcgcctgtaaccccagcactttgggtggctgaggcaggtggatcacctgaggtcaggagttcaagaccagctggtcaacatggtgaaacctcatctctactaaaaatacaaaaattagccggacatggtggcgcacggttgtgattgtccggaggctgaggcaggagaattgcttgaacccaggaggcagaggttgcagtgagccgagatcacaccactgcactccagcctgggtgacagagtgagattccatctcaaaaaaagaaaaaaaaaaccccaaaaccctgagaatcacctcttccttacagcatcttgttacttcctgtcctcaagagggcgcagcttcctgtagaaaccttttggcccaaggataggcagtgatttttttttttttttttttttttttgagacggtgtcttgctttgtcgctcaggctggactgcagtggtgcaatctcagctcattgcaacctccaccttccaggttcaagcgattcttgtgcctcagactcccaagtagctaggattacaggtgtgtaccaccatccctggctaatttttgtatttttagtagagatggtttcaccatgtgggctaggctggtcttgaactcctggcctcaagcaatccacttgccttggcctcccaaagtgctggaattacaggtgtgagccaccacgcctggcctataggcagtgatcttttaatacaaggttcaactaggacttgagtaaaggccaagttatattaagtaatgggaatttaggtaatctgctcttaggcactgacctaattgtgtggagctcctgcccaggaaatggcaattctcatattttaatatgagaatattaaaatatggtgataaggcccattttctgacaccatctgtttaattttaaccccaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacgatcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttgccagagcagccttttgagaaagctgccttccagaaacagaatgatacccccaaggggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctggccactgagtatttttgagggaactgggtgctgcctttgccgctttaagggtaaagatgggaggtgggactgggatcttctgaggagagggaatggttgggtgctactgagaaataaggtcagttttaggctcctgcatccttgggttttcccaggaagggaaagccctggagtcagagctaggggtgattgaactccggggagaggagggcaatagaagtgtaggggaaggcggggcacactagctcatgcctgtaatcccagcactttctgggaggccaaggcgggtggatcacctgaggtcaggtgttcgagaccagcctggctaacatggcgaaacctcgtctctactaaaaatacaaaaaatcagccgggtgtggtggcgggtgcctgtaatcccagctactcgggagactgaagcaggagaatcgcttgaacctgggaggctgaggttgcagtgagccaagatcgcgccactgcactccagcccgggcgacagtgagactcggtctcaaaaaaaaaaaaagtcgtgtaggggagatgggcttgccaccagaacccatggggtactggaggtcctgggctttacgccaccccggctggagtccaggcggtggctcccctcatcacagggctcggcctcagacccggaaaggtccagggtccggcctccaattggagcctgtcattggcttcccctcggcccgccccctgacctctgccccgctgccgagccgcctgattggtcggctctgtcccgccggcgccgcattggctcttctggctcgccttccatccctgctcctgcaccggtctgcatctcccagcagaaggcgcagccatgaatccgttattcggccccaacctcttcctcctgcagcaggagcagcagggcctggccgggccactgggggactcactgggaggcgaccacttcgccgggggaggagacttgcccccggcgcctctctcgccggccggccctgctgcctactcgccgcccgggccgggcccggccccgcctgccgccatggccctccgcaatgacctgggctccaacatcaacgtgctcaagaccctgaacctccggttccgctgcttcctggccaaggtgcatgagctggagcgccggaaccggctgttggagaagcaactgcagcaagcgctggaggagggtaagcagggccggcggggcctgggtcgtcgcgaccaggcagtgcagaccggcttcgtcagccccatccggcccctggggctgcagctgggcgcccggccggccgctgtctgcagcccttcggcgcgcgtgctgggctcgcccgcgcgctccccggccggccccctcgcgccctccgcggccagcctctcgtcgtcctccacctccacctccaccacctattcctcgtcggcccgcttcatgcccggcaccatctggtcgttctcgcacgcccgccggctcgggccgggactggagcccactctggtgcaagggcctggcttgtcgtgggtgcacccggatggggtgggcgtccagatcgacaccatcacgcccgagatccgcgctctctacaacgtgctggccaaagtgaagcgggagcgggacgagtacaagcggaggtagggattgggaaagggggacaggtctctctgtgtcataccactcacaacgggccgcgagttggtgtgggttccgaagaatcaggggtgaaaagaatgagagtaaagtttgtgctgtgtaatgaggagcttggaagcaattggatgcagggagactagaatccgcagagaatgcagaagccctgctcgtgacaggaagaaggacgctgggagcggaacacggggggattcctacttttccggcttgtctctgccatccaggcttaactgcgggttttgtgcggtgtgaaagggactggggctctgccctaccggtctcagccctggggcaggttagggatataaacttcaaaagtaggaggcaaggatatagcgtaaatttgggagactaaattgagtgaaactggaaggggctggtgagggaggggctgtaccttgcaacgagtgattctttcacaccccaaggtttcccaaagaatattgatggaaaccaggtacctgctgtggtttcataggaaaagctccgggacctcaagccattgcttgagtaggtcaacaaactgggaaaagaaagagtgaagggaattcactagggtgagggtggagagcagggctgacaggggaatcttggcagtataaagcgccagtggggagggagagtggagagccagcaggggactgagcagggagaagctgggatatgggccctccctaggaccgcgaggccgcggggcgggcccggtgcattctgtggatgaagatttggctgtctgagaggagcccggccccaaggggcaagggaaagggatgtgatgccaggagtgctggctgtataccaagtggattcctyagatggctgataaccaagccgataggacaggagtgagagcagaggtagtgtcttgcagactccaacccaagccttgaggagggagcgggtgactgacaggctttggtttggcggcctcccctctcatctcagctattatgaccccttgtgggcgggcctgggaactacctatgcagcccagtgtggcggagattcagcactgggtgaggattggccgaatgttctaggaaatgaccgctgggtctaggggcgaccttcagggatctccaccctgctggagtttaccagatcacagatcagcaggctttctttttttttttttcccataaatgataatattttattatagaaaaagcatcccaaatacaggatttcgtaaacactggtaggtgaacaagtgcaattttagaagtaaatgcaaagtaaagaggcaaaacctacaagcattttgccttcagaagaagatgtagtgttctcctgcactagtgatcccacccagaacacaaatgtggctctgtctcccgtgaaagcatcagatttgctttctgagctcagtatgcccatttcaataattgcaaagtgatggcaagaagtggcgttgaacacatgactacagacccttgacttaaaatattgagacagggacttgctctgtcatccgggctggagtgcagtagcgtcatcacagctcactgcagcctcatcctcctgggctcaagcaatcatcctgcctcagcctcttgagtagctgggactacaggtgtgcactaccatgtccatgcctggctattttttttttttctttttgcgttgtccaggccagtctcaaactcctgacctgatcagcaggctttctgagcttgagtcctgtcctcgtgctggcttccttagttgtggtccatgttatgtgtccttgggagtttcagttgtcctgaaatcatcgttctgccacccagaaccagcctgctctgcccctgcaggagttaactacgcgctcagcagtggcacaggcacagttctggaatacatccataaccacaggaacaactgctgttctcaggagcattttttttttaaactgaaggagcgtttgtccttggtccagctgtccaggacaggaaggagttattccttggggactgattagctcatcgctctgcagcacgctgctgtgtagagagccttagctggattcggatggtgcgtgatactggcagtgactcttcttcctccctagattccctgccctcattctggtctctttatagcaacactgtaactcctgtcttctgcctggaaggcctgggatggcttgagcgctacactgggaggtagctaaaggcctcctgcgttctattttcagctcccctgccttgtgcgtgacctttttttgagcccccattttcccaacataggaatggtccctgctttctctcttcaacccagggatacagttttttggaagagagatatttggtccatgcagaacacatggatatcgctctcaaattctgcccatgttaagggaaccttataagtgagaccagatggaaatggaggtgaaaatgaacctgtctgtgtgaagtctggccaaagaacaaatagaactgtagtgggcttccagatgattcatttgtagattttttttaccctgtaagatttccttaggcttaacctttagctataactgccttacttaagtttcttccaggctctgttgagctcactgtcagatagcccctcctgccctctttcacacatcttgtccagggttagcgtgcccttgacaggcttactgtctccctccagggactcgtgggctcccggcgcatgagggcaccacagttcatgccttcacatcatagatgaagaaaccaagacccagaaaagataagggtcttagctaagaaaacataatctgatgcgactggttcccttagtggcctgactgtatgcatgagaatgccagggaggaggggagaagcacctacgggacacacagggaagggggctgggagccaggaaggctgggagctgggctgtgtggggagccagcagggtggtggctgggctggctgcctcctcctgctctgcccagcagggaggggcagtcgaggtgatgtggaggagttattattaggaatactgcagtgcggctgtgaatgaggagatgggacccagaggctgacacaggaaggaagatggagggaaggggaagaaagggcttcacccaaggcttcagaagctgcccactcagattttaattttcttgctgtcttcttggccccttcctaaccacctttcttgtgttgaagtttctctcttggtgcagttcccctcccttctcgggttgacagaagtgatgagctcacaggaacaggatttgagatgtgctgctacgccagctagactgcagggccctggaatgccgggcgggtcctaagcagcacgttgccctggcttccatctctgtgatggaatagaatatgcactgcctgccatggctgatgagacatgacaaagctggctctgggaagcatgccctacctaggaccctgccctgtggcccagggtgtcgtccggcccacttgcagtcttaatctctgaattctgggccctggaacaggctgtgtctagttctcatttgccgtactcaccgggcccctttacatactctactttctctttccctctgggtttgagtgctagtaaccccaggctcgtgtgtccactgctgtcatgctgctgtgggacttccggcctctgagccagtctggtcacctctctgtgactcccttagaggaggctctgggtgggtagtttctggagctagtggggaaggactttgagtgtctcctaccaggctcttgacccactctgttgatacactatgtgtcctgcagatgcttttacagggttaaatgataccacaagaggcagggcagcgggctcgacgagctctgttctgrtgcgggcaggaggcgggagcccggatctgtgcgactgaaggtgggagactgggccgggtggacctggtggtctggtgtgggcaggaggtgggcaatgaggccagccggacagctggctgagctggggcctgagcagggatgggcatcacggaggaccggagcctcagcacttgcccaaacagagctcctggtgcacagcccggaggttccgggaaggcagctggcgagctcgacgcccatcaggaagcacagagccgcgtgacagctgcagttggtcaccagctggctggccaggcattcctgtgccctgctcctccccatccagggaaccagaactggggtctgaggcctgagccagagaggtggggacagggagccatgggggcagggaaggactctgtacctaagctctctccgcccttcccatgtctgtcaggtgggaagaggagtacacggtgcggatccagctgcaagaccgtgtaaatgagctccaggaggtgagggtggcgccccacttgctgctggtgcttccctgggtacccctgtctgcccatgaccctgctgccgtctccctgtccctccttggcatctttatcttcctcccacctcggcagtgccaccaacatcagggtttctcccaactgcaggaagcccaggaggctgatgcctgccaggaggagctggcactgaaggtggaacagttgaaggctgagctggtggtcttcaaggggctcatgagtaacgtgagtgcagccccaggcttcccgagggtcgaagtgaggcttctgaggccagaagagtaggcccttctagtgttggcctgttggcctcccgtccacggctcctccccttctctttgctttccttccctttttcccctagccacccctaactccagagaaagacaagcaacaaaagtctcggtgttgcgtcacagaggtggcgcagcttctgagggcctggggttgcagagcagttagtgagcagcttctggggtggaggctctgcagctggcgccggggcgctgggccgattcctcagcctctgaggcctcacctttggcgtggggaaataaacgcgtgcgctctgcaggagtattgtgagggtggtcatgtactcgggacagtgcccagcatgcagtgttagctggaagagtgttagctgttgcgattattatagtcctttctccactcttataattcccaggagtctctttctctctgggaatgtaagttctaggaggatgaggaccgctagtcgttccagtgagccccctgcatgtcccaggcactggccatgccctccagggcttccgtttggccagggagcagtggcccgagccgccccatgcccagcatattcacacagtgctgtggggaggccaccgctacccaggaagaggggtgcagtcagctcagggagactccacagaagaggcaccggtgcaatgtggtgggaaggatgaggaccttgccaggcctaattcgtccttgtctggagaactgggcgcctcctcactgttccctgggctccctggacagaacctgtcggagctggacaccaagatccaggagaaagccatgaaggtggatatggacatctgccgccgcatcgacatcaccgccaagctctgcgatgtggctcagcagcgcaactgcgaggacatgatccagatgttccaggtgaggacggagctgccctctgctctcaggggtgggtggggcaggtggatgcttccgtggcggctggcctggaacgcaggccctgcctcctgcttggggagccttacctggcaactggggccctcacggggctagactggggggtaaggagcagcatcaggaggggcatcgtggaagctgtctctaacgccgtctctcccttccccctctctctcctctgtctgcttcctctcctctcttcctctcatcttctctcttgcttcctccacagaagaagctggttagtttgatctcacgcaagcttattaatgtcccagtcccagtttctaagctgcctaggcctcctggccctcagtttgggcccgctgggctcttgagcacggatttttttctgccctttcccttttccttgctcttccccctttttctctctatctcttgttctcttgactgcatttctttctctcccttctcccccggctttccagatctggatgtgattcaggttctcttttgtacacattgcacactcatcctccttgcgtcctaaagcttttttttttttagttgagtcatttaatcaaaaagactttttttagaaaaaaatttcctcttgagccatcatgcacatctgactgcagccccagcgagcccttccttccttgtctgactgctcttcttctcgatttcttcttgttctgccttctcggtttgcagccctgacccccgctgtgtgtctggcccttggtgactgtccgtgtttctgttcctgtcattgtaactgtgacttttctctctgtctgcccccccttcctactggttcatgcttctcccccattcccaccctctctgcccggcctcccgctcccgccctttctcctcatgcacccggcctcgtctctgtagtctctgcacttgtctcccattaaggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgtgagtccgcaggccgtgctcccgcagcaccgacgccacagcagcccaggaggccggagctccccagtcccccgccaggacgaggccccgcccgccctgacacccgggttccctgtctctaggagggagtatgattttgaggacgactgtgacagcctgacttgggaggagactgaggagaccctgctgctttgggaggatttctcaggctatgccatggcagctgcagaggcccagggagaggtaacctctgctcccggcctcagggccctctggctctgcctctccagcctgaagcccactcccccgctcctctccttgctctgtccccccatgtggctgtcatcctctacctgcgtctcccctcttcctttatccttttgcttttctttctccagtttctttaaccagacttcctctctctctctctccctgacttggccctttggaatgcgtcccatcccatccctccttggctggcctcccccgcttccctttctactccagcagcaggaagatagcctggagaaggtgattaaagatacggagtccctgttcaaaacccgggagaaggagtatcaggagaccattgaccagatagaggtaagggcaggagcggaagccaggggcgtggtgtcccagagggttttgagtggggctgcaggcgcagtggcctcatccctgctgcaggaccctagagaccaaggtcttgggaggaggagtgatctctcagctatagtcctcctggtgggctctgaagacctcaggctctggaaacagacagatatcggttcaaatctcagctctgttacttacaaccaccctgaacttgtaataagttacttgttccctctgagcccctcctttcctttcctttcctttcctttctttccttccttccttccttcctttctctctctctctctcttcccctccccctctatccctccctccctctctcccttgtctttctgtcctttcttttttgagacaaggtctcactctgtttcactctgttgcctaggctggagtgatcctcccaccccagccttctgagtagctgggcccacaggtgtgtgccaccatacccagctaatttttatttgtatttttttgtagagatggkgtctccctgtgtttcccaggcaggtcttaaactcttgggcttaagtgatcctcctgcctcggcctcccaaagtactagaattagagacatgagccatgtgtccagccctacacctgtttctttttctttctttctttctttctttctttttttgagacagggtcttgctctgtcactccaggcccactgcagccgtgatcttctggatccaagcaatcctcctacctcagcctcccaagtagctgggaccacaggcgtgtgctaccacgcccggctaattttttgattttttttacagagaacagggtgtcactatgttttccaggctgccctcaaacttctggattcaagcagtcctcctaactcggccccacaaagtgttgggattacaggcatgagccactgtgccgggcctttttatttgtaaaatgaggaatttaataatacctcacctatagggttgtttagaagatcagatgaaataatgcatatatagagcttagggcagtgtctggctcatagcgagtgtagcatagtggggactgttttattattattaacactatcagtgccatggcactcagagatggactgggactttcctgtttcttccactcagcctttgagataacagagaaatctccatgctttttcccaagccttgaagtaccttctagaggtacctagaggcaagtggagctggtgctttagctcaaactctaggctttaggagctgcaagaaggatttgtggaggccgggcgcggtggctcacgcctgtaatcccagcactttgggaggccgaggcgggaagatcacgaggtcaggagatcgagaccatcctggctaacacggtgaaaccccgtctctacgaaaaatacaaaaaaaaaaaattagctggccgtggtggcaggcacctgtagtcccagctactcgggaggctgaggcaggagaatggcgtgaacccgggaggcggagcttgcagtgagccgagatcgcaccactgcactccagcctgggcgacagagcaagactccgtctcaaaaatacaaacaaaggaagaaggatttgtggaaccacagaatggaggttgctgttgctgtgggaggagggatggacgggacccccgtgagctctcctggcctggtgaggtggtcctttcccgacgctctgactttgggagaggcatggagccttctctgcgtctcagcctctcttcaggcccacatgggagattcatacgtagtccccccttatcttcagggcatgtgttccaagacccacagtggatgcctgaaaccaaagatagcactgacctcctgatagcttgggtccagttgctgtcaactggaacgtgtttctgttcatgtctcccacccacacattcaatgccttttctatcttaactaagcacttagcgtgcgctgtggcggtaccttttgcagttcgaggtgtgacagcaaaactggcacaaatttctttttccttctttacaatttcacggatagaagattcattcttactgtagagcttaccaacctcagcatcggattctttttcttattaagttgaaaacttttaccttttcacttaaagggagcatattttggcttctctttcacatatccaaattgccagcatcactactcttgtgctttggggccattatgaagtaaaaataagggttccttgaacacgggcactgccataccacgacagtcaatctcatcactgagatggctcctaagtaactaatgggcaggcagtatagacagtgtggatccttgggacagagggagggttcatgtcctggtctggatagagtgaggtttttttttttttttccgagacggagtctcgctgtgtcacccaggctggagtgcagtggcttgaactcggctcactgcaagctccacctcctgggttcacgccattctcctgcctcagcctcctgagtagctgggactacaggcgcccgccatcacgcccggctaatttcttttgtattttttagtagagatggggtttcaccgtgttagccaggatgatctcgatctcctgacctcatgatccgcccacctcggcctcccaaagtgctgggattataggcgtgagccaccgcgcccggcagagagagtgagattttatcaggccactcagaacagcgtgcaatttaaaacttaggaattgtttatttctggaatatttcatttaatattttcagatcaaggttcaccttgggtacctgaagccgtggaaagtgaaaccagtggataaggagagagtgactttattcttttcatttatttatttatttatttatttttttgagacgtagtctcgctgtgtcgcccaggctggagtgcagtggcgcgatctcagctcactgcaagctccacctcccaggttcacgccattctcctgcctcagcctccagagtagctgggactacaggcgcctgccactacgcccggctaattttttgtattttttagtagagacggggtttcaccatgttagccaggatggtctcgatctcctgacctcgtgatccacccgcctcggccttccaaagtgctgggattacaggcgtgagccaccgcgcccggccttgactttattcttattgctgtcacattggaggtgtttgagaaggaagtcgagaaattattttcctatatactcattctcccaacacacatcaaactgtcctgctcctgcatcaaacctggttttcttggccaggtagatgaggtttcctggatttgtgctgctagctaaagacatggcaagggaaaccagtactccccaccctcccgtctaccgcggctcactgtttcctcctcctgcctgacctgattcttgtctccctcttttggatggtggatttaaggtttgtgttttcactgtgccttcaaccaactaggggcctttgtgcggccatcttcgtgagaagagatctcgggctgccatctctccctagtcttccctggacctcaagtgcccagtgtaaaacatgatctgaaagaacgaaaataatatcttaaatggaatcatgccttttaagctatttttggctgggcgtggtggctctcgcctgtaatcccagcactttgggaggccaacgcgggcagatcacttgaggtcaggagtgtgagaccagcctggccaccaacatgtgaaaccccgtctctactaaaaatacaaaaagtagccaggcattgtggtgggcacctgtaatcccagctacttgggaggctgaggcaggagaattgctggaatctgggaggtggaggctgcagtgagctgagattgtgccactgcaccacagcctgggtgacagagcaagattccatctcaggaaaaaaaaaaaaaaaagtattttcaaatcatctgactcctcctctctcccagtgcaatgactttaggcagcagtccccaacctttttggtaccagggactggtttgtggaagacagtttttccactgacccgggggaaatgattttgagatgattcaaacattacatttattgtgtactttattactatttttaaaaattattattattatttttagagacagagttttgctcttgttgcccaggctggagtgcaatggcgcaatcttggctcactgcagcctccgcctcccgggctcaagcaattctcctgcctcagcctcccaagtagctgggattacgggcatgtgccaccacgcctggctaattttgtatttttagtagagatggggtttctccatgttggtcaagctggtctcgaactcccgacctcaggtgatccaccacctcggcctcccaaagtgctgggattacaggcatgagccaccgcacccggcctgtgcactttatttctattattattacattataatatataatgaaataattwtacatctcaccataatgtagaatcagtgggagccatgaacttgttttccgcaactagacggtcccatctgggggtgatgggagatagtgacagatcatcaggcattagattctcataaggagcacacagcctagatccctcgcatgcacagttcacgtaaggtagggttcaggatcctgtgagaatctaatgccgccgcggatctgacaggaggtggagctcaggctgtaatgccagtgatggggagcagctgtaaatacagatgaagcttcactcacttgcccactgctcacctcctgctatttggcctggttcctaacaggccacagacaggtactggtccgtggcctggggtttggggacttctgcattaggggaaccgttaggaggacttgctgacctcaggagtacccaaggtgcctttatctttgtgacctttgatctctcagggtcactaagatggagcaaggtaaagccaaggcccagagtggtgggcgggaggcagttcttccccaccgctcctcacctctctctgtctcctcccgtcccacccccaagtctgttcacacagygagcctgcagttttcaaggtggcttgtcaaggacatctcctgacatgcacgttcacctcctgaccttgttcctgctgtaaatttgtgaattaagtggggacatagacatatgcagagactactggtggcagtactagccttgtatttcagtagaatatatttggttcatttccttcttcccagtctccctgagtgatggttccagaacccagctccctgcactccggttcttccaaggtggagaaattggggtgtaggcagctgatctgaacaagggctggtggcactgtattttccccctgggttgaacagtcaccgtgtcctgctcctcccactactgtggggccccagctgtggatccaagcctgccagggaagctgtccccactagggcttctcacccagccagccgccatctcaccccaaatgtcactgtcctgaccatctctgctgtctggccctgtaacctgtttccttctttctctaagttcccaccctctctgtccaatccacattatggcagctggtatcctccccgttctcttcactcaggcagtcacgaacgtcatctccaggaagtttcattttgcttccccttgcggcccctgccctttgtacccaaaacaaagagaggcagtcgactgtccctggcactgagtttgtgctgcctgggccctgcctctccgcctgcctcagagtgtgggctgcagaatgggcccggggagggagaccggatttctttgattctgagccccgtgttttccacgtgtgacatttctgaaatcaggacaggtctcagaatcaatggcacctccaatatgggagtcttccttttagtgtctgaaaatggcttttaggtgagaaaataaagtgataaggagagaatggtaagaggattgggcccctttcagcagttagccaggcttgtatgccacgggtcacagagagagttaattcccttcgaggtctgggtctgccaggatgaggaaaacctgtcgctaacccttacgggagctcacagtgcagtgaggggacagcccaggaccagcgcagtacaggggatgaggggtgagccgggccccataggaacctgtgtggccctgggagcctgtggatctgctccatcccgcccacactgactttcctcaccactcttatcagtcttaaaagaacacagcctgcagcagtacctttgcattcctccataggcaaagatttccaggaaaagcagaggaaacaatggtgtattcgctgccttctgccttggtctggtttattttaaaatctgagccttcagtaatggctgcctgggcccccggcccagccactgctcttggcgtgttggcctcctggcgggggcaacagaggcgctgtgaacgccacctgttaaccccgatggccctgcctgccccaccacagctggagttggccacggccaagaacgacatgaaccggcacctgcacgagtacatggagatgtgcagcatgaagcgcggcctggacgtgcagatggagacctgccgccggctcatcacccagtctggagaccggtaggcgcctcccctgggcatggggccttccagggggacacagcggggagaaaggttggaacacagccccagagaccctcaggcaatgactgggtcacatcttgctgtggggctgccctttgggagttacctggtggggctggcccagacccacagctctctcccttggcagttggatgagctatgtccattcatgacgggagggctgaaacctcccaaggccaccagctctggtggttcccctggttagaggcagtttaaaaactggcaaggaacagaagggttgtgggggcagatttttatctaaagtcagggccatgatttgtgcatttgaccctgtgtaagttacacygcaacaagaaagtgaatttttaaaaatcacaaaaatactgcagatagacataaagccaaggccctagagtcagggtgctggaggctcagcagcttctctcctactgtgacttcagctatttctttttttttttttttttggctcactacaacctccgcctcccaggttcaagtgattatcttgcctcagcctccaaggcgcccgccaccacacctggctaatttttgcatttttagtagagatggggtttcaccatgttggccaggcttgccttgaactcctgacgtcgtgatccacccgcctctgcctcccaaagtgctggaattacaggcgtgagccatcatgcctgacctcagcctctgagttcccaagacacaggcggggcccatttccctgtcagggtgggtttggagagagttcagtccctgccgctccctcgccatcccgcggccccgccctcgcttccggtacttctcacgggctgccagagggtgaggcagcaggaggaggagtgccgtccgtcttcaggattcctgcctgccccaaggttgacaactggtgtttttttctagaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggtccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacrtgctcacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcacaatgcctcggtataggaggctgtgttgagctgacattcaaatggattctttaataataatgaaactggcgagtatttattgtgcactttggtgtcactgtctcaagcacttcctaatattcactagtttgaactctgaggtaggtactttttttttttttgagatggagtctcatactctgttgcctaggctggagtgcagtggtgtggtctcagctcactgcagcctctgcctccggggtgcaagcgattctcctgcttcagcatgcctgtagctgggactataggcatgtgccatgaagcctggctgatttttgtaattttagtagagacggagtttcaccatgttggccaggctggtctcaaactcctgacctcaggtgatacacccaccttggcctcccaaagtgctggggttacaggcgtgcgcgctctaccgaggtatgtacttttgtctccactaggtaagcacacgtgcaaagtgaggcccgggagtaactgcccaaagcaactgagccgttcagtggcagagccaggggtctggacctaggtcccagctacacgccttgcccctacccaagttcccctaaggacgatgatggaaataagtcaccctgacacatctcagttcatcttcctcaaaactatgcgaggtgggcatttttaccgatttttaaacattatatagtccttaccgccttgggcatggttttaggtacttggtttacctagatgaatcctgcttgaagaccttaggggctggccacgatgtcctcagataagacacgagggcacagaaagcaatagagcacgtgctcaagacctcacagctgcggaggccaagctggaattgcccgctgcagctcagctccaggctgagctccactaaccagtcagcgtcagagcccagtgcgagccctgacttcctccacctgtcagcctccctggggctgcccacagaatagcttcttccatgtttggccaacagcagatagcctaggactggagcgaggagaggaaaaggccttgttctctgaagtagtggtgccagcttcctgtagcactcaagacgtctgagcgggaagcaaatggttctcgaagcaagcaaggctgtttggaggccctaccctcagtctgaggagaacataccaggtccctccccagcaagaatgtctcaccttgacacaagcccagcttccctcccctctgccccagaccctagaataagacaggacaagtaactggttgagcacagggtactttattgatggtacatgacaaggtgcggctccctaggcccctcccctcttcaaggggtctacatggcaactgtgaggaggggagattcagtgtggtgggggactgagtgtggcagggactccccagcagtgagggtctctctcttcctcttgtgctcttgctggggctggtggtccaggggtcttactccttggaggccatgtgggccatgaggtccaccaccctgttgctgtagccaaattcgttgtcatacctagaagatgaaaagagttgtcagggccctttttctgagccagccaccagagggcgccagaccctgcactttttaagagccagtctctggccccagccacataccaggaaatgagcttgacaaagtggtcgttgagggcaatgccagccccagcgtcaaaggtggaggagtgggtgtcgctgttgaagtcagaggagaccacctggtgctcagtgtagcccaggatgcccttgagggggccctccgacgcctgcttcaccaccttcttgatgtcatcatatttggcaggtttttctagacggcaggtcaggtccaccactgacacgttggcagtggggacacggaaggccatgccagtgagcttcccgttcagctcagggatgaccttgcccacagccttggcagcgccagtagaggcagggatgatgttctggagagccccgcggccatcacgccacagtttcccggaggggccatccacagtcttctgggtggcagtgatggcatggactgtggtctgcaaaaggagtgaggccctgcagcgtactccccacatcacccctctacctccctccccaccttgaaaggaaattatgggaaagccagtccccagaacccccaaccccagggttgcacgcagccccggcagggaggagccagtcttggatgagaaaggtgggagcctcagtcccattccccagctctcataccatgagtccttccacgataccaaagttgtcatggatgaccttggccaggggtgctaagcagttggtggtgcaggaggcattgctgcaaagaaagagggagcggggcgcaagtcaggggagcgtgtccatagggtgccaggctggccgcttctccacgggccctgccttcctcacctgatgatcttgaggctgttgtcatacttctcatggttcacacccatgacgaacatgggggcatcagcagagggggcagagatgatgacccttttggctcccccctgcaaatgagcctacagcagagaagcagacagttatgaacccgggtcctgcctttgcagggctgagtcagcttcccctcccgcgggccctcctgcactcaccccagccttctccatggtggtgaagacgccagtggactccacgacgtactcagcgccagcatcgccccacttgattttggagggatctcgcctatgggggtgggggggagatggggacaggaccatattgagggacacaaggttaccatatacccaagggagccacaccatcctagttgcctccccaaagcacatttcttccattctgtcttccactcactcctggaagatggtgatgggatttccattgatgacaagcttcccgttctcagccttgacggtgccatggaatttgccatgggtggaatcatattggaacatgtaaacctgggggaatacgtgagggtatgaaggggctgcccatcagccaggtggctcctcccacaccagctttggggctcaccatgtagcactcaccatgtagttgaggtcaatgaaggggtcattgatggcaacaatatccactttaccagagttaaaagcagccctggtgaccaggcgcccaatacgaccaaatctaagagacaagaggcaagaaggcatgaggaggggaggctcctccagaatatgtgagcagccctaggccacctccccattaagagggcgaatgcagcatctccttacccccaggagggcccaagaggttgaattttatctcccttgagcttccctgccaggctggcctggcttaaggcatggctgcaactgaaggctccagggctgcccaacacccccagtcatacgaagcccttccaggagaagcggccatgtggggcactgccacccacagtctgggcacaagctttgtacatggtattcaccaccccactatgccaccccaggaatgcttgctgctgcctagctcagctgcaccctttagggagaaaacgcttgtacactcagcatcatcaaactcaaagggcaggagtaaaggtcagaaattaactggacagggcaagcccaccccttctctaagtccctcctacaaaagggacagagactggggcgggtgggaagaggggaagctgtattttaaccccctagtcccagggctttgatttgccaagttgcctgtccttcctagctcttttccagaaatcaggagtgggagcacaggtaagtgcatgtgtgtggggagaagggatgggagagagccccagcccaggcccccagctacagaaaggtcagcagctatatttaacctcagaccagggtgcggtgggagatctggtttccggaagacggaatggggagaagggcaggttccccgaggcgcccagacacccaatcctcccggtgacatttacagcctggcctttggggtcgggtcaacgctaggctggcaggggaagggcggggccgtgaggtgagccggcgctgcaggaaggggccaccaccagaggggccattttgcggtggaaatgtccttttccaactacccatgactcagcttctcccggcttggcaccatgccacagccaccacacctctgcggggaggggacacaagaggacctccataaacccacttctttgatttaccagagaataatctaggaaaagcatcacccggaggagaaatcgggccagctagcctcgctccacctgacttccccgccacacgcgactccacccatcgaggcaggagcgcagggttagtcaccggcaggctttcctaacggctgcccattcatttccttcccggttgcaacatggcggccgctctaccgcaggcgcagcatccggacagggatgcacccgctgcgcactagcatcccggggcctgcggtgccggaggccgtgggggaggggctcctctgcgacacgtgaccccgcagagcgcgaaaggaaagaaagcgtcccccacctaggggtccgggtcgggatctcgggcgggagtagggacctcctgtttctggggactaggggaaggaggctccgggcagatggcgccgcaagggcggagctgcacagggcgccacagcctgggtgcggggctccgccaggtccgagcgctgaccttgagctctccttgcggggaacagctaccctgcccccatacgactgcaaagacccggagcccgcaaggctcgtagacgcggttcgggggcggtcgcagcccagggccccccagccacccgcgaactcacccgttgactccgaccttcaccttccccatggtgtctgagcgatgtggctcggctgcgcggagggagagaacagtgagcgcctagtggccccggccgacacacacgcctcccctcccctcccccaccaggcctccatgcccagcccgcgccgcatcacgtcctccgcccgcccctgcaatgcggaggccgcccgggcccaccccgcagcggcgcgaacacatccggcctgcgcccgcccctgccgccttcaggccgtccctagcctcccgggtttctctccgcccgtcttcacctggcgacgcaaaagaagatgcggctgactgtcgaacaggaggagcagagagcgaagcgggaggctgcgggctcaatttatagaaaccgggggcgcggcggcaggcggtgactcggaccccgcctcccgccaggctcagccagtcccagcccaaggtcttgaggcctgagctacgtgcgcccgtaaaaccgctagtagccgggccctactttctccccgcttttttttttccgcagccgcctggttcaactgggcacgcaccgagcgtgtgggccccgacgtaggggggaagggactgagattggcccgatgggaggtgatcggtgctggttcccaggactggactgtgggcagcaggacactagggagtcaaggacggggacccttacacgcttggatgaaacaggaggactttgggaacgactgagatggggaattggagccggagcccagcaccgctcgcggctgcacgcggcctgccccctcccctttctttctttcaaaggctgagaggcgggaaagttggggaacttctcctcgaggctctgcggtagtgacaccggactgctcaggcaaaggcctaggaggggcccatgggcctcgggcgggggcccgtggttccttcccagcccccacttccccctccccatctcctggctcctggcatctctgggaccgaggcctgggctgggcactgggcactgggcactgggggcctggagaggaaggaggctcgggaggcggcttgagggggagggggaggtttctgcacggaaggtcacgatgtcctgcagccctgtagcctggacctgataattagggcagacaatcccggccctgtgtgcaccagcggctctctccgggctggggccccaggcggaggacaggatggctggtgggggcccagaggcctcccacaaaggcactcctggaaacctgtgggctgtgctgcctagggagagagacagtgtgcctttcattccatccagcctggggcgaagagcgggacgtgagggcggaagtccctccccgccctgggacg

SEQ ID NO: 17966 - DNA, 44801 bp, Homo sapiens
tccggggagtatgtgatgataatcacccccagcagattccattacctcagcagctcttgttcccccgccactggcagttctgcaatgccatagcattttccagagctaagatctctgggttgtatttgctgacagcctgcaagcttgcatgctctgaaagattttttttagtttttaatttttttgtagagatggggtctcgctttgttggcgcaatcctcccacctcagactcccaaagtgctggaattacagttgggagccactgtgcctggcctggaagactttcaacttgtgtctcagtgcagttcttgactcacctctctgggcctcaggttctacaaatgccagacacctagcgaagagctctgcaggctttccactgcctgtattggaaatcttgcaattcacataattattcagtcactgcctggtacctttatcttcccatcccactaatgttagtgttttttaatggagcttttattctgagaatatgtgtttgtctgtttgtttgttttttgagacagagtctcactttgtcacccaggctggagtgcagtggcacgatctcagctcactgcaagctctgcctctcaggttcaagtgattctcctgcctcagcctcctgagtagatgggactgtaggcacctgccactatgcctggctaatttttgtgtttttagtagagacagggtttcaccatattggccaggctggtctcgaactactgacctcgtgatctgcccgccttggcctatcaaagtgttgggattacaggcttgagccaccgcacccggccgagaatatgtgttgttatttatgactggattatgaagaatcaggagaatgcatttcatgtctgattctgctgctaattaagtcaatcatttaatttttgggacctcagtttctttgtaagtaaaataacacctgcttgttcttcatccctgggctgttgggaggaacagatgagacagtggctatagaagcacttggaaaatgcacttgtcctgttttgtaaaataaaaaggtattaaatgtgtatttctgccatgtacctaatgattattcagtgcgtatatatctgaaaagtcatgttgcaaatctttctgtgaaacagatgctattttaaattcactgggagaaatatcctatttaaagtaatctatagtaatttctttttatataataaaaatatatttgtaaagtcgacagacaacttgtaattagttttgtgtctggaagaatttgtttagagaaggcactctgtatccttgagatggggtagcaaagagctaggatcctggctcttactgttgactgttaatagctgcatgatcttgggcccagttagggagttactctgaggctctgtttcctcatctgtacaatgggaaaaagaaaacgtacgcatcttgtagggttgttgttggatgggtcctgcctggtgaaacatttggcagctccccagtaaggacagctttggcttgatgtgtgatgtagctgagctgggtcccagtccaggtggacagtgatctatacagacagccctgtcttcagctctggtgtctgtgaggattcaaggtgaatgtgcattttgtgccccaaatgggacctggcctgttgcgaacactttacaattataagcagggtgtttccagggctgtttgagcaatagagggctgacaccaataggtttgtggttatccagacatacttacatttctagactaggatttcatatatttttggagaagtcagtaaatccccttgggacttggatgaaagctctagacctttgctacatacagacatacatacatatgcgttctgagtccatgaattccagaccttcatgggcaccatgatgtcttttcatggatcccccgtagggaagccctgaattatttttttttaggttaatagaggatttaaaaatctaaacagtacaaaggttccatggtgagaaggcaggctttttctcaatgggatcttagtctccagtttcttgttcccaaaggcaaccactgtcactaggttggagtatccttccagaggtgatggaaaacagaggtgatgctcaacttagtcatcagggaaatgcaaatcaagacctctatgagatgccacttcacattcactaggatagctataatcaaaaagacaaaaacaagtgttggccatgatgtggagaaattggagcccacacacactgttggtgggaattgaaaatggtgagcactttggaaaacagtttggcacttcctcaaaaggtaagaatttccatatgacctagcaattctacccctaggtatctacccaagagaaatgaaaacatgtccacacaaaagcctgcacaccaatgtttataacagccaaaaaataggaacaacctaaatatccatcaactgataagtggatacatgaaatgcggtctattcatgcaatggaatattcagccatagaaaagaattaagtacttgtgaaaagtaaagtagaggttcctcttcaaagactttcctccccatctaattaggaataaatagtaacttctcttagaagcaaaatttattcaaagacctaacattcttaaatacctgctagccataataaatcaatgtactttatgttcttaactcccacaatttagcctaaatatttgccctggcacggttatactggtgcaagcaagcattaagtcatagcctgttcctcttccttatttgaaagtgtttttacctttctcagcattccacaagttacttcctccttcctttgttctcctctgcttttgcctctgaaaaaattctaagttgttagccaatcaagacaaatacagaatgtgaagtcccgtttcagccaatggaaactggacccagaggtagggtggatacgtcaggttataaatgaccctgtctcctttgttgggtgtactcgtggcaaaactgctggcgagtgtaccctttctgcagaaagtgtaaaaatggccttgctgagaaaattatttatgttcaagtgctatttctttatggcactggggaacaagcatttcaaacatactgacacgttacaacatggatgaaccttgagatcatggtaagaaaaagcaagtcacatattgtatgattccatttttaattttttcagaataggcaaatctatcaagacaaactagattacagtcttgctgaaattacaggagtgagccaccaggccagctggtcatacacctgttttctttcttcttttttgttttgagacagagtctccctctgttgcctaggctggagtgcaatggcacgatattggctcattgcaacctctgccttccagattcaagcgattctactgcctcagcctcctgaatagctgggattacaggcacatgccaccatgccctactaatttttgtatttctttttagtagagatggggtttcaccatattgttgaggctggtcttgaactcctgaccttgtgatctgcccaccttggcctcccaaattgctgggattacaggcgtgagccaccatgcctgctgctcatacactttaaatgagtgaactttatggtatataaattatatcttaaagctgttagaaaggaacacacaaagtggttaccctcaggcatttgaaaaaagaaagccacatttacctttgtatgccactcctctctatttagccacacatgtgttttgttaatgcttttctaggtcctttgttttttcatgtctttcttggctattgctcctcaacagtaagtttagatcacttcattctttttgccttacattccattgtatggatattccttaatgtatataaccagctgatagagattgaggttttgttttcattctagctactacagacaatgccaccttccaaggagattgtatcaattaacacgttcatcagggatgtatgggagtgcatttcctcacatcctcagccacaaggtatattatcctgctttttttttttttttgagatggagtcttgctctgttgcccaggctggagtgcagtagcgtgatcttggttcactgcaagctctgcctcccgggttcacaccattctcctgcctcagcctcctgagtagctgggactacaggcatctgccaccaggcccggctaatttttgtttttttttttgtatttttagtagagatggggtttcaccatgttagccaggatggtctcgatctcctgacctcgtgatccacccacctcggcctcccaaggtgcggggattacaggcgtgagccaccgcacccggccccttaccttgttttttgattattgccaatctaacgagtggaaaattataattttatatgtactttttaatttaatttaattaattaattttttttttttagagacggagtctctcacccaggctgaagtgcagtggcgcaatcttggctcactgcaagctccacctcctgggttcacgccattctcctgcctcagcctcccgagtagctgggactacaggcgcctgccaccacgcctggctaatttttgtatttttagtagaggcggggtttcaccgtattagccaggatggtctcgatctcctgacctcgtgatctgcccgccttggcctcccaaagtgctgggatcacaggcgtgagccaccacacctggccttacatgtacttttttaatggttgaggtggagccatctttcttatatttaggagcgtttcatgatttgtttttgttcattgcttcctttgcctttttttttttttttccctgagacaggggtctcactttgtctccctggctggagtgcagtggcagtaatcttggctcactggaccctcgacttcccaggctcaagggatcctcccacctcagcctcctgagtagctgggactacaggcgcccaccaccacaccaggctaatttttgtgtttcactagagacaggatttcaccatgttgcccacgctggtctcgaactctttgcctcaagagatccacccacctcggcctcccaaagtgctgggattacagacgtgtgccactggacccagcctcctttgccagtcttaatactaagttattttattattttgggagaattgctacatcgaatatcagccctttgtcatatgtttcgagtatttttctgaatttgtaccttgtctttgattttttttcttttttgagacagggtcttgctctgtcctccaggctggagtgcagtggcgggatcacagctcactgcagcctcgacctcccggcctcaagtgatcctcccacctcagcctgagtagctggcatcacgcccagctaattttattttttgtagagatgggggtcgcaccatgctggccaggctggtctctaactcccgagctcaagccatcctcccgcctcggtcttccaaagtgctgagattgcaggcgtgagacaccgtgcccagccgtctttaatatttttcaccaggcggatagttcacatttttgtgtagtcttttttttttttttttggtgccttctaattctaattcttcccatttctgggtgtgtacttagtctctctgagccacagttttctgctctataaagtggggtgataatgctcagtacacggtttgctttggctcgatgagaaatccaggtctgaaagcttcaggtacagcggccggcgctgaggaaaacagcgttaagtgaggcgcgtcagcggacaccacctgcctgcacatctggctggcctcaacttcccgctgttcgagcccacgtgagtggctccgccccatctggcttctgaccaatggacgagcttcctaaggcgtaccgtcccgactccaaggcgcctggctttgaggcgggctgcgtcttgctcggagtcccgccccttgccgggtcgagcaatgggcgccttccgtttggcgcaggccccgcccctgtcgctctccggcctgcgggccgcagggctcgttccggagggcgggcgccacggaggccggagtggtcgcagttcgggcggaggccgggccaggcggggctgtagggctggggcaggcggcgggctgcccggcgggacagctgcggcagccggcggggggcgtcctgagttggcggtcgagggcgctgccagctcccgaggggccgctcgggccccttccggcccgggtctggttgggcckcaggagcagggcgggctgcggcgcccgggtctggccctggcctacgggctaagcgcccggccccggggccgcggatccggcagccatgtgtggatcttgaagcgccatgtggtcttctgaagcgctttgacagttctaaagggctttatattgcaaactgatcaaagcgcttcgtagccccggaagcgcttaggcatctccgaagtagcgctgggcaaagtgaaggcttcctgatctcagaagcacgttgtgggcttggaaacckacggcagcctttagtcaattttggatcgctttgacttctccaacacggtttggcatctctgaaaccttgagaactgtgatgggcagtggaaagaagagggaaaggtcagtgaggctagcccctggctctgcccttatgtcttgccgtcctcctgggcccggggtggcgggaatctgaggtggggycgccagraagggtggtgtkggaatccaggccccctgtaccttgcaggtgcccatggcgtccgagcggggcaaggtcaagcacaactggagcagcacgtcggaagggtgtccccgcaagcgcagctgcctccgggagccctgtgatgtggccccctccagccggccagctcagaggtctgcgtcgcgttctggagggcccagcagccccaagcgcctgaaagcccagaaggaggacgatgtggcttgctcgcggaggttatcctggggctcatcccgccgcagaaataactcctcctcctccttctccccacatttcttgggccctggtgtgggcggggccgcctccaaaggctgcctgattcggaacactcgggggttcctgtcttcagrgggatcccctctgcgtcctgccaacgcctctttggaagaaatggcttctctagaggaggaagcctgcagccttaaggtaggtggctgccacgctttgcaatcggtgaagccccttccacatggcttgagaggttggggatgggaattttggtggaaggagactacaaaacattacatccttgaaggtctggaaggtctttctagaagtccactccccccaaactcgaagacctagcagtcttccaggcgcgtggcctgaagttaagtagagaggtaattttcaaactcggcagcactttggaactacttggaaagctttaaaatacttgggcctgcctcctactccagagaaactgatttattgggctgaggtgtggtctgggcttccagatttttcagtgctccccaggttattgtaaacgtgcagcccygttggagaatcactgcagtagaaggtggattatgtgctcaagagaagaatgtatttattttagttgtcagtttaaagaattgtgtgcccttgtactttgaaccactctgaatcacagaaccaagaattgcgsttcttggtgtagcttttctccaaagtcatagtttccagcatgttggggttttgcttggtggtgctagttttttttttttttcttttttttttggaggttaaattgttaattccctaatggaaacatgcaagagggtttcataagtactttgagcagaccaaggagtgcttcacagagaagatacatttcgctcatctactcaatcaaggctttgaacaaatatgtgttgagggtttagtttgtgccaggcaatgttctaggtgtttgggattctttactaacaaaacagatcactttccccttagagtttgcatcctagattttgaagstctgagtcttaagaagtgagaagttytgcctgtggaggagtggagaaacagtcttatttgggatcagatgggctgcctctagagaaaattactttacaaaagcaattaaaacaggccctaaggaatatgtgtttgtttttaagcctagccttggtggtttcttttgtgtagctgagaaaggaggctgtatttgactgtttgtcttggggactcataggctaagtgcccctggttttttcaatgtggacctcactgtctgaactcttgtgtgggcacgtggattttttctttttaaattcacaaataacagtgagttgaaaagccctgtctctagcgtaggaatgctgaatttgtctcaaatcaggtaagtatgggactttgctcatacaagttaatcttgccattaatccttgatacaatttcagtagacttgggtacagcataaaataataccagttgattcaatttagcttcactgacaatttgtagatagagtgaaacctgttactgggagaggcaggaaatttaytttacatagtctttcaggtgtgctgaatccctggctgtcctaaagacctggaactcaggtttgagggtgtggtctctaatctgggtgggtctaattgtaggtggacccacctttctctcattaaggctaaaggggccttgttttgcaagaacccaatttaatggtttcagtagaagcacttgagggttattgtgggccacgcactgttgggtctgggagtgatgagcttctagggagcagtctggtgggagggctggaggagtggtcgcatgactgcccacaatgtggtatgatggagtagtgagcccagaatggaggctggagagcgaggtagggggtggattgcagcaaggttttagtagccaagggaatttggattttatcctaaggacaatggattttattctaagggacaattcccttagaattgtattctctttttttgagacagattcttactgtgtcacccaaggtagactgcagtggcatgatctctgctcactgcagcctccacctcctgggttcaaacaattctcctgcctcagcctcccaagtagctaggactacaggtgtgcgctaccgtgcccagctgatctttgtatttttagtggagatggggtttcgccttgttggccaggctggtctctaactcctgactgcaagtgatctgmccgcctcagcctcccaaagtgctgggattacaggtgtgagccaccatgcccggccaattgtattcttattttaaaaaaattattttatttttttgaaacgatttcccaggctgragtgcagtggcgcaatcatgtctcactgtagcctcaaactcctggggtcaagcaatcttcttaaataggtgagaatatgggcatgtgccaccacaccctgcagattaaaaattttttttttgggctgggcgtggtggctcacgcctgtaatcccagcactttgggaggccgaggtgggcagatcacgaggtcaggagattgagactaccctggctaacacggtgaaaccctttctctactaaaaatacaaaaagttagccgggcatggtggcgggtgcctgtagtcccagccacttgggaggctgaggcaggagaatggcatgaacccaggaggcagagcttgcagtgaaccgagatcaaggcactgcactccagcctgggcaacagagtgagactcagtctcaaaaaaaaaaaaaaaaaaaaatttttttttttgtagagatgaagatctcactgtgttgcccaggctggtctcaaactcctgggctcaagctgtcctcttgccttgtcctcccaaagcgctgggattagaggcatgagccactgtgccagctggattgtcttctaagcaattagagaatttatacagggctctacacagaaaaggaaattgcattgtagaaagatcactcttgtcgagtgagggtttttatattaccctgattgtccatctctaggactgctgaagtctcttcctggagtatatgtttgtcagtttaaaaaccaagtgtacagtacttgactcatcttgatgaattacaaaacacctcttaccttccaccttcatctgtacctcttcctcccttgctctgtggtcatctgtgaacttatctgtcctggtcctaagtccttcagcaagcacagccgaggggtactcacaaaaatggcatgttcatcctcaggtccttctagagtcctctcactgctctcctgtgtctgctctgtaaactttttttttttgtttgagacagggtcttgctctgtcacccaggctggagtgcactggcatgatcatagctcactgcatctcaacctcctgggctcaagcgatcctcctgcctcagcctcccaagtaggtggaactcaggcgtgtgccaacctgcctggctaatttttttttttttttttttgagacagaatcttgctctgtcacccaggctggagtgcagtggtgcaatctcggctcactgcaagctccgcctcccgggttcacgccattctccttcctcagcctccccagcagctgggactacaggtgcacgccaccatgtccggctaatttttttgtatttttagtagagatggggtttcaccatgttagccaggatggtctcgatctcttgacctcgtgatccgcctgcataggcctcccaaagtgctgggattacaggcgtgaaccaccgcgcctggcctgcctggctaattttttgtgttttgtaaagacaagagtctccctatgttgaccaggctggtctcaatctcctggggtcaggcagtcctcccaccttggcctcccaaagtgctgggatcacaggcatgagctactgtgcctggccttgctctgtaaactttgagggttacacagttgactttgttcccttctcccaccagcctttaacacatctttctctgtgccaggtcacagaatattctgaggggaaggtgttagactggtcattttagaatcggtagagatccctgctggctgacctcacatcgttcccttcttacctccaggacagttggagatgtttcatgttagctgatgatcttcatttactcttcacagaggagactaactgtgtgacgagcaccttcatgtagtaaagattatttttactatgacatctaaatgtctacattcaatttagagttgaaagaatggaagggaaaatttgagcatgtatgataaggcttggtcaactatgattctcgatgtttgatctatagactatcacataatcccaaaagtgtcgtgaagtaggtggtattatctccacatatccattagtaaataccttcatatcaattaacaaatatttaagcacctactctgtgtaggcactgggcagatgagattcagaaaggttaaataagctgaccaaggccatgcagctggtaaatggccgagctgtggggtaatatcagattagtccaacttcaaagccagtgttctytgcactgctgcctctgggagcacctgctctgttctagcctggcatcagatgtaggggtggcaagacgaaggtgccarggtccctcccttgcggagctctctgcagggtgagttagcccaggcacagtaaagcactgggtattgaggctcttgagtgatagagcttttgcacatcccctttcctgcatctccacttggcacatgtctagtgcacacgtggaacrccaggcttggggctgttgktgccaaggacaatcgggccatgcttcacagactgaraagtcactcaccacggggcagtgagtggagagctgtaacagggatgggtttggagtacccaagggtcaggggaatgagcgactgaccatcaggaaggtcctcacagaagaggtgacatctgagtcttactgatggacaaggagggggacaggacatttcgggcatagggagcaatacatgcccaaaatgtcaggaaatgctgcttgtctggagtgcttggggcactgctggccctcccttctctcatccrtgctctcctgcgttccctggacacttgcrtgtttggaggaaggcaggagatgaggctagacaggaaggctggggccagtctgtgaagggttcctgatgagctcaggggtagggattattctgtaggcaaatgtggagccctggaagggttctaaactaaggckgaagtggtggggtttgcattttagagctcctctggcacgctgcagagaaagggtaggagggagaagacagggagctggtgaggagctgttgaaatccttcaggctactggtgatagggctggagcaacatctccacttatctttccttctttcctttggagatgcacagttcaccaagcagtgcttccaggaagaacgaactctcccctttatgaagtcaggtggtttgtctcttaccttctgcccatggtctacctacttcttacctttagagccaactgtcacctgctgaaactcatcctcggtgtcgttgatccatcttaggtcctccagcctaggagagtgtttctcactttctctctttttttcccccttcccccttcctccttcccacttcccactccccctccccctccccctccctcctttcctgtctgtcacccaggctgaagtgcagtggtgcaattggctcactgcatccttgacctcctggctcaggtgatcttcctgcctcagcctcccaagtagctgggactacaggcgtgcaccaccatgcccagctaatttttctgtattttttgtagagaggggtttttttgccatgttgcccaggctggtgttgaacttgtgggctcgagtgatctgcctgcctcagcctcccaaagttctgagattataggcaggagccaccatgcccagccaacagtgtttctcactttcatatttcattactcctttcccttggcttccaggatgttagggagaacttgagtttgaatcccggttctgccacttacaagccatgtagcagtttcactttctgtaaaagaagtatgacggctgtagcacttctgtaaattgtaaatctgtatgaaaatataaggtatattattatactcctaatttttttttttctcccccaactccagtcttggtcttcacaaccagaggtggcaaaactgctggtctgtggactggatgtagcctgctaggtccttaacagtatttacattttgagacaattcacattaagaatttatgactccaggctgggtgcggtggctcatgcctgtaatcccagcactttgggaggctcaggtgggctgatcacttgaggctgggagtttaaaaccagcttggccaacatggagaaacctcgtctctaccaaaaatacgaaatgtagctgggtgtggtagcacatgcctgtaatcccaactactcaggaggctgaggcaggagaatcacttgaacctgagaggcggaggttgtaagtgagctgagatggcgccactgtactccrgcctgggcgacagagtgagactgtctcagaaaatagaatttatgactccagtctaagtccctaccttgaactgaagaattgaatgacatcacctccccattttatgtcctcttttcttattttgtttttctccttggcagttatcactctctaacatacatatttcacttgtcttacctttctcctggttttcccttcccttaccagctaaaatgtgagctccaggaggcagacgttcttgtgtgttattactattatttwtttttttgagacagcgtctccaaaagtttggagcgtctccacaggctggagtgcagtggcacaagctcggcttactgtgaccttgaccttccacactcaagcaatccttctgtstcagctcctggagtagctgggactacaggtgtgggtcactgcacccagctaatttttgtatttttcttgtacagatggggtcttgctatgttgcccagactggtcttgaactcctaggctcaaatgatcctcctgccttggcctcccaaagtgctggaattgcaggcatgagccaccacacccagccttgtttttttttttattgaacgctaaacccacaggtccagaaccgtgcctgctggcacagagtaagtgcttagtaagtgcttgcttaatggttgaaaagtgcactaaattcaatatttctggttttacttgaaagaaacagaatctctaactctgattctctactctcaaatggcaccagttagaggtgaggagcagctgcccgtctgagggtgcagatactcctcagtttgttgcagatctcaccctctgtgttgtatatgtggctacagcgggagcagagggcaggggtggagaagcagtcagtggagatggggccttaacagacaggtgggaacacaaaatgggacggaggcaaggacatggcaagcagaggagataagatgtgctagcaaatgtgtaagagggtgtgatgggccaagggtggcaggtggttggtggcaggcagaagagggcactagagaagtgggctgggaagttggggctgtgtctcacagggcaggccctgggagtcatcaaatttattattagtattagaggccaggcacggtggctcatgcctgtaatcccagcactttgggaggccaaggcgggcagatcacttgaggttaggccaacatggtgaaaccccatctctactaaaaataccaaaaaaaaattagccaggtgtggtggcagatgcctgtaatcccagctacttgggagggaggctaaagcacaagaattgcttgaacctcagaggcggaggttgcagcgagctgaggttacaccccgcactccagcctggacaacagagtgagattttgcctcaaaaaaaaattatatatatatatatatatgaattccttaaatataaaaagatacaaagaaaacaggctgagcgcggtggctcacacctrtaatcccagcactttgggaggccgaggtgggtggatcaccagaggtcaggagttcaagaccagcctggccaacatggcgaaaccccgtctactaaaaatacaaaaattagccaggtgtgattgcacatgcctgtaatcccaggtacttgggaggctgaggcaggagaatctgttgaacctgggggacggaggttgcagtgagctgagatcgcaccactgtctccaaaaaaaaaaaaaacaaaaaaaaaaaacaaaaatgacccgtaacctcctttaacaaataatctctgtagacacgttagaaaatacagaaagtaagaaaatttactaagtccacagaggttcaaaatgatagcaaacaccacctttcctattcatcttcgtgaagttagcagctgccaacagtttgagtactttcaggaaaatagatgtctatattaacaagtatagatttctaaaggtttatgatttttttttttttttttttttttttttttttttttgggagatggagtcttactctgtagcccaggctggagtgcagtggcacgatcttggctcactgcaagctccgcctcccgggttcacgccattctcctgcctcaccctcccgagtagctgggactacaggcgcccgccaccacgcacggctaattttttgtatttttagtagagacggggtttcactgtgttagccaggatggtctcgatgggcccgcctcggcctcccaaagtgctgggattacagacattagccaccgcgcccagctaggtttatgattsttttaagttttattttcctttggcccttgattcaggataatgattaaaaaaaaatatgatgtgctcttcggaaaaaaatttcaaatgatacaagaagcttataatataagcacctaagcctttgtttgtttgtttgtttgagacagagtctcattctctcacccaggctggagtgcagtggcatgatctcggcttactgcatcctccgcctcctgggttcaagtgattctcctgcctcagcctcttgagtagctgggactataggcatgtgccaccacgcctggctaatttttgtaattttatttttattttgcttcttttttttttttttgagacagagttttgctcttgttgcctgggctggagggcagtggcacgatcttgcctcactgcaacctctgccttccgattcaagcgattctttgcctcagcctcctgagtaagtgggattacaggtgcccgccaccatgcctggcttaagttttgtattttcagtagacacagtgttttgccatgttggccaggctggtctcgaactcctgatgtcaggtgatccacttgcctcggcctcccaaagtgctgggattacaggtgtgaggcactgctcccagccgagcctaagtctctttctacttccctgcattccccaaagagatccattataaacagtttagctttttagacttgtttgcgaatatatacatataaagcaattttgcctttytttttttgagatagggtctcactgtattgcctaggctggagtgcagtggtgccgtcacggctcactgaaacctctgcctcccaggttcaagcgattcttgtgccttagcctcccgtgtagctgggatcacaggcgtgtgccaccatggcccagctaatttttgtaatttttagtagagacagagttttgacaccttgcccaagctggtcttgaactcctgagcctaagtgatcttcctgtcttggcctcccaaagtgttgggattacaggcatgagccaccgcgccccgtgtgttttatagagatggggtttcgccatgttggccaggcttgtctcgacctcctgggttcaagcagtccacctgcctcggcttcccraagtgctggattacaggcatgagccactgtacctggtctgtatttacttttgagaggaatttaatagaaatgacttaggaatgcaaatgggataatggtttactgcttatggaatggccttaggaggacatttgtggagagttcttacacccggcagggattagactggattagaatttcacatcaaaatagtctggcaaacaaagtctagctttttctgtgtggagtcctggagtgagtgggtgcaagagggggctgaggcttcacttccgtcttggaggaggtttgttgttgggagcagtctatcttgactgaccctggtgcagtcactgagaaactgaggtattttccaaaaccaagttgattatttgaggggaagtgtttgcagagaactttcaggaggctttgggtatggtgggaaaaacactgcactcagaactgggggattggagttcctggggctagcccttcccctcactgggtcctcaggtttcctttacccttagatatgggattgggctagctggtttctagggccctttccagtgggaagagcttgagctgctgttttgcctgaagtgtagtccttgccttccaggagcttgcagtctggtttaatgagagtgttcatttcagctccttccgtccccttgcagtgaaaggatatcatctgctgagcatgagaaggcgaatgctaagaaatggcagcaatcagcccctcttacagtgccacttcaccacccggagagaacctttgccttagccacagtcactttccctttgactggtagaaccaccactgatttataatttgccaaatgcttcatgtacgaaagtgcccttggaacagccctttcaattctgttttttttttcccaggttgattccaaagatagttctcataactccacaaactctgaatttgcagctgaagctgagggtcagaatgatacaattgaggaacccaacaaggtccagaaaaggaagagggatagacttcgagaccagggctccacaatgatytacctgaaggctatccagggcatcctggggaaatcgatgccaaaaaggaagggagaggctgccactcgggcaaaaccaagygcagcagagcrtcccagccatggagaaggaccagccaggagtgaaggaccagccaagactgcagaaggagcagccaggagtgtcacagtcactgctgctcagaaggagaaagacgcaaccccagagrtcagcatggaggaggataagacagtgccagagaggagcagcttctatgacaggagagtagttatagaccctcaagagaaacccagtgaggagccccttggggaccgaaggactgtcattgacaaatgctctccacccctagagttcttggatgactstgactctcatttagaaatccaaaaggtgagtaaagcttgyaccaggcatctgactttttagttctsttgatgaaatgtgttccatctttctagtttgatcctaagtgttactaattaaaaatagtactttacttaaccaggcctccaggraacaaactgatggttttcttctaacatacttttcagattttcagagttattaataaacctaaactaagtgcttttttttttttttraaggatttatatgttaggatatgggtttagctgctgtgtaaaaggccaaaatcacagtggcttraacagaatataagtttggcttaagaaggatggctccatcatgtcagagatactggtaccttttgtcttgattctctatcacccctcaacacagtgtccatctcttggtgtgaaatggatactctgataggactcagggtttgttatctgggcattctggccagtgggaaggggagaagaggagagtgcattccttccctkttaagagcttggctcaagagttgcacatgttgtatctgctgttgacaagagcggggaaacccggctgacacctggctgcaagggagtctggaaaatcagcctttatctaggcagacttgtacctggataaccagagaagaagggaaggatgtcattggacggaaactagtgatttttaacatagcttataattgaggggaagcattcctccatctttttctttttttttttttttttgttgttgggacagagtcttgctctgttgcccaggctggagtgcgatggtgcaatcttggctcactgcaacctccacctcctgggttcaagcaattctcctgcctcagcctcctgagtagctgggattacaggtgtgcgccaccaaaccggctaatttttgtatttttagtagatatgggatttctccatgttggccaggctggtctcgaactcctgacctcgtgatccacctgccttggcctcccaaagtgccgggattacaggcatgagccactgtgccaggccacattcctccatcttactcgtctccacccatcctttactactgctctgcaggcagcttctctcatctttagctctttcttctagtacttaccccatgtttctaaataatctttactgttgatcagtttttcagttttagatgtctgaggacttcttgcttgggcgatgagaatttagttctctatacctccttcagaagcacccacacccagggacacattagcttcccctttctgcagcctccctgtgtggcttgaataccttttgggttaagtctgtgtaagatttgttactgccatgttcacagctgagtcgccttgtatactctgatcacattttctttcttgtaaaacttcattttccttaaagttcatcattactttgtttttcctttggttttcctggtacctttcactaattaatccccaaactgcgagagctgtaaaatccttctcaatactgtcaaaataaggaatctgtttcttttttttctctcttggaggtatacgtcctcagccctctgttgtcctgctctggtctggactgcctgccgtcaggccagctggcagctgtctctctggagcctccttcacatttctcccggattgagtcttctgctacctatactctgtgtcttctcatgttcttcttccttggtttactctcacattttggtggaatactttttctagtagcttcttgagaaagggtacatggagaaactttttttggtaaacatgtgtctgagattgcctttattttacctttaaccttgattacaagcttggttggttttggaattccaggttggaaattgttttgtttgggattttgaaggcattgctccttttcttctgggcttttttttttttttttttttttttgaggtggagtctcgttctgtcttgcccaggctggagtgcactggtgtgatcttggctcactgcagcctccacttcctgggttcaagtgattctcctgtctcagcctcccgagtagctgggattacaggcacacgccaccacacctggctaattttgtatttttggtagagacagagtttcatcatgttggccaggctggtctcaaacttctgacctgaggtgatccacctgcctaggcttcccaaagtactgagattacaggtgtaagccacttcgcctggcctcttctggttttcttgatgtctgaagctatgctggttcctgaaccttggtatatgattttttattttttattttcttttgctttgagacagagttttgctctgtcgcccaggttggagtccagtggcgtgatctcagctcactgcaatcttcacctcccaggttcaagcgattctcctgcctcagccttgtgagtagctgggattacaggcatgtgccaccacacccggctaatttttgtatttttagtagagatggggtttcaccattttggtgaggctggtgtcgaactcctgacctcatgatccgcctggctcagcctcccaaagtgctgggattacaggtgtgagccaccgtgcccaacctgtattttttttttttttccctctgtggaatcttgtagaatatattttgatctcagggctctgaaatttcatggtggtggtgtctactttgcttagcatgggacattccctttcaatctaraaacccttgtactttagctgtgggaaaagttcgtgaattactgtacttcgctgatgttttctttccgtatttttcttctctctttctctctctagcttctctaccttctttctcttatttggatgttggatttttcaggactggtcctgtaattttattgcctttctcccttgtttctagccaatttcttgctttactttgtaggatatttccttttctttatcttccaacccagctgtttatttagttttacttttctactgtcatgctttttattatccaagagctcttttgttttttaataacatctctgttcttgtttcatcttctgttatctcttttagggagttcatggtagttttttggcttggttttagttttctttaagttgcttctttccgtttcttttgatctcttctgtgttagaggctgccttcacatgtctggtaatctttggttgtctgtttatgatcaagaatgggaggattaaaaagctgtttggaagctctgagcgtaaagactttgagctttgctttgggatgatcggsagaayataaccctcttccccttgccatgtcactgcttttaggaaagcctcgagactggtcaccttgcccagaggagtgtttttcagcctgcttaggaggaaaggtggctgggagctgggtagcgaaaggggcggctgcgggggcggcgtcagcattcacttaatctttgtctttttggtgcagtaccagtgccctccactgagctgaccaggccttattctagagatcctcttgttttactgtcttcaaacaactcaccttctctgagtatgaggagggaatctgggatctaactcattggaaaccagatttcaccctgtcctcctccttttaatgttcttctgtaactccagttcctccagttcccaaggtgcccagtaccgcgagtgcctgctctgttctaagctttcctggtgcctagcttaggtctcagccttctcttggtctgccagtgaggtgttatttggccatctgctttctagcctccagtgcgtgatcactgtagtctcttgttcttcctgttctggtgtttttgttattgtagaggggttttatttgttttttgtttggtttttagattctttagttttagtgaggtttcaggaaagagtaaaataagtcgaatttgttcagtacatccttagcctagaaaagttctgggaaaatttcttgattatttgatttcttgtctgtttcttctttttctggaccatctattttatgcttggtctttcggatggaaattccaattttcttttcttcccagtgaatcctttttaaaaaatttttctggatggtttcttcaactttatcttctttttttttttttgagatagagtctcactctgccacccaggctggagtgcaatggcttggtcttggttcactgcaacccctgcctcccaggttcaagcgattctcccgcctcagacccctgaattgctgggactataggcgcatgccaccatgcctgtctaatttttgtatttttagaagggacggggtttcattttggccaggctggtctcgaactcctgacctcaggtgatctatccgcctcggcctcccaaagtgctgggattacaggcgtgagccaccgcgcctggctcaagtttatcttctaacgtttatgttgattttttttttttggtcttttttttttttttcctgtgcgtggtttttttttttttttattgctgccaatttttttttcttttttgtctttttgagacagagtctcactctgtggcccaggctgaaatacagtggtgtgatctcagctcactgccacctctgcctcctgggttcaagcaattctcctgtttcagcctcctgagcagctgggattacaggcatggaccaccatgcctggctaatttttgtatgtttagcagagacaggatttcaccatgctggtcaggctggtcttgaactcctgacctcaggtgatccacctgcctcggcctcccaaagtgctaggattacaggcatgagctaccacgcccggccagaactttaaaaattaaaaattttagctgggcgtggggctcatgcctgtaatcccagcactttgggaggctgaggcaggtggatcatgaagtcaggagatcgagaccatcctggctaacacggtgaaaccccgtctctactaaaaatccaaaaaaattagccaggtatggtggcgtgcacctgtagtcccaggtgctggggaggctgaggcaggataatggcgtgaacctgagaggtggagcttgcagtgagctgagattgcaccactgcactccagcctgggcaacagagcaagactccgtctcaaaaaaaaaaaaaaaaaaaaaaaagtttttgtcatccaggttggagtgcagtggcatggtcatagctcattgcacctttatttttctgtggtccccttggtttaacttttccaagcatcaacttttgtcctttgctgggtggggaaagggcaggccatctgcacagggtgggagcaggggtctggagatcttgacagacttcagctaattcctattttcatctgcggcttcaccctcactttggaagtctggcacctccaattcctgagtctttctggggtcctgtagtctggttctgggtttttcctcactgaaggcttaggttttggccatctgatcttcttggctgataatcattaacccatctgttttctatgctctgttatctgtgaatagcatccaatgcttatttaatttgctttgctgttcattttgtgtgctttccccttgtaggtttataccttttcggatatatttcctgtaactttagaagggtttttgggtgggaaggacaaaaactrtatgctatatatataattggaaattcccacataaagtaggtttgtaagatattttcctcccaaatatgtaatgggtgtgttttctgtctaatgtagatcatcttacttggttgcctctaattccattgtgtggatgaattttctaaagttatacccaaacttctatttatgagactggacgacaattaggttttctcttacgtatctatttggagacagcacagtatggtaggtgagcatgtgagtgttgggatcagaccatttgggtttaaatcctggccctgccactcgaattaggatcttgagaaagtcagcctctttgaaccccagtttcttcctgtgtgtaaaatgggctagctcttcaaatgttaccacttgtaaaaagctaatacagggtcagatgcatttttgggtttacagcctctgttgcagcttttcarctctgcatgaaaatggccatagacaacgtacaagtgaatgggcctgactgtattccaataaaaccttatttacaccagcaggcagtgtgttgttcagtgaggtttcaggaaagagtaaaataagatgaatttgttcaatccatctttagcctagaaatgttcttgtgggctgcagcatgtggaactctgaattcatacgtgattactctttgctcagtgcccagtagtaggtgctcaataaatgtaactttaaattttaccatacaggcttaaactaactaaggcagtctttttttttttttttttgagacagagtcttgctctatcacccaggttggagtacagtggctcactgcaacttctgcctcccaggttcaagtgattctcatgtctcagcctcccgagcagctggggttacaggcgtgcacaaccgcatttggctagtkttttgtatctttagtagagatggggttttgccatgttgcccaggctggtctggaattcctcagctcaagtggtctgcctgctttggcctcccaaagtgctgggattacaggcgtgagcccccttgcccggctgagacagtcttgaatatcggcagtctcctcctatttcccccacaccccccgacaaaaaaaaaaaatctgaaaacattttcttggccaacttgactctagaaacctttcaaggatttagatgacataattattatgtctgtttatggtgtatgtttctagttacatgtgcatttttgaaactgcttttttccttactttgacattttcctatccagtctgattaaatttccctgtttgtttgatgattgttttggttcatttgaaagaggatccaaatgagaactgtatgtggcaatttttaaatgtgtcaagtctcttcgtctctatagattcatccttttctccctccaaaatgttgtaatttatttgttgtaaaaaatggggtcatatgtctcgtttttgctgatgagaatatagtactttttgaatctgtgtattgttcttggaaattttattccaagttgcaaatagtcatcatatcacattgaggcagtctgtttccgtttttcctcgaggtgtgtttttgggattgccataatgtgaccacctccaattattttgcagacatgttaatgatgtgttactgtatatgataaacattttaactttcaggtgcacctatacaaaastagacttgtagttccaatatgtttcactagaaaattcagcagggaaaaaaaacaaaacagaacacaaaagccttgtcaaacttaggcaagactgtaattttttattgtctgggttgatggaaattttctgttataaccgagatagtttttgaaggattgttctcccttatagataagtttttaaaggttttaggggaaattgcaaacattcaaagtaaacagaatagtgtattgaatcaccagrtgcccatcacccagcttcaagagttcagattaaattaaaaatgtgctacatttaagttagcttgcattttagaaaagattcttgtttggatatttctgccattcaagcagtagctgtgagaagtctaaggcaggaaagtataaaatgggaaatgggtaattcatttaagtgttggttactaatacttgtttcctgttagagtgtagttaggggtatgaaatattagtacagccaacataaacagttttgttccattttaatcaggtaattcagctagaatgctctttcattgtgaatgtttgttttattatgtgaattacatatactcataaaagtattaagagaactttgtaaggcctcttgctcatcaagccttctgtcattggcaggtatagatggctgctttaagaagaaatgatggcacttaaattttgtttccagcatgaattgatattgatgtgcttactgtatttctcaaacctggtctgcatcacaattccggggagagttaaatgcagattccttggccccaccttggacctattgaatcacaatatctcagggtggaatgggccttaaaaatctgtttttaaaatgctrcccagttgatggagatgtgatgctaagttgaggcaccatttattctaaaaattaattcagcagatattcatgagcactcagtatctgccaggcactgttctaggtgttggggagacatcagtggaaaaaaaataaaaattcctgatctcgtggcgcttaccttctctagtaggactaagccgatttaatgcaagggatggttgtttcagtcactattactagttagtagcttaaaataacttttcttttgctctcagtactgtgggtcaggaatttggaaaggcctagactggggcaggtgtttcttggggagccccatgtagttcctttcagattttggcgagggctgtcgtcatctgagagtgtgactgggctggacatccgagatgttcacttacatggtggacagatgttggctgtcagccagtaagtcagccaggctgtaaactggcacacctacatgtggcctctctagcaggatgtcatttgggttgccggacttcttacatggtgcttggcttgctccagagtgagcaagtggagtgaaccagatggaagctacaaggcccttctgacctggccttggaagttacacagcttcgcttctgttgcattcttttggctataagtaagtctctaggtaggtccagattaaggggaggggtcatagaccccactctcaatggggagaagggttaaataattcggggacacgtttaaaaactgtcacaatggccaggtgtggtggcttatgcctgtaatttcagcattttgggaggccaaggcaggaggattgcttgagtccaggagtttgagaccagcctgggcaatatagggagaccccctacctacaagaaattagccagatgtggtggtgcgtgcctgtagtcccagctacttggatggctgaggcaagaggattacttgagcccagtagttcaaggtttcagtgagtcgagatctcaccaccgcattccagcctgggcaacagagcaagaccctgtctgaaaaaaaaatacaactgccacagctgttgtaattttacattttgaatatattgacgacagtgtcagagaggaaaagctgggcastgyttttctctaaaatctccaatccggagtgtgttctagagagcagtttttctcaagagaaagggatgcaggtagagcaccacctttaggagtagcatgatgaggccatggtcacaggcctattccctgaacccaatacagctgttcacagcagtaacttggctcagttctggacatttctggaaattgtaaggaaaccaggtgacagggtgagctaatgagccaatgcaaagccatcaccatggccagaagaacaagccagggtttatgttcagctgatgacagcctgggaggccatcttcacrtcggaaggctaacccactgttgtatgccttcttttctgcagcataaagatagggaggtggtgatggagcacccctcttctggaagtgactggtctgatgttgaggagatctccacagtcagattctctcaggaggaacctgtctccctgaaaccttcagccgttcyggagccttcttccttcaccaccgactatgtcatgtaccctcctcatttgtacagtagtccttggtgtgactacgccagctattggaccagcagccccaagccttctagctacccctccacaggcagcagcagcaacgatgcagcccaggttgggaagagcagccggagccgcaygagtgattattcccccaactctacagggagtgtccaaaacacctccagagacatggaggcctcagaggaaggctggtcccagaattctcgttcatttcgcttctccagaagctcagaagaaagagaggtgaaggagaaaagaacattccaagaggagatgcctccgcgtccttgtggaggacacgcatccagctccctgccaaagagccacctggagccaagcctagaggagggcttcattgacactcattgtcacctggacatgctctattccaagctatctttccaagggacctttacaaagttcagaaaaatttacagcagctccttccctaaggaatttcagggctgcatctctgacttctgtgatccccgcaccctgacagattgcctrtgggaggagctgttgaaagaggatctrgtctggggggcctttggctgtcaccctcattttgcacgttactacagtgagagtcaagaaagaaatcttttgcaagccttaaggcaccctaaggctgtggcatttggagaaatgggcttggattactcttacaagtgcaccacgcctgtcccagaacagcacaaggtaacaaggctctctttagtctgcttatagttttaatttttcttttagttgttgaagcctgacaataagggtttatctaattttagaagtaaataattgagaatccctgaaaacgcagtgtgcttgctctcatccagaccatctagatgccatttgtcaaatgctttacaagctatttcttactgttcagctttattatggaagatgagggagaagtactttgtgacttcttatggatgatatcaatgtcaaaacatttgttttctttctttcttgggaagcaataaactttaggttttcttaattkattttttgagagggagtcttgctcttttgcccaggctttggagtgcagtggtgcgatctcagctcgctgcaacctccgcctcctgggttcaaactgttttcctgcctcagcctcccaagtagctgggattacaggcgtgcatcactacacccggctaatttttgtatttttaatagagaccatgttggccaggttggtattgaactcctgacctcaggtgatccacccgccttggcctccgaaagtgctgtgattacaggcatgagccactgcgcctggcctgcattgttttttttaaatatacccattgcagaatatttgaaaaaatatgaaaaaatgcataatttcccattcaaccagagatcatggctaatactctgttaatatttttttctttttctttttggagacagaatctcactctgtcacccaggctggagggcagtggcacgatctcggctcaytgcggcctccacctccgcctccgcctccgcctcctgggttcaagcgattctcctgcctcagcctcccgagtagctgagactgcaggtgtgtgccaccttgcgtggctaatttttgtatttttagtagaggtggggtttcaccatgtttgttagactagtctcgagctcctgacctcaagtaatccacctgcctcggcgtccgaaaagtgctgggattacagacctgagccactgcgcccgccccctgttaatattttttttcctcccaatattttttgagcatagtgctttggcagggtaagagttgtagtattttagaatttcttttctttttttttcagagataaggtctttgtcgcccacactggagttcagtggtgcagccacagctcactgcagccttgacctcctgggctcaagtgatcctcccacctcagcctcccaagtagctgggactgcaggtgcacaccaccacgcctggctaattaaaaataaaaatttttttgagatggagtcttgctgtgtcacccaggctggagggcagcggtacgatctcagctcactgctacctccacctccccagttcaagtgattctcctggctcagcctcctgagtagctgggattacaggtgcctgccaccacacccggctaatttttttttttttttaaggcagagtttcrctcttgttggccaggctggagtgcaatcgcatgatattggctcactgcagcctccagttcccaggttcaagygattctcttgcctcagcctcctgagtagctgggattatrgactcccgccaccacgcccagctaattttttgtatttacaggatcacacctgtaatcccagtattttgggaggccgaggcaggcggatcacctgaggccaggagttggagaccagcctggccaacgtggcgaaaccccgtctctattaaaaatacaaaaattagctgggtatagctgggygtggtgactcatgcctgtaatcccagcactttgggaggccaaggcgagcggatcacctgaggccaggagttggagaccagcctggccaacatggtgaaaccctatctctaccaaaaaaaaaaaaaaaaattagctgggtgtgatggtacatgcctggsgtcccagctactcaggaggctgaggcaggaggattgcttgagcctgggaggttgagctgcagtgacccatgattatgctccagcctgggtgacagagtgagaccctgtctcaagacaaaattatcagggtctcaggtctgcacttaaaggtccatggggcgacctgcacaacaaactgaactagaagcgataggcatagggggataaacacagtcttgaagatgtcatttggcttggtgagatttgactcaagactggaagataatgagtctgaggagttgctggctgggagagggctaagctgcctgtaaaggggaggaagactagaaaatatttgtcaacaccagagactcctaggctgggtgggggatatggacactgttttgatgtaaataaaaaatttggcacccaaatgaggtgaatggtggtgactggcaactgcacctagttggatgtcagtgctgagttgcatttacctaaaagagcagttagcaagttctkgatgtgtcctgctgaatgttttatcttgtgaagggaagaagaagaacctatagagggctgggcgaggtggctcacgcctgtaatcccaacactttgggagtctgaggcaggagattgcttgagcctaggagttcaagatgagccaaggcaacatagtgagaccccatctttattacattaaaaaaaaaaaagagcctgtggaaggtctgtatctgggcaagatgatagggtgacagaccctgctcattataggagagtttggttgatgtacctaaaattttctggaaggattggaaaatagagaaaagcaaaacaattggggaaagaatgggtagttatagttattctgctggttagagcaaattactgttaacgttttctttgttgatctgtggtgtttacagattaactatgtaactcataagagttagatcctgaatagtttgtgtgtaagttgcacatgtcagcatctgggagggatgccagggagagtagactgtccttccctacccaggctgtatctctttacttgtgttaaagaggaattaattaattattaaagtaataaatatgcaagagatgcctggggcaactcccaggagagactaactctggaatccctggaaataatggatcagttaggaagccaaccttatgcaggtagaagtgagtaattatactgggtaataactcatctgtacttccttcactcctgttgtttttcagctgggttcctggtgaggacaaatgctgcaaatagctcctgtccaaccacaagttcctgcattctaatgagttcttcttccttcttaacatttttgaaatctggatgtgtttcatgaaacattataaatgtaatgttattgttccttggaaaattgyaaggtacaatacaattgcaaggaacagttgcacagtggcttgtcttccatgcacctgtcgtaggttggatgtgtgtgcttgtgttaaagaaagaaattaggaaattaaatagttttaagtgtcttttctactcgtgaaattttcccattcatcagctatactttgaaaaatgtttaacagctgtgtaatattctatcctaaagctctaatagtttatttcactactctgagggataattttttagaggcaggaatgaaatgttggaattggaatctcttgaaacctctgctgcctgtgtgtaggggtcggggagggcagatgaacagcttagcagatgcaaataggaggggctccagccacctattgatagtggaactggccaggctttagataaagcctctgtcaagcagtctataattttgatgtctgtggtcattttcctttctttgaaaacacagattaaacaaaagttacatcagaattggtattggcttagtgttgctattttgagaagaggcagtacrggtgttagacttgtaaatattctcaagtgaatatcacctgactcaaattacaaaaagtatctcattgtttgatgctgaaaacataaacacaaattatgttccacagttgtagaaactactcatggaaacattaatatgaggtaatttgcttataatgaattaattttttttttttttttttggagacagtcttgctctgtccaggctggagtgcagtggcatgatctcagctcactgcagcctttgcctsccaggttcaggggattctcctgcctcagccacccaagtagctgggattataggcacctgccaccacacccagctaatttttgtatttttagtagagacagggtttcaccatgttggccaggcttgtcttgaacacctgacctcaaacccgacttggcctcccaaagtgctgggattacaggtgtgagccaccacgcctggtgaattaatacttttctttgttctaaacctgggctcgttagaggaaagaacaggtcctaactctacttttttcatttaaattaacaatagtgaagatttaaaagtgggtagtgttataaagagtaaagtatatttgtagttattgacctgcgaggatacgcgattttgattgagtaaaggaagcaaattggccgggcatggcggctcatgcctgtaatcccagcactttgggaggctgaggcgggcagatcagttgaggttagtttgagaccagcctgaccaacatggcgaaaccccatctctacaaacaaatacaraaattagccaggcaaggtggtgcctgcctgtaataccagctacgcgggaggctgaggcaggagaatcgcttgaacccaggaggtggaggctgaagtgagctgcaattgcaccactacactccagcctgggcgacagagcaagattcggtctcaaaaaaacaaaacaaaacaaaacaaaaaaaaaaaagcaagttgtagaaaataagtgtagtatttgtttctttaacaaatatttgagtaccttctgagagccaggcaccttgctggagatgcacacaaacaccacgccctgccgtccccaacagctctgcataggagaggtctggaagttggtatctcttgagagcggaggtggggacagtgaggtgagggacattaactttgcgctttatgttcttgatccctgccctgcccctgccaccccaggtcggcatcatatagtggttactgtgtggaatgccagggttcaagtttggatcctggtgctatagctgctggctgcaagttaacttgccctcactgcatgctgcgcagacagcagcacctgcctcagggtggttgtgaggactgcaggttatgatagacgtgcagtgctttgggcactacctggctctattgtaagtgaccaataatcattagctattattacattatatagttaaaaaaagagagacacagggggtgcctgctggactgggcgttccagaggtgatggacttctgaagtgctgctaaccaacaggggttgtcgctgtgtcctctcctaggtatttgagagacagctgcagctggctgtgtctctaaagaagcccttggtgatccactgccgagaagctgatgaagatctgctagaaatcatgaaaaagtttgtgccccctgactacaagatccataggttagaagactggaacttcagcgggcaaatgaaagaaacacttcctctgtcaagttgatgaggacagcaatgatcgtattctgtcattatacactatctattcttttttttttttttcgagacggaatctcaccctgtcgcccaggctggagtgtagtagtgcaatttcagctcactgcaacctctgcctcccgggttcaaacaattctcctgcctcagcctcctgagtagctgggattaccggcacatgccaccacgcccagctagtttttgtattttaagtagagacggggttttgccatgttggccaggctggtcccgaactcstgacctcgtgatctgcctgcctcggcctcccaaagtgctgggrttataggcgtgagccaccgtgcccggcctatacactatcttttctaaagaattaactattaggttaaaccacttgaaatttctcatatttgacctttttttttttttttgctcacaaaatagtaacttcgtatggtttgaactaataaccctaaatcaccagtgagcacaaggggccttttgtgcccccatcctggggatgggcagaaatggagtttcagttctcagcagtgaggaytgctgatcttgagaggttgctgtggggtgtggtggcttagcacacagagcatcttagggtacttgaaaggacattttctttcctcttttgaacttgaaagctcctttctccccagttatgaaaatcaaggtcatgttttatcagaatggcatctatgggtgcttaagttcagtttggtaaactctctgaacttctgaactcttgccacgtgtaggtcctgggctttggcttgcctctggggacatctggaggtgctgccaggagacaggttggatggtggcttctgcctacatagcatgtgggactgggtggtcataggtgctgtgggagccacagcaggggcccattatcatagcccagccagaagactcaggaggtgatgcctggccggctccttaaagatggttgagaggggttggctgaataacaaggactctagcacccaaatcgggtcttgtcagatggcagaaaaaggaggatggkgctgtcagggcytttgggtacctaagcagaatgagtgaagcctctgacccctggctgctgcacacaccaatgatgaggcagtcagttggcttttctgggtcggttggtttttcattacttcattttgggctaactttgaaggaaatgtaatggtggctggtaggccagggctaaggtgacccaacgaggtggtattgcaggaggaggccctaaatttacagattggtaactatatatatggcaccaagaacatgaacaggtatcagattaagaaaatccacctgtagttcgactccccagtattttgttagatttcctttcagttcatttgactacttgggcatagtttttatatgctgtcgttgtcatcataggggccacagttgttgattttgctcctcttcagtgttagaagcatttcctatcccagtgtgttctctgtggtggtcatctcaggtgactgcagagcactctgtggtgtgcgtggtatctctgagtgatctctgatcactcaccaagtgccatctcggggcttcctgtgttggagccagcccttgtctgtgtttactgtggagtccttccctaggatgcagtctttccatttctgggaatcattgaaaaggggtgatgggtgtggggggagctgggggctgctgcagaggggactgtgagcagccctgatgtggagttctgtctccaggcattgcttcaccggcagctacccggtcattgagcccctgctgaagtactttcccaacatgtctgtgggcttcacggcagtgctgacatactcctctgcctgggaggcccgggaagccttgaggcagatcccactggagagaatcatcgtggaaacggatgctccctatttcctccctcgccaggtaagggggtcttcaggctgagtggaggcaccggagggagagggtggggaggtgggtggtcacccttacaaggttggcagggccagagccccagtgacttccaggtcccatcctgggctgtgtagatgcctccttgctgttactctgcagaaccaaaagtctagggggctgagaagctgaagggtaaccactctcttccaggcagtgcaaagccctaccctgtagagggtagtccaaggaagcgtgggaccctgctcacccagagcccccatgactaggactctccctgcacctgcaggtaaaggggtctctacagggcagccccaaagaggtccttgctggggaagggacagggagggagttctagattatgactgtgcacacatggcacaatgatgttatgaccacttgatgtcttccaggttcccaaaarcctttgccagtatgcccacccgggcctggccttgcatacggtccgagagattgccagagtcaaagatcagccactctccctcaccttggctgccttgcgtgagaacaccagtcgcctctacagtctttaagcagagaaggtacagtcctcgggagtctcctagaaaaggtcgtaaaactcacattctgtatkttttaaaaaccaggacaagtcttttgttgcattttgttaatgtaaagaatataaacatagtatgagcattaagcctgatttgttttgagtgacrtggtttggaaccttcttctttttctcttccaccctccagggcgaccagcagcctgacagaacacaggctggcttgaagtctgtgtctcaggtcgaggatgtgwttagagagctgattggaacacagaaaaccaggacaggatgttttcctccaagcgggtcataaggcttcagcttctgggtggtgggtggggtggggtgggcatggaatgaggggtatggggactgcctgtaatagcactgggattttgcctcccagccaaaatgctccagggtaggcagcaaagaagaaagagtgcgatatgagggtacagtgagtttggcagtccaaattctgttctctgcagcctgtttttgagtagtttgtgaataaagtcacccgcctacttgtctaagcacatgtgggtgtgtaactcagttcctggttctcggttctaaaaacagacttccaactgggaaactttttgggggaaattaactggacacctatctcggaggtttattttcttgcaaccagtgaagtcgtcctcctcccttccctggataactcttcagtttgactgtcactgttctggtgtcaactccagcgtcggcacaggcagaaggacttcagctgctggtctcattggttccactgccattgatatgggggrgtgcagaggagcactcattgtccatgatggagatccaggacagactgggggactccgggaagaggctttcttggggaagaggaccccaaaggaggtacttcctcctcactgatgccctcagggctgctgtgtgggtgtgttaagctgataaggttcagtttgcggcggaaactacctgctagtcttgtgtcaggggctgccagcctccttttgtttyacttttgcccccttcttgggaacatttgaccaaaaataatcctcatttcatcttgtgtacagtcctttgtgtamcccgcccaggttgagaggtgaatcagcgtaattctccgaagctctgctgggcagctcagccatgttacattgtctatgcagaataagcaggcctggtgtctgcaaatgtaccagtccttctcccgcatctcctgggtgcccccttggctttgcctctcctgtgtcctgtctttctgcgttttagaagtgagagcctctccttcaccttttgagcaactgagtcatctcaagtcctgagctctgctctgccgcctgctggtgccttgtaaaggtatactcgttacaggccctagaggttctaatggtccagggttaagtgagaggagactgtactttgtttcaaaggatccttcaccctgatctgcagtgaggtggatagatcacctggagtccctcgtctgtggtcttggaggcttaaattgtaaaatacatcccttatggaatcctaaattcctctaggtgtttttggaaggcgcatttgagccttgtgagctaaaatggaatggatttaatatttcctatctggcatttccatcttgcccctggtacacaagtcactggcctggaactcagccttgattcactgtccgtcttcacggattagctgtgctgttatgttgtctgtgctgcagattggcccatgtgggaagtcgggggggacctgatttcctgcttggaagacttgggggactgccgagcatatcaaagtgtttatagtcaccaagtgaactgcagcacaaccatctcctctccagcaagccctgaagtcagtagtgcctgcaggtgaaaccaaccagccctgtgttagaggaggaaaagcggagatgacatggaagtctccaagcctgtgccatccacctgccaaggaaaagcacaaggtgctatctacttttctctctaggatttagattatcatttatgtgctgttgcacagtgaaacctcacctgtgtgggcgtgaaagctgattggcattgtttttgattcagctttttggatggctaattgttttcactgtgctgtgggaatgcctctgtattttttcccctctttggccatctttttctgaaaataaagtgatggatcctctagccaacccagtctctccgtgtttgtatagacttacctgagtgatgcagtggtttagtctggttgttggccagcattgtaacccaagaatccaggtagctggagactttttttctttcttttttttttttttttgagaaggagtcttgctcttttgcccaggccagactgcagtggcactatctcggctcactgcaagctccgcctcctgggttcacgccattctcatgcctcagcctcccaagtagctgggattacaggtgcctgccaccgtgcccggctaattttttgtatttttagtagagacggggtttcaccgtgttaaccaagatggtctcgatctcctgacctcgtgatccacctgcctcggcctcccaaagtgctaggattacaggcgtgagccaccgcgcccggccagctggagactttcttgagtatctatgtggctctctgtaaaattaaactgcatataagaattcttaaagttcggccgggcatggtggctcacttctgtaatcccagcactttgggaggccagggcggacagatcacttgaggttaggagttcgagaccaagctggccaacatggtgaaaccctatttctactaaaaatacaaaaactagctgggtggggtggcacgcgcctgtagtcccagctattcgggaggcttaagctgaagaatcacttgaacccgggaggtggaggttgcagtgagccaagatcgcagcactgtaccccagcctgggtgacagagcgagactctgtctttcccctccccccgcctccccccagaaaagaattcttaaagttctacagccttagagtgttaagtaattttactgtctgggaactcagatgcactgcttctttctgacctatgtaggtactttcttttcttttttttttgttttttttttgtttccagctcaaggctgtaggaggaagaaaaatctagtccctgggggtactgatgaatcagttggatggtgggcgttggactgtgaattcctgatgcctctgggtaaactctggaggaaattctgtttcattacttgcactcagccctcctattttgtactaaggtattcttgaatacaagtgcaccggccaaaaaagtaaacttacgcataaaaagaaaggctctcttccttccaagaatgctgaacacctttgaagtctctgttgctgcctcatcttttagatacaatcattgattatgtatttttggcatcgtcctgaactttgtttcatttccttcacagttgaatgtgcagttggctttgtccactcagtgatggtccttgtgactgttcttggcttttctgttgtttttccatctttctataggaagcttgagaccgatactcatcgtttgctttcagcaccttaattttgctttgttcatttttgtaaagtaagggcaaatggccaccggaatgtacagtgattaaagaagcaaactctgtcaaagatggtgattagtggccagccagtccctctcaggatcactgtattaaaaagtgctcatttgccagtgacatttttttttggttttggtttttttttttttttttttttttgagactgagtgtcactctgtcgcccaggctggaatgcagtggcctgatctcagctcactgcaacctccacctcccaggttcaagtgattctcgtgcctcagccttctgagtagctgggactacaggcgcccaataccatgactggctaatttttttttttttaaattttaagtagagatgagattttgccatgttggcctgtttggccttatactcctcatctcaggtgatccacctgcctcggccccccaaatgccagtgacatttgtaggtggattcagattaaggtgggtagcttagttgaggcgtctcaacccttttctgtgcactctctcaagatgatttctgaacacacaactataagtgcatgagaacttaaatacgtgtgctcttatgctaattatacacaaagtaaaagttttttcacaaggagaatttttttctccagcaaatagctcgctcaccctaggggtacatacaccccactttagagaccctcaagttacagtggtatcattaaacgatccataaaggagtgggtttaagaaagctgatacaggaacatgtttgaaataatacattttctcaagggtgtcctccaaccattttctttgataaattatatttctgcccattgttgacttgaaattgtcctcacccctctaccaagttcacccagtgtattctgaaggaaaatgaatgaatatggaaacctctctcatcctaggcagtagagcgagggaagctgcactggctgagaggctgtggaaccggatgaaaaagcagcccctgagtcctgtggcgttggctgtgagtcggccacgtgcttgctgtgtgctttaggaaagttacttaatttctctgagctttagttttctccctcataagtaggcttgctgtgaaaatgaagtgaaatcacattaatctgcatgagcatttaacacggtgcctggtgtacatcaggggtgtgacagtgagtgctggctgctgtagtaattgaatgcttagctacgtgccgggccctttgccagctacagctcatgtgagacctcatgttcagtcttggcagtaacccagcaaggtaggcattttacatgtgaggagcctgagaaattcagtcttggcctggatcacagagctggtatccaaattcaggtccgaggccaaagcccagatctttgcactacaccttgttgcctggcacaggtgagagtgcccagcccatagtgggtgcgcaatatctgtttctatttgaatgacccaggcaggcggttaataatgcttgtgatttctttgagagagaagtaagttcttgtctttggtgggggaagcatcaggtgaccagcatttgtccagagcctggtacccatcctctcccaagcccaatcagtggtgctttctcaaaaagaaaccatctcctgaccactttggccatattgggcctttgctcctcttctgtagctattgataagagggctgtgggcagttagtgataatcaaggtcgtatcccaactaagtgacagagctgagacagttaagttccaggacaagtgtgttgatctctgtacccacttgtgccaggtgcctggggaggtaggggcatggctgtctgagggtggaggggtgagtagggggcctgcagtgtgctgtgacgcctgggaaggggattctaagccatttcccatcagccgtttactaagtagcctggggatcttgttaaaatgcagatcctgatagattagggctggggtgctgcccaagattctacatttctaagagtccctggatgacggtggcattcacagaccacagcttctatgtgagggagagcagttgggtttctgtctgcctgccgcacctgatcagtagttagtgcctgcatgtgtggcggccagaattttacttggggagacgctcggctcctagcaccctctgtggtaggggttttccagagtgtgggcattaccccaactgtctctgcagacggcttcctgcatgtttcccacaagcgctcagatggctgaattggcaagtctgtggtgctgctctttggggccacctcgttctttgcctttccctccccttagcgatgtgtcccatccgttgcctacagtcaagtcagtccacatgtttaggctaaggtgggcatgaccgagtggccttcccccgggaagaccagtgtcgtaactggaattaagttgtggaacataagagtcaaggctcgtgtctgctgtgaactggagttgagggaatgtttggggatcccacctggtatcagtaagggaaccatggcgacggccagccttgcccatgtgaggcatttgctttgtcaggccttctcagtagtggagaagggaggaaggagaatgcagctctttcagtgctgtctagcagtgcccaagagccgtgattgggcacctcacttaacgtctaacttcagattcactcttgggcattcctgtcttcctctccaatcttgaatggatgttggcttcgataatgtcatcctgaagtttctttgtccacacagccctggctggttgttaataagctgttaatgcagccttgcactcaggaagccctgatgtttaaaggaactgtgtctttgttcttcctctcttccctctttctcttagtcccactttatctcttctttctcttcctctccctcctccttttcccctctccctcctactctccccctttctctcctccttctctaagaaacccagtcttaattccacacaatgcatgcacatgcagtagcttctctgcttgagtgagctggtgtgattaggttttctaaacatgcacattggccttgctacttgtccttttattcccttcccacagaccataaaccaagaattatttttatttgtattattttgatttttttaaagtaaaatattaacttttcctctttgaaataaattcccatttggaacatcagcatacagtttgaacatttattcgcctcctgagcttgtacaacagtcgtgggagttgctgcagaagcaagcgaaaagccagatgagcgcttctaaacttagagagaggtgagtaaggcttgtgggcgatcacttgtcggctggggcctctggaaagcaagaggttgagtaagaatgctgggtgcaccgtcctgctagtgcttttcttccacggtggtgagattggaggtgggatgtaatggtgggggttgtggggaagcactggccttggagtcagagggcggcactcaagtgtggactgttgtgccctgggcaagtcacctcaaagctctgagtcttggtttcctcgtttgcacagcggggtgaatgctacccctgctgttccccaggggtgacgggtcaccgccttggtgaggacagtgctttgcagatgtgcaggtgtttctgccacctcaatcagttgggcggtttcttttttttcttttacaaggtgaggggattcaaagcaaaccctttgcttaactcaggaagctctaatatttgaaggaactgcttaacaggctgcagaacctgttctgagtgctattttggcaccaattcctttttgtttgtggagtaaagttacgcagtgaagacggtgtaacaccaaataattgtagactctcacaataggtaaaatagctccattttacagttaaggaagctgaggttcaactgaggccccaaagctagttaatgtactagttcttagaacattctttgaacacaaagactatgatgaactcccttctgagccactcacaaatactagccaaccactatcctgcagatctttgggaaagggaaattagaagttcttttggagaggcagaggttggggaaaactcatcacccacagagtgaactcccatgtggggctgcaaggaaaccgagcaaacccagtccaggcaggactcacctttggcctcttcccagaggatgtcctgaagaaacttccccagggcctggctgtgctgctggtactgaacccctgacagcttgattccaacatcaaagggggcgttgaactaggaggcagggcagggaggacccaggagatgtcagaggtcatgcccatccccatctcaaagggggctctgggctctctgcctctcttcaggagtggagagggagaatggcctttgggccccagcagggactgctgagtgacacctcagccaggttctcttcctttctcaggaccacagctcaccttcccactcaccatctttcagacacttaccttgcactctcatgcctctcagccttagcctctaatgggattgctgataaaagctgtggtgccccctagtgtgagattttttttctcccttgcagttttgaagacaaaaggttgagtcaccaatggcagcatttcaggccctggcagggggtctgcccagcattctcagcactggcctgctggccttctattccttccctgctcccagctctttctcctttctctcttgtctgtttcttctcctttttctccttccctaggtattttttctctcatatgcatagacctttctttgatgcctggaa

SEQ ID NO: 17967 - DNA, 24617 bp, Homo sapiens
tatagattcccagagccttctcctaaggattctgatttgataagtccatgaagttcaagggaatctgtatttatattaattactttattgacatagagtaaagtaatttttaatgtgctgacagattttttttaaagatttggggtgttgctgtgatgctcaggctgaagaaaagtggctatttacaggcgcaatcatacagcctcaaactcccggcctccatcctcctgcctcagtcttccaagaactgggactacatacaggtggatgtcactgcagctggctcagacagatcttattcagtggtcgtgccaaataaggaaacaggtccagagtgagaatgtgacattgtcaagatcacactatcacaaggtggctcatctatgattagtaaccagagctcctgacacttagtcctgcgctcttcccataatgtcaggctgctactcttatggaatttgcaacatttttcccaaatgtatatgtaatgtactatattagacaggccaaatacattgcctgctgtactctagccttttctaagggaagatattctacccccagacttatcagggacctgggtgaaccattacttccactgtaccagatagaattgattgaaccaagggtgagtatctgatcaagggtagcaaatccatagactacagcacaatgagattcaaataccaaacaaagcagatgtacaaatctattaaatgaaaattgtctaatcattaaacactactttaaacctagtaagtctgtgctttttcagcaaattgtgcttataattaagttttcttattccccttcccaagagcaaagatttcaaattgaaaagatgaggccaatacaaattaaatatttcaaaataaaatatatcaaatattatctttagtattgtgattcctatttattaattttcatttttattaaaatgtctttaaaaatgcaaacagcattacagggtttatactcaaaaaaattaaaagttgctgaatatgttgtatgcagctgatccaccttatactcataaacatttcctttattacatggcttttcaggtttttttggagttaataattgctttatttcctcccgtttgcttagttttctatgtgcctatcaccaatttattcccaaactctccactaaaatgcataaatgtgttatcagtatgctcacccacactggtgaactacatatttcatttttttcttggcaacacctcacctccacttctgccctgcttcagtgtgaatggattgctctctttgccagctgcatgtctgctaccctaggcttcccttcacaattgtggtggattaattttatgtgtcaatttgactgggctaagtgatgctcagatagctggtaaaacaatatttctgagtgtgtcaggaagtttctagaagagattagcattttaatcagcaaactgagtaaagatcactctcactaatgtgaacagacatcatccaatccactgagggcccaaatagagcaaaaagacagagggagggcatatttgccctttctgtttgagctcagatatctttctcctgcccttggactccagtgttctcagttctcaggccttcggactcagactagtacttacaccagaggctcttctggttctcaggccttggttcttcatgcttggactggaactaaagcatcttttctgggtctcccacttgaagacagcaaattatgggatttcttggcttctgtagtctcctgagccaatccatcataataaatcctttctatatatctaaatatattctattggttctgtttctgtgaggcaccctgatacactaatcattttgaaatcaccttaatctcctctatattggatcctctttttcttggattacacatacctttactggctaactttttttttttttttttttgagacagattcttgcactgttgcccaggctggagtgcagtggcgcaatcttggctcactgcacctcccgggttcaagtgattctcctgcctcagcctcccgaggggctgggattaccacccctggctaatttttgtatttttagtagagatggagtttcgcgatgttggccaggctgggttcaaactcctgacctcaagtgataaacatgtctcagcctcccgaagtgctgggattacaggcatgagccaccagccctggccagctaactttttttcttaaagatgggatctcactctgtcacccaggctggagtgcagtggcacaatcatagctcactgcagcctcaaactcctgggctcaagtgattctcccacctcagccttctgagttgtttgaactacaggtatgagctactgtacttggcttggctcacttcctactattgatggagcacattttctagtagctcttgagaaagtatgtatggaaggttaacaatttttagaacttacatgtgtaaaatatttttcattattccttcacacctgattgatactctggttggtgttacggggtgaactgtatctcttcccttcaaaaaaaaaattaaagttctaactcccagaacctcaaaatgtgactttatatggaaatgaggtcactgatgatgcaactaatttagggtaaggtcacaccgaaataggaagttcttgtaagatgatttccagctgacaacagataacacaagggaagacgccatgtgataatgacaacagagattgaagtaatacagttgcagaccaaggaacaccaaagcctgccagcaaactaccagaaagctaggaagagacaaggaaggaatcctctacactttcagagagcacatgacatcttggcttctgatttctcgcctccagaagtgtgagacagtgactatctattgttttaagtcacccagtttgttgtatcttgttatggcagccctagaaacctaatacagttggatatagaattctagtttgcaaataattttttctaaaaatttagttgctctctgtgtcttagcttccagtgctgctgaggagaagtacaatcttgttctgatttccaatccttagaatataattttttatcctctctggaaacttctaggatcttctatctattcctaggattctgaaattttatgatgattacatgtgttaaacatccacccgggtgtggcggctcacgcctgtaatccagcactttgggaaatcaaggtgggtgaatcacttgaggacaagagtttgaggccagctagccaaacatggtgaaatcccatctctacgaaaaatacaaaaattagcagggtgcggtggcaggtgcctgtaaacctagctactcgggtggctgacgcatgagaatcacttgaacccaggaggcagaggctgcagtgagccgagactgcgtcactgcattccagcctgggtgacagagcaagactccatctgaagaagaagaagaaagaagaagaagaaggagaaggaagaaagaagaagaaataaattaccagacagggaaaggaaaagagcaaaaaaaagtccacaaactcagttcctaagaatagttcccgttcctaccaaagtagaaaaaccacataattcactttgggtatggggtaaggaactttgaagggtactgtcttagtagtgggatacaattaaccctacataaatgactgaattggttccacctaaaaaaaatcaaaacccaaaagaacaaaattgtttttcaagtaagtaaattttacaaagtctagcatcttgttaaaaaaaaaaaaatttccaggcatgcaagaagcaggaaattatgaactgtaatgaagagaaaaatcaatcaatagaaactatgccagaaatagcatagatcatagaattagtagacaaggatattaaaactgtcattataattgtagtctatgtgtttaagaagctgcagaaaagttgagcatgttaagacataaaagatgtaagacacacacccacacccaaatcaaactggtagaggcaacaactacaatgttttatatgaagaatgaactggacaggatttcaatattagatattgaaaaaagattaatgaatatgaaaacatagcaattatccaaaaggaaacataaagaaaatcttgaaaaaaaaatgaacagagcgtcactgagctgtgagacaatgccagttagttcaatatacatgtatattatgtacatgcacatgactccaatagtcacaccaaaggagaggagcaagagaatggaaagaaaaaatatttgaagaaataagggcaatgtttgcatttgtcttgctctacctggtattcctatcaaggcacctggtatatattaggtgtttaataaacatttcttgaacacatttgcagcaaaaaaaaatgacaacgagtaagagataagcacctgagtgttactgcaacgtatttaggccatcagaggacaaaaaaggggaataatatggagaaaaggcttggtagaagtggcatgccttcagcagggacccacgaaatgggttcaactgagtgtgtacaaagtttggagactaggaagggatgaagaagggcattccacacaagaacaacacaaatgaagatttggagcctggcacagtggcccacgcctgtaatcccagcacttcgggaggccaaagcaggaggactgcttgagctcaggagtttgagaccagcctgggcaacatagcaagacccccatctctactaaaaatttaaaaatttgccaggcatggtggtgcttgcctgtagtcctcgctactggcaagactgagacaggaggctctcttgagctgtgattgcaccactgcactccagtctggacaacagagagaaactctgtctctaaaacaaacaaaaagacttggaatcaggaataaatatggttgaaactatactatctggactgaagtggtggttgcacttagtggtaatgagaaatgaagttagttggatgagttagggtcagagtatgcaaggctttagaaataggaaacaggagagaaaccattgaaagtttctgaacagaacttgtgatgatgaaatcagaattcaaggggagaaaaaggagcatagtggtggcatccatgatggatttggagaagaaaatactaaaggtgaatggaaagggtggaccaggggcaaacaggttattaaaacagtcccatcatgaagtgttgaaatgctggatgtaaacacacctaccacagtatcagtacagactaagggcttggataaatgttagtcaaatccaaatactaaaattcttcttggttcgcgaaaatttcagaagtggctcaaaaatctgtaatgcattaagaatattatttgcttcacaatatttcatttacttaagattttataagaatcagctgcttataaaattgttactttgtggtgcaccaaagcaccttgttctctccctcacccagatatgtttcatgctctttgtactttccaccccttaacagatttggagggaagattcaagccgtggatttttaaatttaaagcaatgctgtcacaaattgagaactgacaacatgtcattacacatttaattgccaccgaatcccagagtttaaaaattgtaaggacctaagagataggacctctcgttgtacagatgcggaaactgaggctgagagagggtaagtgaacagtcccaggtcacagagctgctaatgggcaaggtgggactagaatccaggcttgactcctctacgctgagccaagggttcgaagcgattgggataagggaagcctgaggcagggaacgagagtcaggaaagcagctcttcccaaccctaggaggccgggggacctcgtcaccgcggaaggagcggagccaggccgacctaaaaagccgcaagtccaggtacccttaccctgatggccgcggcgacacactcggccaccttcctgatctcgcgatactagccggtactcacttttccggcttcccctaggccccgcccccccacctcagcccttctgtcgtcatttcctgtgggtctgtaggttaagggagaagatggcggcgctaggggaacccgtgcggctggagagaggtgagtgcagccgaggctcggcggaggtgggcggaagggttgggggagtgctgtgtcgctggaggggaggaggagtgacccaggctctgagatccgggccacgctgtcccttgtgccggcgccagaggccgccgttgtctctgtgcctggctctaggaagggcgcttacggtattttgtctgttaaccgtaagccctcctctgttcacacggactgttccaaggcacagcacaactaaacacaacctgcccgcttcgcagacacacgccgcacacgcgctcccttggtgagcacagcagaagcagcattcggagacccgtacacccgaaaagcaaacgtcacacacccggttcgcacagactacactcattgcctgtacagcacgagaacggacacacggtacaattcaacagaacctcctttccccgctgtttgcacacaaactccttcattactttctccacaacctcgcttgtattcgggttggggtatttgctagcttttgtgcccctcctagaaatggagaggttgctttaaaaacaatcctactgacttggtcttgggaaggaggttacgtaagtaagccgaatagtggtagatgctaaaacacttgcaggtgcagtgtttttcatttcttacaaaccctacaattgcaaactggttggctgattgcttcctagagcagactgtcaaggaaaataaaaccacctctgctgagtaattagagatagagaagcctacgaaaataactggctatgcgcctaccatgatttccagcattccagcgtttccagtccttttacagatttccagcattccactctgtccctaagtcctttatttcaaacaatttcaagcatgcttttcatacaccagcattagaaatcattgataggaattgagaagtacaaataaacattttgagtactggtggtaaaaaaaaatgtatatgtaggatggagactgaaattatattgcacatattaacatttgcaattagtctaaatattactattgttccctaagaaaacacatttttagaattactgtacttagaaaaacctctttcctaatgccttcccacaaacaaatgtgcacttaatgttgctgatttgctctttacsgtgttcaccatttggaagcctcactgtaaatgagattgtttccgttaagcctattaaagcatcattttagaggactagctactctgggaagacttgccgagttaggcctaagtctctgacatcttcctcttgagcacagtggcactgtgttttatagatgggagcaaatctgtttggtgttaacaggagtaagttttttctttgaaagctagttaagattctaacgtattggtcttttgtgtttttgttgttgctgtttggagacgtagtcttgctctgtcgcccaggctggagtgcagtggcgcgatctcggctcactgcaacctctgcctcccgggttcaagcaattctcctgcctcagcctcccgagtagctgggactgcaggcgaacgccgccaaacccggctgttttttgtattttagtagagacggggtttcaccgtgttgcccaggctggtctcgaactcttgagcttaggaagtccgcccgcctcggcttcccaaagtgctaggattacaggcgtgagccactgcacccggccggtctttgtatttttaaatgcaacacaaaatgtgkaacttctgtggcatttagttttgatagtcttggctttgttttttgctgttacagatttcttttctgttcttcagtagaagactccaccycttagtaggatgaattacagtcagccctccatatccatgggttccatatttcaaccaactgcagattgaaaatactcagaaaaaaatcgtgtctgtatagaacatgtacagacatttttttcttgtccttattccctaaacaatgtgatataacaactgtttacgtagcgtcagatattgtaagtaatctagagattatttaaagtatagaggggggatatgcataggttttatgccaatactatatcattttatatcagagacttgagcatctgcagatcttgatatctgtggtatctgaagaaggtcctaatgaatcccccactgttaccaagacagctgtactagtggttgccatttagcagggtaagaaagtcagattacatcacctctgattcttgtttagaattctaacagactctattaacaaacactcccaacgatcctaaagtagaaaatcctacagtacaattacaatacagtgcctgatcacatatgatgatttagagtgccttctaaatcatcaaactatgatttaatgaaacacaaatttgagcacatagtaggtacattttagatttagtcaaaagcattttacttttttccatttttttcttcactggaaatttttatatggcttatatattataactttataaatcaaaataattgatgaaccaacagtccccatgtatcggtcattctggtgatgggaaatcagaatggtgaaggtctatttgcttccattgcatttgattaactttttaagtttaagctttctttacctcaaatttaaaaatctgctttctggccaggcgcagtggctcacgcctgtaatcccagcactttgggaggccgaggcaagcagatcacttgaggtcaggagtttgagactagcctggccaacatggtgaaaccctgtctctactaaaaatacaaaaattagctgggcctggtggcaggtacctgtagtcccagctactcgggagactgaggcacgagaatcacttgaaccctggaggcagaggttgcagtgagccaagatcgtaccactgcaccccagcctcagcaacagagggagactccatctcaaataaataaataaataatctttctgccaggtgtgatggcccaagcctgtaatcccagcaccttgggaagctgaggtgggtggatcatgaagtcaggagtttgaggccagcctgaccaacagggtgaaaccctgtctctactaaaaatacaaaaattagccgagcatggtggtggactcctgtaatcccagctactcaggaggctgaggcaggagacttgcttgaacctgggaggcagaggttgcagtgagtggagatkgcgccactgcactccagcctgggcaacagagtgagactccatctcaaataaataaataaatatctttctttactacatttattcatagttttctatctgcaaacacgaagaaggccatactaactctataaagaaaaatttccagtccttgagtgtaacgaaatcaggaacttctacttaagtcaaaaggaagcaaagcaataatagaatactgggcattgtagtaccaggggtacaaaaacagtataccaaaacagtttttggaaaaataaaagtagagatagttaacagtgttatagctgacttcctgaatcttctaaaatgtctcaattcataaaacacttatcctcacacttctcagtgagaattccctaatgtgcttcatacatttgtataaatgtatacaacctcttagggttttttttgtttgtttgtttgtttttgttttgtttggttttttgtagatggagtttcactcttgtcacccaggctggagtgcagtggcacaatctcagctcactgcaacctccacctcctgggatcaagcgcttctcctgcctcggcctcccaagtagctgggattacaggcacccgccaccatgcctggctaatttttgtattttttttagtagagttggggtttcaccatgttggccaggctggtcttgaactcttgacctcaggtgatccacccgcctcggcctcccaaagtgctgggattacaggcataagccactattcccagccaatatttcttatgattaattggtaccaatgtaacataacacttttgcttgctaagcccttttttatgtattttgtggttcagttgttaactgaactcataactcttcctcataacccttatatggaaggtactgttatttccattgtacagtgaaagaaactgagacataaggacatcatgtaacttgcccaaggtcacacaggtggtattgagaccagattgataaagctaattgtttttatttttcttttttgtaaacataagtgttggagcttgtttgaattaacagtgttaattaagttgaaaaaaaatcagtttatttcatttgtactgcttgttttttgcatttttatggttgttttaaatgtgtccctgccactaactgcatctgctctcgagtggttatctacctatgtatcatgtttctttcgaggaatgaccagtgattttactagcttatagtgccttgtactgttcagtgctttggttactaataataattaggtaaatttttattgactagtttctgacaatattgctagcttttctgaagcagtacaatgttcatgtatcggtcacatttgagtcacagtcctttccgatgacatttggtattttgtgttcaatttgcctgtgtttctccaaggtcttattttatgcttctgtaatctcagtagtttttcctatctactgtaaaatttagtgttcttacattttacattctcaccctccatgtgtgtacacacacacagtctccttcccaccaaatgtgcaaattcaatgctttttttcccctcgattgtctgtatattatttgcccttgaggaatgaatcctaactgccccactgttacataggcattgagaaaacccttggagaaaattatctgtgtgtgtgtttaactctagatatttgtagagcaattgaattattggaaaaactacaaaggagtggagaagtaccaccacagaaacttcaggctttgcaaagagtccttcaaagtgaattctgcaatgctgtgagagaggtgagtaaacatcattaaaatttacaaaaatttgagttaattaggtcagataatactctaaatttgggttcaacatttcttaagaaaaactttagaaaacattaaaaccagtccctctcatttttggaatttctgataaaaccattttataaagatgcataamtttgcctgaaattttaacttygcctgaaattttaacttcacagagaactcaagcatggtatattctgagatataactttggcttttacaggtatatgaacatgtctatgagactgtggacatcagtagcagtcctgaagtgagagcgaacgctactgcaaaggtaaatttttttgttttccaaaagtaagaattcttcataaattagaagtttaaaatatggagttattaaattcataataaacttactttgaagactaacatgtatctttcaagctacaccaaatttctcaagtactaagaaataagacatttgtttctattgcctttacataaatgctgcatgataaatagcttacataagctattttatcatgcagtttagataatgcaatagaaatgtacttgcatacaatatgtatcatgcaatatataattgtgttgtatatgttatatatatgatactatataatattcattatacaaaatctaatcagaattttaagatatgaattactatcctcatcttattgatgaggaagcatgaggtgatttgccgcaaaccacacaaatagcatatgatagagctggggtacttccccgagttgatttttgctttcttctttacattatctgcatttctgtgccattgttttcctcaaataatttaggtattgacctcactattcatgatagggggtttgaacagggtaatatcagcagtcggtgacttaaattaatcatcagcagatagttttttatggatagttactggctcacaaaaggaaatggtggattctttgttgaatacaaatacttaaacatgtggatatagtttatcagtgtagaaaagaccagagaaacatggttttaattgctgagttgtgtgagtttgatagcctactgaatttctgagccttaattccattatctgaaaaatgaggcctttttcagagcttcgaagataacgggtattcagtaaatcttgatttcttcaaagataacgggtgttcagtaaatcttgatttctttcctcctccccatttttgtgatccatcacaaaaaaatggtactagataattaccctttaaagcaaagtgaaacaaaatctcaactttataattagtttggattagtctaaagttgagctttaaagaagatacggctctgtttcatcttctgtggggatttttagttgtgtctagttaactaaagcaacaaaacattcagattggctatatgtacctctctttttctcaatattgagttatttcttgacatcttagatatttagtatatagtacaaatagtacagaagccaaaatgattacatataagggcaactccatgttgattatataggtaggttgtgtcctgcacaaaggctcctgaaggagttgggcgatccagatctaaagcccagggctgctagcatgctggggaaggggttttcctccttactatgtacaatatcagtctgcccagtaagtctgcttgccaagccctgcgcatacaggactgcacaaaagagtgggcactgaatgggctaggaatgacctaaaaaatcataacaaaaaatcgtaacatttcctgcataactcgaaattattcatttgtcgtctctaaaataccttctgtttagcttaccttctcagaatcaccagtgaatttgtgagcattcagacgtcaaaaatacgtgctcaaaagtagtttttaaaaagagacaaaagaggccaggcgcagtggctcacgcctgtaatcccagcactttgggaggccaaggcgggcggatcacgaggtcaggagatcgagaccatcctggctaatgtggtgaaaccccatctctactaaaaaaaaatacaaaaaaattagccgggcgtggtggcaggcgcctgtagtctcagctactcaggaggctgaggcaggagaatggcgtgaagccaggaggtggagcttgcagtgagccaagatcacgccactgcactccagcctgtgcgacagagcgagactccatctcggggggaaacaaaagatgaaagaactgaagtaaataaaagtcatatttttaatatgtaaaactttctttcaggctactgttgctgcatttgctgccagtgaaggacattctcatcctcgagttgttgagctaccaaaaacagaagagggccttggattcaatattatgggaggcaaagaacaaaactctccaatctatatatcccgaataattccaggtggaattgctgatagacatgggggcctcaaacgtggagatcaactcctctctgttaatggagtggtaaggatgaattttatttctatttgtagtgatctgttgtgaccacctgggggcgtatttgagtaataggagaaacctaagaaacttgtggtttagaaatgccttgagggaatcctaggcagtactattaatacagtgatccttttttttaagcactataagtgtattttgcagtgtaaattagcagtgcttaatgtcatttttatgacataagctctttattaaaggcaatacmttaaattagaagtctaccctcattttactcttataaaatgccaattgcttgatctactgaaataataaggcatatagattaatatgctaattatttggaacttaaaagccagcttttagactataaacagaatatgatgtaagagaggatttcatatagattaaaatggtaaggcaggattatttcttagttttgtaatgttggaataatataacattaaaacttttcttcattatatatattgtaaacatttttgcattttgagttactttcaaaacttagatattagtgtatggttggttgtttttttttcccctagagtgttgaaggagaacatcatgaaaaagctgtagaactgctgaaagccgcacaaggaaaggttaaattagtggtacgatacacacccaaagtcttagaagaaatggagtcgcgctttgaaaaaatgagatcagcaaaacgcaggcaacagacctaatacatttcaaaacttgatatttcattttgcgttttagctagagaagttttccttgtgacttactaatggctgcaatgccaatgattgtaagaaaacaaacaaatttatcatgaaattctccttgtcattttataaatgcctattttaacatcatttatggttccagagatgcatacacttttttctgacaagaaaaagtaaaaggtgatgagggcaattctgtcctactgtttttacaggcctttttcaaatgcagattttgtcataaagttgttatagattttttaaaatgcttttttaatattaaaatgtacttttacattcttaatctttttttagaaaggaaaagttttcttcatttagctgctgatttaaaagtaaagttctccaattctttttttttgcttactctattttttttaacctgtgaaatttctttacagttttccaagaaattaagcataacagtctcatctacggcagttcattacactgtcaatgttaacatcattgctgcattttgtactttgaacacacacataatatatataaccagtggtaaatcatgactcagtacagtgcaagttttttcacttttacttaaacataatatataatggatattcatttatactgatttatgaaagtaagtttttaaacactgaaacaatcattgctaaaatacatattcttaatatttgagcattgaggcaagaggatgtaattgatagcattacttattacatccctatttatgttcaaccgtacatcaaattataaatgcaaaacaggttcagatttcatcttttgtgatttcttttaaatactattcatttttatttaaatgcacagtatttcccctatattttagtccttccattcctagagacaaaccagttatttggtggtgggaagtagctgaagcaaagaaggaaaagtaatacctttaacctcactagcttcaagagtagacattcttactagctcaatttaaataattgattttaaataggaagaaaagaggatatatttaagatacatagaaattatgatgtgaagtattcatgagaatctgtagattccatcaaaataagtaggaactcatactaaaattgttggatttaaagaggcaacttttgtttatgattcaaatatgggaatttgagaaatatttcatttgtccactggatgtcactattttactaaaaggcagctattagtgtgggactgtgactgaggtcttaaagactgaaagagttggggttcattttctgttacaacttacaggaacatttgtactttaagaaaaatttaagtgacaaatgttagaagatgatggattgaaaaatataagtaatttggcatattgaccctatataaaaaagtgggcattttgtaacattccttcaggaagaatagaattgtatgcttttttctgcatgtttgtgatcactgtgagtctcagatgattattccagttttcaatgatttttcaaaataaaagtcaatcagcattgttatttatcattaaggtattgaacactggattgcatggttgaatgtgtctttaatccactacaaaatgtgcttgttattgataggatcatgttgttaaattgtaaattttcaaaattaattgatgttttaaaaatgttgagaccaaagtagtatagaagtatggacttaatttaattgtaaaattattagaggtatttgttgtagagctttatatattaaagagaggtattggtgcatataaaaacagtaatattattgttatgcttgtwttcttgcatttcagggtaagtaaaccctgaagaaatcttattttagtatagctacagctgcagtagcttttaagtatgtatcaacatttcattataaattatagcttcctggttctgtgtctcagctgtttcagaactttcagccaagttaaatcttttttggtgttgaaacttttagtaagttgagtaagctatttttttccctacggtaatccacaatctgttctttgtgtgggttgacacctatttataattcttaaaataagggtagctcaaaggagccaagtacagtagtttagcttgctactgttgagcatgaatagcagtaggttgttttcattaatgcagttttcataatgtatcccagaattttaaatcttgaccatagaaaaatacagtcattcattggcaaagatgtacagtggtggtttagtgcagtgaggaaatgatgggaatttttatcttagaaatggatgattcgtgaataaaactaggtacatagtaagtgtatgatagatgtttgatttgtaaattacaaatataaattatcacccccatttccatttattttcttgatatatcaaaatgtgttgacttagtgattctcaatcttagctacatattagcctggcagagctttaaaaaattgatacctgggtcctattccataacaactaaatcaaaatcacccttttttttttttttgtaaagctttccaggtggttctaaaggacacctggggtcaataacccattataaaatgatctgattacactggacactcttaggaagtatcaaaatagaacagttcaatttgcagctacttaatgattaattacatttcttaggttttttttttgttttttttttggtttgtttgttttttgttttaaaagagacaggatcttgctttgtctcccaggctggaacacagtggtgtgatcatagctcactgcagcctgaaactccttggcttccacctcagcctcccaaagcattrggattataggcgtgagccactgcacctggccaagtaatttcttttaggaataaaaggtacttggcattccttatttgggaagtaattacagtcttatctttttttttcttttttcttttttttaataaaatctaccagtaatttaaatgtgagctttttatgtctgtcatcattctgccccctttgcctttaaaacttacaaaaatacgtgtttgttatttgagaaagcatgtttaaaaattgcagatgagaaatattgtcgttaataattatgtactgtcttaatgtgggcacttcatttgttagtataatactagataatagcagcctagttctttaggatttgacgattcaaattttttttttgttttttgtttttgtttttttttgagacagagtcttgctctgttgcccaggctggcgtgcagtggtgtgatctcggctcacttcagcctccgccacctcaaggcagttcaagcaattctcctgcctcagcctcccgagtagctaggactacaggcgtgtgccacctctcccggctaatttttttgtatttttagtagagacggggtttcaccgtgttagccaggatgatctcgatctcctgacctcgtgattcacccccctcggcctcccaaagtgctggaattactggcgtgagccaccatgcccagcctcaaatatgtttttagaaaatatcattgtcctcctcctcttaagatttttttaagttattttgctcaagtacttaagtagtctggctcaagtactttgtttacaattaaaatggatattatagcatttaatagaagaaatggttatggcttatccaaaaagaatgtcagcatgacctggtgtagacttaaaaaactacatgtttgtgaatattttataatgtggaatgatcattgaaatatcaaggattctagtaattgtatttcctgaataaatgtatgtttatgaattttctaacttacattttgttgtgtcctctgccaacaatctggttttataattgttgtctaaagtttgctagtagtgtttcttcaaaggttattccaggtatggttaagtagtgagaaaaatcacttattaattttcaaraactttgagactaatttgtattgactcggttttttaaaataactggcaaatgctatgcttctacttttaaaatttgtggtaatacccagaatggatgtaaaataacatttttcaatagattacttcatttatcaatttaattctgattttaaggcttatttaaaataaatttgtatgagttatgtcctcgttctttggatttgaaaaaagttgatataactacacaatagataacgtttatgaaaggtatgtataaaaaaacataattcctggtggctgctgaaatgaaactttgaatttctatattttgctttgtctttcataaaatttaaagaaaacattttcttgtgttatttcaagagcggcagtatgacgtgattgagagcacagattctgaagccaaacaactctggtttcaatcccagttccaccattaccgtgtgtcaccttagacaggttgcttgatttctttgtgccttagttccctcacctgtcatttgttaataagaatgcctgtaagtgtcatgccattttctgtaaggcccttaaaaaggtgcctggcatagtaaatactgtttgtgtttgcttttgttcatgtaaaatagcttcagaaccttatgagctaaaggaaataattctggtcaaaaaattaaaattagcaagtttttatttttggtatttagaaaacaacctttatgcttaaaaactttagaagaataagattcataagaaattatcaaatttatattttgatcaaagaaactcggaatttttaattggagctttgaggattgaagccatattctaatgaaaatcattggaaaataagtccaagtaaggatttgttaaattaacctttaaggtgatgacctaggcatagagacaggagactactggactaggtgttagacagtccaaggcatcaccaccattaactttaaaaaagtgtggaaatgtgccacacagccgaggaacaacaaaaagcatttagtgttaggactcagtttttttcaaaactttagtagaccagagtatccattcactaaatttttctattcgggttttgttatattcactattttgattattctgattttactataatgaattgctgacccatattttgtacgtttacttattagtggcagataatctccctgatggaatcttgaagatttactttatatacagggcaaaaggtaaattcatacagaacccatttgtcaattttattttttgaattttaaattttaaagggacaaatacttcattttaacaaggtatatgtaaggcctctcctaattctcatgaacaatacctattggttagaatgagaaatcatccacactttcttacctagagacaactttaaaaacaccaaatctttttttttttttttgagacagggtctatttggacaccacagtatgtatatttaaaatcaccaaacatcaagatttggtgttttggggccaggtgcagtggctcacacctgtaatcccagcactctgggaggcctgtaatcccagcactctgggaggccgaggcaggtggatcgcttgagcccaggagtttgagaccagcctgggcaacatggcaaaaccccgtctctactaaaaatacaaaaattgaggcccagcatagtggcgcacacctataaatcccagcactttgggaggccgaggagggtggatcgcttgagggcaggagttcaagaccagcctggccaacatggcgaaacctcatctctactaaaaatacaaaaattagcggtgcatggtggcatgttcctgtaatcccagctacttgggaggctgaggcaggagaattgcttgaacccaggagccagaggttgcagtgagctaagatttcaccactgcactccagcctaggtgacagaatgagactcttgtctcaatcaatcagtcaataaataaaagtacaaaaattagctgggtgtggtggcacgtccctgtagtcctagctactggggaagctgaggctttcatgagaattgcttgagccccggaggcagagattgcactgaaccgagatagcatcactacactccagcctgtgcaacagagtgagacccccatctcaaaaaaaaaaaaaaaaaaaagatttggtgtttttaaagtttgtctctaggtaagaaagtgtggatgatttctcattctaaccaatagggatagaaattttagcccctgcagcaggtaagtttcctgtatatggcagttactgaaagtaattcatttcatcagagggtattaaaaacccaaaactaattttgtgtttgttttttatttggcaaagaaatgcaataaaaccatgaagtaggaagttattactggtatctcttaaatgacataattttgagcccagactttaaatgatatctaacctttgtgttttacagtgttatgggttgaactgtgttcccctaagataggttggagtcctaacccccagtacctcagaatgtgacctcatttggagataagatctttacagaggtaatccaattaaaatgaggtcattagggtgggccctaattcagtatggctagtgtccatattttttgaaaagttgggagagatttgaacacagacgcacacccagggagaacaccatgggtagatgaaggcaaagattggggtgatgcttctacaaatcaagaaatattgaagattaccaacaaactaccagaagcaagaagaaaggcatagaccaaattctccctcacacttagaaggaaccaagtctcctgacactttgatcttggacttaacagcctccagaactgtgaaacaattaactttcacttaagccacccagtttgtggtactttgttatgccagccctagaaaattaatatgtgagagaatccacctttcagcggcatcactaccaaaactgggtacagaagcaaaattaaatgtgggttctccagtgtgtgataaaaacattccagtagaagtggctttggctaagaaaggatgagattcctggcccttggggatgaggagaatgctggtttctttgctttctgtggttgaaatgcttccttggatacctgtgcagctgtgtaactgagcttgtgcctccacgttggccccctggactcatgagcacctaagcacctagccgtttcttcactttaggttgtcagttactgcatggatgcgtcttaactccaggactcgtcaggagttggtatcgtcagggcattgtctccttcagcactgagagtagtttatgcagcagtccttgctccagctgggtgagatgaggatttgtctttgacatgggacattcagcctgtaaaggtttgtacaggttccttatgatccatgggcctggtaccaagcattaattaagccagaaccaattgtgttgctccctttttaaaactctgcattgtacttaggataaaatccaaataccttgccatgacctcaaaggttctgcataatccctgccctacttcctctcaggcctcatctcagtccactgccctacttgttctgctccacagcctattcccttgctggaaggcttccctctggttcttctactaactggctgcccctcattcaggtgtcagccaaagttgcgttgcctgttaagttcaccatctaaaggctgattcctcatcctttaacatggcaacaccttgtcgtttttgttttttggggtgtttttgtttttttgagagacagtttcgctcgtttcccaggctggagtgcaatggcatgatcccagctcactgcaacctccgcctcccgggttcaagagattttcctgcctcagcctctcaagtagctgagattacagacatgccacgatgcccagctaattttgtatttttagtagagatggggtttcacaatgttggacaggctggtctcgaactcctgacctcaggtgatccacccacctcggcctgccaaagtgctgagattacaggcatcagccaccgtgcccaaccaacaccttgtttatattaacatgcttgtgtcttttccattaaaatttaagttgcatgacagcaagaaggacacgactgtacccccattacttaacacagtgcctaaaacggtatgatgtcttgttataccttgttgaattgactggctttccataattccacaggtagatcaataacttatattggcactgtataaacacaatgatgtgtgtatcaggtagacacagtatttatcaactgatcttgatgttagatgtcctagaaaggatcaaaatactatagggacaatacccttgtcaatcttttattacctcgctccattaacatgccaagtaccatttgtggaggacaacaatgaaggttactttcatcttttatgtaaaactgttccaactaatgttaatagtagataaaatttgtacagtaacacctaatttttaaaaatagaacaaagattttctttgggtattgccacaaccaaaattaaatgaaaaattgtgtactgctaaccaagacctaatttttaaaatgtctattgtgtaattttaaataaaaaataacaaggctggacacagtggctcacacctgtaatcccactactttgagaggccaaggcaggcagaccgtttgagcccagaagttgaggaccagcctgggcaacatggtgaaaccctgtctctacaaaaaatacaaaagttagccaggcatggtggtgcacacctgtagtcccagctactggagaggctgaggcagagaatcagttgagcctgggagttcgaggctgcagtgagccctgatcgtgctactgccctccatcctgggtgacagaatgagaccctgtctcaaaaaataacagcaatgacatagtgtagtggaagaaacactggacttacattccaattatgccattaacatatgatccttaagtcttcattttcttgattgtataataagggaggttggtagtttccaatctggtttcatttctttattccttagaaaagtcctctcttcagccaaagcctaatatatagaactacgctggttcaagaaggctgtccccttcaaccccccttcccatgctgcagacaggagttcctctgagcacagtttgaaaacctttgtcctagagctggggtccccagctccatgccgcagatctgctaggatctggtaaatctgttaggaagcaggctgcacaccaggaggtgagtgtcgggagagcaagcattatcgcctgagctccgcctcctgtcagatcagcaatgatggcgttagattctcacaggagcgtgaaccttcttgtgaactgcgcatgtatgcaagggacctaggttgcccacttgttgtgagaatctaatgcctgatgatctgaggtggaacagtttcatcctgaaaccatccctatctccctgtgaaccacagccttcccccgcaaccccggtggaaaatattatcttccacaaaaccattccctggtgccaaaaaggtcagggaccagtttaaagtccattcctgttctaaaagtgcaataacattaacacgcaattggtttgatgtgaactattttgtatcatgtaatgacatataagctagtttatgcacaaagggggtattttctaaaatatcagaaatattgataatcatgcatggctgcctttcataaagcatctactaagcactgcatctaatccttataaccccccaataagatgggtgttattctgtttcacagaatcaggaacaccaaatagtttattcataattacacacttacactgactcatggaccagattctaatcccaagtttattttcaaaacccataattttcccccaataccacactgcacttttagcaagattttctctctcattcattttattttatttttttaggtttcttgttggatttgttgtggttttttttttttaatctagagccctgtaagaacaacaacaaaaaaagcagagtatgaatctaactcgtatattatgtcaatattcaattggatatttttaagttggcatctcttccccagtatataggtattatttcattaaatagcattagcacattgaaaataccacctattattttctacctattgttactttgtatcacaaaattataaatgatacgtatgttgtagcaattaaaaatttttaagagatgaattctacggaaaatggcagcaatttaagtgaattatttccatagggggaaaaaaaatttaaaaaaaataggttgggtgtagtggctcacgcctgtaatcccaacagtttcagaggccgaggtgggaggattgcttgaggccaggatttggagaccagcccgggcaacatagaccccatttctacataaatttttcattaaaaaataatgaaatagcattctattaactgttaatgatggtggaaggaactaactgaagaaatgacaatgggaaaaattggaagaagaaagtgatcagctatggttttatacatttcaataaaatgagcatgattttgagtcttgttttactgggtacataccataaaattaattcatttattcattcactcaacagtatttattgagcatctattat

SEQ ID NO: 17968 - DNA, 34524 bp, Homo sapiens
gacaccaaattctattgttcctgatgcccaaatgcccactcctgctctctgtgactccacccaaccccgtcctgattcaagcttcgtggcctttccctgggtgatttcaacgcatgcactccttcagtgcagctttcactcttcccagagggaactctgccacatgcaaacctggccacgtcgttccccttctttcacctcttctatggctccccagtgccctcaggacacagtccaaatccttagcaccttacaaagactgtgccatctgtcctctgccgacccaccagcctcacttctaatcattgccattttgcatcctgaccccgggtaataatgacctgtctgcagttcctgaaggtacaatgccctctctcacacctgaccttggaccatccttggttttcagccaggtatgccttctgcctcttctccacttggaaactcctgttcttactccatggtggtacctcccctggggaattgcccttttgcagctggccttctcttgggcttcccactgggctctaagccagcccctctctgccttgtccttgagtctgttcctctagacatgagctccccagtggtgagggctgagtgagtctcatctgtgtattcatcatcctaccacatgcctgccttaggatgggtacggatgcctacactggtgaggagaacagggcaggatcagtgctgggggccttacgggaagcccaggggtctgtcggagcctagaagaggccccgacgaagcctgggggttgggggaggagcagagaagtcttctctgaggagatgatgccagagttggagtcttcaaggatcagtgcagtgtcaagaggcactcagtcaggtgggggcggggtgggcattccagggagcagaccctggcatcaaagacttgtgggcaaaacctggccactggcccaggggtgtgtgtgcatgtgtgtgtgtatgtgtgagagagagagagagagattttagtaggggcagagggagagacgctgaacggtagagaggtgggcagaggagctgggggctgaggatattgatctgtgtttgtgccagggactgagttatgaagcgttctgggcatgagtctcaggaatttagacttggccttcgtgcaactgggggtcaccaggcaagagacacagttgagatttgaaaaaaatccctctggcaattggtgtagaacccaggggcctcctgggcatcgttttgggcatttgtggggtgctttcagttatcatgatgactggggggtactactgtgagttagtggatggggcctgggatgccaaacaccctgtgatgttgggaacagtccacatcatgaagggttggcccatgtgccatttgattttgcatttcccaccaggcacgcgtgcagagggaaaacacctgtctgtaattgtctaagattagagcacatgtctggcttgcatagaaacggagagcatctttgcgtggtttttagcgaagactgatttgccagaactatgccttccatgcacattttaggaagattgcgccttatcttgtttggagccttacccagattcgccaccattttgaaaaactacatacttcatggcagatcttctcatgggatttgagcggccaacgggaccttccccacattggtgtgcatctgtggctgtcaccttcagtggagttctgtgtaggcacacacttctcattgctttattgtgtctgctagcatagtgtactcaacaggagcatttacaatttgaaataatggatcaccttaaattaccttcgttatgtattcttttttttttttttttctgagacagagtctcactctgtctcccaggctggaaggcagtggcacaatctcagctcagtgcaacctccacctcccgggttcaagcgattctcctgcctcagcctcctgagtagctgggattacaggtgcccgccaccatgcctgaataagttttgtatttttagtagagacggggttttgccatgttggccaggctggtctcgaactcctgatctcaggtgatccgcccacctcggctcccaaagtgctgggattacaggcatgagacacagcgcccggccctttatgtattaatttaaccaacactcatttaactcttgacattgccagacacttttctaaatgcttgatgagtaattatttaatcctcaagacaagtctatgcagtaaggtgcagttgctgtctctttttttttaccagggagctaactgaggcacagagaggtgacttacccaaggctggagtcgggcagacccaactcgaatcctgccaggcactggtgctgggccaacctcacttctctgtgccttggtttcctcatccatagaatggggccagtgctgaccttgcagtgctgctgggaagtggagaagccgggatttgaatcagcatctgtgcacctcaccactggcctatagtgtctgcctctgatgtttcagttagggcattgggttggttttcttttggaagttacaagcatacatatgttgagacaaggttaagtgccactggtggagagcctgtgagagctgggctgggagggagtggaggtctggtcactgaagctggggcatggacacgcttgtccagggaggaatgtggagtgaggagggcagggggctggagacagacccggacaggtcacaacattctgggaggaggagtgaggaacggttaacaaggtagagagaccagggtagcaggggttggggagcccacagggacagagttccaagaaggagggcatgggtgacaatggagaaggccttagagaaacccagtgaggtcagggctgatggtggccccagactcagacacagagggagcagggggacctgggccgtgagagccgaaggggcctcagctggagctgcagtcactctcaccccaatacccaatgtagggagaaggaggggaagaaacaccccaacctccatctcctctctccctggcatctccggcctgtgcctcccactggctcacctttccaggaagcagatggaaggaagccagcatgacacagcccacaggtgccagcagggcaagggcggctctgggtggggagtagggacaaacagaacaaccagtgagaccctgagaagggagatgtgagaccctggggaatgatccagagcaggagtcacctggaagggtctgaaggggttccttctggtgggctcctcagtggggagggtcactatcctcccacgacgaggctctgacagcagccgcccagtccttgcaatgttctcaggcagatgctgtgatgatcccatttacagatgggagaactaagacgcagaaaaggaacagaccaacaaaagctcacctaagggcagagagcaggaaccggattcaaacccaggtctgcctgatgccaaagctgggactcccaaccactgaaccttgctgtcgcatgtgcccatcagcttgagagttggtgggaatcccggcccaggacagcgtcccctcagccagggaggtggcagcaagtcatgctcaggctagtggaggggcagttagtaacctgcagtcggaggttcaccagtggaaaggctggagtcgggcagacccaactcgaatcctgccaggcactggtgctgggctgctcacctctctgtgcctcggtttcctcatccatagaatggggccaatgctgactttgcagtgctgctggtgggtggggggggcggtaaactgaggttatgtcgattcccttcccaggtggggaggacaggggaagtggatgcacctgggggaccatctcagaggagctggcccactcttactgccttctccagatccggaccagggagcggtcaagatggtgtgcccttgtctgacctccgtcctgcctgctgtccagcgactccctggcttcctccccgtcacgtgggactcctgtacccggtgctgtcgggggagcccccctccataccctccagacctcacaagacacttccaggtctggccacaaggtggagtgtggcggctgcaggacagtgctgggggccgggctgcagaggagactggacctgcgccgggtgacctccccgctctgtgaaagtgtgggagtttgtgtctgtgcatccagagaaccagagggtggtggttgacttgccgtgctccccccagccccccattgggattgcctgggtctctgggggatcactgagaagctggataaagagagctggcactgtcgccttggctcactaacgccaccattttacaggtgaggagactgaggcccagagaaggaagtcacgtgctgaggtcaccggctaatcagtggctgagctgggctcgaacccagatctcttacgctgtgaggcctctgcttttcctgtggcatggagaggggcttctcccacctggggagagggatcctgttgtattggagaggcaggggattaaagatggactgagagaggttagtgtcccagaaaccaaggggcaatccctgccctggagagaacaggcctcaagggcagggatggggcaggggcagtggataaggagtctacccaggcctttttgggttccctcctttggtccctggggacccagggctgtggcacttgccccgggctagagggtcggccagggcctgtgtggtgcccactgctccctcccctgcactgcaggggacccttgcccatccctctagctcatctggacctccctcaatggctcctgctgtctttccaggctgtgtcctcccgtgtcagggacacatcccagagcccagggcctgcgtgggctgtatccacggttactgaatagggacaaacaggcatgtattggcaggggccggtggctcatttcaggaaagtcccttcagcaagaggattctctccccactggggctgagggtggtagaagaaaggaatgttgttctatgttgtagtgtctctgagatgacctggcttcctgaaccaggtccccctgaagagctcctcctgtccaccccaacaagaggccagctggagagcaagcaaacatcgagtgcagcaggagactataaggttagacaacaagaaggacttcctggcaggggagagcaatgcttgcttggttagagctgcctttcagtagaatgggctgctttggattgcagtgaggtcgctggagttgcaaacagcagagccagagatcaaggtcaagtggaagaaagctgggaaaggttcagtttggctggtgaagggtggagagggtaaagggaggcagggaccaccgtggtgcaggggtgaggtgccctgcagggagctgatcctgaggccgatggtgggaggagctgtgtgtggtcgggtgggacggggtggggacagcaggagacactgagaaggtggcatggccaggagctaggggctgaccgagtgtggggaggggggagtggggagggggcgttgggctgcccgatgggaggtgccttggctccgatgggagcactggggagcagcaggtggggggacgagctgggtgggaggggctgcagcttcccagcagagacagggtctgggaggcgactggactcgaaggcctgggcttgggagagaggcccgggctggagaggtggggagggggatccaggagaggggataactaaggacttgggagtagctggcatcacctggtgagacgagagtcctgaacagccccctctccaaggacagaaatttctccaaggaggctgacctgagaggtgggaggagagtggggcagagggtcaggagggagaaaccagtgggtgccaagaccaggtcagccccacaggctagggggcttgaggacttggggctgatgtctagggacgtccacgaggtggagcagcccaggaggcctgggtgggaggaggaggcggtggcggggaggggagggaggggctgggcctctgtccacagcattagtgctggttggagggacgaggggggtgcggagccagccaggccgccctcccgttctcacagcagccgagcagagcgcagagcgggctgccatggcgctggccaggcctgggaccccggacccccaggccctggcctctgtcctgctactgytgctctgggcccctgccctttccctcctggctggtgagttggggcccatgtctggaggggcctgggagagggtctgtcccccaagacagataccccaagccttggctgctggggtggtgggtgggctggtccgcgtgggtgcaggcctgagctgtggggtgcacaggagtgcgcggctgtggcccccagactctgtggggctccacggaggtgagtgtgttctgaggctcggggctgtttcatgttgaggggggttgtaagtttcggggttgggggatcgggggctgggcatgatttgggggagctgatgcgggtgagggatggggtgcgtgttttgggaggktgctgtgttgcatcctgtaaagggctgggggacttctgggtttctaggggctgagtttggggagttgcaggtggcataagcctcaccccagagcytgttctgtgtcgcatgctgggttgtggggcacaggttgtgggtgtgttagagttgggaggtggatgagctgtctggggtgagccgtgagttgtgtccgaggagttgggtgtggtgagctgtgtcctagcacacgctgtggggtgtaggttgtccagggttgaactaggtctttgctctcaacatgaggggtgtgggatgtgcacagccgaccccaactcgggactgagtggagaagcgtgagggagactcagggagctgggtgcctgcccgcacccctccatttgtgcggtagccctgcctgtgctgagggctgctggggatgctctgggtccctgtggggtggctggggatttgggaacatgtgtgtgtcccctgctgccccctccccagcattccaaggccaatctgaaagggctccctgaagccagaccacatttgccaagccctttttgcttttgtccaagctctcggagcctggaattcctcctggggggtccaagggaacgcttggtgttagttactatagttacaggggccgggcctgggaagtcccctgcccccaccaccacaggctggggagggagccaaggagggcctgggctctcctgaggctgggggagccctccctgccccagagctccacaggctgtagggtgtgggggccaagtgtctcccagtcccacctggggaccctcatgtttcccrcactcacaaagctttcatttcctatcctctctatggggccctagggaggatgaggaccccattttgcagtgaaggaaaccaaggctcagagagggacggggacttatgagctgggctctgctggcaggcgacttgggctccatagaggggtggggcatggtggcggggggcggggtggctgctcctctctgttctctgcatacaaagcacgtgagatcccggtctgtggatcggtgctctgtcccctgccctgtgatgctcacacacccacactccgcacacctgtgtggcatgcccaagggcacacagcaccacagggacaggtgctacagacacatgtggatctaccagcacatgcacctacctacacacatggcatgtgcctgcacaccaatgtgcacaccccaacacgcacrtgtggacatgtgtgcattcacactcagtgtgcactcacaggggacctggaggcacagagtggatggaggctgtggggggtctggacactggtgtgtacactcaacccatcaggcctgctgggttgcccaggggcagcctttcctctgccrtttctgtgctgggagcgccatccctggggatccctaaaagttggtggggtacactgcaggcatgaccatttctgcatgctggtaccctagactgcctgccgggaggggagggattggggattttgtcacttgaaaaccaatttccatcctggaggggatgggggcttctggaggccatgggcccctggcttttctccccacccctgccaggccctgagctgggcctctccatcctgggcccaatttgccacaaaggcccggctggttgccatggagaggaccaagcatcttggagtacaatggggcacgttgggctctcatatccaccctcccttccccaaacacccagggagcccagcagacaaaggggcagtgagtccaggccccaagtccggcccctcctccagccagaagggggtgggggcctgcaggacagaagcagagatggagcagaaagccacacacattcaacccaatgtcaggatcctttggacagtgggtgtctgcctcaagtaaagaattgttaatgagtaagatcagccactccatggcaggcactgtgctattattaacgaggtctaatttaattctcccaacagcctatgaagtcagctctgatacccctagtttacagaggaggtaaacgaggcccagagatggccagtcccagagccaggaagccccagagccagtgctgggatttcacagtacactgtgctacttgcctaggcaaagtcacgtctcttctctgtctctacaaaacgaggacagactggcttactccgagcgctggtataaggattggaagagaatgcagtgagcggttccccaccccaggttttggcatggaacccccaatttcaagggaaattttagatggaagcccatgaatagttaatagtaaaattgttaaaagtggcctgtttgggtggcaggtggggaaccccacctgctctgtctccccctcacttcaggaggtaactccctggaactgtgctctgagcccaaactctcaagggttggtcagtgccaggcacagggtaggtgctccgtccctgacagctattgttgcaattactgttatcaaaattatgtcttttaacctcagaaggtaaacatttttgaaaaagagtatgccaaattattctgcccaaaagagaatttcaccctttcctgatgactgagtgagtgtctgcaagcctccatggttattcagccctacccttgtagggtagagccytgggrcccagggatattagatgaacaatttcttcccctatgctagaagttcccacaccttatgagatcttaggtcgcttcttagaaatattctgtctcttgatttgttgggacaggaagcttccccagtaaatgcttctttttttgtttgtggtttttcgtttttktttkktttyktttttttttttttttttttaaraaagggtctcaccctgttgccctggctgcagtgcagtggcaaaatcatagcccactgtagcctcgacaccctgggctcaagccatcctcccacctcagcctcccaagcagctgggactacagggacccaccccatgcttggcttatttcgttttgttttcatagagccagcgtctcactatgtttgcacaggctggtcttgagctcctggcctgaagtgatcctcccacctcagcttcccaaagtgctgggattacaggtgtgagccactgcacctggcttcagtaaaacacttctcatcagttgttggctgttataaacaggcccattctaagtgcatgaaaagtaggagttactaatgagtgaggcctgagacacagtgggattactgacagctgggttctggatagacggggaagattgcctgctctgcccaggctgatattggaagctgtattcctgtgaaaacctttagagattttttttttttcctgggtgaggcagctgtaatgtactaaagcaacaatatgtgagtggcaatttagggtttgtaaagtgaaaatttcacatgcattgggagatgtggacctctgggaaatcaggagctgatctgattcttcgtctcaacctgggcaaaattatcaacctctctgagttacaaaaacagaaattttcttaatggcacccaccttttctggtctgaatcaagtataacaatgtaataatagatgcacaggcccaagcacatagtacacactcagtaaacagctgggtcctcctgcccctccccaggacagggcagcaggtcgaaggggaggggcgggcgtcggttaatccctccctgccaggtcggcccaggcagcctgaggtcaggagggatttgtaaagataagcacaggcccctcgttgccctggcaacaggccccgcccctccagcctggcccgggaaggggggacagcccctcctccgccctgctgccctccacaccccgcccctccttgcctctcctgtctggcctgggctatcgtggcctcctaggctcactcctggaagacagagacaacctgaggtcagcggttcccacacctaaaagtgaaaggaatcccccaggagcaggttgsgatgcagattctcaggctcagggcccagtggttctaaatttggggtctggagtgggttccaggaatctgtattcttaatgtgggcccgtgattccgggaagcttggagtgaggccctgggtttggattccagcctccctygggctgtggactgtgaggctgcttcgagtctccctttcctgagctgtaaaacaggcatcataatcctatccacctcggaggtaaatgccaagatcaactgagatgacacatgaaagatggctgtccctcccaggcaggactgtggcactattgcatgcctcccaggacgggcagctccttcccttcctgcctggctctgactggagaaattccttcctcccatggggttggactctgtctcccgggctctgtcatttagagcccatctgctcccatggtcctgggaagatcccttgtgacaaggcacctcccccgccccccaggatcctttccccggtgctgcctccccagcgtggtcccagctgctctgagatagggggcaaagcttcagattggatgggcggggrggcggggggggttccttgcactgcacaggtgagggacagtgctctgtgggaattaagtgagggacctgttggcacaggcgctggcagccggggccctttaccatgggttatgagtgctgcaccctcctgagcagtgctggccacacccagtcccagggctgtgccctgcatcaccttggtgaatccttycaacacctccaygagatgggcactttttgcaccccagatacaaaccaggactgcccgatgccccaaacctgtgccctttcctgggggagctggaaggatgcgggtcaggccacaggacagccctgcctggaatgcggatgacgcctgagaggctgccagccttatctggggggcttcaccagagtgggggagggaagggtgcagggtctgagctgttctggggtctggtgagtgtctagatgacaacctgggtgggggaggggcacctttgggagctccggatgggggtggggggaggaatggaggctgtgtcttctggaggctctcctcccccatcccttaccgagttsttaccaaaagcagcccttgactgcggtgctgrggagctgaatagttcagcatttgatgaggggattcttttatgatctaattttcagactgggaaacrgaggctctgtaggagaaatgacttacccagggtctcatagctaggaactttctgagctgaaattgaacccaggtctgtttcacttcaaagcycaagttctcacctgggcattgtggtgacaaggctctcaggaaggcaggaggagaggaagggggatgaggatctctgggcgtggcttccaagccggttggtgaccctctgttagagcyccggtgctggaagcatcatggtggccaggggcaggtgtccgtgagccatctcaatacctgctctgtaccatgcgaccttggccaggccggccactcaggtgtttgctgatgggggatgaaattagggccagggaccctctagaagttcctaggccagtggctggcagggggtgggtagtgatgtggagaaggggtaggaatgagaccagcggagcacacgatccctgcttttgaagttgtccacccatcctccmgaggttgaggtcgggcycatctccagtttcacccagggatggagttaccagacccctggcagaagaggtggagggggcagtgggaggagcctcaccctctggggcctccttggatggatggggcctgcaggagggagacccctccccaggtggagctgaaataatccagatagaccttgaagcctgtcccagcgaacactaacttgctgtgtgaagtggacagggctgggcaggctcagcaagccttcactttctttcctgggcctccttttgctgtctggtgcaatgggcatgacggatactgcctcaaagggggactgcagggacaagacagtggagggaagctcacggggctcagggaacctctgctcactaatcctgcccagaagccagacatccttggtgctgtttctctgctatataggctctcctaaaaccgttcccagttctgggtgcagatgtgtgcagcttactgggacctggcttgcagacccctggccctctgtccatactgtgcatgcagagacccacgttgcttttggggtctggggtgggcctgagagggtggrgaggagattgtccttgtaacctctgcccaccctgcccagccagtttcttctttctacagggacggtgccttcagagccccccagtgcctgtgcctcagacccgtgcgctccagggaccgagtgccaggctaccgagagtggtggctatacctgtgggcccatggagcccyggggctgtgccacccagccatgccaccacggcgctctgtgtgtgccccagggtccagatcccamcggcttccgctgctactgcgtgccgggtttccagggcccacgctgcgagctggacatcgatgagtgtgcatcccggccgtgccaccatggggccacctgccgcaacctggccgatcgctacgagtgccattgcccccttggctatgcaggtaacagcctgggccgccctgggaggaggtctgtaatgcagatcgcatcagctgctcagagtgtaagcatcatggcttcagctttgcctttcgtgtagggacgcccccaggcatccgggcagctctagggtatatccacttggtctgactacagaactgatgcctggcagctctgggtgagagtatgtatgtgcgggtgctggcgtggtgtgtggcgcatctcaggcactcggtaaatgtgatttcagtccagcctagagttcagtttggctgcgggggtggaatacccctcattcatctctggcagtgtgaacctgcctggcgtgactttagtgaggatgcccagatagtttttctagcacttcaggcctgtgccaagctgtcatgtagacactgtctacacgacagtcaccatcagctcatttgaacactcctgatgtggtctggagtgcaatgtggacccctggcctctgggtctcccccagagttctagcatagacatacaaggtctcgttcaaactgtagtgttgacataccccagggatcgctgctgtctggagtgggataatatatacgtaagtgctcagaaaagtgactggcactaagggtaccttctccagagtgtggcccgtcccaggcccacccatggtctgagccgagaacatcctggagcggcttcccagagaggcctgaagtcgggaaggagggcgcagctggggacagaaggggcgcagtctgggagcgaagctgagtccagggcagagtctgagtctgcagtgtagatgctctggatcctacttcaatcctgaattcagacaactgtactctgagggcagagggcagtttgaagtcacttcagagcaagaggtacagattggggggctgggttccagggcagggggcctacagcgaagagatggcagctgatgaagagagatttgggaagctggttccatgcatctttctcatcgttccagtgtctcagcgtctgggtgtattagtgtacatgccagtgcaggtcacattcgtccatgtgtctcctagttccaagttctgttttgcatctgtaaagatctgccagtacctgggggtgtctvcagtcdgagtscatgtgtgggcagtgggttgttcgggcagtgggttgtgtgggcagtgggttgtgcgggcagtgggttgtgcgggcagtgggttgtgcatccggatgtgtagcactcacacacttcgggtgactcttcctgggtaagctgtggatgtgagtgggggcagcatctgccgtgactcattctctcctctttccattccaagccgggtgggggagtttgggatttccagacaaggcctggctccccctggcacagagggtgggagtggggatggggagggaggagggaagggtcatgggaaggtggggccatgttttgtgctcaatgaactgagaagggggagggttccagctggagtcagctgggcctctggcccccgcttgaccaaacccacttagggggcagggcctgctggagtctacagtgacacgtgagtccaggatgatctcaggcagcgtatctgaaaccctgggactccccatctcccttcctcttcaccatcaccctgggagagccactcagctgtcgtgattcgcccaggactgcgagggttctggggacttggtactttcagttctaaaaccaggacagtgcagggacactgggaggagtgattaccctactcaagcatctcctgcctctctgggatctgaaagccaccagagtggaccttctaaaaagtaggtagggccaggtgtggtggctcacgcctgtaatcccagcacttcgggaggctgaggtgggtggatcacttgaggccaggagttggagaccaacctggccaacatggtgaaacgccttttctacaaaaaaatacaaaaattagccgggtgaggtggcatgcacctgtaatcccagctactctgcartctgaggcacaagaatcacttgaacccagtgggcagagattgcagtgggctaagattgcascactgcactccagcctgggcgacagagtgagactctgtctcaaaaaaataaaaaacaaaaacaaacccaaaacaactaactaaaatgtaggtgggaccaagtcacttacctgtctgaaactttcaggatggacccagaggttacctggtccccaaggcactgacacctcccacccgactcacctccgccaccctctcccttgcttccaaccctccaataaccccgcctagggcatcatggccctgcccctagtggaacttgcctcttgctgcagtctctttggaatccaactgctgcccacagtcccctatctgaatccttcaaaagcctcttcttctaggaagccttccctgaacagagcagaccccggctattgctttcccaagacccaacccctttccttgttgaacttggcaacatcacctagctcatttaggtaattactggctgaatcaccccccaccatgtcctggcctagactgctgtgagccccatgarggcagggctgtctgtctcgtttctctccctgcggttgctggcatgacccgtcccccaccccccaaccaccaccaccaccatccggctctgaatgaatgaatccacgagtctctaactctggagcaggcctggcgcgacctcttccgccctgctctgggtgtccatcctgcaccctgtgtgtcccctgccctgtccaggcgtgacctgcgagayggaggtggacgagtgcgcctcagcgccctgcctgcacggggsctcgtgcctggacggcgtgggctccttccgctgtgtgtgcgcgccaggctacgggggcacccgttgccagctggacctcgacgagtgccagagccagccgtgcgcacatgggggcacgtgccacgacctggtcaacgggtgagcgagcggcggggcaggcggcaggggcgccgggtgcccgagggcggggaggccaggcgcggggcagaaggggcaggcgcgcgctcagctccgccggtgcgccctccccaggttccggtgcgactgcgcgggcaccggctacgagggcacgcactgcgagcgggaggtgctggagtgcgcatcggcgccctgcgagcacaacgcgtcctgcctcgagggcctcgggagcttccgctgcctctgttggccaggtgtgtgcrtgcaggtgcgcggcctggcgggggsaggggtaggtgtgcgcctgtgcggcctggggcggtggggcaggtgtgtggctgcacgcgagtgcccgctgggtcctcgggaccagagtgtgtgtgtgattgcaacctgtcggagcctcagtttcctgatctacaaaatagggctgatcgtagcgcctgctcctggggttgctgcggggagctcgaaggtgcgacgcctgggaagcccttggggagggcctgacagctgcaaagggctcagtaattaatgctagtaatagtagtaagactaggccgggcgcrgtggctcaagcctgtaatcccagcactttgggaggctgaggcgggyggatcacgaggtcaggagttcaagaccagcctggccaacattgtgaaaccccatctctactaaaaatacaaaaattagccaagcatggtggcatgtacctgtagtcctagctactcaggaagctgaggcaggagaatcgyttgaacctgggaggtggaggtgagcagagatcatgccgctgcactccagcctgggcaacagagtgagattctatctcaaaaaaaaaaaaaaaaaattagtagtaagactagtaatagcagtaataggccactgctgctgaaggctgccgtggtcattcctgcggcccttagtgtgtccctccctcgccattcgtggcttattccragctgcggtcccttgctggccctcgctagcctggtcatagtgaagaggtgctgcccggcaaccccgtgagacctgatgtccgcgtgtgtgtgcccccaggctacagcggcgagctgtgcgaggtggacgaggacgagtgtgcatcgagcccctgccagcatgggggccgatgcctgcagcgctctgacccggccctctacgggggtgtccaggccgccttccctggcgccttcagcttccgccatgctgcgggtttcctgtgccactgccctcctggctttgagggtgagcccctgctggggaagcggtcagcccatgtccagatgcccagggagggatsttgtgcccacccccccaccccccccacccccccaccccacaccccacacccgagtctgccctctctcttggactcagtctctctagctatagaatggaccctctcagcccctgcctggctctgagggtgcaggtgggacccacagctgggcctcttacaggagccgactgcggtgtggaggtggacgagtgtgcctcacggccatgcctcaayggaggccactgccaggacctgcccaatggcttccagtgtcactgcccagatggctacgcaggtgtctggggtggggtgggccctgggaccatcagaattggtggtcctcaggtgagaaggtcccttctgtctggatgtgtggattgatggggtcaaggagatcagggaggaggtgggtatggtggcccaggtgaccgctgagggtggctgaactgggactcgctttggaggtgagactggggctcaggagtgtagtcctggcagctggggccatagtgggctgaggttgtctgggagaacgtgtggagggatggtcttcagggaagacggaggtggttcagccaggacagagaaggaaaggggggctattgcagagagttagggggcagcatctgtagaaggatgactctgacctttggggagctggggcctgtcaggcaggagttgggggttcagaagtctgcccctgccttgggtacacgcagatgcacagacacaggaccccggtgagcccagggagctccaccgccaacactgaacgtccctgccccctctggaatgcctgcgacacctccctcacacccgcccgcattcctgctggggcacactgcctcctccccctggcaggctcctgggcacaggctcctccaccaggggaaagagatggtggtcacctcttcccctctctcactcgcctgaagatggtgggactcagtgtcccccagccctggatggctgacactcctgggggtcccgaaggcccatccactgcctccatgggccgaggttccccaagtcctgctccaagagccatggcctcctgggtacctggcacacagtgggcccacacagcacgtctggcctctgggaagcatttgctctgcattttgttttttccttgccacagccccatgaggcaggggtttaaaaccccatcttacagctgagaggatgagggggtgtcatcccccaggttcaccactatcagcgggaacccggctcctctcccagttgagctcactgttgggtgacagggagggcagacctctgaggtcagagccagggaggggggaccccagctgcagggctgggctctttgcccatcctccctccctttaggccatgctgggcatgggggaggccagtgcctggcattcctgagcaggctccgaaggaggcagctgggccaggcagggagctctgccycctccccacttccccagcctcagtgcccgcccaccactctcaacctgtctggagggcatggcaatggagccgggggctctgtggaccttcctgggccacctgtggctcctggcaggtatggaggaatgtgggccctgggcagggggaggttggtgggtggtggttcctaggaagaggctgtggtgtttgtgagctgatcgaggctgggcttcaaaccctggtgacttctctgggcctgggttcctccagctgggatgtggctctggctgagctacagtgggctatggcttctggacccaagctggggcctgagcacctgaagggatccctagagggaggatgaggcagccccttcacagccagtgtgggggccctggggcagagggactgaggggttagagcctgggaggccactcagagtgccttgggtacttgcactaccccactagctcctccatgccatcactctgtccataaaagccatgtcaggccctttgctgggcaccaaggacatattcaggtccctgaagatctcagctgagtaaacaaatacttttaatacagggttctggggagctgtgcctgggactgcagagtgacacagtagtttgaggttgggagttagggaaagcctctgggccctttgagtttgggctttgcaggatgagtaggagtttgaaaggaagggtaagggtgaatgaggcattccaagcagacagaacagtatgagcaaagccccagagtcacgactttccaggaaatgctcggaggaatgggacgttcaagatttgtgggaagcaggattgaggcttgagagcctggtaggacccagcccatgagggtgtcttaaatgtcagggtgagtgattggacttcaggcggcagaggaacccagcctggcgatgctttagaaatggacctctggctactggtggagatggatgggaragggcttctgaaggctggcgaactgggggatgcgggatggtagcccagacagctggtaaggcaggagatggggggtaggagaaaggggcattggagaatgtttaggagattaaatctacagggcctggacactcaccagacatgagaagggaaggggcatcttggcttctggcctacggggggacttgaggggaccatgagaaatcctctgggaattggtttggctgataggtactgaggtccccatcataagaggcatgtaagttctgggycagtactgtgattctggccccagacattactgaaccttggctttrtctctcccaaagggccgacatgtgaggaagatgtggatgaatgcctgtcggatccctgcctgcacggcggaacctgcagtgacactgtggcaggctatatctgcaggtgcccagagacctggggtgggcgcgactgttctgtgcagctcactggctgccagggccacacctgccygctggctgccacctgcatccctatcttcgagtctggggtccacagttacgtctgccactgcccacctggtacccatggaccgttctgtggccagaataccaccttctctgtgatggctgggagccccattcaggcatcagtgccagctggtggccccctgggtctggcactgaggtttcgcaccacactgcccgctgggaccttggccactcgcaatgacaccaaggaaagcttggagctggcattggtggcagccacacttcaggccacactctggagctacagcaccactgtgcttgtcctgagactgccggacctggccctaaacgatggccattggcaccaggtggaggttgtgctccatctagcraccctggagctacggctctggcatgagggctgccctgcccggctctgtgtggcctctggtcctgtggccctggcttccacggcttcggcaactccgctgcctgccgggatctcctctgcccagctgggggacgcgacctttgcaggctgcctccaggacgtgcgtgtggatggccacctcctgctgcctgaggatctcggtgagaacgtcctcctgggctgtgagcgccgagagcagtgccggcctctgccttgtgtccacggagggtcctgtgtggatctgtggactcatttccgttgcgactgtgcccggccccatagaggtcccacgtgygctgatggtgaggaataagccaggtgggaaggcagcacctgagatctgcctccctcagcctgcaggcctcacacctggcaccttctctccctgcagagattcctgctgccacctttggcttgggaggcgccccaagctctgcctcctttctgctccaagagctgccaggtcccaacctcacagtgtctttccttctccgcactcgggagtccgctggcctgttgctccagtttgccaatgactcygcagctggcctaacagtattcctgagtgagggtcggatccgggctgaggygccrggcagtcctgctgtagtgctccctgggcgctgggatgatgggctccgtcacctggtgatgctcagcttcgggcctgaccagctgcaggacctggggcagcacgtgcacgtgggtgggaggctccttgctgccgacagccagccctggggtgggcccttccgaggctgcctccaggacctgcgactcgatggctgccacctccccttctttcctctgccactggataactcaagccagcccagcgagctcggcggcaggcagtcctggaacctcactgcgggctgcgtctccgaggacatgtgcagtgtaagtgtctggtggcrgtggtggtggtggggtggggagtccttttcccaggatctgtcctgtgtcaccggggcttagtgtgtccttttgctgatgaggaaactgaggctcaggaggtgaagtgacctgcccagggtcccactacaggagggtggcagggcagatttacatctgtctcttyagcccagctgctcctaccctctggcggtccccgtgtctccccgagctagtcctggtgtgagagagacaccctgaccgagatagagagctgcctgagcctttctgcaggagctacttggggagcgggacacgcttttgatcatgaacagaattccaccaaccctggagttagaacagcttgggcatgaattctggttcctctctttactggctgggtgactcaggcaagtggctttgcatcactgagcctcagttttctcatctgtaaaatggggatcttagcgacttcctctcccctcgtttgtgaggagatactgtgtctgtagtaggtgctcagcgaagaagcactgcaatgccagttatggtgggtgatgctcactgcagtcctgagccaacccctgccctgcctctcccacagcctgacccctgtttcaatggtgggacttgcctcgtcacctggaatgacttccactgtacctgccctgccaatttcacggggcstacrtgtgcccagcagctgtggtgtcccggccagccctgtctcccacctgccacgtgtgaggaggtccctgatggctttgtgtgtgagtgtgtgtcctgggcagctcccgtgctgggtgctggacacctaagctggttagatcccatctgcactctcagggcttgtaggatactggtggaccaggcatgccaagccctagggcagtgtggcggggccaccgcatgtagagggacagagtttctggagaaggtgagcctgtactgggcttcagggccagactctgagagccacagggggaaggatattttatggagtggcatagcatgtgccaagtccctgaggtctgcaaggacagtggaagtgcaagggggtgagcaggaatggggtgggaaagttggtaggggctttgaggacacccagctaggcggctctgactttatcccaaggacagtggggagcctctggagggttttaaacaggagaggggcatgaccagatctgcattttacaaagatgactggctgcagtgaagggcaagcctcggccatgaggtggggcagcttcacggagaagggaaggggccagattctgccaggagttgctgttgcctggcttgtgacctggagggtcgcctaggcatcacgccccaccccccagcactggccgggaactgctcctccatgggtaggaaatacattgggagtagaagtgagggtggtgggggcggctgcagtttccaggattagatgataggtgggtgcgtgtgccccaccccaagtaagtggctgtctgccactcgctgggggaagtggggaggtggcatttctggagaaggctccgtgggctattccctgaggctccttctctccgcaggtgtggcggaggccacgttccgcgagggtccccccgccgcgttcagcgggcacaacgcgtcgtcagggcgcttgctcggcggcctgtcgctggcctttcgcacgcgcgactccgaggcctggctgctgcgtgccgcggcgggcgccctggaaggcgtgtggctggcggtgcgcaatggctcgctggcggggggcgtgcgcggaggccatggcctgcccggcgctgtgctgcccataccggggccgcgcgtggccgatggtgcctggcaccgcgtgcgtctggccatggagcgcccggcggccrccacctcgcgctggctgctgtggctggatggtgccgccaccccggtggcgctgcgcggcctggccagtgacctgggcttcctgcagggcccgggtgctgtgcgcatcctgctggctgagaacttcaccggctgcttgggccgcgtggcgctgggcggcctgcccctgcccttggcgcggccccggcccggcgcggcccctggcgcccgagagcacttcgcstcttggcctgggacgccggccccgatcctcggctgccgcggcgcgcccgtgtgtgcgccctcgccctgtctgcacgacggtgcctgccgtgacctcttcgacgcctttgcctgcgcctgcggcccggggtgggaaggcccgcgctgcgaagcccacgtcgacccctgtcactccgccccctgcgcccgtggccgctgtcacacgcaccccgacggccgcttcgagtgccgctgcccgcctggcttcgggggcccgcgctgcaggtgggatggctgggcaggggggtgggctgcgaatgccccctggggctrtggtggggcagagaagtctgccaggtctgtggatgagtcgcttcccttccctggtcctcatgtccttatctgtgacatgaggaggacagtttaatttgataaatttcctgataaaatacagatcaaaacacaaccagttagcctggaatttcagataaacagcgctgtggtctggggctgggagccgcctgccgcttacacggaggttcatccctattggtggctggttggggtggagggagggggtcaggctttggcgcttcccttattcatctggcagtggctctcccgggagcccagcgtgtggaaggggatctggctgtggcctgacccctccctctcccctcaaggaatgtccaggcgttgtgtttaggasctgcttttgttcagagtccttacactttgttgtcctgagtcctctgagactctggaaagcgagtgacaaccctgtgtcccttccctcccatcagggacctcaatcccatgcccaatagaggaaggccctgagttccatacatgagaacacaagctcaggtggcccacggtcacagcgctggggagggcaggtcccaggtgtcctgcacccactccagcctctgctctctccccaggttgcctgtcccatccaaggagtgcagcctgaatgtcacctgcctcgatggcagcccatgtgagggtggctctcccgctgcyaactgcagctgcctggagggtcttgctggccagaggtgggtctgggggcctgggaactgtgaggaggtccaatgaatgtggagggctgttcctccagccagggtggggcgggggtcctcgcccaccttctcacccctccctggtawcacagtcaccattgtcacttgagtttccttccatgactcgcaagaccatcctctgtgatacagactgctgctgggcagtggttgcctggtggcagttctggaaacccagcctcagcccgcctgtgggagaccataaaagtgcagattctgggccctgcagacagtggcgtcagcgtctggggcacctgccttcacacaggctcccgtcaccctaatgggatgagagtccttctcagtgacggctgctcaggtggtcacctggcagggcccagctgggyaggagcagcgcatggggacagtggatggataagctctgatgcttgctgaagtggggatgggcagcagagcagctgggagcacaagaggcagccatgggggaagccgctttctcagcccmcctccctctccaggtgtcaggtccccactctcccctgtgaagccaacccctgcttgaatgggggcacctgccgggcagctggaggggtgtctgaatgtatctgcaatgccagattctccggccagttctgtgaagtggcggtgagtgttgtcaggggtgaggggccgtggacgtggcctgctgggcccttggcragatgctgctggggagagagcgcagcaccatggggctgttcctgggccactctgtcatggggtggggcagtgagaggagcctcaggtcccttccacaccccccacacaagaggtatttccactgcagggagagctttgggggctgtcaccgtctattgacaagagcacaaagctcctagctgggtcagsggcttcctcagagtgcccagggcagtggcagtgaggacagatggtctctgccaatccaaccaggactcagggccatgttggtgttctgggatttaggttggtgaatccaggagactcatctccaggggtttctgagccagtgtcctgagtaggaagacacggaggggcagggggcctgggagtccgcactggagcaggctcggcccgctgtgcaggctggccccaaccccgggtggctcagcccaggaggagcctggacagacgaaggcagcaggcgctggagctgtgaacctccccgccacaccccttcctggggcggggtggggggagtgggtgctggcgaggagaggcttggaagggaagtctggggagcagccttgatctcyacaggcttctggcagcctgggtcataaaccacaaatcccctccgcttacggggaatgtttcctttcaagttgaacttttacagcctctggcttccctacccagccacctccccagggcagggggaggaaatggctttacagctcctccctcaaaatgtccaacggtggaggctggcaggaccctctcaggaccagaggaactttcctgtcaagttttaggacccaggtcacagtgggctgggaagcctggaggtacagagggaggctggtgagtcccagagcccatgcctctggaatcctcgcatcctgggactacagagtcccaggcatgtagaggctttgatggggaatcctgggagcctgtgactggagacaccagggaggtttgctgggctccccgaagcctgggccgaggctcgcagggacaagctgtcataacagcccctcggcccccctgccaccctgcccccgcaggtgggccccagtggattctgaccttgctattgtggcagggggccgctcagcctgcccctgctcctgctctgcctcatgagaccctcgtaggcttctgtgaaacccatgcaccctgcttagctcctgccgggtgttcaataaacgcccatctctgtccttctagccagaactcctttgttgtataggcctcccygagcagtggctgtgacaggtggtttcctggcacttgcctgcayacccctggggctgggtcttcactgctcccagggcagcctgctcccagctctgattttctctgagtaggtccttgtgctgcgctctctgctctytgagggccccrgcgtcctccccttctctgcggtcttaggcctcggtgtcgtgtctcttgcagaagggcctgcccctgccgctgccattcccactgctggaggtggccgtacctgcagcctgtgcctgcctcctcctcctcctcctgggcctcctttcagggatcctggcagcccgaaagcgccgccagtctgagggcacctacagcccaagccagcaggaggtggctggggcccggctggagatggacagtgtcctcaaggtgccaccggaggagagactcatctaggccagcctggctgctggcaccagcacctggaggtcctgaatggtttctacctggagacccaaggaagctgcttccagggctcgggacattgctacggaagtgtccccttggctggcagcctctgcctctgcctctgccccatcctggatggaggacgaggggagcaactcagggaaacagaggcctagagaggctgcggacttctccatcccaccctcggggttccgccttggcaggtgtacggctgtgcgtgggagggcacacgtgggttcacagtgtgttcaggagtgtgtgtatctggaggagtgtgtgtgtgagtgtgtacctgggcctgtgttagtctgcagatgctagtgtgagtgtgtcctgacatggctccagggcgtgtctgccgtgtttactgtgtgtctatgactgtgatgggtgtagctgatcccaggaggtggcggctgcgccatggggtcaaccattacagtcctagggcaggggcggcccaaggctgcatgttctccaggaggccaggccggggttgcccaggcacctccttccccgcctctgggggctgctcctgctgtggaggcagctgggaagtcagggaaggccactagcagaggctgagtgggcttctggctcctagaacaaatgtcccttcaggcaggtctgtctgccagaagccagagccagtcatgcgagggaaccacagacccacccgccccctcagccggagcagcccgagggagcagaggaggggctgcctggagcttcccaccctgctgtggtcatttgtcaaagggggaaggcacccactgcctacctcacagggctgttgtgaggatcagagaggacgacagtggggaaagaatctggaagtcttcaactgccgtctgatgggaaggaccgtctgggtgtccttctgggatgaggatgacagagcaacccttctcctgccctgaacccccccagctcacctgaccacctctggttctccagctccggtccttcctagcagcctggtgagctcactccttcccctgatgactggctgcctctacacagactcggcgagaggacttgaaggaagccctctgggttgtctgctgagtacaggggctcagtgaacactggcgctgcctctgagtcggggctgggcctgcagaggccgactcagaggagactctgctgcttgctcccagccccttccccggcgatgcccatcacactgtgacctcccatccctgaagggcacctgcctgagggcctggcctccttccagcttcatggacctggagatgtgccctttcatccttcctgcttcccaggccagtagatccgtttacacttttgggtcgacagtcagcttttccttttggttttggcgggtcccagaggcatgggtgtccagtccaatgtggggagccacgtgacaacgtgggggactgggacatgggactgggaagtcagcagacgctgggatagagagggccctgaacaccaggctcaggggcttgcttggtccttatcctgtaggaggtgggaccacctttccctgaactttctctacaacccttgggagcgtggggaggaggcggctggttccagggtcagtttactaagttagagatttggaaaacctgtgtcagctgtaactcctaggatattttatgtggaacctaacatgcagatgaaagctggctgtcccctgtcctcttcctggctcctgtgggttcgggtgcctgtttttttttttttttttttttttttttttttttgagatggagtctagttctgtcacccaggctggagtgcagtggcgagatctcggctcactgcaacctccgcctcccaggttcaagcaattccctgcctcagcctctggagtagctgggattacaggtgcctgcttttagtagagacggggcttcaccatcttggccaggctggtcttgaactcctgaccgacctcgtgatccacctgccccggcctcccaaaatgttgggattataggtgtgggatgacaggtgtgagccaccgcgcccggcccgcgtgcctgtcgttttcagcctgtcagtcagtcctgcaagtgggggcatggtcagatgatgggcgagtcggagggggtgggtggtgtgactgggcatgttccacgctcactatggggtggtcgattggtctgcattcccccgcccgcctccccgcaaacaccagcgtccaacagaggcagagtcccaggctctgttcttgctaatgagagacctgtgggggcgacttgccaggtgtccccttgaactctttcctggctcctgggtgccctcaacgtcgttggaggcctgcagtctgccccatggcccccgcagggctgagcaggcctgttgccagcccaaccccgtgcctggtctgtgaggggcagagcatgagctggcttagagccctgagtgggcaccggcttgggagggtgcggggagttgactccttccctaactgctctgcgcctggcccctgcctctacaggagcaggtggtgaggatggctccgggcccgtgtggggcctccccgacccaaaagcttcaaggacacggggatgccagcctcttccccaagatgattttattgaatgcacacaaagttcatccttgggtttgcaaaaagtcccacaagtgaagaggcagcagtgctcatgtgaacatggagcgctcaccccagcccctcagcacagccagggggccttggggtacacaccctccttccctggggccgccagcacctcctctgccctatcccggatggggcctgggggtctgcccagggtgcgaaactggaatctatgctgaaacacctaagtgcccaggaggtgcccccatggcccaggagtgacacggctcccccagcagccagagcccattcctgagccagacaggtcacggttgacccaggaagagccatgtgccaggatggccgccaagcctcactgagcatgtgcagcagtggcagcctctcagacatagagggggctccctgggtgacatctccagagacccccttgtcccccagacacccctgggtagactgtgtctgacccttcacaaataggaaatgagagctcgggtcgaaatgctcacaatttcctgcgtgtctcagatggttgttttcttaaatggtcgggccatactttaacttggtttatggaaatgaatccatttcaagattcatcaaatcaataaggtaaaaaggaaaaagaaagataataaacattcaatctaactttggtgacgttggcctcaggaatttctgtgctggcctggagctctgggcaggtggggagggactggcttctagccctcctcctgcttccccgaggcagagaccaagtttgtcctttctacctggccctggagaaggggctcagggccactgcctcgttccaacccaggaaggccagctgccttccacatcagtctgaggcattcagcttgacctttttgggttgaaatctgggttgcagcttctcagctttgcccacaaagctccagatgacaagaggctgagccccagctttgacagtgaggggagtacctggaggtatcagcgtgccagagctggatgagggctgggggctcctcccaaaatactcagatgggggtttccattttccttctataaatcaaagttgctggtgctcgcagcccccgtgcagggtggctggggctgtgtatcacaaggcagcccaagaccccctggtccccagatcctcccaggtcagaatcaactgaagttttggggtgaagacacaggaaagaacgtgtgtgtatattgctagaaacagtctggaagtgccccaccaggtaaatcctccagcccaggaggagtcctaacttcaaccccaagctacctgtgtctcgtgcagatgagctcaaactggagggtaaccctgtcacctgtgtccgaggaggtgggcgtgcagggcctggctgtggaggagacaggagagctgggctcggaggggaggccttcggagcctcttgggacacttccgggggaaggtgggtaggactcggtctggagcaatatcattggcccagctgacctctttagtgcaaaacccaatcaagggtgccgaggagaggcaaccgcggggtgggatgggcactcaggaactgggttgattcccaggctggaactggtgccattccccagggccagacatcagagatgggcagtgtggaggggaggagggggcagcagagaggggtcccatcccttcccaccagcagaacctgggcagagagagagtggcgggggagcctcggaaccgcagcagtggacggaccctcgggcctcggtgcatcccccaccctcagggcccggctcactcgaaggtctcccactgcttcctgagctgctccaccgagtctggggccggggccagggccggactcgggctcacgtcttgcttggttttctgtaacaaatcctcaaaggggtctctggcctgttgaggagcagagggctgcagtgttggctccaggccttgagggggcctgggaggcagaagcggggggtctccaggcctcagggccagcccctgcttggtctcagcagccctggcacttgagcgggccaggggcaacgttcggatcctcgacggggcaactgctgggggacccagcggctgtagggggctcgtgtgggtgcccatgggcatctggccaaagaggttgggcatggagagggcggagaggttgggctgagacctgtgaggggcacagaagccagcactggacagcaggaggccggacgcaaaagccggccccagggaagctggaggggccccgaaaggcccggctggtgtggagaccaggggcagggtgggtggggctgctggcatggatgggacaaaggggttgagtggtggctgtgggaatggggtgggtgtccctgcaggggggaagctgaattggggggtgaatggggtggctacattcggggtggcggggcgtgacgggagggtgctgcctgaccaggctgtgctgagcgggtccaggagggcgagcagggcgtcactgctcgtgcctgcagccccggggccagggctgagcggctggagcagttcagtggggccttgggggacaacaccaggcaggagccctggactcagggcagctcgcctgtcccgatccgtctgcagccgctctgagacgtcaccaagtgcggcgccggcagcctggagcttggccgggcggggaatgggcggtggaggcacgatgcccagctctggggtcttcctgccttggggccgggggatggtgatgctgcccagagtaggggtgggcacctcctccttgtcactggggttcaggatgctgtcccggttctggggccttcgaggcagggccagggagttcccgagcagggccgagggcttctcaggggaggcagctgggggcttgctggggatggccatgtcgtcctggcccaggctccagagcttgttgtacgggtgggtaagcttcaaggccactgtcaccccgcggctcctctcactcccgcccagatccagcctctgttgggagggaaggagggcggcagtgaccacgggctgagttgggacatatgtgtgcccattcccacaccacttctgtgtgctgaatgtgtgctgggcctagttgtgtggctgatcagctcctcggacttggaacagctgagggctcccccaggttaccagcagaggacccacgtgtgctgggactccaagcctgtgctccgggaactcaagacaaagctctcgtccctttatgccagtggcggttgccaaggagttttaggaaagtgactccagctaccggctggccctttttactttttagatcgcaggcacccgcaatcacctgtaagcccgggggcgcgagtgagactcagggcctggtaggaggcaccttggctggggaggaaggaggaggccaagttggagtcctggctctgccacttgcaagccacacggcccgggtgccagtccctttctcctggcccaggtcctcgttcccagcagggaacactcatgaatgactggagctctgtgaaccccacggtgtgacccagtgatgcaaagtcagaagaccccacttgcaagtgaggaaactgaggcaccgagcggggatgtgatggattagacgtcacagtgggaattacacactgatttgcattcataatgcagagccaagaacttgcatccacaggctctgccaaggagccctggcagggatggacgcaatcccggttccagcaggggctgcagccctgcctgggggtgcgaggagagtggctggcagcacccgcccccccgtctgatgcacacacagagtggggcaagtttccatcgggctctagcatcttctcctaccgtcactgttagggtggtgtgggccccggcaccctgggaggtgtttacagtcacactgaccctgagcattggctgagggtcttggaaagtcactgtttctcccttagtctcttccactgtcacatggggatcccacctcgtgtgcggacagtgccggcccccggcagataccctcccttgcccatgccatacctgatagtcaaaggtccctggctgctccctcaggtctttgggggcacgaaggtcctctaagctcttggcctggcccagtggctgcagtgcggcctccatgtccaggttgctgaagacgtcttccagaaggtcgatgctggcagcccggtcagggggagctgggacagggcctgtggacttccgcacttgctgctctggactctctgcctcgtcgccttccgcgctgtctgactccctgagtgtccgatacggctgcggcctgtgggggacagagcaggctgcactctcccacccaggccttcaggggaggagcaagcggactccagcccaagcacattgagggcttgaggggtgcacgcaggggcctgcgggacaggagagtgtcccggggtctccgtgagggcaggagtctgggaggctgcgagggtgcaagctgggcatgccgatgggcctggggctgtgaaccagggcaactcgctttggctctcacttgcactcaggggacccatttagtgccccccaaactacaggtcctttcataaaactggctactgggcttgtgagccattcagacaaggtgtgaggaacagacaggactggaagggggctcacaggccagcagtcatgctcctcttgctcccgccctgctctgctgtttgtttggtggcctaggcacagccacagtcaggttctgtgaacagcccatggggaactgggctggggaagctctccaggggagctgtctgggcctaagcttgccctgctaaccttggttccacctctggtcatgctatttcttgctgtgggacctttggcaggtcacttaactctctgagcctcaggtgctcaggtggtggtggtggttacatgagcaaatgcggtgcccggcacacagcagacacgcacgggttggttacagcatccatcgcccaccagtgagcacggctgtcacacaggctcttctgctagcagctttctgtacttttacacattcaaaaccttgcagtcattggctgggcacggtggctcacgcctgtaatcccagcactttgggaggccgaggcgggcggatcacttgagttcaggagttcgagacca

SEQ ID NO: 17969 - DNA, 43173 bp, Homo sapiens
ctactccgtgactcaagaaagacagcctggctttcctcagaacttgcatgtcagccgggtgcaatggctcacgcctggaatcccagcacttcgggaggccaaggcaggaggactgtttgagtccaggagttcccaaggagcctggacaacatagggaggccacacctctctctctctttttttttaaagggcctgagaggtttgtttttgtgcaacaaaaaacaaaaaaaccagttctaaatcaaaacacagcctttctctgaaacctttctagaaatgcagtcttcagttttctgttgtctcatttagcaacaagcaggactaaaacatagagacacaagacacagaagatgcactttcttcaggagttagttattacagaccgaaattcaggtcgttcaatggaaaagatccatgccttcacaacattctcctctacacactacaggaggaaaatgataaaaacaaagtaacaaacagaaacaacaggccagctgaggcccaaaaagtgtaagtgacaggactcctaaggtgtttagacgtagagggagagtgagcaaaaccaaaaaccaaacacgaaaccaaacctttcaaacttgggtgagaattggtcctttcacataagattctttggcaaagtatacaccaccccacctatacaaaaactgagactttattttgaaacaccaagtcaaatgtattgcctgcttgatcagacatcagtaatttcacatttgcttttcttagatttctatcccatttgcttccaatagatctgaggcagctcatgcttcagactctgtgagaggccagaagcccacctgtgcgtggagagatgatcacaagtaagtgaatcaactgattccacatatcccctggtggggcagcacctccagagatgcccctggaatttgcgatgtctcattccaaggaggaaccagtgactgtcattttggggtaagcactcctagttctcagggtttcaagacagacacctaaggcacctacaaacattgttcataatatctagtgattgttttataagacatatcactgtgtacaaggtgttgcaaagtaattccgcctttttaagtaaaaataatgaggcagcagatatcagacagccaaatctccaggaaaagagtagtaagaagctttagctgtaaggtatcatattttattaaaccaaagacctctgagagttcaggtgggactcttgtttctagtcaagacacagtacaagaactgtattaactttctgcctgaaataaccacaaaatcaggcaaaatatacgaagcaacagttttcgaagcactgagtactgggctatgaaagacagtgaatctcagaaagatgggagacaaacaggccccaactgctcagcttcctgtgtgaagagcttccaggttgtggtgtgggggccctgagtagctgggactacaggcatgcaacaccccactaggctaatttttaaattttttgtagagatggggtttcaccatgttgcctaggctggtctcgaactcctgggctcaagcgatcaggccacctcagccccccaaagtgctgggattacaggtgtgagccactgagcccagactctcaatactgttaagaatttaattctcctacattgatctgtagattctatataccgtcaatcaaaatcttagcacactttcttatacaaattggccgattctaaaattcacatggaaacacaagggaccaagaatagccagaaacctgtgcaaatgtatgaagctggggggccaacacaccctgatttcacaactcactcctcctactcctacgtggtttttgacaaaggagcaaaggcaattcagtaggggaaaagagactgaaaaactggacatttgcagggaaaacactgactctagacttttctttgtatttttttgaaatggagtctcactctgttgctcaggctggagtacagtggcacaacctcggctcactgcaacctccgcctcccgggttcaagcgattctccggcctcagcctcccaagtagctgggattacaggtgcctgccaccacgcccggctaattttttgtacttttagtagagatggggtttcaccatgttggccaggctggtctcaaaatcctgacgctcaggcgatctacccaccttggcctcccaaagtgctgggattacaggcatgagccactgcacccgactctgactctagatttgtatttcacaatatatacaaaaattcactctacatagatcgtagacctagatgtaaaacctaaaactctaaaatgtctggaagaaagtataagagaaaactttgtgacctcagattaagcaagatttcttggatactaaaagcacaatccatagaagaacaaactgatacatgtgacttgaaaacttaaaacaattactcttcaaatggcacagttaagagaatcaaaagacaagttgaagactaggcagaaagtatttgcaaggcgaatatctgatacaggacttgtatccagaatacataataaactcaaatactcaataataagaaaataaccaacccaataaaaatgagcaaaatatttaaatagacacttcgtcaacgaagatacatagaatggcaagtaaatacaaagatgcttagcatcagagggaaatgcaaactaaaactacaatgacactccaccacacacccacaagcacagctaaagttacagactgaggacaccacacgctggtggcggagtggaactggagctcccatacactgctgggagagacgcacacgctggtggcggagtggaaccggagctcccatacactgctgggagagacgcaaaaggggcagtcacttgcaaaaacaagaaattccgtacaaagttaaacatacattttccatatgaccctgagaacttacttctagataaagaagtaagcagaactcacctgagaggagtaagaatatatgtccaaacaaagggttattcacaaatgtttacagcagctttatttaaaacaacccaaggccaggcgcggtggcttatgctggtaaacccagcactttgagagaccgaggtgggtggatcacctgaggtcaggagtttgagaccagcctgcccaacatggcgaaaccccgactctactaaaaatacaaaaattagccaggcgtggtggcaggtgcctgtaatcccagcgactcgggaggctgaggcaggagaatcgcttgaacctgcgaggtggaggttgcagtgagccaagatcgtgccatggcactccagcctgggccacaagagtgaaactccgtctcaaagaacaaacaaacaaaaaaccccaaacatggacacccaaatgtccattaactggtgaatggataaaacaactgtggtatacccattctactaggtaataaattacaatcacactgcgttgtgcatgaatctcaaaagcactgtcctaagtgaaagccagatacaaaagactatgaaatacatgactgcatttagataaggttctagaaatcgcaaaatatagtaacagaaagcaaatgggggaccgccaagggctaggagtcaggggagagggctgactgcaaaagtggtcatggcaatttcgggggtggtagcaatattctaccattctaccaagaaagattccatcttgaccgtggtgccggttacgtaactgcatgcatctgttaaaacttcctgaagtgcacattatatgtagactctatctcaaagctggtaagaaaacatcatccacttacacttcagacaaagaatggatgtatgtacaccaaactgtcaacagtagttttctttgggtggtaggagtataggtgattgaagtcttcttttttgtattttttataatttttacaatgcagtcacttgcatatccagaaaaaaagtttttttaattcaagccttttaatagaaataattgtatgacacatcgtgacctaaaatatagatattagactactgaatgaatgttactttacaaaaagaagacaccagaaaaaaagtcgcttataaataaaatatccaagtatggtaaaatgtacttttttgttacttcagaaacggaacaccatcactttgaattaaatgctaccaaatctgtttgaataccttaaaggcaaccactaatcacaaaacacaacagagaacaaaaccactttttctgaattttgaattttttcaaaatctgtttgaatatcttaaaggcaaccattaatcacaaaacacaacagagaaaagaccctcttattactgtggcaagtgacacagtcatgagttttacatataacgagaaaataatttgccgtatacttgcaaaatatgagtcacgtggctcctagaaacacacctccttctcttccgtaatgggataactttaaatatggttctaagcagcttaagcctgaaaacaaaaattccaccacggcaataaacaaaaccacttgttgcctctggggctcccggccctgcagtggaggcaaacgccctgcctttccgctccccggcgagagcctgcgaggcacccggagcggccgcccggccgcgtctgcgtcacgcggggcaggagcggcgtccccagccccggccgccgcctcacctggtagagctcctcgaggttgtacctgatggaggtgctgctctgcacggcccgcaccgcctcgtgcagcttccgccacgtgtcctgcgtgtagttgtcgggcagccgaggtctgtctgcagggcggagggagagcgggcggctcagggcgcgccgcgaagcgccccgcgtagccacccccgacccggccggcgccccggcgcccccgctcccggggcccgcacggatctcggggccttccccccaagtcgggcggggtctcgtggggtccccgcccggggcgcctggccctcgacccggccgccgcacccacctcggaagttcttgatgaccagcttcttggagccgcccgcgccccccggcttggcgggcgcggcggccagggccgcgggcttggtgaggccgttggtgcggcccacgagcgccgagaagctgcccttccgcggggcctcgtccgccatggctgggccggaaccgccgcgccccgccccgagcgccgccgcccgccgagctccgctccgcccgccccggtccgcgcggcctccgccccgtcctcctcgcgcgccccgccccgccccgcccgcgtgcccgagcccaaccgccgccgcgcccggctactcctgagggcttaggaacgcgcgccgggaatccctcctgagggatcggactccccctaagagattcggacaccccctcctggctcgagggcgcgcgccgggactcccgtcctgagggatcgggaccctcacccccggctccggggggcgcaccgagaccctgcccccagggctccgggcaccccctcctggctcggggatgcgtgccgcgggcacccctcctgaggggatcgggagccgggacaccctcctgagggccccggggcgcgcgcctcctgagggctcggcacccccaccccgggcgtgagaccacctcgagggctcaggggtgcgcgccgggacgtgccctaactcctgcaggctcgggagcgcgcggcggaggcaccttatgagagctcgggagcgcgcgccatgtccctccccctccccctcctcgggcgcgcgcgccccgaggccctggcccagccaggcgcggagggtcctccgcggcctggttttcacaaggggcagacgaagggtcagcgcagtgaaaggcagtttagccgtggggctgtcctcgccactggaccccaaacccctcagcccgggcgggcccgaacacacaatcagagccgctggcgtcccggctgagaggacggggccccggcagaaagaccccgggccccctcagcccgagcgcgtcgccgagccggtccccaggttctccctccggaaccaacctgcgcacccgcggcggggccgggggcgccaggacccagacggaccgagggccggaagtgacgccagctggcccgcttgaggcgtagggggtggcgctctccgttcggcggcgctcccatggcgcacattaccattaaccagtacctgcagcaggtgggtcctagccggggagcgcgcggcggcgtggttggccctcggcgtgttccgtgtgtcccctcctgccttggaccctcaggccttttcctttcccgcctcgccaccctttttccgttcgggtccccggcgggcagccgcgcgagccgaacagcggcggccgggactcgggaaggcggcccgagttctcccctgcagggccgccgtgggggccgggcggtgtccgtggatcgcggagtcgtcgcggtgtaagtagacgcggcggtcccaggtcgctgccctcacttgctggcacgtgtggccgcgctcccaggcggtccgaagggcctgcgggccacgccgagggcccgctgtgggcggtgctgtgtcggatggacgctgtttcccagcaggatgcgggatgaattcggggactccaggaggcgatggaggagtaagcgcgaggctgtggccgtgctgcaggccgggctcgtgcccctcgtcctcgctgtcgtttaacgcccttcactctccgagcacaatgcacacttcatatcgctcggtacatgcgtctgacagatgttgttcaacagcttgtaagtagcagaagcacagttaaaagatggacacttgtaaagattcaacgcatattctttccactaaactatgcctgtcttcagaaccagcactgtggtaacagggataggaaatatagggaatggatttttaaaatatttgaaggaaacattaccaagacgtggtgaataagaatgggtgggctgagggacacggaggagttaagaatgattcccaggcttgtaatctgggaaaaagatgaatagagtggatttggagggagaaataaagttttgggcatgttgagtttgaggtgtctgttgacaactgggtaaagatacgtacttgatagctgaaaagtctgacatgattgggcccagcagttgcttggttaattgagaaaactggttaaaacaggaatcacgaagaaatggatgtatgtttttaacttaaaacatgaaagtatacattcacttgccaattttttttttacaccacttacctcaagttctatacttgccaatcttttgatgtaagcccagggccttttctttaggctgtgtctgttttggcctaatcttwgcagacttaacattttccaatatmagtttatttaaagttaaacaaggatataggcatttaagaaccaatttgatacgattatctttagaattttcttaatcttttacaatttttcccccatacctaattatttttttaacaaactcaagtgagccttttaaaaacatacmacttagcttatagagaaacaactgtttccttttgcattcatatttcattgatgagcttaaaagtacataactaccataacaggttcgggtagcaaaaatagatttgagaacaaacacatctggatatgagaacacatacaacttagctggcaaaagcttgcgatatattagagtgaagcctacttgctgaaagtcgtcatcataccttgggcatcagctcatgtatttcagggagggattggagagagtcatttttccaattcaagtcagttaaagtgagactgataagcgagcttctactctatgtgtgtaaactgaagtttaaacagacagatttgggttaaagatacaaacctgagactccttcgtagtcacatgatgggaaagactgagaagggaaggggtgacccagggaacaagtagagagagtagacaggggctgggcccaggatggacttctatggagatgtgcatgcctacatctccgcaaagggcagtgtagccactggggtgagacagcaaaaagtccgcttcctcctaattctgatggataaaaatatttctggttgaactggcatgttacctaagttttatgtattaacagattcttgaatattttaagaaaataggtgcctcttcgatacagaatggcaaccggttatacatggtaacacatgtttgatttgttgtataggaacataagtgccaatgtcactgtatctctttgggaataaaaccatcatttgcacattcatcaaagctaggaagttgggggaaatcattgactcctcctttagtctcagcaaatagtcctttacctaattggatgtatctccgaagtctctcagatccatcccttctttatctgttgccacatgctccccagccaggacgccctgctgcaggtactggttgatggtttcctttactttgccctttccaagtgagacacagcaaagagaccatagactttaaagacaataagacttcagcccaaatcctggcatttttactaattctgggaccatgacaagttatctaacttctgtgactctccatctctaaacaggcttcacataagttgtgagaattaaaaagaccatgaattcacagtaaatgcatttacttagtaaatgatagttctggtattttattgaagaagagttgagcatctgcctctgttactaaaacttcattgactctctgtttcctccagggaaagttccaaatgctttagcacatcatctggtccatgtttacctgttaacttggcatcaccagtctgaaggtttatttcacttatgytgaatgcaccattgccccaccgaagtactcataacttaaaatataccatttaaccattttaaagtacacaattaagtacattcacaatattgcacaaccatcaccattatccagaattttttgtcaccccaaatggaaatgtcataagcattaagcagtcactccctggtcctccctccygagcrcttgtcaaccgctaatgtgctctctgtctgtatggatttgctgactctggtgatttcagtatgtggcttttgtgtgtctttcccttgcatcatgttttcagggttcatctgtgttggaacatgtgtcagtgtgtcgttcttttttatggctaatgatattccattgtatggagtattttgtttatccattcatcagttgatggaccacttcagttgtttcctctttttggctattgtgctgctgctgtgaacattcttgcgcaggttttgtattctttttggcatatacctaagagtggaattgctgagtcatatggtaattctgtgtttaacttgttaaagaaatgccaaagcagctagctgcatcattttacattttcaccagcaatgtatgagggttgcaatttcttcactttcttgtcaatgcttgtttttttccattctttttattatggccrtcctgctgggtgcggagtggtatcttcttgtggcaccccatgatctttcttgtcccaaagattttcttcattatgttccttttgccaagaacacctctcttttttacaggtgtagtgaacatctttatttagggaatcagctttgagttagatactttactccttaatcttcagtagttcttcatattgtctttcaagagtttatggaattggaaagtttgactattcagaagtgacttcagaggttcatgacctgtaatgattttgaatttttaaaagagttatgagttccaagagtagatggtgcctcctgtggaccagactggagggcgtgaggggcatgcagcaaccacaaggaagtcttcctggggccagagccagggagcatcccctggtgagccaggcctgggggtgccgctcagaaggtgctcacttggagtctggttgtgtggtcccattgagggctgaaggctctgcagcatgagctgttaagagttggccaggtggctgggctgctaggggtcctgtgtccactgcggcgccagtcgcacctttagggcttgcaagtaccgtccgttgccatccctgcttttcctcttcacatccccagtcttctcacagtttagtcattgaggcaggggcattgataggaccacccctgggacacattcatgcctgccaagcaagctggggccctccttgggctcaaggccctgtggcactgagccctcctctggtcaggtcacccgtgggacactgggtgcagcccaggtaggtgtggccaagcagagcccaggatgtggcgacatcaccctgcatatgtgcagggaccaccctgggaggtcacaggcaaaggagggctaccagtgagtgcccccagcaggggtctccgcctctccttggagggccccggtgtctgtactccagggtttgatcccttcgtgaccactgtgtccccagtgtgtttagtcattgaagtatgcttccattccacagtgcttgctccaagtctgggactctcagctttcagtcactcataggttccttctgcagagagctctggaggccttggcaacatcagaacatcatgctcaagtgtgacctgtcaccagagtactgatgttaaccagaacactcctcttctcaggctcctggggctgggcccagtgcaaggccctgggtggtgcgagagatcgcacagtgcggggcctggagtgcctggaaccataagcaggggtggctgtggggaactcttagcttgaacctcctgtttgtgtggaaccaaagagagcacggcttggccagcaggctccagaaccgctttctagccagaagccccttagttgagcaaggttggagtctgttggggctcctgtggctaggcctgcccacatggcacagggagggccactttggaaggcatatcctctctggggctaaactgactaatactggttttcttgggggacttgcagaccaagacctgggtgggatcggttgttttgccttccatcccagggccaactactgatgggagggcaaacggggaagacgcagtgtgcctgcctggccaaggcagttgccaccctcatccttgagggcgctgttccattgcacctggtcagatggtctcgagggagccagaggaggcccctttggagctgggcaccagtgagttcttgcagggcgtgggcaggggacaccggaaagcctcctgcagaggatgggcagataccagtgttgtcttcttggggccatcttcagcttcttgatgatgattggcaaatgcagtgttgtaaattgcaaaatactgatctgtagcatggtgattttaaagaggaaacctaaccctttcccctaaacagctgaggatcttagtatctgtctgtctaccttttagatgaaatccctaaacctgtggccagggctatgaagagaaacttagtttccataatacttgggcccaaatcrtcttgcacccatttgtgactttgaaaatgtcaggagctaggctatgatgtgacgttgagcagcagcttgtgaccttgcatggactggggcaggagggctgcctctgaatggctgtagttttcctatgaaggcagaaaacctgcaagtcttcagatggcttcagctgaagataaagttaagttcctgcttacacctccaacccaaatcccatgggactctcccttctcctgctctgtgccagtgctgctctttctcactgacgactgtggtcccggcgacaccgccctacccactgcactcacaagcagttcaggattagggccctagtgccaccaacaacattctactcagtgatgttgaaattcaggattttttttgttttgtttttggcagtctttttgtccttagaataaggacagtcaaattccacaaactactgttttcaaaggttactcatataggtatgtattttctatttgtttcaattttaaggtttgtctttctattttatttcttgaatggggttgtaagtaacttatatttaaaggtgtgctcagaaactttccttctctctctcacctcattccacccccctctctagaaagataatcatttgcattagattctgccttctccatcctgtatttccttttgggatgtacatgtgacacacacacagacataaacacacatatttttcttgtttccyttcattcttatacaagacgcagcattctatacatactcttttacaacttgcttttttcacttaactgtatcttcctagaaattattgcatgtaaattcctagagatcttcctcattttcaaaaaatggttgcatagtgtgccttaaaatagatgtttcacagagtattcagcctgtctctatggatggatatttagtttgtgtccaatattttgtgattacatgtagccgagtacaaataccttctgtttctagttgtaagttcctggcagtgtgattactgtttcaaaatgtaaatgcatgtgtagttgtatggaatagtcaggggggaaattccttatcatggaagttagtcttcaggaaggtggtgtcagcctccctgtcataccctgagttgaacaatggggtagtaggagttgggctccagtgtgttgaactggtggcatgtgcctccctttcttctgggtatggacacctgggcacaggattactgggtcagagagtaggcgtttgcttgctttagtagaataccaattttcttctaaaaatttaccccaagttaccccatcaccaatgtgtgagccttctagttgcttcaggctcctggcaacacttggtgtcatcagccttcctagttgtaagtactcttgtgggtgtgtagagggatctcatctgcttgtgcttttttgccatttgcacatgcatgttatgacatccccggtcagtcttgtgttagcataaaatgtaaatatttaattttatcatagttaaattatactgtatctaaagctttgtgcttgccttttttcttagttagaatttttatgtcctttttttttttttttttttgagacggagtcttgctctgtcgcccaggctggagtgcagtggcgcgatttctgctcactgcatgcaagctccgcctcctgggttcgcgccattctcctccctcagcctcccgagtacctgggactacrgatgcccaccaccacacccggctaatttttttgtatttttagtacagatggggtttcattgcgttagccaggagggtctcgatcttctgacctcatgatctgcccgcctcggcctcccaaagtgctgggattacaggcgtgagccaccgtgaccggcaatttttttgtaaatataatttaaaagcatatttggttttctagttataaaatgtctgttgtggcaggcgctagatagggcaaaaggctcccgggtctcctagtctccacccgacgttctgcgcagtcagctggtgtggtatggtacaggccctgcattctttcctgtgcctgcatgttgtacgtaatttttctcttcttttttctcccaaatcaagttatacagttttcctgcagttaactttttttttcatttaatcatcatattgtggacattttctcatsttactacatacagatctattttattctttttaacagcagccgagtatcgcattgtatgaatgtgacatctatttagctatttccattttccttttattttatattaaggttgagtggaagctttttgaattttggatatatgtggtttttaaactgatttctttttcataagctgtatatttggattttcaaacatatattagtgtgattgagtaaaattagaataattcatcttcatgaagagctacatgataaaccactgacttatttttatttgcttaacctgtttttttgcttcaggaacatctgtttttgtttttttggtctgttttaaagagacgggtcttgctatgttgtccaggatggtctcgaactcctggctcaagcagtccttcctcagcctcacaaagtgctgggattacaggcctgagccagccaggaacaacctattttgaaatgaaattattgtttacgattgcgccactgcagtccgcagtccgacctgggcgacagagcgagactccgtctcaaaaaaaaaaaaaaaaaaaaagaaattattgtttacccactgcagagagtagtgaccatctgttacwttttgattgttctgtcttctttcaaagtaggggaaaatgaattttcccctgtgtggcattcagtgtattgttgtaggttctattcgaacagaatattttattttctacttaggtttccctttcaaatgtttcaggtgtacgaagccatcgacagcagagatggagcatcttgtgcagagttggtgtcttttaaacatcctcatgttgcaaacccacgacttcaagtaggtgaaagagctgtgcacacagrtgtctgcagacaattacagggtaaccactttcctaagagaagcgtagagtttgagtaagaagaaaactaatattgtcactcttayttgaaaattttaaagtttctttatgatttrtgtaatttcaatccatttgtggagcactgactatgtacgyacactgtggtgatgtggacctcctgcccttgtgtttgattcctagacagctctctgaggtttagagaagttagatggtggagaggcggtggagcttagattctgtctaggcctgtgcgtccccaaagccccatagacgtcatgtaccacaggtgtctcccatttaagttgttagtcagaaaggctggcaagccaaggcccagcctggggttgtacatggagtttccatgtcatctgtggcgtagatgatgttgaggcagtattttctrtagaaaatcttgtggacatttggtaaagccctgtttcctcattgacaccctttatcatattggagtgtgttcctactggaagcagcatttttcttttggaagaaaaatgggcttatctattggtgattatgtttggcggtgtacagacttgcaactcagaccaggtaaatcagtctctgaagtagcagcaggcctgtttttgtttttctaataaagttacctaggtgattctatgtgtagacagtgttgaaaaccattgctctaagtaggagttagtgctagagactcgatgagactcaggcttgccttggccagaacaccccatggctggtgccctgtgctttgtattgtatgacatgagaggacacacactgtcctgtttgcaatctgagacagatcccttcattgtaaaattccccagtaaactttctttcggtggtttcattcaccagggactgtagaatggtgatttttctgatactgtcattcttctctctcaccatatcagcatgggctcattgcttttgtaaacaaaaccaaacaaaacaaaaaaacgcagtgtgcttataatccattgtgtgttagtctgggttctccagagaaacagagccagtgggatatatcaatatttatagagatttagtatgaggaactgggtcctgtgattgtagaggtcaagaaatcccacacaaggagtgaattctttcttcctcgacctcttgttctattcaagccctcatcagattggccattgcccgtccacactgaggagggccatctactttcctgagtctactagtgcaactgccagtctcatccagaaacaccctcacagacactcccagaaataacattgtctggggactccacagctagtcaagttggcaaaattaaccatcacctgttgagatgttcagattatctaaaatttgactgttaggaggaaaggaaaacttagaaagaaatgtcagctagactagcccaggagatgagactggtggtctcagcaggaagccgagaagaacgagtcctaacatagcaccatctgtaactcattagacctcacttactaaacctatgacagttacttaacaagtatttcttgactgactggtcaagaatactaatatactgaaatgtatrtgaaagtgcctagaatattttctgacttgcagaaggcgagaccaaattatattcatgggcttctttttcccctgaaatattgataaatatttgttgaagtaatgaaccatttatttatttatttatttatgagacagagtctccctctgtcacccaggctgtagtgcagtggcacgatcttggcttactacaacctcccccacccatgttcaagcgattctcatgcctcagcctcctgagtagctgggattaccagcgtgtaccaccacatccagctaatttttgtaattttttttgtagagacgggctttcaccatgttggccaggctggtcttgaacttctagcctcaagtgatctgcccacctygccctcccaaagtgctgggattacaggcatgagccactgtgctcacggcctgaaccttttatttagagtggtaaatataaagtgttactgtgaactgtaaagcataaattctcttgaaacagaggtttaaatctctttctatatgttgcattctttctgtgcctattaattttacttttgctatttttcttttttaaaatcagatggcctctccagaggagaagtgtcaacaagtcttggaacccccttatgatgaaatgtttgcagctcatttaaggtaatctgttggggaggaagaaaaacacacacatctggaaattgctgaattaactggggattttatcttgcattatcttrtgcttgaagcagtgaataactgactttgaaaaagtgggaaaatgcatttgtaacttcagtttggtaaagcctgtggaaattgtaaacatcagttatataatactatttttaacatcacacagtatttagcagagtgcctgctcagtggtctttttagtagagtttggagccgaactgttcacttacccttttcgtggaaatatgtctgtttttgaagctctttacgttactgggaaagaaattagagttgagcaaagcaaacaatgctactttttatgtacacttcatatctactgttttatctctaaaggatcagttcaggcagaagattgtgtccttatagccatgtgagatttgattactgtctttcagagcagcctgggctacaggaccagtgtggggtctgtgagcaggaatgttctgtgaaccccacagggtctttggaagagttggggcaccaccgtgttccttgtagtacaaagcacctgtgatttcctagctctgtgcagtgtgcgataggttccagatttggcgatgaactaacactgacrttacccagctgggaatctagtttgaatgtcattgtcagcccctgctagagtggaagggtcatactatgttatcaacatgtgttactcataaacctgctggtgctaggtccttctgggacttgaaagagtagtctccaagcttactgtgggacttcctcttatcctcacctgtttgtgttcagccatttgtgtgtttcttccttcactcctttcatcccaggaccactgggacctgtgcaaygaagtgagctgtgtgggctgcataactagtgctaggtttttattgtgtgacagcatgtttctgtttctcctccaggtgcacttaygcagtggggaatcatgacttcatagaggcatacaagtgccagaccgtgatagtccaatatcctttgtcgttcatggcagctgtcccgcatagaacacatgcagtggattacttgggacttgagacccggaaacactgggccagttgctcatttctgcagttagaaaggaatgacagtgttttggaacagaagctcrtttcagctctttcacttgggtacttaaatttagcayggatctgaagactcgtgcagtacttagtaaggaagaacactggttaggaagaaggatcttactctgctgagaagaagaatgctttgttgcctttagtaaggtagtaagtatatttacagggactggttaagtcctgttggtgaaataccagaaatccagaattcaggcagagatggacaagagtggcctcagatgtacatcggcattgaattgtggcagctgaagaccttaaatcaaaccaattcatacttcagtcatttaaagggtatctttagttacggcctgagtcagtgagtgtgctaaggatttgtatgtatctctagattttgtcttttcgttttaaccaccttgtttaaatatacacagaagagagttgggctatttgctcacagcctccttagaattcaagaattctagagttgataaaatcagccttatgctacagattctaaagcacttaaatataactcatgatcatctgggctcagagaaaccaaataaaatgtcagaaagggctgattttaaaaaatcttgtaagtcttttttatttaggagacagtgtgtatgaaataagtgtatttagtatacttgagcctaatgagatacagatatttgtaatgtgagcttataccttttttccttcaagaacttactattgttgcaacataaatctgctcaagggtgakctacattccttaaaatttagattcttattctttacttttatcgtacgtagcattatttgaactttgtatgccatatcttccttaatacagtacatcattcttgcgagcattccaggcccacaaagaagaaaactggtaagtgtgaacagaaacagctgaattagcaaatggcaatttttttagcagaatctttttacaaatttgctttaaataaatgtgtattgtattttccatgtggatatttggtaatcagtgtgttgacatatggtaatatctacacagatgagtggagtcacaaatctagtaaactgaaatggtagatcagccacattgtttgcagtgtgtctatgtcaatatagtattatttttatttcagatgtccatttccctagatatttattaaatactgttttttccttcagttgtcaattttgaacttttggttttaaaccttagataaaagaggtagaccaactacrgttcatttggggtgttctaatacataataatggtggtatttttaaatgccttgccaaactaaattttatgatttattaacaaactataggttaatactgaaatttgtttatactgaaataaccaaaggccttttgcaaacaaacccgcccttttatctttttttttttttgagaaggagtcttgctcagtcgccgaggctggagtgcagtggcgcagtmttggctcactgcagcctctgcctcccgccacccttttatcttttaacgtgaaaacttgcacatgaaaacagtccagttttgccagttggctgtaaaagttgttttgtgacattttgtgtattacatattctggttcctgttaggaaatctgatcaaaccacttcttttttagtggtgctgtttggatactggtgggaagctgaggggaggaggatatcctgggagcccagaactgaagcagggctgaggtctctgacagggttggggacaggggtgtggagcaccgcattgtggggccccaggatgatcaggaagtctgaggcctgcagcctgcctggacagaaggtgaggaagcagacaactgtcagagttttggataagtgcggactccattctggatagtagccctgggtgtccgtgttcttcccacctctggggatggaatcttggcccacgtagcccctcacacttgtttacttttttgccctgcagggctctgcctgtcatgtatgcagtagcgcttgaccttcgagtgtttgccaataatgtaagtttaatttgctgtcattattattttaaaactaaaacttggtgactatctgttgtttaatttcatgtcattcttcccagaagttttgaggagcaaattggagttgagatgtgtctggtatagggagcaaaagaaagatattgactattctttctgggttaacaccaacagatttatataaacatttgctcagatttccacactrttcatatagagggagaggttccattttgtggttaaccatttatggtatgtgttatttttatgamgtgagtggaacaacaacaaatgagcttattctgcatctcttctacctttaagatgtggcctgctcccccaccaaaaagaattcagcttcatatagatttgggcagtaggagggggcttccctggggtgaagggagatcctgggttttatggaggcgacgtccccatggggacccacggaagtccccattatggagcagcatttgtcaaccttttggttttaggacgacccctttacagttttagaaatgattgttgacttcagttccagtcaggatgcaatggatttcaccctattgtgcctgctagaaacagttaaaaccctgggagttgtcaggccggcatggctatgggaggtggagagaagagggggatggggctcagagtcacgtgtagggagtctccaggtttcctttttgtctcctgtctgtcctggactgggcgcgttagaaacctgaagcctttcaccatcaggcagagacaaaaagccccaaggaaaccaggaggctgggaagacagtccaatccagcaagacagaactctgaccgtcactgcctcactccagtgccaggcgcaaagaagtcagcaggtccgtcccaccccatctgcaaagtggtgcggactgggggtggcccaggacctccaccctgggctagcagtaatgaggagctagtccccctccccaccaggtggatgtcagaggctaagcaggggacctagacctccccgactcagtggctaaggggatgcacctgtttctctgcttgcatggtgaggcctgctaaacaagataaataaagtccatagtctcgtcaggtagtgcctcaaatgtccgggatctaatcgacactgattaccaggaaaatctcaactttcagagatttcaaatgagaaaaaacattcagcagaagacaccaaggctgagattgtacaaatgttggaattatgtgacaagagttttaaacagccctcttgattcagcaagcaatttagaacatgcttgaaacaaatgaaaacatttaaagtctcaacaaggaaataggcgatataaagaagaaccaaatggaaattttagaactgaaaagtatactgaagacctcagaaagcttttatttttgttatatctatttatatttactgtattagaaattttaattagaaaagattttaaaatattcattttaaagcaacaataataaaccttttacatgtaacataactgactttttaaataaaaaataactatatttccaaaacaaaatactaagaaaagtagtgtcacatcacttttgacctctttgatgtctagttcagcagaggcaatctggtccccttgcctgcttctgcacttactctgttgcagtacactgttttgagtaaagtgtttctctgcctgatggtgaaaggctacatcacaaagttgtagatggaaaagagaggaatattctcataggctttccagaccattgagataattctttgactctatataggaaaactccaagaggcagttttttttttttaaaaaggttagttacaatgtggcttctgaagtgtaccaataaactttttctacctttacactgaaatccactggtctgcctaaagcactgaatggatttcgtaatatcttgtgttagtcatgtcttagtccatttgggctgctataagaaaatactataaactgggttggcttgtaaccaacaagcatttatgtctcatagttctggaggcagggaggtccagatcaagtcagggaggtccagatcaagtcaggcagggaggtccagatcaagttgagtttctgatgaagagggccgcttcctggctcatagcatcttgctgtgtctgcacatggtagatggggcaagggatctctctttcccattcatgacagcttcaccttcatgacctcatcaccttccaaaggcctctcttccaaacaccgtcactttgagggttaggatttcagcatgagttttggaggggacacaagcattcagaccatagcagaccatttggagtatattagcttactgagccatgcagcacctcccaagtgctgatataccactgttaaaaacccaacccccaaacccctaccttccttaacatctccaggggcstcatcagaaaagccttggagtaaggaaaagctgctaagctcacagtagttcataaaagttttccagaattctggtttttcttgaaagcacaaatgttgtcattggcaacgagtaccatcagttgtttgcctggaagtgacagatttgttctattcgttttggagaatatggtcagccagatgcccaagcctgggtagctgtgtctgcctgtcagttttctgttctgcaagaagcagctagttcagctcacagctcagacagctgcccagagcttttctgtaaacagccatgagacacccgtgtgcaacagaagtgctgtatgcttctcatttcatcacaaagaatataaaaaacgtgtgctcaaggaccaagatttaaraaaattcatatttactgcattatcaaggacattttatttatttatttagagatggtcttgctctgtcacccaagctgaagtgcaatggtgcagtcatagctcactgcagccttgagttcctgggctgaagcctcccacctcagcctcctgagtagctgggactacaggtctacgccatgataccgggctaatttaaaattttttaattaagacagagtcttgccatattgcccaggctggtctcaaactcctgggctcaagtgattctcccacctcagcctcccgaaagtgctgggattacaggtgtgaaccactgtgcttggctcatcgaggacattttttaaaggaaactaattttactggtttgttgattgactgattgattgcagagtgtctggtgtttaagaacgtggtgattacttgcgtagtttggtgccggtgggagcactccagcattttacctattgctgtttttgcaccatcagtgcaaacgttaatacagtaaaaaaagaccataatggcttagtgttgttgtgaatatagtttgagctgtgggtcatctgcaagcctgttgcaggcctcgggtttgtggagaacacaagtggcagaaacagactctttcttctttaaccaaggccatcctcccaaatgcgagggaaaagtcaaactcagtgatgactttaatatttgttaaacgtttttatttcaagtgttttgactagccaacttcagggactgaagagagagcttagttgcttagtaacatatgcagtgcaggtttgaaaaattggtgactgacttaacttgaaataattgaagaaagatttggtttgtgaaagaattggagtaatacagacttctcaatttttaaaaatattatagtacatgctagctgatttctccaggatctttcgggactttgagtcttaattgtacccattttttgcttcaagaaataaatgttttggctgggcacaatggctcatgcctgtaatcccaacacttccggaggccaggatgggaggattacttggagtcagaagttcaggaccagccagagcaacaaagtgagaccctgtctctacaaaaaaaaaagaaaaaaatattaaaataaattttaaaaaaacaaaacccaaaactagccaggcatggtagtacctggttccatggttccagctcctcaggaggctgagatgggaagatcagtggagcccaggaggttgaggctgcagtgaggtgtgattgtgccactgcagtccagcctggacgacacagcaagatcttgcttcggaaaaatgaaataaaagttcttatattttattaggcagatcaacagttggtaaagaaaggaaaaagcaaagttggkgacatgttggaaaaagcagcagagttactgatgagctgtttccgggtctgtgccagcgacacgtgagtaaggacttgargaccgaccaccagacgctgttggtggtgttttcattgcagcgttcaccctttctggcctgtgtttattgttgacacatatttcatttctacacatgctataatcccacarccrttgttatttttgctttaaaaagttgattgttttgtaaaggaaataagagctgagggaaaaaagagtcttcatttgcccacatttgaccatgcctggagctcctctctgcaggaaccagtttccgtctagtgccatttccctttcctgaggcactttcttccacatttgcgtttggtgagggtctgagggcagtgaatcttttaagctttcatttttctgaaactctcgttattttttttaagaaatgttctctctttaccagtgaagaagcagcactgatcaccttcatttttaaggctccatttgctacatggagtctcgtgggttgacagttttttccttttggcactttaaaaatgtcattccatctggtttcctttgcttctgatgagtccttgccatcgttccctgtatagaatgggtctttttcctctggctatgattttctctttatcattggcattcagtaatttggctctgatgtgcatagttggtttttttttttttttttaatttcttctgtttagggttcattgggcttcctgtatttgtaagttgatgtttttaaaaatttaatgttttacattctttaactacttttggccccattttttctcttctctttctgggatttcaactgcatgtgtgttaagtgcatgatattatccctcacaggccgctgttagtctttgtttattttttaatcttttttttttttgagacagactcttgctctgtcgcccaggctggagtgcagtggtgccatctcagctcactgcaacctccgcctcctgggttcaagccattctcctgcctcagcctcctgaatagctgggattacaggcgcatgccaccacgtccggctactttttgtatttttagtagagatggggtttcaccatgttggccaggcttgtcttgaatttctgacctcaggtgatccaccctcctcggcctcccaaagtgctgggattataggcgtgagccactgcacctgacctcaatccttttttttttttttcctctccttcattttaggtaatttgtattgacctgcttacaagttgactgatcttttctgccattatttatttttaaattctcaactttccgtctgattctgctttagaatttccattttttcttctaaaactcccatctcttcaccaattatataatcacatttatttatgagatttaggaaattttaaagcaaagaaagattatcaaaggtatccatatataaataaacaaaaaactattgttcccagagagtagttgttttagtcctcttgtgttgctataaaggaatacctgaggctggggaatgtaagaaaaggggaatacctgaggctggggaatgtaagaaaagaggggaatacctgaggctggggaatgtaagaaaagaggggaatacctgaggctggggaatgtaagaaaagaggtttatttggctcacagttctgcaggttgcacaagaagcatggtgctcgtatctgcttctggtgaggcctcaggctgcttccactcatgctggaagacaaagaggagcccactacatggcaagagaggaggcaggagatagaaggggaggcgccaggctcttccacaaccagctgtctgggaaygctcacaggagctcagagcgagaactcattcattatggcaaggacagcaccaagccattcatgaggggtccacccccatgacccaaaaacctcccattaggttcctcctccaacaacggggatcaggttttaacatgaggcttgatgtggccaaaaaaccacatccaaaccatagcagtagcccagcttctcttttcactcattgtgtttgttgccaataaactctgtagcctcaaaagatgggaacttttccttttgggtgttgtggatcccatccatgaaaccgaaagtaagtgttgagcagagcaagctgtatgtaaaggccaaggaatgaagaagcaggagtgtggctcacaaatcaacttctctactcctgaggggtgaggggattgaaatagagggtttcttgaatgaaggggttggacattgaaagcaaggggaagaatattcatggcttttctggaaatggacggtgaacttctgggagctgaagcactgccatctttttgtccttttacggcgtcttcccgtcattgtcatggtgattgtcagccgctgtggcactggtgggagtgtcacggagcatgcaaatgaggttgtaatgaagttggaggccctgcaaaggccaggtggacttccacttagcatcctgctggtcttagctggtttaaccaagaggggagcctctgacctcaggcatcctattgctgaagataggcagagtttgagttgtgcaactgttcagccaagcctacaagatgtatagtgctgtgggggtaacatggcctccctacccagcctcgcttcagaactttcgtaccaaggctggactgtagaaaagtccttcctatgccatggcactttcccactgaggcctcccatgggtgccgtttcctttgctggaaggttctcctcgactcctggcagtctatactcatttaaaggtttccgccttctctaaagcctctcactgctggacttcacggtggatcagatttcccttttataaacattcatagcagactgtacatttctttcactgcgtttaccaaacgatttgatggcgaagtgcgtcagggcgtgggccttctccatcactagcgttccttgcaccccaggagctcaatccgtgtttcctaaatgaatacttgacatttcgcttgatcgtatatttttgcacagcagtgatcttcacgacctttgattaggcagtggcttctcagatacgacaacaaaagcataagcaaccaaaggaaaaaattaattggacttcatcaaaattaaaaactttagacttcaaaggacattctcaaaaaagtaaaaaacaaccataacctagcaaataatacatctgataagggcctaatatccagaatatataaagaattattacaattcaacagtaaaaagacaatccaattcaaattctttaaaatgtttaaagaatttgaaaaatcttccaaacaaaatacgcaagtgaccagtaagtgcatgaaaagatgctcaaggtcattaatcaccagtgacttagtcaccaatgactaatgcatcagtcacttgaaatgcacatcagaacctctgagagctgccaggccacacccagtgggatgactgtaatcagaaagacgggcggcgccagtgaggatgcagggagactggagcctcgtacacatcgccaggggaacaaaaacagtgcagctgctgtgcggaaatgggaaggcagttcctgaaagtgggacgtagagctaccatgtgacccagcatttccaccctgaggggacactcagaagacagggcagatccccagtgacatctctttcccgttggggtttgcttttgtcacagtctccaatagaggtcatcattcctggtgccagaccagctacgatattaccatgcgtgtagcgttttacgtgagttacggagtacttgtgtgttttgtttggtttttccatagctctttgaagtcatagaacagtattattatttgtctccgttttcagatgaggaaaacgagaccttgagagacttttgtttgaggtcatgcacgtagggaatgataaaagtcatagacctgcttagagcagctcacaggcagttataaaacagggtttgatattttaaaattgtatttttacattattttaagtgtttctatatggacacattttggtctttaagagtaattttatgttctgtggcttgtaaaccacctgcttgttttctgtactgggcacttttgtatttttgtgccttgactttgagtgattttatcattttgttaacaccacagagtgtacttcgtaaaccgagatggcgtggcctgctacacacccccgctgtgtggcgcagcctgtgggtcctaggctgcgaggagcaagagctgcactaaatgctgtaggcagctggaacacagtgggaattatttgtgtgtctaaacagatctaaacacagaaaagatgcagtaaaaatacagtgtgagactccgtagggccccatctcacatgtggtcaagtgtgagactcygtagggccccatctcacatgtggtcaagtgtgagactccgtagggccccatctcacatgtggtcaagtgtgagactctrtagggccccatctcacatgtggtcaagtgtgagactctgtagggccccatctcacatgtggtcatctgtagttgaccgaaatgttgtgtaacatgtgactgtttccaggttaattgcagacagtggcacaccctcccctaggttcttcagtttctgttttttcagtcttttgaggtaaaatttgcatgcagtgaactacctacagtattatctgtctgcttgctgctgaggtataggacatgattgccaccccagaaacttccctcatccctcatgtggggcaggccctttcagctgtctggatttgttccactgtgggttgcttcctgcctgttcggtgacttcatgtaaatggaccaccacagtgtgtactttttgtgtctgccttggtgggactcatcctctttgtgtgttttactggtttgttttgtcgtactgatgagaagtatttttccatttttcttttctttttttstttttgttttttgagacggagtcacgctgtgtcacccaggctgaagtgcattggcccgggtttgagtgattctcctgcctcagcctcctgagtggctgggattacaggcacacaccaccatgccctatttttccatttttcaaaaacggtttataacaattaacttttacgcattgttgctgcaaatgaggcagtttttagctggtgccgcggaggaaggatgttactcaagtagttaattgggattttcctggtttgttttytcttttatttttacccatcaggtaagacatcttttttcataatgttattttgtttgatgaatatgacttgatatgaataagttgatatgaatatgacttgagctttgggacttacctcaagatattaatttgtttaggcagtttattttgtgatttataaatamaatttttatttcctatgtaacttaaaaaaaattatttccccatagccgtgctggtatagaggactctaagaagtggggcatgctgtttctggtgaaccagctgtttaaaatctacttcaaggtgtgcttctgtttgaatcctttctgtctttacaattttcgattgtcctggrcttcccacatatcatatatatatcagctagcctccctggcgttgcttgtgaaatgatcataaccgtattcctagtcctaatagcaaacatttgttgaatgcctactaggtgcaaggcactattctgaatgctttacaaatgtcttcctgttgacaatcagccctctgaggttagcgctcccagccccagaggaaacgaaggcccctgtgtgtgaagcagctgtcccagtgtggtggaattgggctttcagtgcaggcggtttcactccagagcgttttgtcttctgtggtcataattaactatggaaaagcaggcacgtagatggatagatggataaagaaaccattgccacataaagtcagtcaggtgaagagcagcccatcacgtgtcagcagctgggacttgtgccttctgtccagtgccttccactcctgtagagcaccccaccttcctgccggtgctgcataagcacaggctcctgcagggctgcgccccctggaacggcttcccagagcctccacaagcacgggctcctgcagggctgcgccccctgaaacggcttcgcagagcctccactagcacaggctcctgcagggctgtgccccctggaacggcttcgcagagcctccactagcacaggctcctgcagggctgtgccccctggaacggcttcccactgcagggctgcgccccctggaacagcttcccagagcctccaccagcatgggctcctgcagggctgcgcccccggaacggctttgcagagcctcccagggtgaatgccatctatgctggctgctctctgttttggttttattatataaataattgttatgatataataggttttgtaatttgcattttaaggagacatgcttagtaatttgttttgccacctgtttttgttgtttttaartattttaaatggattgttattcattatagatcaacaaactccatttatgtaaacccctaattagagcaattgacagctcaaacctgaaagacgattacagcactgcacagagagtaacatacaaatactacgttggacgcaaggctatgtttgacagcgattttaagcaaggtatgttgctaatctttttttcccagtattttaaataagacattgcattctgaacaactttgaataatatagtttcagagaacacaattactgtattttatttttaaatgtggaccaagttatatatacatatttgacactaaagctgattaaagggaaattatattgaagattcttaatccatactgggtctctgaagtgcatgctggagtctcacaggcattacagacatcgtttctgagttcactgagcatgactgttctcagaatagaatgtaaatcattgttttctttatttgctttttgaccctgtaatagatgctggttatgttgacataggaaatggagattaggacaacatttagttcagcgactgacttcatgacctacacatcccgcatggagatgacttagaagcaggggatatgcccttggacctggtgtcaaagctctcgtttaaacagcctcgtgcagtgtgtcgctaccacagagctcctgtttaaacagcctcgcacggcgtgtcgctgccacacctgacactattgtattagtttacgttggtaactttctcaagaacaggaaactagtcttctttttgtaatttttatcggctgtcacggcatcattcttggtgatctcttctcttgtgctcaaaccagactttaaactcttcttcagctgtttgtggagcacacagtcccaagtacatgaagcaacataactttaggcaatgcaagataaataatagccctttcataaggacgctctggctttttattctataggcttktatagaccatttcctttcacagtttttactctgtgggcttgtatggactgaccatttcctttcagtttttagtagatctagggcttttaaagaagggcttttcttatctgtctctttttttttctcttaatatgaagcataaaggtagagaagcttttaaattctatcctattggattttattaagatactgattttttttcttctgaggattcagtaagtggtatttttgaatacctaacatagccagaaattgttattaatattgatgcgacatagtcatagtttctgacatctttagagctaaaaagtttgtttaagtctgtatcatccaaccctttcgtttgactataaaagaaataggaagccattgagagtgtgatgctctgagattactgagtaattctgtgtccccaaaaagccagcgctggccatagatcttctgccttgtagctcgcagagattttgttttccattttactgctaggaattcctagagccctgattgtatttaagtggataaaatgtctgcagagattgtggtgattttctttcctgtgattttatattatttatgtaagaaagagtatttggagtatctcagttgttgtatgtatacttttattaatttattaatttcagagatttatacccctctacatatttttgactccaaccgaaatatattatttgatgcaaaatgacttaggttccctcaaagacagcagaaaaatctcagcttgcattaactattagaaaatgcattttttggccgggcgcggtggctcacgcctgtaatcccagcattttgggaggctgaggtgggtggatcacgaggtcaggagatcgagaccacggtgaaaccccgtctctactaaaaatacaaaaaattagctgggcaacggtggtgggtgcctgtagtcccagctactcgggaggctgaggcaggagaatgacgtgaacccgggaggcggagcttgcagtgagctgagatcgcgccactgcactccagcttggcgacagagcragactccatctcaaaaaagaaaaagaaaaaatgcattttttgtacatccaggagaatttgagattaccttgggcagtagcaaaggtacactttttagaggctagtttgcaaaagtcaaactggcagctggtgggatattgcagactctcagtgaatccttgttctttggtctcagccccacagggctcctcgtgggtcatggctttgtggtttggaagagacgctggccccacagcattcacgctcactgtgcaagactggatgttttttgtgccaatgtggccacatagtttaggagcagaggcagtgtgtggtctcagtgtggrttccctaggcctcgacccagaccccagggcctgctgcttctggtgacccattctgcataagggagggcctctgcagctctgagcatctctgttctcttatatttgggacttaatatcactgttcaggaagaacttacataaacaggaacatctcactttcctaattcttgacccaaactcagccttagtgaagcctcttctcttcacctagggagaatgtggaatcattgtccagaaacccctgacccttcagctttccagcctcaggacaaggctcagctcctgcctgcctgttctgagagttccttgttagcatgtgctgaactctttgcaggcctgtcgtgcagtttgtgggattaatcttgacaaatagaattacttttgtattttgaaatctattaaattcaaatctgttttttaatattgctctcaggmcagaattaatatgttgtgtgttagtaataataagttaattttttaaagcatgtggtcatttaaaatggaagatatatgatcactaattatatgttaagctggaggatggtgttttactaagttattttcattgtttaattatgggtgattaaaatgtattgtggaggtacatttttaaatatgtctttatatttttcatgaatgtagaaatcatctgagcagggtcagacttttaaaatgttatcataatggtttgccagctgaccttaggcaaatcagaatctctgtgaaagttattttcttcagttttcctctgttaagtaggacttcccaggcagttcctgttgaatttgggggtatggattttacttaaggaaagtcattgatcacagaaatgaaactgggatgatattttttgagataataaagggagggggcttttgccttttaaatcaggagacagtggtagaaaatggagcaggaaggggcctgaagcaggtgcgttggtctcatgcgtgctggctctgccttctttgcagctgaggagtacctgtcatttgcctttgagcattgtcaccgttctagtcagaagaacaaaaggatgattctgatctatttgcttccagtaaaaatgctattggtgagtgattattactccaygtttatagatcctggtgctttcacaaagttgacagctgataggtttttttaaaacctagcagacagtctgtagttgatcacagcctgagctgtgtatgagcacaccccaaaataaagaaggcgcatgcattgtgtgtggcccaaacccagagcttcatgccttacgcctccaggtccttctagaaaagctctccctgtgtcttgtttcccttaaaagtatttaactcaagagtttaacgttcatgtgacaaaataagtacgtatcatttgtattcctcccttaaaacctaagttaaaagcagtggattcaccaagaaagaaaaatgtcatttcaccctctctgtgggtatttcatttagttactaaaatgtatttttgatacttgaaataactggtaagttaattgactaatgagaaaagcattgcacacaggtggctaaagcttctgtagctctgaatggattgtgatggagaagcgctgctgtggccttgccctcctcacttctcaccccatttaactgacagccagtttcaaatgcttagctgattcttctggaagctacttccgtatgcctacatctcatgcttatactagcatttcttcagttatcactctcctgttatagaaattcgaagaaatgtgagaaggtcaagatcaaggtcacgtgtcatggaatgacaaaagtgtgttgtacccaggtgttctgatttctagacctgtgttgttttcctagtgtactatgatgtgtttaatccatggacattctaagaaactcaggttgcaattttcttaaaacttaattccttgatatgaatatttatcaaggacaattttgtcaaaaatgaaagcattttcattctggaaaattgactcttagggtcacatgcccactgtggagctcctgaaaaagtatcacctgatgcagtttgcggaagtaaccagagctgtgaggtagagtatgccatccttcctgtttggggttttaaaaatgcaagcctgatgagagttgacgtgcacgctctgtgagaaactcaccctccttctgacgcgcctcccccctcaccagcgagggcaacctgctgctgctgcacgaggcgctggcgaagcacgaggccttcttcattcgctgcggaatcttcctcatcctggagaagctgaagatcatcacctacaggaacctctttaagaaagtgtaagcatttccccggcacattgggctcccagtgtggctctcggcagagcagtcagacatccagggctgttgcagtctaagagagaaggccaccgtgtgggtggggtcgttatcttccttccattgtgtgggataaaatgaagcctccgcccactgcctcctggggaccctgcgcgagacacgtgagtagcacaagctgtgcctggacttgtgggggaggtaagcaggttctatgtgagaagacaacttgagaacatcagccctgagagccgcggtaccacatttcatcagagcacacaggactcgccactcactcccctcccttagtgctgaccaagtagccctcccagccacttctgcctgtcacaaaggcagatgcagagatcgtcattcctttcctcacacgtcttctgaggcctcgtcccagcaggatctcagttgtgtaaacttcaggcaaaggccaactttgtatagagctgtgggtagcacgtcacaaacagtagggaccctatttcgctgagtctgtgagacacagcccattgtcaggtgcttcctgatttcagggagattaaaatgtgaaaaaaaaaaccgaaccttaatgaaatacttagaaaataattaaaaattgtgtttgtactagtgactttttaaagattgaaaagtcaaattagatttaatagctctgagagtgtagtttagagtttatctaataggtgggaatttttttactcttttagaacaccggcttattaagaggtgccttttcttggctgtggagtattgcatcctgtcggtaaccacagtgcccttctcctcccctcttccaggtatttgttactgaaaacacaccagctgtctctggatgcttttctggttgccttgaagttcatgcaggtggaggacgtggacattgacgaagttcagtgtattctggctaacttgatatacatggtgtgtgagtcctggttttaatttaagcagctactcacagcaagattcagcccagaatytgaagcttcagtgtggtggtgttaaaattgttaaaaggccttctgctttttttttgatagaactaattttagcccaggaaataccattcaccagggccttaggagcatgaggggacggatactcttgtatgtttgcatattctttactggcggtacatccctcggtatctgtcgattctccaacccccctcggataccaaaatccacaggtgcttcagtcactgataggacgtagtatttgcatatgagctatgcacgtcctcctgtatactttaaattatctctaggttacttaaaatactcagtgcactgtagatagctgttgtactgtattgtttagggaatcacggcaagggaagagcgtctgtacgtgttcattacagatgcattttttttccccaaatattttcagtccacagttggttagattcatggatatgaaacccaccgtggatatagagggttgattgtatttatttttactcattgtcttcccgctgaactgaactgtgccgctcttggggaagaatgctaatgccaaattaattagatcaccyagcatctttgacatgactcagatccaaaaatgtaaacgcattcctccctttctgccccgcagggacacgtcaaaggctacatatcgcatcagcatcagaagctggtggtcagcaagcagaacccatttcctcccctgtccacggtgtgttgaaagtacacggagccccgaggacgggtgagcagttgtttctttccactttggttgtgctgatgagaccggtccggtactgcaacaaggctccctgaagccggaactcttggaggcgcttttcccagggatgctgaggctgagattttcagcacacccgagttaatctccttcatttgtaactaatttcagcctgatgaaaacctggaattcctttttcacagactcggctggttctggagtctttgtgagacttctttgaaggaggctttgcgtgaaggctgctcggctcacttttcctaagtgtggttcctgaaggctgtctttgtaactttttgtagttctttgtgtaaaaagcgtattctgaatttatacacatggcatgttcttcattatatcttccaggatacatctatttttatatattaaatttgaatgtgttatcaaaatgcttggttaacttaaggcacctttttaaaagcagaatttaatttgatttaaattttccagattttatagcttgcctgtatggatgctcctcaatttatgatggggttacatcccaataaacttattttatttgcctttgctttgttggttaaaaaaaaatttcttttaaaaaaccatcttaaattgaaaatacatttaatacacctgctactaaacattatggctcactctagccttccttaacatactcagaagcctccactcttaggcaaaatcaaacacaaagccgattttattttataataaagtgtagatgccgggcgtggtggctcacgcctgtaatcccagcactttcagaggccaaggcaggcagatcacctgagattgagagttggagaccagcctgaccaacatggagaaaccccgtctctactaaaaatacaaaattagccgggcgtggtggcgcatacctgtaattccagctactcaggaggctgaggcaggagaatcgcttgaacccgggaggcaaaggttgcagtgagccgagatcatgccattgcactccagcctgggcaacaagagcgaaactctgtctcaaaaaaataaataaataaaaataaaagtgtaaatacctcgtgtagcttaccgagtgctacactgagagtggaaactgaagggctgcgtggacgctgaggcatggctgcccctgagcgcgtcccttcggcaccacggcgaggttgacagtcgctaagttgggccactcacattgggctgttggggctgccatcacagaataccacaggcagcttaagcaacaggaatgtatttcctcacagttctagaggctggaggtctgactgagatggggttgccagcacggtcggcttctggggagggctctcttctgagttgcacacttaagaataaggtggtattccttgctgtgctagagatggtacagatagagatgactctctccctccttttttgagacaggacctcactctgtcacccaggctggagtgcggcagtgcagtcagtgcttactgcagcctcgacctccgagactcaagtgatcttccctcctcagcctcccaagtagctgggagcacaggtgcatgccaccacacccaactaatttttttattttttgtagagacagggtcttgctaatattgcacaggctggtctggaacgcctgggctaaagcaattcccccgcctcggcctcccaaagtgctgggtgacaggcatgtgccaccacacccggctctcttcctcttacaaggccacagttctgtcggggcaattcccccgcctcggcctcccaaagtgctgggtgacaggcatgtgccaccacacccggctctcttcctcttacaaggccacagttctgtcggggcaattcccccgcctcggcctcccaaagtgctggggtgacaggcatgtgccaccacacccggctctcttcctcttacaaggccacagttctgtcggggcaattcccccgcctcggcctcccaaagtgctgggtgacaggcatgtgccaccacacccggctctcttcctcttacaaggccacagttctgtcggggcaattcccccgcctcagcctcccaaagtgctgggtgacaggcatgtgccaccacacccggctctcttcctcttacaaggccacagttctgtcggggcaattcccccgcctcggcctcccaaagtgctggggtgacaggcatgtgccaccacacccggctctcttcctcttacaaggccacagttctgtcggggcaattcccccgcctcggcctcccaaagtgctgagtgacaggcatgtgccaccacacccggctctcttcctcttacaaggccacagttctgtcgggttaggaccccacccttatgaccacatttagccttagttaccccctgaagaccttacctccagatacagtcacactggggctaggacttcaatgtaagaaatttgggggacacagtttagtccccagcactgccatttttcagagtatgcacatttccccgtttataaaaaatttactaaagaagaacacaaaccataagagctcatctttgcaaagttactgcatttgaaagctgcttgttcaaggagaggctattctacaaagtgtgaatccctctttctctctctccgggccgcgcggcacaggactcactttgtgtggctccttcctcaggttcccctggatgcaggagctgccccagggcttcagcagcactccttagctcgctcctacatctgcaggtctgcagtttcttccgggctgggcggggaagcttgtgggctcttctggggcccgaatgggcctctttgaaggtgactcattcccgtgtattggcccgggctctcacctggagctcagcagggctgtgggtgggctcccctgtttctctccacacgtagggagctggattctgggagcgcagatcccagtagagccagggaagccagatctcttttatgccctgctctcctaagtcacacccggattccagccgtggactgccacacgtacacgcgagagatgaatgcacgaaggcaagcgcctgtgcctgtggagttcatgccaaggatcctcttgacctacgtagctgctccccagcagcagcaaggtcctcagcgctggcagtcgtgacaagtgcctcctatgtcctgtggggcagacacggagcaaactcatgccggcggaggctttgggcgcgcatctgttttctagctacccatgtgtccagtggggccccgttctcttgcagtgttgggtacggaaatctgatcttccctgctgctctgcatgggccttgaacatccttcaacttttgatttaaatgattttcttgcagtaatttgaatattggaatttctgccagcatacctgaatttcattctggatgtaatagcggtggaaagctcaggtttgtcaacatttctgggtaacgtattgaaccgtccatagtgacacctaaagtcaaggattgatactttaaggtaattggatggttattcttagcgatgaaagaaacaacctcagtgtaggtgtccttacgtttacctcttggtgttcaggcctctgtcagttcgttctcacgctgctataaagaactgcccgagactgggtaatatgtaaaggaaagaggtttaatggactcacagttccacatgactcgggggacctcaggaaacttacaatcatggcggaaggggaagtgagcatgagcaaaactgccacttttaaaaccatcagctctcgttagacgccctcactgtcacgagaacagcgtgggggagccgcccccgtgatccaatcacttctccacacgtggggattacaattcaagatggaatttgggtggagacgcaaagtcaaggcctgtgtccagcatggcagcattcaagtccacgggcgtacacatgggcatgtatcagtgtgtttgcatggattcaaatattggacttaataatctctgcccaagtgtgaactagtttggcccttttaaaacatcatcacaggctggatgtggtggctcacatttatgataccagcactttgggaggctgaggccagtagattgcttgagccctggagttcgagaccagcctgggcaatatggcaaaatccatctctgcagaaaatacaaaaattagctgggcatggtggtccacacctgtagtcaggaggctgaggtgggagggtcaattgagcccaggaagttgagcccactatgagctaggatcgtgccctgcactccagccttgggtggcagacagagaccctgtctcaaaaaacaagaaaaacagtcatcatagctagcttcccttttcttgagttttactgttttgttagatttgtttatggtgtagtttctaagcatgtcattaaatgccagtagagtagttacttcattttgaaggcccctcatgtctctgctgacagtctgggcctgtagctttctctgattgttcctgatttcacagatttcaccattacggagggagggtcttcatatgctttgcctctgcccagctgtgtttgaagtaggtttttttttttttttgagatggagtctcgccctgttgcccaggctggagtgcagtggcatgatctcggtttactgcaacctctgcctcccgggttcaagtgattctcctgcctcagcctcctcagtagctgggattacaggcgtgagccaccacacttggcaaagattttttttttttttgtatttttagtagagatggagtttcaccatgttggtcaggctggtctcgaactcctgacctcgtgatccgcccgcctcagcctcccaaagtgctgggattacgggcgtgagctactgcgcctggactggaatagttttcaagcagggcttccactctagtaaatccaaatttgtaatagaagtaccagaagcaagattgcagacatttctgcagcattatgtacagaaagcctgccatgttcattagctgattttaaaatcattagtaggcatttaaagcagtgacttacttaccttattgtagtttgagaataatacaaccaaacttcactaagactttaaaattcaccctagtgaattttaaactgccctccccattaatttgccttaaattacagtgttgctttttgccaaggacctttcagagaaatgggccatttcatctacaggttggagaaaagtttaattctggggttaaagcgtaaatgaaagagagtgtgctgaagaacagtaaggcttaaaaacccaagttatgtgtaaattgttctcaactcaagagaatatttgtccacctacatttttaattcctctttttaaaagtcctctctgctcttcaacgatgctctgctctgtgtcactcaaggacactggtggagaagcagctgtgccccttccttaactaagtcagagttaaaatgtgaacatttatgccatttctgtccatttcagtgcaaattcagaccctgctaggagctccagtctccaaggacgtttcactgggggctggactgcagctctgtctttggtacttgcattgcagctgcagccttcatgacagcaggtgtttactgtgattcagcacgtgctgtcctggtctgttctacaaaataccatggactgggtgataacagaaactcatttctcacagatctgggggctgggaagttcaagatctgggtgccggcagatttggtgtctgctgagggctctctgtctccagggtagcacctcactgcagtgtcctcgtatgggagaagagatggaaggggctggcagagccctcatggcctagtcacctcccaagggccccacctccccatatcatcatcttggggtaagttccaattttggagttttgaagggacacacactccagccacaacagtgctgggcgttgccctagctgcccatcagcccattggtgaggtgctgggattctaccctgggcgaccctgaggcatgaagaggtggaacagttgtccaagagccacctggtgggacgagcagagagctgggtctcagtgctcagccctgacttcgggccccggaaccttccgtgggaaccctcccagagaagggcgggtgcacaaccccgtgagacgccggcgtgcctcctcagcctctcttgtgctctctggccctttcctctaatgctgcctctctgggatacccacagggtcattctcctccattgccaacctgcttctagtggctgcttctgcactgagccatggtcctcagtcacagtggcaattggtaaaccaacagaggaggtcactttctgctgtaaccggagattgttgtcgcttctgcaccagaacacactcaccagtgtgcaggctggggtggctattccctgagcacagggaacactggacttggagaaggaaagaatttctggaaaccaggctgctttatgactgacagattatcttattttattatttaacgtatctcatgttttcttttaaggtctctattgagataaagagttccagggaaagaaaggtcacagtgctcggtaaacaacccagcaaacggcggctctgctgctgcgtgggccaagcgggtggtctggggctgtgacggcctctcagtgtgtgatgaagtttcagcgccctccacagtggcagtgccagcttggaatcccgcttccggttgtgttgttcattctggct

SEQ ID NO: 17970 - DNA, 13557 bp, Homo sapiens
gggttcactccatcctcctgccttagcctcctgagtagctgggactacaggcgcccaccaccacgcctggctaattttttgtatttttagtagagacggggtttcaccgtgttagccaggatggtcttgatctcctgacctcgtgatccgcccgccttggcctcccaaagtgctgggattacaggcgtgagccaccatgtctggcctggccaggctggtcttgaactcctgacttccggtgatccatctgttctggcctcccaaagtgctgggattacaggcataagccaccacgccatgccgaagcccagcttgtttttaatttttttttttttttttggagaaatgaggtcttgcaatgttgcccaagctagccttgaactcctggcctcaaatgaccccgccttggcatcccaaagtactgggattacagatgtgagccaccatgccccagccttgctttcttgagatacgatttagaataccataagattcatcccttttaagcacataattcaatgacttctgtacaaacaaccatgactacaatctaattttaaaatatttcaatcactctaaaaaagaaacctcctgcttatgtacagcgactctgtctacctcttaagtgaattctcctacctttaatagccctattttacagttcaggaaactgaggttcagagagacaaagtcacttacccacagcaaagaagcaaggctgggtatcaaatgcaggacccccccggtcctgatgcttttttttttttttttttttcctctgagagagactctcactctgtcactcagtctagagtacagtggcgcgatctcagttcactgcaatctctgcctcctgggctgaagtaatcctttcctcacaagtaaacctcagcctctcaagtagctgggactacaggcacacaacaccacgcctggctaatttttgtatttttaggtagagacggggtttcactatattggccaggctggtcttgaactcctgacctcaggtgatccgcctgcctcggccccccaaagtgttgggattacaggcgtgagccaccacacgcagcctttttgttattagactctgtcattactgactttttttttttttttaatagaaacagggtctttctttcccaggctaaagtacagtggcatgatcacagttcactatagccttaaactcctgggctcaagtgatcctcctgcctcagcctcccaagtagcagggactacaggtgtgcaccaccacacccagttaaccattcattcattcattcattcatttattttgagatggagtctcgctctgtcacctaggctggagtgcagtggcacgatctcagctcactgcaacctccacctcccaggttcaagagattctcctgcctcagcctcccgagtagctgagactacaggcgtgcaccaccatgccagactaatttttgtatttttaatagagacggggtttcactctgttggtcaggcttatctcgaactcctgacttcgtggatccaccctccttggcctcccaaagtgctgggattaaaggcgtgagccaccgcgccctgccaacctttttttgatttttcttagagatgggggtctccctatgttgcccaggcttgtcttgaactcctggcctcaagtgaccctcttgccttggcctcacaaagtgctaggattacagcctgagccatcacacctggccaacaggtttttttttttgttttgttttgttttttaaagaatgtctaggccaggctcatttactttcacctgtaatcccagcactttgggaggccggggtgggcagatcacttgaggtcaggaattcgagaccagcctgggcaacatgctgaaaccccgtttctactaaaaatacaaaaattagctgggtgtggtgacacgtgcctgtaatcccagctactcaggaggttgaggcaggagaattgcttgaacccaggaggcagaggttgcagtgagccaagatcatgccatcaccctccagcctgggcgacagaaggagactcagtctaaaaacttaattaattaattaattaaaaataaaaatacaaaaattaacctggtgtggtggtgtgtgcctgtaatctaagctactcaggaggctgaggcaggagaatcccctgaatcccagaggcagaggttgcagtgagccaagatcgagccactgtttgcccagtctagtgcactgggctgctgaatttatttgaccagacacctagcaatagactttgaagttcttttccacttttcactctaagatgctgctgtcatgaataaggaatattttgatccccttcacaaacactcggggccctcttaccagttttcactgaagatcttgacattcctatctgcttaggtgtctgggcgtgtttgggggagatactgaagaggtagggctcccaggcaggtgcagttcgtctgttaggcaggcagcaaggtccacttcaccagacacccccacctctgttttcctgcagggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttggtgaggattgaagaagccagcagggagaaggtgggggtggggtatcctgcaatgcggtgcctgtggccacaggatcttttgagatgggtgtggccccggctaaggggtgcatgtgttctaggcgtatgtgacctaggctgctgagtggccctggaagaggatctcgcaggagggggaatgaaatgccccagagaagggcttcgggacgtccatccctgtctgctcacacctttcttctctccctagtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagtaagaaggggcaggggcggagtggggcttcttgggggtgtgacctgaacccggggcggggctcactgtgtgcctattccaggctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtgtgagtggggctgctggtcaatggcccctatcccccaaggcccaatctccctgaaggtcccataaggtcttgcctccaagtcctgcccccacccacctccatgtcatctcatcgtgtttttccagatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcaaggtgaccgtgaatgtgctctgtgagtgagccggcgggcagagctgggtgggggcaggggccatggacctaatgcaatcctcaccgcctgttgtatcctccccacagccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgatttttttttttttttcagagacggggtctcgcaacattgcccagacttcctttgtgttagttaataaagctttctcaactgcctcagccttgtgtgagttgaggggaggtgtcacatccagctggagtcctttctaagcagccacagcctgatcctcccacttcctcccccaagaaaacattgtgggttgatggccataccctgaggttctggtccaaatcggactttctatgaccttctgggtctctagtgaaaactaaagactcctctccagaaaaaaacatttggtttctaatgaggcctggaatcttattcttgacctggggagcggaatccctttttgcagtactcccgggccctctgttggggcctccccttcctctccagggtggagtcgaggaggcggggctgcgggcctccttatctctagagccggccctggctctctggcgcggggccccttagtccgggctttttgccatggggtctctgttccctctgtcgctgctgttttttttggcggccgcctacccgggagttgggagcgcgctgggacgccggactaagcgggcgcaaagccccaagggtagccctctcgcgccctccgggacctcagtgcccttctgggtgcgcatgagcccggagttcgtggctgtgcagccggggaagtcagtgcagctcaattgcagcaacagctgtccccagccgcagaattccagcctccgcaccccgctgcggcaaggcaagacgctcagagggccgggttgggtgtcttaccagctgctcgacgtgagggcctggagctccctcgcgcactgcctcgtgacctgcgcaggaaaaacacgctgggccacctccaggatcaccgcctacagtgagggacaggggctcggtcccggctggggtgaggggagggggctggaagaggtgggggaagggtagttgacagtcgctctatagggagcgcccgcggacctcactcagaggctcccccttgccttagaaccgccccacagcgtgattttggagcctccggtcttaaagggcaggaaatacactttgcgctgccacgtgacgcaggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcgacggcctggtggtccgcaacagctcggcacccattacactgatgctcggtgaggcacccctgtaaccctggggactaggaggaagggggcagagagagttatgaccccgagagggcgcacagaccaagcgtgagctccacgcgggtcgacagacctccctgtgttccgttcctaattctcgccttctgctcccagcttggagccccgcgcccacagctttggcctccggttccatcgctgcccttgtagggatcctcctcactgtgggcgctgcgtacctatgcaagtgcctagctatgaagtcccaggcgtaaagggggatgttctatgccggctgagcgagaaaaagaggaatatgaaacaatctggggaaatggccatacatggtggctgacgcctgtaatcccagcactttgggaggccgaggcaggagartcgcttgagcccaggagttcgagaccagcctggacaacatagtgagaccccgtctatgcaaaaaatacacaaattagcctggtgtggtggcccgcacctgtggtcccagctacccgggaggctgagttgggaggatcctttgagccctgaaagtcgaggttgcagtgagccttgatcgtgccactgcactccagcctgggggacagagcacgaccctgtctccaaaaataaaataaaaataaaaataaatattggcgggggaaccctctggaatcaataaaggcttccttaaccagcctctgtcctgtgacctaagggtccgcattactgcccttcttcggaggaactggtttgtttttgttgttgttgttgtttttgcgatcactttctccaagttccttgtctccctgagggcacctgaggtttcctcactcagggcccacctggggtcccgaagccccagactctgtgtatccccagcgggtgtcacagaaacctctccttctgctggccttatcgagtgggatcagcgcgggccggggagagccacgggcaggggcggggtggggttcatggtatggctttcctgattggcgccgccgccaccacgcggcagctctgattggatgttaagtttcctatcccagccccaccttcagaccctgtgctttcctggaggccaaacaactgtggagcgagaactcatctccaaaataacttaccacgctggagtgagaccacgaatggtggggaggggagggtcccacggacatattgagggacgtggatacgcagaagaggtatccatgtggtggcagccgggaaggggtgatcagatggtccacagggaatatcacaaactcgaattctgacgatgttctggtagtcacccagccagatgagcgcatggagttgggggtggggggtgtcaaagcttggggcccggaagcggagtcaaaagcatcaccctcggtcccttgttctcgcgtggatgtcagggcccccacccaccgagcagaaggcggactcaggggcgctccagggtggctcgagctcacacacgctgagtagacacgtgcccgctgcaccctgggtaaatacagacccggagccgagcggattctaatttagacgcccgcgaacgctgcgcgcacgcacacgtgtcctcggctcgctggcactttcgtcccgccccctccgtcgcgtgccggagctgacccggaggggtgcttagaggtatggctccgcggggtcaaaaggagaaggatcagtgagagaggcatccccacaccctcccctagaactgtcctttccccatccagtgcctcccaaatctctcttagtccccaaatgtatccccgccctaaggggcgctggtgggaggagctaaatgtgggggcggagctcggagtccagcttattatcatggcatctcagccagggctggggtaggggtttgggaagggcaacccagcatcccccgatcccagagtcgcggccggggatgacgcgagagagcgtggtcgcccccagaaggccctgggccatcatgccggcctccacgtagaccccaggggtcgctcactcctgccagctcgccttcaccaaggccaggagcttagcgcacgctcgcctcccgcccccccgccgcctctgccgccgccccctccttggaaaccaagttaccaacgttaaaccaatccccaagcgcaactctgcctcccccacaccccacccgccgcgccgcgcggagccgtcctctagcccagctcctcggctcgcgctctcctcgcctcctgtgctttccccgccgcggcgatgccagggccttcgccagggctgcgccgggcgctactcggcctctgggctgctctgggcctggggctcttcggcctctcaggtaagagccccgctctggttcggggtggacagggcgggggcggagtccctggacctgagaaacggcctcctgtccctcccagctctgccctcgcctcgctcccacgcctctgcccccacctcgagcctgagtcttctccccttccccctcctccccaacacacacccgagccccagcttcctgactcctcgatagcccctacccgcttcgagatcctaggtgttcttccgcacccaacccttcgccctggagacccagtgtctctcctgtccgctccccgggtacctccttacgctgtgctgtgcaccatggtccacggactggcatcttccccactcgcggtccgcgaagactccatctctccaactaccctgactcagaggcgctgttcccgctccacccagagccctggcaaccgggtccctcagctgttcccgcggttccttccatgagcccagccttgcgtcccggctccgtgttcttcaccgggtgtagggtccttcctgatccttgacccagcctcgtctctcctttgcccttgccgcaaacgcactctcctcgtatcccggcattctgccaggaccctgagaactggttcatcccccatcccccatcccgggtccccttctctcagccttgctgtgttcatccaagaacccacctttcctctcctctacgccctccccccatgctttcccgccgctccatcggcgctttggagaccatggctctctgctaccacgtcccagagacaccctcgaggtttagactctgggagtgcgcctttaaaccggaggcctgggcacgacgcgggacgcctgggttctttccctggctgcagcctctcctcctcctccccgccctctgagaacccttgactcgacataggggcgctaagatgtcagggagttggctccccaggctcagcccgcgtttccctgggcagcggtctcgcaggagcccttctgggcggacctgcagcctcgcgtggcgttcgtggagcgcgggggctcgctgtggctgaattgcagcaccaactgccctcggccggagcgcggtggcctggagacctcgctgcgccgaaacgggacccagaggggtttgcgttggttggcgcggcagctggtggacattcgcgagccggagactcagcccgtctgcttcttccgctgcgcgcggcgcacactacaggcgcgtgggctcattcgcactttccgtgagttctgggtggccacgcgcgtactccactactctccctccctcccaggccccgccccctgggtcccagggtcctccccttcaggccccaccttctgttccaagtcccggcgttcaaagagctgcggactcttcccccttgcagagcgaccagatcgcgtagagctgatgccgctgcctccctggcagccggtgggcgagaacttcaccctgagctgtagggtccccggcgccgggccccgtgcgagcctcacgctgaccctgctgcggggcgcccaggagctgatccgccgcagcttcgccggtgaaccaccccgagcgcggggcgcggtgctcacagccacggtactggctcggagggaggaccatggagccaatttctcgtgtcgcgccgagctggacctgcggccgcacggactgggactgtttgaaaacagctcggcccccagagagctccgaaccttctgtgagtgggtgtggggaggagatggggacccagtggggtcggtcggtgtttaggaggtttagaggtagatacatctgaatgctgaccccgacttcaaccctcgccggctgagctgtttccccctccgtgccttgaggatgataatacgataagatagtgcatgtcaagtgcttaggacatattgagcgctcggagttagttcaaacttggttcttcgacccctagccctgtctccggatgccccgcgcctcgctgctccccggctcttggaagttggctcggaaaggcccgtgagctgcactctggacggactgtttccagcctcagaggccagggtctacctcgcactgggggaccagaatctgagtcctgatgtcaccctcgaaggggacgcattcgtggccactgccacagccacagctagcgcagagcaggagggtgccaggcagctggtctgcaacgtcaccctggggggcgaaaaccgggagacccgggagaacgtgaccatctacagtaaggaaggaggcggggtctccgcggctccgaggtgggaccagaggaatgcgaaggcggggcgaagagtgggcgggacctcagtaccggaacaggcgtggcccgagggggcggggcaggtgggggcggagacgtaatcgctggggaggaggagcctgtacagcctgagaggcggggcgccgtaccctagttcgttctcagcaccccgaggattcgggcagataaggggcgggccttgaccggagggaggggtatggtcagtatactacgaccaaatgctccgcccccaggcttcccggcaccactcctgaccctgagcgaacccagcgtctccgaggggcagatggtgacagtaacctgcgcagctggggcccaagctctggtcacactggagggagttccagccgcggtcccggggcagcccgcccagcttcagctaaatgccaccgagaacgacgacagacgcagcttcttctgcgacgccaccctcgatgtggacggggagaccctgatcaagaacaggagcgcagagcttcgtgtcctatgtgagttggtgataacccctcgccccccaccttctggtgacttccaaggacccgcctgctccctcaccgtgtcgtggaggcggagccatttcttacgtctaagcctctgtaaccccacgccctgcccgcagacgctccccggctagacgattcggactgccccaggagttggacgtggcccgagggcccagagcagacgctgcgctgcgaggcccgcgggaacccagaaccctcagtgcactgtgcgcgctccgacggcggggccgtgctggctctgggcctgctgggtccagtcactcgggcgctctcaggcacttaccgctgcaaggcggccaatgatcaaggcgaggcggtcaaggacgtaacgctaacggtggagtgtgagtgggggtgcgcagggtgcatttctatctggttcaaggtctggagggtggccagcctccagggaagagtaggagtagggtatgaggtgtccctttgggtgaggttttgggaaagggaagaggctggttagtggggttggagaaagatcttggaggatggaagggaccgggtgggcgtgcccctagcctagggcgtggtatttgggcggagtcgtggaaaggcgggcagtccagagtgtttaagtttttagacgaaaaaggcgccactggtggctcaggaagctcccagacagagtgcatgcctcgactagcgtgacacctccttggatcggcgtccaagggttatgcagggacaacacttcgtggaagccttgccgcgccaaggagggtctagggacgtcagatttgcccccaaaccccaaagccaacaatacactccctcctccagacgcaccagcgctggacagcgtgggctgcccagaacgcattacttggctggagggaacagaagcctcgctgagctgtgtggcgcacggggtaccgccgcctgatgtgatctgcgtgcgctctggagaactcggggccgtcatcgaggggctgttgcgtgtggcccgggagcatgcgggcacttaccgctgcgaagccaccaaccctcggggctctgcggccaaaaatgtggccgtcacggtggaatgtgagtaggggcaccgcggagttaggcaggatctgtgggacaaccccggctggacttcctggcccccgtgtgagcccctgcaatcctgtttcccagatggccccaggtttgaggagccgagctgccccagcaattggacatgggtggaaggatctgggcgcctgttttcctgtgaggtcgatgggaagccacagccaagcgtgaagtgcgtgggctccgggggcgccactgagggggtgctgctgccgctggcacccccagaccctagtcccagagctcccagaatccctagagtcctggcacccggtatctacgtctgcaacgccaccaaccgccacggctccgtggccaaaacagtcgtcgtgagcgcggagtgtgagcgaggcccaggcgggtagggagcaggggtgccccacggtccaggcactccctgacatcccccatggctgctttgcagcgccaccggagatggatgaatctacctgcccaagtcaccagacgtggctggaaggggctgaggcttccgcgctggcctgcgccgcccggggtcgcccttccccaggagtgcgctgctctcgg

SEQ ID NO: 17971 - DNA, 19409 bp, Homo sapiens
tgggggagatactgaagaggtagggctcccaggcaggtgcagttcgtctgttaggcaggcagcaaggtccacttcaccagacacccccacctctgttttcctgcagggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttggtgaggattgaagaagccagcagggagaaggtgggggtggggtatcctgcaatgcggtgcctgtggccacaggatcttttgagatgggtgtggccccggctaaggggtgcatgtgttctaggcgtatgtgacctaggctgctgagtggccctggaagaggatctcgcaggagggggaatgaaatgccccagagaagggcttcgggacgtccatccctgtctgctcacacctttcttctctccctagtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagtaagaaggggcaggggcggagtggggcttcttgggggtgtgacctgaacccggggcggggctcactgtgtgcctattccaggctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtgtgagtggggctgctggtcaatggcccctatcccccaaggcccaatctccctgaaggtcccataaggtcttgcctccaagtcctgcccccacccacctccatgtcatctcatcgtgtttttccagatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcaaggtgaccgtgaatgtgctctgtgagtgagccggcgggcagagctgggtgggggcaggggccatggacctaatgcaatcctcaccgcctgttgtatcctccccacagccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggccccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctaatcacattcaaggtcaccaggtacagttgtacaggttgtacactgcaggagagtgcctggcaaaaagatcaaatggggctgggacttctcattggccaacctgcctttccccagaaggagtgatttttctatcggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcgtgtgtgtgtgtgtgtatgtgtagacaagctctcgctctgtcacccaggctggagtgcagtggtgcaatcatggttcactgcagtcttgaccttttgggctcaagtgatcctcccacctcagcctcctgagtagctgggaccataggctcacaacaccacacctggcaaatttgatttttttttttttttcagagacggggtctcgcaacattgcccagacttcctttgtgttagttaataaagctttctcaactgcctcagccttgtgtgagttgaggggaggtgtcacatccagctggagtcctttctaagcagccacagcctgatcctcccacttcctcccccaagaaaacattgtgggttgatggccataccctgaggttctggtccaaatcggactttctatgaccttctgggtctctagtgaaaactaaagactcctctccagaaaaaaacatttggtttctaatgaggcctggaatcttattcttgacctggggagcggaatccctttttgcagtactcccgggccctctgttggggcctccccttcctctccagggtggagtcgaggaggcggggctgcgggcctccttatctctagagccggccctggctctctggcgcggggccccttagtccgggctttttgccatggggtctctgttccctctgtcgctgctgttttttttggcggccgcctacccgggagttgggagcgcgctgggacgccggactaagcgggcgcaaagccccaagggtagccctctcgcgccctccgggacctcagtgcccttctgggtgcgcatgagcccggagttcgtggctgtgcagccggggaagtcagtgcagctcaattgcagcaacagctgtccccagccgcagaattccagcctccgcaccccgctgcggcaaggcaagacgctcagagggccgggttgggtgtcttaccagctgctcgacgtgagggcctggagctccctcgcgcactgcctcgtgacctgcgcaggaaaaacacgctgggccacctccaggatcaccgcctacagtgagggacaggggctcggtcccggctggggtgaggggagggggctggaagaggtgggggaagggtagttgacagtcgctctatagggagcgcccgcggacctcactcagaggctcccccttgccttagaaccgccccacagcgtgattttggagcctccggtcttaaagggcaggaaatacactttgcgctgccacgtgacgcaggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcgacggcctggtggtccgcaacagctcggcacccattacactgatgctcggtgaggcacccctgtaaccctggggactaggaggaagggggcagagagagttatgaccccgagagggcgcacagaccaagcgtgagctccacgcgggtcgacagacctccctgtgttccgttcctaattctcgccttctgctcccagcttggagccccgcgcccacagctttggcctccggttccatcgctgcccttgtagggatcctcctcactgtgggcgctgcgtacctatgcaagtgcctagctatgaagtcccaggcgtaaagggggatgttctatgccggctgagcgagaaaaagaggaatatgaaacaatctggggaaatggccatacatggtggctgacgcctgtaatcccagcactttgggaggccgaggcaggagaatcgcttgagcccaggagttcgagaccagcctggacaacatagtgagaccccgtctatgcaaaaaatacacaaattagcctggtgtggtggcccgcacctgtggtcccagctacccgggaggctgagttgggaggatcctttgagccctgaaagtcgaggttgcagtgagccttgatcgtgccactgcactccagcctgggggacagagcacgaccctgtctccaaaaataaaataaaaataaaaataaatattggcgggggaaccctctggaatcaataaaggcttccttaaccagcctctgtcctgtgacctaagggtccgcattactgcccttcttcggaggaactggtttgtttttgttgttgttgttgtttttgcgatcactttctccaagttccttgtctccctgagggcacctgaggtttcctcactcagggcccacctggggtcccgaagccccagactctgtgtatccccagcgggtgtcacagaaacctctccttctgctggccttatcgagtgggatcagcgcgggccggggagagccacgggcaggggcggggtggggttcatggtatggctttcctgattggcgccgccgccaccacgcggcagctctgattggatgttaagtttcctatcccagccccaccttcagaccctgtgctttcctggaggccaaacaactgtggagcgagaactcatctccaaaataacttaccacgctggagtgagaccacgaatggtggggaggggagggtcccacggacatattgagggacgtggatacgcagaagaggtatccatgtggtggcagccgggaaggggtgatcagatggtccacagggaatatcacaaactcgaattctgacgatgttctggtagtcacccagccagatgagcgcatggagttgggggtggggggtgtcaaagcttggggcccggaagcggagtcaaaagcatcaccctcggtcccttgttctcgcgtggatgtcagggcccccacccaccgagcagaaggcggactcaggggcgctccagggtggctcgagctcacacacgctgagtagacacgtgcccgctgcaccctgggtaaatacagacccggagccgagcggattctaatttagacgcccgcgaacgctgcgcgcacgcacacgtgtcctcggctcgctggcactttcgtcccgccccctccgtcgcgtgcsggagctgacccggaggggtgcttagaggtatggctccgcggggtcaaaaggagaaggatcagtgagagaggcatccccacaccctcccctagaactgtcctttccccatccagtgcctcccaaatctctcttagtccccaaatgtatccccgccctaaggggcgctggtgggaggagctaaatgtgggggcggrgctcggagtccagcttattatcatggcatctcagccagggctggggtaggggtttgggaagggcaacccagcatcccccgatcccagagtcgcggccggggatgacgcgagagagcgtggtcgcccccagaaggccctgggccatcatgccggcctccacgtagaccccaggggtcgctcactcctgccagctcgccttcaccaaggccaggagcttagcgcacgctcgcctcccgcccccccgccgcctctgccgccgccccctccttggaaaccaagttaccaacgttaaaccaatccccaagcgcaactctgyctcccccacaccccacccgccgcgccgcgcggagccgtcctctagcccagctcctcggctcgcgctctcctcgcctcctgtgctttccccgccgcggcgatgccagggccttcgccagggctgcgccgggcgctactcggcctctgggctgctctgggcctggggctcttcggcctctcaggtaagagccccgctctggttcggggtggacagggcgggggcggagtccctggacctgagaaacggcctcctgtccctcccagctctgccctcgcctcgctsccacgcctctgcccccacctcgagcctgagtcttctccccttccccctcctccccaacacacacccgagccccagcttcctgactcctcgatagcccctacccgcttcgagatcctaggtgttcttccgcacccaacccttcgccctggagacccagtgtctctcctgtccgctccccgggtacctccttacgctstgctgtgcaccatggtccacggactggcatcttccccactcgcggtccgcgaagactccatctctccaactaccctgactcagaggcgctgttcccgctccacccagarccctggcaaccgggtccctcagctgttcccgcggttccttccatgagcccagccttgcgtcccggckccgtgttcttcaccgggtgtagggtccttcctgatccttgacccagcctcgtctctcctttgcccttgccgcaaacgcactctcctcgtatcccggcattctgccaggaccctgagaactggttcatcccccatcccccatcccgggtccccttctctcagccttgctgtgttcatccaagaacccacctttcctctcctctacgccctccccccatgctttcccgccgctccatcggcgctttggagaccatgsctctctgctaccacgtcccagagacaccctcgaggtttagactctgggagtgcgcctttaaaccggaggcctgggcasgacgcgggacgcctgggttctttccctggctgsagcctctcctcctcctccccgccctctgagaacccttgactcgacataggggcgctaagatgtcagggagttggctccccaggctcagcccgcgtttccctgggcagcggtctcgcaggagcccttctgggcggacctgcagcctcgcgtggcgttcgtggagcgcgggggctcgctgtggctgaattgcagcaccaactgccctyggccggagcgcggtggcctggagacctcgctgcgccgaaacgggacccagaggggtttgcgttggttggcgcggcagctggtggacattcgcgagccggagactcagcccgtctgcttcttccgctgcgcgcggcgcacactacaggcgcgtgggctcattcgcactttccgtgagttctgggtggccacgcgcgtactccactactctccctccctcccaggccccgccccctgggtcccagggtcctccccttcaggccccaccttctgttccaagtcccggygttcaaagagctgcggactcttcccccttgcagagcgaccagatcgcgtagagctgatgccgctgcctccctggcagccggtgggcgagaacttcaccctgagctgtagggtccccggcgccgggccccgtgcgagcctcacgctgaccctgctgcggggcgcccaggagctgatccgccgcagcttcgccggtgaaccaccccgagcgcggggcgcggtgctcacagccacggtactggctcggagggaggaccatggagccaatttctcgtgtcgcgccgagctggacctgcggccgcacggactgggactgtttgaaaacagctcggcccccagagagctccgaaccttctgtgagtgggtgtggggaggagatggggacccagtggggtcggtcggtgtttaggaggtttagaggtagatacatctgaatgctgaccccgacttcaaccctcgccggctgagctgtttccccctccgtgccttgaggrkgataatacgataagatagtgcatgtcaagtgcttaggacatattgagcgctcggagttagttcaaacttggttcttcgacccctagccctgtctccggatgccccgcgcctcgctgctccccggctcttggaagttggctcggaaaggcccgtgagctgcactctggacggactgtttccagcctcagaggccagggtctacctcgcactgggggaccagaatctgagtcctgatgtcaccctcgaaggggacgcattcgtggccactgccacagccacagctagcgcagagcaggagggtgccaggcagctgrtctgcaacgtcaccctggggggcgaaaaccgggagacccgggagaacgtgaccatctacagtaaggaaggaggcggggtctccgcggctccgaggtgggaccagaggaatgcgaaggcggggcgaagagtgggcgggacctcagtaccggaacaggcgtgkcccgagggggcggggcaggtgggggcggagacgtaatcgctggggaggaggagcctgtacagcctgagaggcggggcgccgtaccctagttcgttctcagcaccccgaggattcgggcagataaggggcgggccttgaccggagggaggggtatggtcagtatactacgaccaaatgctccgcccccaggcttcccggcaccactcctgaccctgagcgaacccagcgtctccgaggggcagatggtgacagtaacctgcgcagctgggrcccaagctctggtcacactggagggagttccagccgcggtcccggggcagcccgcccagcttcagctaaatgccaccgagaacgacgacagacgcagcttcttctgcgacgccaccctcgatgtggacggggagaccctgatcaagaacaggagcgcagagcttcgtgtcctatgtgagttggtgataacccctcgccccccaccttctggtgacttccaaggacccgcctgctccctcaccgtgtcgtggaggcggagccatttcttacgtctaagcctctgtaaccccacgccctgcccgcagacgctccccggctagacgattcggactgccccaggagttggacgtggcccgagggcccagagcagacgctgcgctgcgaggcccgcgggaacccagaaccctcagtgcactgtgcgcgctccgacggcggggccgtgctggctctgggcctgctgggtccagtcactcgggcgctctcaggcacttaccgctgcaaggcggccaatgatcaaggcgaggcggtcaaggacgtaacgctaacggtggagtgtgagtgggggtgcgcagrgtgcayttctatctggttcaaggtctggagggtggccagcctccagggaagagtaggagtagggtatgaggtgtccctttgggtgaggttttgggaaagggaagaggctggttagtggggttggagaaagatcttggaggatggaagggaccgggtgggcgtgcccctagcctagggcgtggtatttgggcggagtcgtggaaaggcgggcagtccagagtgtttaagtttttagrcgaaaaaggcgccactggtggctcaggaagctcccagacagagtgcatgsctcgactagcgtgacacctccttggatcggcgtccaagggttatgcagggacaacacttcgtggaagccttgccgcgccaaggagggtctagggacgtcagatttgcccccaaaccccaaagccaacaatacactccctcctccagacgcaccagcgctggacagcgtgggctgcccagaacgcattacttggctggagggaacagaagcctcgctgagctgtgtggcgcacggggtaccgccgcctgatgtgatctgcgtgcgctctggagaactcggggccgtcatcgargggctgttgcgtgtggcccgggagcatgcgggcacttaccgctgcgaagccaccaaccctcggggctctgcggccaaaaatgtggccgtcacrgtggaatgtgagtaggggcaccgcggagttaggcaggatctgtgggacaaccccggctggacttcctggcccccgtgtgagcccctgcaatcctgtttcccagatggccccaggtttgaggagccgagctgccccagcaattggacatgggtggaaggatctgggcgcctgttttcctgtgaggtcgatgggaagccacagccaagcgtgaagtgcgtgggctccgggggcrccactgagggggtgctgctgccgctggcacccccagaccctagtcccagagctcccagaatccctagagtcctggcacccggtatctacgtctgcaacgccaccaaccgccacggctccgtggccaaaacagtcgtcgtgagcgcggagtgtgagcgaggcccaggcgggtagggagcaggggtgccccacggtccaggcactccctgacatcccccatggctgytttgcagcgccaccggagatggatgaatctacctgcccaagtcaccagacgtggctggaaggggctgaggcttccgcgctggcctgcgccgcccggggtcgcccttccccaggagtgcgctgctctcgggaaggcatcccatggcctgagcagcagcgcgtgtcccgagaggacgcgggcacttaccactgtgtggccaccaatgcgcatggcacggactcccggaccgtcactgtgggcgtggaatgtgagtgggggcagcaccggatggaggggacacggtcctcggaagaatgactcgcagcggtgggagcattcaagggcacctctcccaatcccattctcggggacagggaattccagcctaaaccagggggtaatgaaaattctagccaggcgcagtggctcaggtctgtaatcccaacactttggaaggttgaggcggatgaatcacttgaggccaggagttcgagaccagcccggccaacatggcgaaaacccgtctctacaaaaattagccggtcgtggtsgtgggcgcctgtggtcccagctacttgggaggctgaggcaggagaatcgcttgagcctgggaggcagaggttgcagggagccgagatcccgccactgcactccagcctgggcaacagagtgagactctttcttagaaaaacagaaaaagaaaattatagggaataggagcacggccctcctcaaatcctggattagaacactgacctgggcttcacctccttccattcggtgaagaagggcgaggaattttagccgcaacagcagcctgattgtcggggaaggaggctctgataggaggcaggatcctcttctgcccatcagaggcgcggtggtctcccatcgatcgttgtgggccggagcagggcatttgatcagtggctgggccggcgctaagccccacttcaccttctgtgcccttcagaccggccagtggtggccgaacttgctgcctcgccccctggaggcgtgcgcccaggaggaaacttcacgttgacctgccgcgcrgaggcctggcctccagcccagatcagctggcgcgcgcccccgrgggccctcaacatcggcctgtcgagcaacaacagcacactgagcgtggcaggcgccatgggaagccacggcggcgagtacgagtgcgcasscaccaacgcgcacgggcgccacgcgcggcgcatcacggtgcgcgtggccggtmmgtggcagctggggagaggcggggcgaggtatctgagagggggcgtgacctgggtcttggggcggccggccccgcctgcctccctctcggtcccggkagactagrcggwagtgggacagartagaagtcaaaggtgcctkagcgggtggggctgttgatcgcactttgaggggtgggagatggaggtggcagggggactgaattcaaggggagggaccctccggggctgtcactgctgcaggaaaggactttaaaacttgggctggattctgcgtggyggaaacttgacccaattcacaatccactgtggggaagattggggagggaccaaagtcattggatgwtggagggagagaggggtcaagatcgccttctctcacttcctgaagctcctggggctgggttctctctggggtcgggggaacctgacctggtcctgccggtcctcattttttgggggatggggagagttgacttgtcgccagggggctaagtgtggtcacgggtttatatccccatgggctgaagtgcgatataaatcgggactcgggtcgccctggcactgggagtggccttattgcatgggttgtctcccttctcccaaggccagacagtgagctccccggggcatgaggactgacttcgtgcctgtgggagtgcggggggcggtgggagaagccccccggagcttggccaccctccgcgagggtctccaccccgcaggtccgtggctatgggtcgccgtgggcggcgcggcggggggcgcggcgctgctggccgcgggggccggcctggccttctacgtgcagtccaccgcctgcaagaagggcgagtacaacgtgcaggaggccgagagctcaggcgaggccgtgtgtctsaacggagcgggcggcggcgctggcggggcggcaggcgcggagggcggacccsaggcggcggggggcgcggccgagtcgccggcggagggcgaggtcttcgccatacagctgacatcggcgtgagcccgctcccctctccccgcgggccgggggacgccccccagactcacacgggggcttatttattgctttatttatttacttattcatttatttatgtattcaactccaagggcgtcacccccattttctasccatcccctcaataragtttttatraaggaactccctgtctccgcttctgtttctgcaaggtggaacaagcccagggttccagtcgtgacctcccgagttattcattcaaaaagcgatttttgagagggcctggggtggtggcttaggcctgtaatcccaggacttgtgggaggcccaggtgggaggatcccttgcacccaagagtttcagaccagcctgggcaacatagggagaccctacaaaaaatatttttcaaaaattagccaaggccggtcgcggtggctcatgcgtgtaatcccaggactttggaaggccgaggcggccagatcacgaggtcgaggtcatgagatcgagaccatcctggccaatatggtgaaaccctgtctctactaaaaatacaaaaattagctgggcatggtggtgcgcgcctgtagtcccagctattcgggaggctgaggcaggagaatcgctttaaccccggaggcagaggttgcagtgagccgagatcgtgccactgaactccagcctggcgacagagcgagattccgtcttaaaaaaaaaaccaggcgtggtggctcacgcctgtaatcccagcactttgggaggccgaggcgggcggatcacgaggtcgggagatcgagaccatcctcgctaacacggtgaaaccccgtctctactaaaaatacaaaaaaaaaaaaaaaaaaaaaattagccgagcgtggtggcgggcgcctgtagtcccagctactcaggaggctgaggcaggagaatggcatgaacccggggagcagagcttgcagtgagccgagatcgcgccactgcactccaccctggcagacagcaagactccgtctcaaaaaaaaaaaaaaaaattagccagggccgagcacagtactctcgcttgaatcccagaactttgggaaactaaggcggggggggggggtcacttgaggtcaggagttcgagaccaccctggccaacgtggtgaaacaccttctctaccaaaaatacaaaaaaattaaggccgggtgaagtggctcacgtctgtaatcccagcactttgcgaggctgaggcgggcggatcatggggttagaagatcaagactgtcctggctaacatggtgaaaccccgtcactactaaaaacacaaaaattagccgggcgtggtggcacatgcctgtagtcccagctactcaagaggctgaggcaggagaatcgctttaaccccggaggcagaggttgcagtgagccaagatcgcaccactgcactccagcctgggcaatagagcgagactctgtctcaaaaaaaaaccaaaaacaaaaacaaaaaaatacaaaaatttagctgggctgtagtggcacacgccctgtaatcccagctactcgtgaggctgaggcaggagaattgctagaacccgggaggtagagatcttgccattgcactccagcctgggcaacagaactagactctgtctcaaaaaaaaaaaaaaaaaaaaaaaagtgttttttgagggggctgggcatggtggctcaagcctgtaatcccaggacttttgggaggcccaggtgggaggatcccttgtgcccacgagtttcagaccagcctgggcaacatagcgagaccctacaaaaaaacatgtttcaaaaaaaaatttttttttttgagatggagtctcgctctgtcgcccaggctggacagcagtggcactatctctgctcactgcaagctccgtctcccgggttcatgccattctcctgcctcagcctcccaagtagctgggattacaggcgcctgccaccacacccagctaatttttttttgtatttttagtagagatgggatttcaccgtgttcgccaggatggtctctattcctgacctcgagatccacccgcctcagcctcccaaagtgctgggattacaggcgtgagccaccgcgcccggcctcaaaaaaaaaattttttttttgagatggagtcttgctctgtcacccaggctggagtgctgtggtgtgatcttggctcactgcaacctctgcctcctgggttcaagcaattcccctgccttggcttcccaaatagctgggactataggcatgcaccaccacacccagctaatttttgtatttttagtagagacagggtttcaccatgttggccaggctggtctcgaactcctgacctaaggtgatccacctgcctcggtctcccaaagtgctgggattacagctgtaagccaccatgcctggtgtatttttcaaaaattagccagacatggtggtgcatgcctgtagtcccagctacttgggaggctgaggcaggaggatcctttgagcctaggaggtcaaagccacttccagctatgatattgtcattgtgctccagcccaggtgacagaaccagaccctgtctctaaaaacaaacaacgaaaaaatccaaaaactttttttgaacacctactatgcatcaggcacaatctaagctgtctttttctttttcttttttttatttttgagacggagtctctctgtcgcccaggctggagtgcagtggtgtaatctcagctcactgcaagctctgcctcccacgttcaagcgattttcctgcctcagcctcctgagtagctgggattacaggcgcgcgccaccactacgcccggctaatttttgtatttttagtagagacagggtttcaccatgttggtcaggctagtctggaactactgacctcgtgattcacctgcctcggtctcccaacgtgctggaattacaagcctgagccactgtgcctggcccggctggctgtcttttctcagtgtgacctagagctcgtcctctctcagtgcctgttttctgctctcttcacacccttgggcaggggtgggggcctcactccttcctcctacttatctcttccacccagcactgccctctgatccgggtcactcttggaggtgggggctaggtgcttcccccaggcctggttaccggcagagctgaggccgccttgccagggtgggtggaggccctctccgttgtgcccctgccctgagacttcggtgagaccttcctgggcaggcactggctgatgctatgggtgtcagcccttagcatgtcctccctgttaaagggggcacccctgccccgccctcaatgcctcctttgtcctgtgtccacccacagtgcttcagtttacccccaccctgcctttccactcagcccatcatgattcagaacagacacacacagggtatccgctgcaacccccactacacggcaccttcccccctcatccccaacagcataaggcacagcagctgggcctcctccccacagcctcctcctctgcccctcctccctcaaaagcaggaacacggagccctagagaaggaagccagtcccatgcaaacatgtaatgagcaaagatgagacggggaaatggcacaagagggcaggccagtgctcggtgctggagccaggggccaggtataacacccaaaaaggcaccagccaggtgcagtccctgccactaacagcacctcaccttttctgcctgtgccctccctacttaatgatctctctccgctcctactgacctcaaggtctctttcagagccttcagatgagatatttattttagtaggttggtgcaaaagtaattgctgtttttgccattgaaagtaatggcaggcagggcatggtggctcacgcctgtaatcccagcactttgggaggccgaggtgggcagatcacgaggtcaggagttcaagaccagcctggctaacatggtgaaaccctgtctctactaacaatacaaaaaaaattagccggacatggtggcacacccctgtagtctcagctacttgggaggctgaggcaggagaactgcttgaaccctgaagcggaggctgcagtgagctgaaatcacgccactgcactccagcctgggccacagagtgagactgtctcagaggaaaaaaaaaaaaaaaaagtaatggcaaaaactgcaattactttttctttttctttctgtttttttttttgtttgtttgtttgtttgtttgtttgtttgagacggagtctcactgtgtggcccaggctggagtgcagtggcgcaatcttggcttactgcagcctccgcctcccaggttcaagtgattctctcctgcctcagcctcccaataggattacaggcacccaccactatgcctggctaatttttgtatctttagcagagatggggtttcaccatgtttgccaggctggtctcgaactcctgatccacccacctcagcttcccaaagtgctgggattacaggcaggcatgagccatggtgcccgacatttttttttttttttctttttttttttgagacagagtctcactttgtcacccaggctggagtgcaaaggcaagatctcactgcagcctctgcctcctgggttaaagcgattctcccaccttagccccctgagtaggtgagattacaggcacatgccaccacacctgcctaatttttgtatttttaatagagagggggtttcaccattttgtccacgctggtctcgaactcctgacctcaagggattcgcccacctcagcctcccaaagtgctgggattacaggcatgagccaccacgcccgacctccttaactcttttatttccttgcacactttttctctgtagcccagctcacaacttaacatcctcttagacatacacctgaggttttttttttttttttttttgagagggagtctctctctgtcacccaggatggaatgcagtggtgtgctctcagctcactgcaaccttgcaaccactgcctcccaggttcaagcaattctcctgcctcagcctcccgagtagctgggactacagacacatgccgccacacctggctgattttttgttttttagtagagacagggtttcaccgtgttgcccaggctggtctcaaactcctgagttcaggcagtccgcctgccttagccttccaaaatgctgggattacaggcatgaggcaccgcgtcctgcctctgagttttttttttttttttttttactgtctcctagaacatcagccccagtagagcagggatctttgttctgttcaccactgagggtcctcattgggtcctagcacacacagttgctcaataaatgttgaataagtgggtaaagacagccacgagcttgcagatatgtgttcaaggtgtgtccttgcagagagcttctctatacttggcactggagaggcctgtcgtgggcaaggacatagatgtggcgacctcagacttgagaactcctggggcagtaggggagatggatgtggataatgtaaccataagccttcctttctattttagactgagtggtcaaggaaggcttccagacaatggaaattctgataggttctaagagggagaccagcaaggagctgaaccggaggctgacacagggtgagagtgggaatgtctattttattttttttttggagacagggtctcactctgttgctcaggcagcagtgcagtggcacgatcgtggctcactgcagcttcaacttcccagactcaagtgatcctcccacctcagcctcccaagcagctgggaatataggtgcatgccaccacatccggctaatttttgtatttttggtagaaacggggtttcaccatgttgcccaggctggtcttgaactcctgggttcaagtgatcttgctgccttgggctcccaaagtgcttggattacaggtgtgagcctgtgagccacatctggcctattttattttttaattagttttttgtttttgtttttgttttgagatggagtctctgtctccaaggctggagtgcagtggcacgatctcggctcactgtaacctccacctcccaagtagctgggattacaggcacatgccaccacgcctggctaatttttgtatctttagtagagacagggtttccccatgttggccaggctggtctcgaactcctgacctccggtgatccacctgcctcagtttccca

SEQ ID NO: 17972 - DNA, 90556 bp, Homo sapiens
agggacaacagttactaggagatagctagcaatctctggcacataagactttaccagacagtgagaaactgcacctccgatttatgcaactgacagtctaaactaggtttaaatcttggctttgcttcttgcaaactgggctttcctttggcacattttcttgtctgtgaaaaagagaccataaatggggagtaatgcttataaggtgtctgttggagcatctggtacatagtaggtggtcaacaatgaagtgtcccttttttcttctcctttctagaaaatatgaaactctggagagtctatcaggaaggctgtgttgtatagccactgagggcttagagcccacatttgctcatgggaatttcatcttctggccggacatacacactgagaggcagcagctggatagcttaagataaatgattttgaaagattctctgagcatacagagctcacagagattaaaggtaaaagccacaaggcagcaggatgtacaatacaaccaaagcctggcaatcaagttagacacatatgttatcttccatcatacctgggtagaatcagaaaccgctagagttgattagccgaggcccaatcaggcatttatcctgatagaaaagacacacccacccagaagattaaaaataaataaatggagccctgagactttttaaatcatgaaaatggaattaaaggctatttgtcactttcctgtcattttgtatcacaaagagacttgcagtctctgtgagcaagggtatttctccctcccatgcacccagcactccccgcaccaccatcagggaccctgtgccattgctggaaggtaaggtccaggttttcaatggctgactccttaggctctgtttttgggagggatctggggaatccttgagtcatgggctttgtacctattgttgttagacaaatatctaaacagggcttttcagctttagaaggtgcttgtgtgtgctttcttctagaaatccccccttcttctgacttgtccaagacatacaatgccagggtcactctcccttcctcttcccctcccagataggtttatataaaagcatgtgtatgtgtaagagagagagtgtttgagtgtgtgtgtgtgttgtatgtgtttgtgcttcctttggagttcaaatgcagcaaactactgatgggtttcctggacagaattacttgatatttgagctttttaatcttagcccttgacaaatattggccatcaggtgtttcatatttgttggtttttggttttttgttttttttttgagatggggtctcactctgtcacccaggctggagtgcagtggcacgatctcggctcactgcaacctctgtctcccaggttcaagtgattctcctgcctcagcctcctgagtagctgggactataggtgcgcaccaccacacatagctaatttttatatttttagtagagacagggtttcactgtgttggccaggctggtcttgaactcctgacctcaggcaatgcgcccgcctcggcctcccaaggtgcttggattacaggcgtgaaccactgtgccagcctagatgtttcatatttgaatatggaattgagacttgccctggaaatcatctttattctacagaaagcttaaagtcatccctgattttttagacaaccttgagattgtaaatttgttggtatgctatttcaaagtcaaaaatgtaccggaaagaacagtgttttattcaaattccaggtcctctacttcctggctttttttttttttaatactttaagttttagggtacatgtgcacattgtgcaggttagttacatatgtatacatgtgccatgctggtgtgctgcacccactaactcgtcatctagcattaggtatgtctcccgatgctatccctcccccctccccccaccccaccacagtccccacagtgtgatgttccccttcctgtgtccatgtgatctcattgttcaattcccacctatgagtgagaatatgcggtgtttggtttttttgttcttgcgatagtttactgagaatgatggtttccaatttcatccatgtccctacaaaggacatgaactcatcattttttatggctgcatagtattccatggtgtatatgtgccacttcctggctttttgaacttggaaaaaattacatgacttctccatgttgcagttccttatttgaaccttaccaccagaaagtaagttcattaaagcagattaatttttccctttggataactgatgttatgtaagttagagcagtacttagtccatagtaggtattcagtaaataactatcaaatgaatcaattacatgggaataataattctgtctcatgggatgactatgaagattaagtaagacaatatatgcaaaacatctggccctgagcctggctcttggtacttgtttaatggtggctgtcattattatttgggagtctctacatttgcatagtgctatgccgattaaaaatataccttaaatatagttttatatctcattttccagaaaatatgattacttattatcattgggaagagatcagcagaatctcctctcgttttctatctgtaaccactgtatgtggaaacattccatcagcatcccaccaaaattgctcttgtcaaggtgatcagtactcccatgttgctaagccagtggcatattctcagtgggtcctcatctcacatgacctatctacaccatcaacactgctggtcatccctctggagaagctttcttcacctggggtccgcatcttcttacgttgtctcttacatccttggttgcttcctcttgttctcctttacttgctccggctcttcttcccaaactcttaagttgactgcccaggtcctagtccctgggtttatatctgtgtcttcttcctgcattagtcagggccccagtaggaaatacctgggtaatttgaggagagtatgataatggggcattttataaatgtgagtacaattgaaacacactaacaatagataatgcagtatctggagctagaaacagtggagagcctgaaggggctagaagaagagtggctactttaactgaaaaagggtaacagaaattgtgagctggctggtgggagctatagcttttgatacagggacagagtcagcataaggcagctcagccaggagggtctgggtctttgatctcttgctcatgctcccattggctgaacccgaatagaaggcagaaatctcactgacagagtccaaataagccaggatagagaaggataggaggatggaacatggcaacagggaggcaaagggaggatagtcagcacacccgtaatgatcttactcagttccaaggctttcagtgccatcatatgctaaagactgtggactcatctctctgcttatggacatctcaacttggatccctaatggatatctccaagtcagcgtatgtaaagccaaactcttatctggaccctcttcaaacctgcaacacccacatctttcctgatctcagtccatgtcaaatccattctttcaattgctctggctaatgtcatcctcaatccatcttttcccctcatgtcccgtagcatgaaattttgcttcactgtctccactttcagtgtacatctaggttctaaataatttcatggttttcaaaaattgttattcaggtttttatttatttacatatttttagagacagggtcttgcattgtcacccaggctggagcgcagtggtgcaatcatagcttattacagccttgaactcctgggttcaaggaatcctcctacttcggcctcctgaatagctaggactataggcgtgtgctactcctggctaatttttaaattttttgtagagatgggggtctcactatgttgcctaggctggtcttgaactcctggcttccagtgatcctcccgcgtcaacttcccaaagtgctgtggtttcaggcatgagccaccgtgcctggctgttatttatgtttttaatggtgcattattcagtaaaaagactttgaacatgcctacttgtgcagagcattaggctaggggctgatgaggcaatggtgaacaagccacacaaggtctctcccttagtggagcttacagtccagtggggaagcatgtcatgatcacatgtctaagatactttctagccacacttcatatcagtagacatgacttcaattttgaagttttggaacgtaatccattgagttgagcgctagccgtacgctgcctgtgtggcgatttggtggataagtatattacacagagcagtttagagaaaggccagcatcattattggcttacaactctttgcccctgtttttctttcaacgcttttctgtcctcaacactttctagacatcctatatcccatgactcatctctcctgccgtttgcttgttgccattctgaattccttcattctcctgttcttatgactctattccactaaacacttgcggtgtttcattttagttttactctcactgcttagtacccatccttctatgtgtccccagtgggactttgtatggcagacacatctgacagcaataactcaagcataccctgagaataatcctatggtctaagaagaatgtgagttcagagtttggagctaaggaacccagcaggggccagcctggagattcactccttatctatgaaggacatccgaacccctggcccattccttggaatgcaggtcatacaggggattgaggccctttattgtgggttaaagggaggctgctaggtgtgggttggtaggtggagtttgctaagtgaaaatactatagaaactgcatgctttttacaaacagtagtggtttttctgtctgctcactgctcctggactgccatgtatgtaagtcctcaaaacaccctgggtctcctttgttggccctgggtctcttctttgacctctgggacatcgtgccatccctgctggagtcagtaggggtctggcacaacagacctcaccttctgactatgatgaaatatcatgtaacagactgatgcttcctctgagagaaactagaaaagctggagaaagtaaaatataaaattaaaggcatacgtgaatgatggaggctgcctatatttgaagggtaagatcataggcggcagaaatgttctttgaggttagaccaggttctgcatgctgcttaccttgggggacatttgctggcccctgagcaggggtgaagccagctgaggtttcctcaacctcaaggggtttgggagacagaaattggaatttggggtcagtaaggacttaaagctaggacttgatgggtgaagatttcagagagaaaggaagtgtgaaggagtagccttgcttaatatcagttttccctcaatatatgttacttaagctgttcgtgaggagagccacaaagccaagtgcaaagcagctgcagtggagcagggtttctggtagactcacggtgctagggaagcaaaatattaaagtgtgggatctacccaagaggagaggccctgggaagcactccaggcattaagtcagaacttctgcagtgctgtgcttcaggagaaggtatgaaccaggaatggatcaaggtattcaaatatcgcattgagcctcggcttgctcacagcccagttgcatttaggtgatctccttctttgccagcttccagaggacagagcaaatcctcttttgaaccagtaatgaagggagagagatatcatccagaacctctgtaacttttcaaagatgatgtccagtatccaacaaaaattaccggggatactaataaacaagaccaagggaaaaaataaaatagacaaactaaaaacactcacaggtttctctgatgttggagttatcagacatagacttcaaattgagtgactgatattcaaaaaagcatatgacaagatggagaatgtcaaaagtatatgacaaggtggagaatttgagtacattccagttcctagtagtcagtgctgagctgtggacatgggtctgttccgcagggtggggtttgttaaagttgtcaagtataaggcctactgtaagagataccaagtgacwtttagaagacagtgtgagggtaaaactgattactatgcttggaaacacttagtggtacaggataaaaataagtctaacacacacaaatacagaatgattatttgtgtgataaatacagataccatttgtgagatggcttatgcccatatagaatgggacatgatagtctgtgcagcttatgcacacgaacttccaaaatacggtgtaaaggttggcctgacaaatgaygctgcagcatgttgtactggcctgctgctggcatgcaggcttctcagtaggtttggcatggacaagatctataaaggccaagtggaggtaaccagagatgaatacaacgtgggaagcactgatggtcagccaggtgcctttacctgctgtttggatgcaggccttgccagaaccaccactgacaataaagtttttggggctctgagagtgctgtggatggaggtttctctatccctcacagtgcctaacgattccctggttatggttctgaaatcaaggagcttaatgctgaaatgcatcagaagcacatcatgggtcagaatgttgcagattctgcaacgtgcattacctaatggaagatgcttgcaaggcaagaacctttattgtagtttccatgggaaggaatggatgaggcaaggtaagcaagcttaggatcgactagttagaataatttcagcaggccctgggatgtaggggctttcctgaattgtctgacacctggtcctgggatgattaggcaagggaatattggcctcgagtgtaagagcctgatagaagaggtgggagaggagtgggctctggattggttggtttgtgtatgaaagggcactcatagtaccatctctgggaattgactagccctaggaatccagtttctccagggtgggtaaggccctcatgggtcaaaacattagctaaaaagacatgcttcatataagcaatagctgaggctcatacatccatgcatttctgcttctatcactttagcagcatacttagtaggagttagttgtgtttggaccaaaatctgttaatgacagttatacttaacaataaaattatgatttagggaaatgttatatgaattagtgaagttgttatttctttgaaaactaaataggaaagtcttgatgagaaaaactacttttaagtatatgtgggttaggtgcaactggaaaaaaaaaaagaaaaaagtcctgaagattccacagcagtgtggaactctcttattaattctacttacagatatctcttgagttttcctttttggacaatgcgacaactggcagttttttgttttttttttttttcttgtttccaatctttgtaggttttctttctttttcttactatgctggcaggatctccaatacaatgttggctagaggtgctggtcacaggtttccttgccctgttttttatttcagaaagaatactttcagtgattgccattagaaatagcatttgctgtaggattttaatagataatttaaaaaatcaggttaaggaatttcctttatatttctagtttgctaagagtttttaatcatttataggtattcccacttattttatacctgccactttgagggatgctcttctcgtaccactgagaaattgtctactttctagtgccttatagtcaaattcacaattcctcatttgttttcaatgagggaggcttgcttcctggctcatcttttgtgtaccataaagtatgtcaatatgcagaagcaaatcaaatttatttatttatttatttttgagacggagttttgctcttgttgcccaagctggagtgcaatggtgcaatcacggctcactgcaacctccgtctcccaggttcattgactctcctgcctcagcctcccgagtagctgggattacaggcttgcgccaccatgcgcagctaattatttgtatttttagtagaaatggggtttcaccatgtttgccaagtctcaaactcctgacctcaggtgatctgcctgcctcggcctcccaaaatgctgggattccaggcgtgagccaccattctcgtcccacaaatcaaatttctaaacattggcattgtgtcaccccacactgtgtgacccttaatgtcaatactgtctgatatggtttggctgtgtccccacccaaatctcaacttgaattgtatctcacataagtcccacgtgttgtgggagggacccagggggaggtaattgaatcatgggagccagtgtttcccatgctattctcgagatagtgagtaagtctcacaagatctgatgggtttatcaggggtttctgcttttgctccttctctcattctctcttgctgctgccaygtaagaagtatctttcaccctccgccatgattgtgagagtttccctagccatgtggaactgtaagtccaattaaacctctttttgttcccagtttcagtatgtctttatcagcagcgtcaaaatgaactaatacactrwcttacatatgagttgccagaaacgagacacttcatgctgtataaaatgcataaaaatgcaaaatatacattgcatattcggagtcagctgacttaatggagctttatggcgagtgagactccatgtccttcggatctatttctcttttattgtatgtgagaattttacttgcatcaccaatttcaataaccctgagatctcagcacagcagtggaataacaatgacagtggcaacagcccaaagagagagattgttttttgaaagtcaacgaaaattcaactctaatctatatattttctataatctatgttttcctgaaatggaaaagcctgtctctccccatggctgggggaagcataaaagctcagtgactcaaggaaaggtttcagactgctcttgatcagcctctttattttcttgtcattctatcccccacactgttccctagtcctcatcctgacatctgtttttttaatcactgtcattgaaaacaagtgtggtgctgtctgaaatccacaaaaagcaacctccggggaagaaaatataaatcataggtgtgtaaatcatcagccctgagagttggcatactgttgacttgcctaagagtctgcattttcatttagtggggaaaatcagctttgatgcacatgattggtgggggtggtggggaacatatgaaacacaatgactcagaactggcaaaagtctgcgtgtggagagagggagattggtggattcattctggcatctaatcagtccctgagaactgtgaggaaattgaaaggggccagcttatcagcatattgacatgcaatgaaagccccttaaatgcttcccaatccctatgcagaagaagcggagaaggaaaaccactgtcattggaaaaaawtatttggcagaacattctctttaacgagcagattcattcattttctgggaaacatactagcgttttgcctctatcacactaaaagaactggctggtgcaatcarttccacagaacacccatcaattcagttaaacaaccagtggggtggaaaacccccagaaatcaatagtagttgtttcactgaattgatgggttactgcgagtcgttcagatccatcggttgacttgtgtgttcagttgctgccttgtctgtggtgttgcgtgggaccttcaggccagagacagaccctgctggaaggcctacaaagtgcaaggtgacagacagagaggtacaggctccccatggccagtgggtgtcacttctgctgggaagatccttgctgcaatgtgcagccatcattgctactggcagctcacctctagtgagggtgatggtgaatagttttaacaagccaccactggctgagtgcctttgatgagggaggtgcttttaaaatattattacttacattttaacaaaccagcaaagtagaaattatccctccctgctcttttcttgcttgaggattgaagagaagcagggagaggcatagccaggaacctgcctctgttcattgtcaaagccagagttctgttcaggatgtcatccacccctcatccatgcatagcatagtggctgagaactgtaggttctggaatctgacaaagatggttcaaatcctggcatctctacttattgtgggatgtttggcaatttacttaactggtttcagtttcaattttcccatctgcaaaatgggaataatatctagtcattgaaggaatgaatacaagaatgtacacaaagtccactgtgtaaggcctgggaataatgtggcaaagcctggttttttgttgttgtttgtttgttttttaaaaacgttatttttggtactgtcactaagggtggtgacttgagcttgtcctaaactcactttaaggctgcacgccttcctctttcctctttccttgctcttgccacttacaaatcctctgagagattttaaatcttttgtgagagccagaacacaggtgtcaatatttaattgtcaagttctgaattttagtgaatatttattacttcacaatacacgaggcttctgttgaccctgctttatttatctaacattaaaaaaacaccagttggttgcctcttcatgctggcatggtctgctcctgtacaagcgtgtgtaggggtgcagtaaggaacaaagggggtttcaacaaaggctcgctggccacaaatagctcactcacctgcatggcagaagaaggcaagaagtgcctacaaaaacactggcagtacaaatccagccatgtctacaaagttcacgagcaggcaaaatgaacctaaggcaatagaagtcagtccattggccacctctttggtgtgggaattttatttcattttattttattttattttattttatcttttgagatggagtctcgctctgtcgcccaggctggagtgcagtggcacaatctcagctcactgcaacctccacctcctgggttcaggtgattcttctgcctcagctgccagagtagctgggactacacgtgcacaccactgcgctcagctaatttttgtatttttagtagggatggggtttcaccatgttgaccaggctggtctcgaactcctgacctcaaacgatccgtccgcctcggcctcccaaagtgctgggattacaggcggcagccaccgctcctggccagtgtgggaattgatggggaaagggcagagggagcctctggggtgctggaagtgttctaggcctggatctggacatctgcacatataacactggagctgtgcatttacaatttgtgccctttatgtatgctctacttcaattaaggagaactgaaattttaaataactatagaaaaagcaccactagtgctgttgctcagcaggatgtgaagatatgtaatacgagaagctgtactcagccacctatggcactgggtaacaattgcgtggattattcccttgcaacagagtgaactggcctgaatgagagctggcctaggcagacaattacagtgtggaaaatggggacacaccccatcaccagatgcccatgagagctgaacaatattcagattccttatctctccttaacaatagtaactaccctgatcaagtacctattcagttctaagtgctttgtagataccgattttttccactagtctttacaataatcttatatggtaggtgtcttttgttccattttatcactgaatcaatagtttaaagagaccttataacaagtaaggggtgaagcaagattttaaccttggtctgtgtggccttttgatcagtaccataggctctgaagacagatttcctgggtttgagttccagctcctcatttcctttctgtgtaaatgtgggtaagttccttgacctctctgtgccttaattttctcatcttcaggaaagggcgtagtggcagctatgtatcacagagttatttgagttaatctgtgtaaaacacttagaacacagtatgcacttggcacatagtaagagctatacatgtgttaccgattactctgttgaatgacacaggctttcaaatggaagggccaaatcccattattttctgggatataaagtagaaatataggcctagccaaactgtttgctccctacctccctcctatgggttaacatagccccgaatcctaggcacgtggcaggcccatgggactgctttccttcttccccaagagaacccctgggttacaggccgggggtggggtcaaggtcccctgtcactccagatctctcctgccacccgtatcctcaaggtggcctaagagaaaatgttgttccaggcttgttggcagttcctacctacactgatgtcaggcacaggggagtctggaagctgttgaaatgaggacttttccagcttgtgccatcaggttttctgcctggatctccaaccccattcccatctggattctggtaattttcccctccctgaccacgtggtgacagttgtccttgtgtgaacaagaccccgcctctgaggtcacctgtgatgcctgaccagagtctcttccccagaagtcaagacttggaagtaagaaatggtaacatcagttgagattgtctttgaatggaagagatataaatagaagaatgcggtagccgttttccatcttgtccacttggaaatatactgagaaaggaagtgtgcagcgagtgtgagaggtaaagcagagcctcagataagagtggggaccaggagcagagattgagagaggtgggtcactctgaggcctgagccactgtgggatcacccagcatcctcatctgcaaattacccctcctgcttaaactggctgtagtgggtttccagcgctcatacttgaagagttcacacaaatacacctggactgagtaattcaaggaacaaaattcattgcatgaagcaattttcttggaagcctttcttgaatcccctaaattgggttaggagctcctctcaaacacagctgcttccctttccccatggacttacttgtatcttagccctagttatactcttcttaaaaatatgtctgtattaaaaaagttatctttaaaacccacaaggagtttccaaaatgtagtttttttgagttgcaatctttaaatgtttaggtcttattcatgtagctcctgcattatttatttattttaataacaacataataggctttaatatttagcttatatttattcattttacatgaactcctttttaaattgagcatcatccaggagatagttaagaattgagggtttgaggtattagatatatatttctaaacatacgttaaactgaatatgtacctattaaaaagaaaagataaaacgtwctacctaagatcatctcacgtaccactttggaaactcctgtcctaccttaccggccccttaaaagcaggacagtgactcatgcacagcctgctttctacccttgggctcagggcccaacatttcccctttatagaacttttcacaagaaaccgtcgaatgtgcaattagtttacttgtctgacttgcatggaagacccttccatgcattgtttactgctttatcctcagtgtcttcaacgaggtctggcacgtagctgaggtttaatacatatgcattggaagaaataatgcatgcattgataaatgaaaaccagttccagaatgttctacagccatgaatgtcaatacatgctgcttctgactggtggggacacttgagggtgagcactcttgctcagtctcttacttttctcgcttgctccactctggtggtgacactatcaggtcaaayatggaaagtctttagtccttagttccattggctgaagcagaacagtcctccgacactgtgattcatacgcaccctaactgggcatgtgcagagccagctgtataattgtataatttaaacagcccagttcaaaatgaaaatgtgtgttcaaaaagcaggagtccctatgactcagcaattccacttccaaacatacccaacagaatcgaaagcagggactcaaagagatagttgcatamcgtgttcatggcagcattacttacaatagccaaaaggtggaacttaaatgtccatctacagatgaatggataaacaaaatgtgacatagacacacaatggaatattattcagcttaaaaaaggaaggaaattctgacacatgctactcacgaagaaccccaaggacattatgctgagtgaaataagccagtcacaaaaacacaaaagctgtatgattcacttgtrtgacgtaccggagttgtcaaattcatagagataggaagtagaatggtggttgtcaggggctgggggtaggggaaaatggggagtaatgggtatcacattttagttttgcaagaagaaaacagttttgaagatgggttgggtcaggcatggtggctcaatcctgtaatctcagcactctgggaggccgaggcggtagattgcttgagcccaggagtctgagacccgcctggacaacatggcgaaatcctttctctactaaacatacaaaacttagctaggaatgcacctgtagtcccagctatttgggaggctgaggtgggagaatcacttgagctcaggagacggaggttgcagtgagctgagagattgcatcactgcattccagcctgggcgacaaagcgagatcctgtctccaaaaaaaaaaaaaaaaaaaaaaaaaagaaaaaaaacagaaagcaagaaaatgggttgataacaacgtgaatgtatttaacacaactgagcagtacacttaaaatggttaagagagtaattttatgttacataatttttactacaattttttttaaagtaggagaaaagctttctctctcacagtctctatctctgtctctctctctctctctgtcatgtttttttatttggtattgagtgtcacactcccttgggcacaagcataggcattgggtgagtgcagacacttataggtgcccaggacctcatcttgatgccctgggcatgcagggggtgcatgcctggctcccacactctgaggagggcaggaaaagggggcagtggttgctcagcaggaccctatggagggagcaggaaaaaggggcagtggtcacttggcaggacaggggagggggtgttgaagaacccttgctagggaggcggcaggtgcaatggcaggagctgaggctccaagtctttggcacataacttgacttacaaaacattaattcaaagatacaatcattaagagttttaagattgccactgcagagcactaaacctcaatcccttctgtgtgtggggctgggcaagtgcactgtatacagtccccaagaagccagccctggttgtgctgcagaaacataacaaaacatcaaccccgcagcaggtgtccccagggtgcccgcgaacatgacgcagctctgcatgtatgggatccacagccagcagacatgtggctcgagcatagcaaagaggctggagggattgagtcactaagccagtgagccttaaagggttatctgtggatttcccaggactagggcttaggtttgccagagccaccctgacctctttttactgatggtagaagtaaattgaggctcagtgatttgaagatttagctgttagagtaaattattttgggattgaggtcatcaagcaggagaaaaactttgcactatcagaatgctagagctgaagttgtgttttctaaaaaagaaatgggttaggctgaggcaggaggatcatttgagaccagaagtttgacaccagcctgggcaacagagcaagaaccccatctctaaaaaatatttaaacattagccaggtatggtggcatgcacctgtagttccagctattcagagaaactgagctgagaggatcactagagcccaggaggtcagggctgcagtgagccaggttcgtgccactgcacttcagccctggcaacagagtgagaccccatctcttaaaaaataaataaatggaagaactgggtgatgtttgtaaccaagtgtttataaaataaagcctgctaaatgtttccacaggagacgtacagcctgatggtgtatgtgatgtctatgtagatgctgagaaacgacacagagctggagtgcaccgttctaagcatggtcacatagcagtaggaatgttctgagggacctccatgctatcagggttacatatgtaaacaatttctggaacctgtttctttctttccacactgtggtgagtatgagaatattgttatttggggcagtgattcttaaactgtcatgcacctatgaatcccctgggatcttgttagaatgaagattctctcctggtagggctgggctgggccagagattctgcatttctaacaagctcccacgtgactcctggaccatactttgaggatcaagggtctagaccagcctggacaataaaaaactgcttccttcttcagcattcatgtctaaataaaaggccctgggaccatgtaagtccagaatagtacagaccccttctatcaggcttctaggttaagctgaaatgtctcctctgctccaggaagccttccttggctcccccaggcaaaggggagcaccatcagctcagtgctccctcagggcttggtacatgcatgtttagtgcatagcatgttgctttacctgcatgtgcagaattttctctccctactggactatgtgtctctggaatgccgggcatatttgcattggcagggtcagtgcctggtcatagaaggtgcttatattgatttcctattactgctggaacaaatcatcaccaacttagtggcttaaagcaatatgaagttctctaggttagatgtccaacacaggtctcactgggctaaaaatcaaggtgtccgcagggttcagttccttctagaggctctagggaagaatctgagtttttgtttgtttgtttgtttgttttttcttttytttttccttttccagcttttggggctacctgcatttcttggcttctggccccttcctctgtcttgaaagtcagcaatggtgtgctgagtctctctcacatttcatttttctgccctctcctgccaccctcttccatttttaagaaagataatctggaaaatccccccatcttaacctgattagcagccttaattccctttaccatgtggtgtaacatattcgcatatgtaacattaccatgtrgtgtgacatattcacaggttgcagggattcatgtgtrgacgtctttaggggctgttattctgtctactacaatgtttgactagtgtctatagagtgaatttgtgcctgtgattggccttatgcacacagctcaggccaggggggttctgaagagttgaagattctacagctctgtacttgctgtggccaatttttttggtagcatttctggtatttttcatttagctgggattatttctgacttctggcatctcagaagacattggtagccttttgattctagtcatccatacacaggcaagatctgcatagaaccaaggaattcagtttacctcagcragtgctaatgcagctctagttttagttttcattctgggatggaacaacatagccccagttgttgagggtctctctgygagtatctttctggtggcacaagcagtgacccctaggcaaattgatgggctcatctggattagtccactgyattttttaggatggccaaagctgctttctggaaagaaagaggttctgttatacagccagtcttcttgaaaaatgtttgtagaactgctgaaagtatatataatttacgcagaatttatgccaratttgggctgaatatatatgttttggttgtgaccaggacggaggagtgtgttaacagaagcaactttcttaaagcctcccttcccgtgtgattgaagttctaatattacttcctaagggactacattgaacctgttccaagtatataataagaataaagcccagtattgattcccccagtcgccccagtaggatacgctggtggctgtaaatttgaaaattgtgacatacaatgaccaagtgctcaaagatgtttgttttcactgtgaccaagtgaccaagggctgcctgttaaaaaatatccccaattctggagaaatgtgggggtcccacaaacgacaccacagtaaatgaaaatgtcagcagtaaaagctgatcatgtgtttttgtctacataattttgtccataattcttgtgcaattctgttatggcacttcaaaagggaagcttctttaaaactggttttatatctacggaaaattctaacttctaaatacaaaggtctgagtttattcgtcaaatatttcatttatccatgcaaagttctaagatgatgtaaataatgtgtatcttctactgttttctgggaagagtgctatttcttgggctaagatatagactcttgaagacagggttagtgttagtatctttttgttcttgctgtttctggcaccatctcaactctgcctaaaaacgtcagagaaagccttcctacagaggaagggacaagagaggtgcttattattgatgatgaagagaaatattcatgctaaatgacttcaaagatataactgtttcccgaactgagcaaaatgagtttgcactggaaaaacataattgcctttggctcatagtggcttcactatgcgtctaccttgtgctacctctcttgtgtgtctgggggctggagtggatcaatgagaaccaggctaccattgatcaagcagaatggtgataatgaccagaccaaaggatatttttttcagcttgaatgtccagggtcaatgcttctggctgtctcaaagggaagaagcagttacagcattgttcaaaatggctcttyagagaaatcatttctagctcactccatttgcatctgtatttcagatttgctaggtttcctttgcaaacattttcacttattaccctttatcacctttgctaattaaggaagatacagaaaccagatttttagggttttttttttttttttttcaatttcagcctytggccacttcctataaaagatttccctctgctttgaataaaatttctaagcagccttcagagccaaattaaatgatttggaattctctctagctagctgatctttagctgcagagatcaagaaccccatctagtgggaaaatatgaagctgccaccgcagtgacggactgaaattagcagcgtggttgaaattcttgcccagcccttcttgtggagcacaagaaggcctctgcagaagcctcattcagaatctcgaaactatcagcctttcaaactgtgtggggcaggaggtgggcagtcagaaagatgctttgtgaggggaaggaaaacagcacccattcccctctgcagagtaaagggaagcctggccccaggaaggagcagctgcctgcaagagggagcctgagccgtggagtcctgggagcctttgaggtgggcagccagggcgtggaggcagcagcaagcccaaacggtcaatacgggcccagctggggcctggcggcggagggtaccctcaaagagccctggctcctgaggccagcggggcatttgggccctcagccagttagggggtttgttcttccttttcctaaggcacgtcgctgcccagtgggagtgggttcctgtccataagccagaagccccaccatgtggtggagggaaaggatgactttccttctcatccccaggtgtcattggacccccctccagggggacctcaggggattgcatgagctgtgctcttccttcgtgagcctcctggctctgcagggggctgccggcttttaccttacagctcttcactgaaatgtcacctccctgtggggcttcctgccaccaccattgttctctgcatggcaccctgtgggcgtccttcatgatgcctatcacaccatttaagatgttttcctgtgcgtcgctctcctcccctgctgagggcaggggccgtgcgtgtgtgctatgttgctgacgtagtccttcctgctgcagtgcctggcacagggcaggcgctcccttgtctctgtaaagaratgaagaggcttggctgagcccaaggactgggaggcaggctgctggcaaggcctggggagacctctccctggctggcccttgtttcttttccttcctctccactagaagtaatcataggggtccaatttgccatgggattttacggaaatcacatgggtcaaagtgctatgcagatgcaaagcgtcatccagtgctgtttcatttccatttgcttggttccatgtgttgggggagggtccaccagcacccagagcccagggaccctatgattctgtcatatacagagtggcaaacgtcagacataggaggcccttgcagtcccctaatccggggcttctcaagccctctccatatgtgagaatcaactgagccgttttattagccacagacccgttcctccctgctggaggttctgatttaattggtctgtgaggaggatcaggcatgggtatttttaaacatctctcaggtgattgattctaatgtgcaactagggttgaagacctggaccaaatccaccccttggttgtttttttttgtttgtttttttttgagacacagtcttgctctgttgcccaggctggagtgcaatggtgcgatctcagctcactgcaacctctgcctcccgggttcaagcgattctccagcctcagcctcccgagtagctgggattacaggcacccgccatcatgcccggctaatttttgtgtttttgtagagatggggttccactatgttrgccaggctcgtctcgaactcctgacctcaggtratccacccacctcggcctcccaaagtactgggattacaggcatgagccaccatacctggcctcaccccttgcrtttaaaatgagtcccacagagccctggaggatcacagcagccactgtcccatggtcagcagagccatgactgggacccaggcccctgccccttctctcacaggcacggagggagctaggccacaggcaccaaagcgggatttgtcctatagcaggactgactctcacagagactgttctcctgtgtaggagataagaaagggggtccccaccacacctagtccaaggtctgagagcaatgtgtagatgctatgcagatgcagaacaggaaatggtgcagcatccacaccccagcagagtacctgggagggggacacatggtcagtacctgggacttccctgggatgccacctctcccctggcctgcccccaccttttgcagctgcagctgttttactgcttccagcaagggtaggcaatcctgaggttgatagaagcctagggaagtactgtgagctttgacactgaccaggggatcaaagcgggccactgcaggttgaggaacctggtttggtgatgggtgcaggccagacagacactgagatagagaaacccagagctctgggcaatgtgaaaggaaaataagtctcaggtttcccaaatcactaagctaaagggaaaagtcaagctgggaactgcttagggcaaacccacctcccattctattcaaagttatccctctgctcactgagataaatgtgtatttgattgcctcctttggaagagctaatcagaaactgaaaagaatgcaaccatttgtctcttatctaccaaagacctggaagccccctccccactgtgagtcctttgcttcaagttgttctgcctttccagatcaaaccaatgctcatcttacatatattgattgatgtctcatgtctccctaaaatgtataaaaccaagttgtgctcagaccaccttgggcacatgttatcaggacctcctgaggctgtgtcatgggcgtgcgtccttaactttggcaaaataaacttcttaaactgattgacagctgtctcggatattcgaggttcacagcaagaagagattttatttgcatttcaggggacacaacaggcttgttttgttccacatggaccgtagctgacagatgaagaaaggggtaaggaatccgtcaatacaaaagtgagtttcctgtgttatctctgattgaggcagggatctcagatgtccatttatcagaggctttgggtatcaaagcttgggggtgttccaaaataggttaattttgggtgccttttatatatttatattattttttatttaaacaaattttaaagttttatttaggtaagaacatttaacatgagatttaccctttcaataatgtttaaatgtacaacacagtattatctacaggcacaatattgcacagcattgctctagaacttatttgtcttgtcttctatgaaccccgaaaagttgagacaggtctcagttaatttagaaagtttattttgccaaggttgagaacttgctcgtgacacagcctcaggaagtcctgagacatgtgcccaaggtggtcagagcacarcttggttttatacattgaaggagacatgagacgtcaatcaatatatgttagaagtacattggttcggtctggaaaggtgggataacttgaagcaaaggcaggaagactggaagcagagagggagcttccaggtcacagatgggtgatacatattcttttgagtttctgattagtctttccaaaggaggcaatcagatatgcacctgtctcagtgagcagaggagtgactttgaatagaatgggaggcaagtttgccctaagcagttcccagcttgagttttctttagtgattttgggggcccaagatattctcctttaacatttccccsctttttwaaaaaaatcttttggagaaagcattttacaagaaaatgaatctctggtctcaggtttcatctgatctctcatggctaggatggtttatttctagatgggtaggtctggaaagctcatttttagcaggttatgaagtctcatgtcctgtgaagagaaaataggaagagaaagggagaaaaaacagaaacaaaagaacaatcctggaaaaaaaaaatcgatatagaccacattactctgaagtccatatattaataggcaggtatgaaagtggcttatgtatgtaaataggttactgttattttcttctgaagcttaagttctctggcttcagttcacagggttttaaaaaagcacagcttagttttcagtgattccaaattaggaaaaatgaaaaagagaaggaaaaaaaattgaaaacattattttgaagacttgtagccaagaaaaattagaatttggtccaaactgtagaaaataataaaaataggaaaaaacattaggcaagactagaatctaacaacaggtgtacaatcattttgaaacaatttttttctctctccagtttcccattttactaaagacaaatcatggtaagactggtttgcttattatacttggcctaattatttgtatacattgcagtaagaataattagtttttacataggcttttaaattggctttgatgggactttgttccataggaggaatctcagataagacttttctaaagccaggcccagccctgggttgtgccatcaaatacccatgagttgggtgaaatttccttttcttttgaggttccaagataaatctggggcttctacacctgtcagaaagtgacattctttacttaccacaggtcacaaaccctgtatagggactgtgtacacaaaatatgaggccagtttttccaagggctttattggctccataaatcaagtttgattccttaraggaaagcacatcattccagtcaaagccttggtaaaataaccagtttctccagttgggtcctgttacaaatgaaaacagattcttattgcacttatgcaaataattgtattgccataagttaagaatactcacaagtagtttccaattctggagaaatcaggtagagagaaacaaatatgctctaaattttgttcataagagtacactaaattgttaaaagctgtcaatagctcaaaagaaagttttaagactcagaaaaacaaaacaaaggatcagcaaacatattaagcaaaaagtaaaaaagattggttaagtccatgcagttaattcctattctgcttgatactcatgaacattttagctctccatgagtcctgaaagtttttcctctgttctgatgtcacagtctccaaagttatcagaaacctgtattcaagagctcctgttggagatttatagttgattataaaatcaccttctaaagaggaccaaaacaagacaacaattgtccattgatgaaaaaaaagttttaagggagccatagttaaaagacacaattgacaaggaaattagttacctccatggcacacaattttaatrtaacaattatgattattactgataatgtacactaagttatatcagaattacaggagtttcccataattttggaacacataccaataatatatttatacaaatacagcccaaagaaaaccaaacaccattttgtatttgacaatgcttcccgtataattttttataccaaataagccacattatgtcatttttgaactttagcgaacctaatgccttaaaggattaattaggttagaaaaagacataattcataatttgattttggaaagttggtcaaatataaaaggtttaaaacacttgatattacaaaataggattacaggtcattgtamagtcatttatttaaccaaagtgataattcaaggatttcaaaaaagcgaaaaccttcattctttgagagaggagacttcattttctaaacaaggggccctagtataaacagcatgaagccaattacattagttttttaaaattttgtaaacaatcttcattatataatataacttccataagtcttttataacctttattaaggagttggttaatgctttaagaaaaccttgttaatctgacacagggctccatatactggttttgcatcaatgtgcctttgacattaayaattaatttgtagagaaactgaacttattttatctttcaaaatkggcccttacaatcttatgcgcccacctcttccccmatagtccctcagtcttgaggagttgaatagctttcatttcttgccctgtgtctcaggaatgcagcttattttgattagcatcttctatggggcctgaagatgaggctttaattgctgtcagtgtttaagatttagcaggacttggtgtcctttttggacccaggagttaaaagctctgtaactcaatgttataaggactttaaaagcatatacaggaagatacatggatgtaatgaccttaatttaaaaaattttttaatctcaattctttttcctgagcaaaccaaaacttaataacaatatgacaacttgattatataaaagtttcaggtttttaaaaaatatatagatcctcttattgtggcttacactgaccgttcatgacattgtcggactttctgatttgttctgaacatccctcctttttaaacaaccagttactttattttagaactaaatttaccatagaagattctttcttatataaaattatttttctttaagcttttttacctaaaaaaattacctctttatttgtattactttctttacatatttttttagttcctggttccttttaccttgttttatacataactctgaaataagctttaaattaggcaaaacttgttcactttttttttataaaaaaggacacacttctttttcttctttctttttttttttttaagcagaaatgttttccyacaatatatatttattggaaaacacccaaatactgaaatatctattaatttaatttaactttctattctaaattatgaccagtttgtctacaagtatttatcccattacatttacctaattactttattttagttgtttatgtagattatttatgaaaactgtgatagtcatgatttaaagttctgaaactgccattgcaaaattataactaagacagtaaaaaaaagatttcacctaattggcttcatctttctcataacttccaagctatccttgtttattcctgggcataagctgaattaacgttgggaggaacttagtttatagtttagctttgacacaaaggtgataacagttctttcccaaaacaaacctacttattgtctatggactaggctgcctaaagtcccaggattagaagctatggtaatattactaaattcaagatgcagctattttcattaaacctgtatcaatgtcttatttattaaattacataagcgaagatcattttgatttgggctgggtttgtagttttgtaatccctatgccaaattttgacaccttatagtatttggcagggataagtatgaaattgcctgattaataaatgcaaacaaaaatgtatgctggcaattcttaagacatttctaatataactytaccaataattttaaagctggcttatttattaaagattttacttaagttacataaacttgaaaaagcatttgactaatcttttctttcttattatctaatttaagtggtttttttttgagatggagtctaactctgtcacccaggctggagtgcagtggtgggatctcggttcactgcaacctctgccccccaggttcaagcgattctcctgcctcagcctcccaagtagttgggattacaggtgctcaccaccatgcccagctaatttttgtatttttagtagagatggagtttcaccatgttggccaggctggtctcgaactcctgacctcatgacccgcccacctcagcctcccaaagtactgagattacaagtgtgagccactgcacctagccttttatttttctttaagccaattaattagagctcttttatatatatttagtaatgaaacattctgtacccaacacataaatacatataaaaacgtattaggcctgctgatggaagtacattttatagattcatagagtcccccactttttttaaacagacacttctgagtgtctaaactacattcttccttaaaaacccaagagtgtcctctgttgcagaactgttttagtcaaaaaatcaggtggaaacagaattcattcaactgagaaaaaaaaaacaaaaaaaaacctttggctcaaaaaaaaagacaaggtcttaggagagaaaaacaaaaaatccccccaaaatacaaaggccttttaaatacaaacatgcatacacacacacacacacacacacacacacacacacacacacacacctcccttcgatgttagccttttaattaagctgacttttagctattgagctcctttaacaaaaaaaaaaaattttttttaatcttattaccatatttcagctaggacaaaatgctgctaaactaacaataatcacacaaattatgatttctgagcggtctaagtgtaagcagaaatgaacacgagctggttgttaatgctaacttgagtagtttgaaaagaatttgcaagacagaatcccaaaccagttttttacctagtgatgggtctcagctgtagaatggtctctaccatcctagaagtgggaaaaaaccttcatcttccctgttggaagcaagctcaaactccataaaggagtgacctcccttccatcgtcatggaagcaggaaaacttactttcctgttggaagcaagtaaaactccaaaataataataataatgaggagttttacagcaaaataaactttagatctcaacctaattttgggagaacagggattctctggagggggtgccctcagacctcagcaaattgtcctattggtttgagccataaagttagctcatgctggtaccaagcattgataggagatttgtcaaaggtcaggggcatctccattcagaatccccccatggttaccaaaatatgaaccccgaaaattcaagacagatctcagttaatttagaaagtttattttgccaaggttgaggacgtgctcgtgtcacagcctcaggaagtcctgacgacatgtgctgaaggtggtcagggcacagcttggttttatacattgagggagacatgagacatcaatcagtatatctaagaagtacattggtttggtctggaaaggcgggacaacttgaagcaaactcaggaagactggaagcagggagggagcttctaggtcacagatgggtgatatacaagtggttacattcttttgagtttctgattagtctttccaaaggaggcaaatcagatatgcacctatctcagtgagcagaggagtgactttgaatagaatgggaggcaagtttgccctaagcagttcccagcttgagttttccttcgtgattttgggggcccaagatattttctttcacacttcttaccaaaaaagggtcgcaatccagaccccaagagagggttcttggatctcacacaacaaagaaatcaaggtgaatccatacagtaaagtgaaagcaagtttattaggaaagtaaaggaataacaaaatggctagtccataggcagagcagctctgagggctgctggttgctcatttttatggtgatttcttcattatatggtaaataaggggtggattattcatgcctcccctttttagaccatataggataacttcttgatgttgccatggcatttgtaaacaaactgtcatggtgctggtgggagtgtagcagtgaggatgaccagaagtcattctcgtcgccatcttggttttggtgggttttagctgacctctttgctgcagactgttttattagcaaggtctttgtgacctgtatcttgtgccaacctcctatctcattctgtgacttagaatgtctcacttcctgggaatgcagcccagcaggtctcagcctcattttacccagctcctattcaagatggagttgctctggtccaaatgcgtctgacagtataacaaattttatacctgttgattagcaattcttcttttcctcatctccccagcccctggcagccatgatcctatcctttgcttccatgagtttgactattttattttattttttttgagacagaatctcactcattgcccaggctggagtacagtggcgtgatcttggctgactgcaacctccgcctcccaggttaaagcaattctcctgcctcagcctcctgagtagctgggactacaggtgtgcgccaccatgcccagctaatttgtgtttttagtagagacggggtttcaccatgctggtcagactagtctcaaactcctgacctcaagcgacccacccacctcggcttcccaaagtgtcaggattacaggtgtgaactackgcacccggccggagtttgactattttagccacctcatagaagggaaatcatacagtatttgtccttctgtgactgccttatttctcttagcataatgtttttcaggttcatccacattgttgcatgttgcatgatttccttatgtatatatatttgacatatatatgtgtatatatattcattatccatttatctgccaatggacatttaggttgtttccacattttggctgttgtgaatagtgctgcagggaacatgggagtgtggaaatctcttcaggattctgatttcaattcttttggataaatacccagaagtagcattgctggattgtatggttgtcctatttttaattttttgaggaatctccatactttttccatagaagctataccattttgcatttccatcaacagtatacrgggttccaatttctccacaaccttgccaacaccgatcgtctttgttttttcttttctttttttctttttttttgataaaagccatcctgagagrtgtgaggtggtatctcattcctggttttgatttgtatttttctgatgatgagtgacatcttttcagatacccattggtcatatgcatgtcttcttttgactaatgtctatccaggttctttgcccattttaaaattaggttattaggtttttttgtttttgtttttggctattgagttgtaagaaatgaaagattttaacctacacgcaaatgtgcagtacaagataactgtagtgttcacagaaaatcacaggatttctaaaactgtgaagtcataatatgtcacagcagtgggtgctgataacaggccacaactttaaagttgtgtagtaggcatctttccattttgtaggtgtagctctatgagtgaatcctggcatttggggatcctctgcccctcctcctcgccagggcctgccctcagctcatggacattctagaagaatgggggacagaaagtagcatggaaaggagggccctggaagtgctagggtgctgaggacagcactgatgacasaaaccctcctgcctctacaccatagaacaccatgtagccacttagagagaagctgaagaatggtagacagtaatctgaaataaagcacatccatggcacatttgtaagtaacagaagccagtttcaaaaccaaaccctgtgcattgtgggtctttttggagaaggcatatatacatatgccagaacaygaaatcaagatgaaaaatccatgaacccactgtgggatgatgtgatttttagttttctggctttcctaaaacttccagagtttttacaatggatacatactasttttgtaatcagataaaagtgtgttattttaaaatgctaatatgaaagaaagaggaaaggaggaggaaggaaaaaggggaggaaagagaaagggaagggccccctttctgttgtgcttggttggctggtttccatctgtcctggggctccagagagtgggagacaaaaggacggagaggcagggagtggtgctgggtctggagccagcgtggggacagagtgggatatatagagtcctccaacagccccttcagggagggacagcatagactggggcagtctgtactcccagtggcctcatcacagccctgtttgagagtgacaggacctgggaacccacagacagatgcagactgtgacttgggagtgactgctgggcatcccagggttgcacagaccccacatctccgaggctgtgcagrgttcaactccctcgctgatgatctccatctttggttattagttatgaagcattgtctagaaatgtgtcatagtgtgcaattttggttaatctatataaacatatgtactgtttatcaatataaataatttgcataatttgtttaatttccacatgcactctctttagttttcaggataacaaagagttgcacagacacatagatctgcgacacacacacaaacacacaaacacacacagctcctcttccttatggggccaggtacttgacttttgctactcccattcctctcctctccagctgtcacaacatgtccctgaggggtcaccttgtccccaagaagccctcaaaggagaagcagggacagcagaaactggacagcaagttttatgagagctgggccacagccttgctcacagctatattcccggtgcttggcatcttggtgcttgttgaatctttgctgatgaatgacccaaygcgtgaatgcatcctcagcacctctggcttctcagggcctcgcgccaggctcctgggggtcctggccctgggcgggttaccctcctggtgtcactttttccttcttcagggctggggaagaattgtctttgtgtgctcttttctcactaggagtggtcctcttcctttgtggattccaaactccaggatgcctaagaatcatttggggagtttgtcccacaccccggtgagctctgggacctgctttatagtgaggtggctctgaagtatatagcccctcccatgggggctgcactttagagcttaactttttttgatagcacttagacgggagctgtccaaatccttctctgccacgactaaaagactcagaatctgatttgctccatagccatttgttgagccttacggttctgtcttgacaaagacgagtcagagtyactggggttctctggaggactcagccagcctaggttttagattcaagttgacctgggttcaccttgcttcttattttgggggtgggttgggggttatctgtgtcttcctaccagtggaacaaaactctaacatgcaggtggttgtgagcattacagagataatctaagtgaagtgcctagcaccgaccagctcagcaacgggagcacagtgtggtggggcagggggttgatctcacaacctgggttgtggggtcgcccagtgggaggcctgggggagaccagagggtgggcaaggggaagtgggaagtttgcggatggatgggactcttaactctcacccgtgaccttggcccctaggggtggaggtcacgccctgcaaatgctaatctcgggtttaccctcatcagctgccggcctgctggactcttctgtcgcctgtgtgaccagtgccctgaattacagtctccagtttttaatatacaagttgtttctatttttttggttagatcctgactgatacagagaggaaatgccacagaatgaaagaagtgagaggaactgcctctgaccaggccagggtaggagatgaaggcagattgaaggcagatgcctcttggaatcttgccaagccagggtgggggaggaatctaggaagaagaaagaagaaattgttgggttaaggatcactagaggagttttctttttcttttatttcttttttttttttgggacagggtcttgctctgttgcccaggctggagtgcagtagtgtgatcatagctcattgcagcctcggattcctgggctcaagcaatcttcttgctacagtctactgagtagctgggactacaggcgcctgccaccatgactggtcaattaaaaacattaaaaaaaatagatgggatctctctgtgttgcccaggctggtctcaaactcctggcctcaagcaatcctcccagatcctcccatctaggcctcccaaagcactgggattataggcgtgaaccactgtgccctgccaagggggtgaggaattaagcaaaggcttggaggtctgtggctgcccagggagtatcagatccatcttagcaccttctctcattctctccacctggtctctctccaggctcctggctgctctactcagcctcagttgtagccgcagctgcactgagaacctcttgtactctcacagttccactgccaggctgagcagctgtgggcagtctggttcctccctcctctgacagccacaggtgcagctccagagccggccctgaaaactggctcccaagaggcctcccgagggttcaagaggttgggtgagctttgcccagggcaggcaaggggtgggagaggagggcagcgccttcagtgctctgatgactgcatgtgtacctggcatggagtcagtcattcacaaggcctagggcctttggactctcaatcttaccccgctgcggctggtggctccatccaggtcaggagggaaggccgtgaggtgttactgcaggcagaccaatctctgaggccatcagacttgtaacctgatgtgctgaaagagtttcttgtcctcttaaggtggcaccacaaaagaccccttccctctttctaggtggatttggtcctgttcataagaaaagggaggcaaataccctaagcagtcacagaaattgctctggggtagagaatgtgctcatatcctctcagctggagctgggcccagcaggtttttgatgctggtgatcaaattaacctcagacaggaggaatttcctgccttgcttgtttgtttaataaaagaacaagaattggaaaacagttaagttggagaaatgagtatatgttcattcttgcctattaaccatcataaatcccaaaggatttagagtttgtaggaagatcactgactctacactctgtaacggcccctttgccgagaggtatctgtccacagcagttgagtatcagatgggatggtggctccccaaaccacaccaaaacagcttggtgttaaggcaaagccaagttcattacataccccagtaaaggggattctgagactgaggagtgcctcagaaaagagggcaaatgtggtggtcattgaatrtgttgaaccctgagtgagtgagtttttgatgtgggggtggattagaattgggaaagtttgggacatattagggtcaggggacacagggaggtgaggatttgggctagattgctgctatttttggtcctgagaaggcaggtaaatggacttagattttcaggaaattctgcaaagaaaccataaattacctacaagctcaccttcccaagggagtttctgggagcagtggtgttggtggatggtgggtggaaggaacatggtgtgagcgtgcacaggatgctgcaggtgtgyggatgcctgctctcctgagggctggtgtagaggaccccaggaaggcttccctggcttttgtcccctgtcctcaagatagcttctgtcgtttgtaaaactccatgttgctcagcacaggccctttggagtcagtttccagatgtctggtatcacagagccccctcttctgtctcatttttctcttggacacacggtggcacagagttcgagatgcaggaggcaaaaggttgacagccactggggaggcccatgtgcatcagacctcagtgcacacagaacagtgctcagaccaagggaaggcacccgggcacccacacctttcctggggcccattggggctgtgctgcaggccaggctgacccagccccagggctcccagagtgtttctgaaattgccaactttaattaaaaaatatatatttaataaataaaaaaattaaaaatagtacatgttcagtagagaaaattttttatagtttttaaaattgtgataaaatatacataactaaaattcacaattttaaccatctttaggtgtaaaatgagtggcattaagtacattcacaatgttgtgcaaacatcacttcccacctctagaacttccccattccctcaaacagaaactctgtgcctattaaatagcaactccccgtcctcccctctcccagctcttggtaaccacattctatttcccttctctatgaatctgactactctaggtgttactggaaaggggtaccaatccagatctcaagagagggttcttggatcttgtgcaagaaagaattcacggtgagtccgtatagtaaagtgaaagtaagtttattaagaaagtagaggaataaaggaatggctactccacagacagagcagccctgaaagctgctggttgcccatttttatggttatttcttgattgtatgccaaacaaggggtggattattcatgcctcccctttgtagaccatatagtataacttcctgatgttgccatggcatttgtaaactgtcatggcgctggtgagggtgtagcagtgaggacgaccagtggtcactctcatcatcatcttggttttggtttgggttttagcctgcttctttactgcaagctgttttatcagcaaggtctttatgacctgtatcttgtgtcaatctcctatctcatcctgtgacttaaaatgccttaacctcctgggaacgtggcccagcaggtctcagcgtcattttacccagcccctattcaagatggagttgctctagtccagatgcctctgacattttccctgctttttaaataacaaaacccttaatcctaagggttgcagagggatgaagatccatcattttctgttacttctttgggctgagtaggggcgatgatattcccaagtctcttgtgttcaggatagagaggagcttagaaagcataagtatgttgagggacactcataactctgagttccaacaaaaggtgatatccagaagatgaataagtgtttaatttaagaaaacattcggtaagcttatcctgcttttttttttttgtttttgagacggagtctgtctgtcaccaggctggattgcagtggcgcgatcctggctcactgcaacctctgactccccagttcaagtgattctcctgcctcagcctcctgagtagctaggattacgccaccacgtcaagctaatttttgtatttttagtagagctgaggtttcacgatattggccaggatagtctcgatctcctgaccttgtgatctgcccgcctcggcctcccaaagtgctgggattacaggcgtgagccaccgcgcccggccgcttatcctgcatttctacacaaagagtacaacaatatattccacaacagtaaagcaaaataagcaaaattatctcaagttaactaaattagaaggctttccatgaactgggcaactattggaaccaagctgatatggggttgctagatgattccaatacatgctcaggattagaatattgatccagatttttatattacccatccctcttgtttcttctaagcagcagccagagatcactggttgcttcataggaataagcagggctagtctaaattacaggaaaaaaactcaaaaataactgatgagactaaagtttaataacaaatgtaccatagttcttgaaacataatttttctctctctagtttcccatttttcactaaagacaaatcatggtaagactgatttggtttattatacttggcttgattatttgtataaagtgcagcaagaataattatttttcacataagctctttttaaattggctttgatggaactctgttccataagaaggaatcttagataagacttttttagagccgagccatggatttgtaccctcaaatacctatgagttgagtaacttcctctcctcttgaggttcccagataacttggggctcttaggccttttcccagataacttggtggggtcctaggcctgttagaaagtgacattctttacttaccacaggtcaggaaacctgtacagggactgtgtagacaaggtgtgaggccagttttcccaaggggcttttattggatctataagtcaagtttaattccttaaaggaaaacacaccattccagtcaaagcctwggtaaaaataaccagtttttccaattgtgtcctattgcaaaagaaacagattcttattgcactatgttgccttaagatactcacaaatagtttccaaattctggaggaatcaggtagagagaaacaaatatgctccaaattttgttcacaggagtataatttacttaattgtcaaaagctgtaaatagcttaagtttccttgactttgaaaaacaaaacaaaggatcagcacggttttaagcgaaaagtcaaaaaagattacttcaatgtttaatttacagaaaaactgaatgctcctttagctttagctaatatgttggcacatggaatctcttttacaattaattgttcacaaaccttctacaacttgttcaaacctttggctttatcctaactcaaaacaacactttaaccctttaatctaggcaaaaaaaatccacatttccttgactgtttatatatatatatatatattttttttttaccaaaaacacatttcactttccttacatgccttacacatagaactgtttctttagtagtcttaactatatgttacaatgttaactcttagtgacttttacttttggtgaaaaccttggtaagttcaggggtttaattatgtactagtgtggagcctaggacccagtcagaagtgcagataaggtctgattctttccgttgtctaactccatgtgtcccaggccttaccaagctgtacatttaagagtcatagtggtgtttttttgaagcatttaggaggcctaatcacctttaaattgtacatttcttgcataaatcccctttataaattcttttacaatgtacacagaccatctacaacctgctttgactttctgacttgtcctaaacatccctctttttaaacaaccagtcattttactttaggacaagaatttaccatacaaaatcctttcttatataaaatctcttttctttataaccttctttgcatagatagggggcacgctaatttcacatgttcccaggccttatctagaatctaatgctccaaaataaattgaacaattttcaaaagtcaaagaagcagtttatgaccttaaagcatttagcaaacttaatatctgactgcataatttagaccaaatgtctttgttttaccaataatctttaaggctgtttttatttccsaaagattactaaagtcatgtgaactaaaaggcattacactttttacttttctgaaaaaatattttatttaagcacttatttttaaaccaattaatcaaagctctttcatatcacacacacaacacatacaaatacacagacattcagcaggtaaaggactcattccataagccaggaattgaaccctgaacccgggctgccattgtgaaaagagaaagcaaggccacatggttcccaaggacatagaagacaggagggaaaccccatccagtttatttttttcatgcatctgcagcaaagtttataactgaccagtttactaggccatcttgaagagtaggcttatgggttctaaggccatgttctatcctaaggtacccctctttatgacagaacaatacagaaagacacacaaagcacaccagattcacyacagcttaagactaggctcacaaatccttttttctattaaccaaaactttatagaggagataaacaatgatttttgtcgtgcgttcaactggtttgcacagagaaagaaaggaaagggaagggagaaaagcattgtctgtggcagggtggggaaggcgaggcactcagggaagccagagaaagacatgcccattgtggccgacactgaatcaaaatttcaggtgatcccttgtcagtcatgaagggatcttcaggcggtcccttgtcggtcatgaagggatcttttccagccatcccatcagctctcaagtttcctttttcagggaggaaaaagccccctaagtcccatgatcctgtacatgcctaattctgtcacyggcagctgccagcatgaggtattgctcctcatacttgagggcattagctgcgggggtctgcctgcagaccctgacccaaatgacagatgaataaaacgtacactgacacacagatattctgttttgccagtccagctgagtgtctgactgcctgcacagcaagagaggtttgtcactgcggctggccctgagcagctcacactccaggcatttatttggtatacaattaacaacagaagctttgagtaaagacacttgcggataattaacatggttaagagagtagttctaggcatgattaaagctcaggtaccccagtctaaagtaaataccattagggggcagtatgcctggtcgacatccacctgagagggtcatctagctcaaaggttagttaatggaggtagggtaaacagacttaactggggaagmctctattgtccctagtatttaccctatgacctaatgctccaaagtaagaactggctgccttcagtctcttcarttattacaagctatgtaacctttcggccttccaaaaggtttgtgactatttcctataacattccctaatatttccctttaatatttcttccaccatcctgagtgaatcacaacatcagcaaagagtgcaaggcagattaatccaaagagaatagcagttaacatcccatagtgccaaatctgttcttagccgagagggactttactgagaggggtctctaaccccctaaatcttaggaaggactctaaccttcctatgctgagtctcaaacccaagttcagtcaagcgtccttgccttttattgagtggggcctttagcccattctgtcttaggagagactttaactcccctaagttgggcctgtaacccaatcccatcctttacccaggtatatgcaccccacttacccaaagttggcccatcagtgctgccgtctatttccttgaggttggggttctcctcagtgtcatcccttgcatggttcaacagaaagatattactggaatgcagtctcaatccagatcccaagagaaggttcttggatctcgcacaagagagaattcagggcaagtcatagagtaaagtgaatgcaagcttcttaagaaagtaaagaaaggaagaatggctactccataggcagagcagccccaagggctgctagttgcccatttttatggttatttcttgatgatatgctaaacaaggggtggattattcatgcctcccctttttagaccataacttcctgacattgccatggcatttgtaaactctcatggtgctgatgggagtgtagcagtgaggacgaccagaggtgattcttgttgccatcttggtgttggtaggttttggctggcttctttcctgcaagctgttttatcagcaaggtctttatgacctgtatcttgtgccgacctcctatctcatcctgtgacttagaatgactaactctctgggaatgcagcccattaggtctcagcctcattttacccagcccctattcaagatggagttgctctggttcatacacctctgacaggtacctagaatgagtggaataatacagcatttgttcttttgtgcctggctcatttcacttaatgtaatgttttcaatacgtatagttttttaaaaatgtaaattttatactatattgtcttataggcatataaattgtttaaattattaacatatttcaaaatttgaggaagtaatatattggacacccaagacccccaccacctagatttcatggaaggtaacactttgcagtgtttgcctcataattattttcataaagttttcagagtcaggttccactgactaataagccagtcttccttgtggttcacacacagagaagcagggtagtagagaggataaaaagggaccctgagctgcctgcctgaactcaaatccagcttccctactagctgtrtggctatggacaagttacacaatctttctgtgaatccatttcccttctgaaaaatgggaatggtcatactaatatctacctcctcgttgctatcatcaggattgagtgagtcggtaaattgcctagactgaggctggttgttattccttcttggttgttattccttcaagatgtggctacaacttctctgtggccctttccatttcttccgccttgtctcgtatttttttatttttatttttttaagacacagtcttgctctgtggtccaggctggagtgcagtggtgtgatcacagctcactgtagccttgtcctccctggctcaagtaatcctcctgcctgagcttcctgagtagctgggactataggcgcctgccaccacgcccagctctttttgtatttcttttctgtagagaagggtttcatcatgttacacaggctagtcttgaactccttggctcaaagaatccacctgccttggcatcccagagtgctgggattataagcgtgagccactgcaccaggcccktctctcatcttttaaaattcctcagacacctggcccttgaccactattgaattcttcatttgtcagaaataatcaggtgtggcattggccttggtccatcaaatagaactggcaaccatctcccccagtcttgggcaagaacctcccctggtaattcactcccatcgtccctggccctcagtccttgggtagccacttcccagcccaggacaacgcaggcagcactctcagaagttattttggacctggtgaggggcttcctttttgcctagcaccttccatttgtgaatacatcctgtttgcaaataaagcatcacagaaccctggatgcatgtggacaatttaacaaatggagctgaaggtaatgctttttaaatttgtaggtaaattctggaatgttttaacttcaaggaaataattttaatatgccctcctgcgtctctgtctcatccccagctcattaaagatagagttttgcctgaatgtaactaattttaaatgttattcttaatagaataggtgctttataagccatttaaatggcagtcaacagattagagggaaatgcttattttacttcagtgtcaaaacaaatacacctcaatgcatttcattggcactgctgttcatataaaatgctaattataaataatttcatattaaagacaaaaactaaggcaagtggcaccagttttggcatatggtaggtgctcaatgcatgttaaacaaaatagtggcaatgcctttgccacaacttttaagatgtgaatatacatccacccggccacacacgtaggcacacaggcacatgaaatttgcatacattcactaattctgacaggcttcctctccatcttggtgcacctgttattgtaatggcgtggattgtccttgctttgctattcacacggagcaggaccagggctgatcctgcagacgtgctgccccctggtgcatttgagaagactcgcatggtcagccaaatgagagaaaacagtcaccatattaagagctcagttagctgttgtcattgcatttatttaatgacctgatagatgaagagaaaactgtgaaggagacagagaaggaacagtccaaggaaaaccctcacagagcccagggcagtgatgagcacagagtagctcccagcaaatatttgctgattgattaaaaggataagcctaggtgctgtagatgttgattcgtagacactggggggtggagcttggtgctggcatccacagtgacctgagtgatkcttcacaagcactgagaatcatgctgagtcttgaatttttttaatattcactttcagcaattgattaatccacccagcactgttagagaggtgtgtggcttctctccatcagctttttgagttacagcattgaaagggccagccattttccactcaaagggagtttaaaagtgtagggataaaatatacattctcgacaagcataatctatgccctaaaatcctcaactgaaccaggcaccaatatttgatgtgaagtagcagtttcactcaagttccttccaagaagaagaaaataacatgctttgctgaaaggggcaaactagggagctgagaatttagtgggaagataatgcaattataggtcaggatagacacgtttgccaatcttcctgcaaaccttgaaagatttatgacctatagctatacctgttcctaatttacttgtcacagataagactggcaccttcgcccagcagagaggctgttaatgaatggagaggcaaggcaggctgctagcaggtactgtacctttagagctctgaaacgatctttaggccctttttccagctaagacttgagaagaaaaacactagtaaaccttacatagagggcttgcttacagagtaaatgtaacaagtttctttgatgtgtgaccaaaaggaaaaaaaaattcatttaaccctcagaaaaaataaaggaagaccctgcattaaagccactctgtgtgttatggggacaacgaggtttaatttaagaattagggtttgtatgaaggaacaagagctgggggagtgaaaccagctggaaggtcatggaagcagctggaaggtcagaccgaatacctaagtgggtggttctctaacatttgccaggaaactgctgcgaaaattttcaagaaactctggaaaacctcctaccaaacctggtgcttgataagaagcctagatgccactgtgaaccttgtgtctgctgtggcccccawgacctgaggaggattgcctctcttcactgtcttccaaagcttaggcaaatttctctcattggaaaattgagctcaacctgtaaaaggcaggagattccaggaaaggaagattcagtgagaagcagatgaaagtgakgaaaagctgacaactaacaacgtagcacaacctgaaagcacctaaattcctacatttacctcctcattatgtaaccgcccagtggattcaccttgtccgcagcctagacagccgatttatcaagacaggggaattgcaatagagagatagtaattcacacagagctggctgtgcaggagacctgagttttattattactcaaatcagtctccccggaaacttggggatcagggtttttaaggataatttggtgggtcggccagtgaatctggagtgctgattggttggcccggggatgaaattgtagggagtcgaagctgttctcttatactgagtcagttcctgggtggggccacagaactggttggcaggttcaggtggggttattcagttgttagaaatgcaaaaactggaaaagacatctcaaaaggtggatcctaggttcacaatagtgatgttaccttcaagagtaagtggggaagttgcaaatcttataacctccggaataatggctggtaatatttagaattccagcccctcttattctaacttggtggctggtagcttttcatttgttttacggggacagtttagctttaaactataaactaaattccttccgaaggctagttcagactacgcccagggatgaacaaggactgtttagaggttagaagcaagatgggctcagttaagtctgatatctttcactgtcataattttctcagttatagttttgcaaaggtggtttccattatgtgggacaaattattcattcatgcgctcaataaatagtaagtacttgaggtgtgtcaggaattgggttaggtgakagaggcagattgaactatgtagaagaatttattcctgccccatgtgagctgacattgaactaaaagggagaaatggtttgaatacacaaaccgtgatgatgcacaggcatttttagggctgttcacaaatattctggctctcctccaggcacatgctaagattgtatttccccacctgctttgaaatttgaagagaccatatgacttgctttggtccacaaagtgtgagcagaagtgatgtgtgtaatttgcatttggaaggtttaggaatgatccatgattcaccatgctgtcttccccctgccatgatcaatctgttgagatgaagcttgggtcagccttagtcccaagaggctaagcagagcccccagctgatctgcaatagatatgcaatatgattgagaaagaaatctgtgtaataagccaataagagtttggagttatttgttgtcacagcaaaagtagcccatcctgaccgacctgtaacaagagtgagaaccatgagcagtgctagggtccctgggggaggggaggaacttttttcagattgccttgtacgttggttaatcattcaccacgtgtggttttggcttagcttgctctctggataagatcaaagaaaacggattagctagggagatacagcagtgggcaaaacagaccacaagtatcaatccatctttctaatgctatcagaacatctcctttctcccccattgttttcagcatgcactgcccccgcctcttggtttgactttagatgacggtgaagtgatcaccacaagattggtgaggatagaataacagtgggtgttttaaaaattgtttctaacatgataatcagaaacaagaacagaactgaagaaaagaaataatcagaatagagatccacaaggccctgaggatttaccatccaattttaagactggtcacaggttatttcaggggaattgataaggctctagcttgatctatcagtcaaatctacttgtagtgggcaggaattcaagcacaaaacagctgagctagcactttataacaagatgacggtttaaaaaaattttttaagcttataagtgctttcttttctctttctttcttttcctttttttctttcttttttttttttttctttttggaacagttcttgctctgtcgcccaggctggagtgcagtggcgcaatcttggtttactgcaacctccgcctcctgagttcaagcaattctcctgcttcagcctcctgagtagctgggattacaggcatgcaccatgatacctggctagtttttgtatttttggtagagacagggtttcaccatgttggccagggtggtctcaaactcctgacctcaagtgatccacctgcctcggcctcccaaagtgctgggattacaggcgtgagccactgtgcccagcccaatgctttcttttctaatcatatattctggtcatatatatttctgatatatattctttatatatgtaaatatatattttcagcatttacattataccgtatttactatttgtatattttcaaccttcctttttctcttaatatactaaaaatatttgtgtatttaaatattctttttctacatgacttcaaaacaacacatttgtgtacttaatacatgaaatatttattatacagacacrtaaaagggaatgtattgtatatactgttttacattggactttttccgcttattacattgtgaatatctttttacattattaattattgctctaagacatcatttttagtaactgctgtgttccattatacaagtgtaatttatttagctaattctcagctgtagaaaatttatgaggccagttgcggtggctcacgcccgtaattccagcactttgggaggccgaggcgggtggatcacaaggtcaggagtttgaaaccagcctggccaacatggtgaaaccccgtctctactaaaaatacaaaaaattagccaggcgtggtggcacttgcctgtaatcccagctactcgggagcctgaggcaggagaatcacttgaacccgggaggtggaggttgcagtgagccgagaccacgccactgcactccagcctgggcagcagagtgagactctgtctcaaaaaaaaaaaaaaagaaaatttttttcaggctagagtactagaagtggaatagccaaatcaaagtgaatgcacaattttaaggattttgatatgtatttccaaaataccccatacaaaagttattccaatagatgctgtcactaatagcatattagagtaactttccctgaaactttccccacccttgcaaccccaggtatcatttttctcaaggtctggtctaacaagtattaaatgtggtttggttttaatttaaatgtctttggtcgccagtgaggtatgcagtttggaatgattccacacttcccatggcaccgttctaggtctctgggctctgatctgcttggtgaatccttcgcagtgttcctcaggacagctgcgcgcccttctgagtgcaggagggcaactctatcctgctctcaaccctgggctcagctaccaaccactacagcttgtgtggctggagaacccttaaaacccaaccaccagggggcagaagaggtcagggtttattatgacgggcatttatttgtttattgagacggagtctcgctcagtcgcccagactggagtgcagtggcgtgatctcagctcactgcaacctctgcctcccaggttcaagagattctcctgcctcagcctctcgagtagctgggattacaggcacgtgtcaccatgcttggctaatttttgtatttttagtagagacagggtttcaccatgttggccaggctggtcttgaacccctgacctcaagtgatgcacctgcctcagcctcccaaagtgctgggattacaggtgtgagccacctcacctatgacgggcattttactgaagaagaaaccaaaggctttcccaaartcacacagcaatgactgacagaaccgaaaatagaacccaggtcttctaactccacatctggtgccttttcaggacctctgaagttagagacaaataaagaaggtgggaagtggtggaaacagtctcaaggcatttctcctttgacagatattcagataaccattttttatgatcataaaaaggttgaatctcatttaacacatatttataaagctcccactacatatctagaagggcaatgtggatacagcagggagcaagagcattcacaattcctgccccggtggagcttctcataatgcggcaaggatacccgcttccagtgacacagcttctgcgttcacatcttggctctatcacacaatagatataggaggccgggcacatcacttaaaaaggtccacttctaaatgtccccatctctgtggtggggacaataatcatacctgataggtaaagttataggattcagtgagatgacacatgtaaaagcccagcataygtagtcagtgcttgcaaatattaaccatgattattactgtaattctcaagtggaacctctacagatgaaaccatttacattattagtaacaatggcaactattattgagtgaccatttattgagtgcctataaatcagcgcggacttcaatactttcctaaacttccttgatggtaataatcctctgggatgctttcttttttttttaaaaggaaaaattcccagattctccgatctctttgagtcgggagttcctctagagggccttgggaatctatttgtttttaaatttatcattttagccatttttaaatgtacaatttagtggcgttaagtacattcacactgtgcagccaccaccatccgcctccagaactcttttcatcttcccaaactgaaactctgtccagatcaagcactaacttcccattttctcctctcctctgcccttggcaaccaccattctttctgtctctatgaatttcattactctgggcacctcatataagtgaaatcatacagtatttgtctttttgtgtctgtcttatttcacgtcgcatcatgtcttcaaggcttatccatgctgtagggtgtgtcagaatttccttcccttttaaggctgggtgctatttcatggcaggtatagaccacctttggttatctatgcatctgttgatgggcatttgggttgcttccacctcttggcgatttcccctctcactctgtacgccatggcagcaggaaagcattcaatgcttttctggctctgctagagacaagctgatcagacaaacgaggactctttttgagccattcacacccactgatatcacctgtgaattcaccaggtttagtgaaggttactaaattccaaacaaacactctgttcccagtgcacccaggtgttattgactgaaccagttctgaaacctctcatttcctcttgatgacttgaggatctgcagctcactccatgcttgcagccacagggcgtgccatacacctggggatactgtacacctgggcatactgtacacccaggcatactgtacacctgggcatgccatacgcctgggcacaccatacaccagggcatgccatacacctgggcacaccatacaccagggcatgccatatgcctgagcacactgtagacctgggcatactgtactcttgggcatgmcgtacacctgggcacactgtacaccagggcatgctgtatgcctgggcacaccatacaccagagcatgccatacacytgggcacacagtacacctgggcatactgtacccttgggcatgccacacacctaggcatgctgtattcctgggcatactatacccctgggcatactgtatgcccaagcatgcaaataaggccaggttggctgtgtcactagcaccctaggctacaagatcatctatttggggtgctattcataattatgccatatacaagtagtagacaaactggatgtatggtcactctatgtgcagggattgtttcacctaaatatgttctgagttcttgctgctgcctgaagaagagtcaccacttctcatcgatgaaagcagatagccgaggctgcctgtgtaaaaaaaaccaccaccttgaaagccccccatcagggcagcttcactctctgccccagtgttgactgactcctgattctagggaagactcactgaggctaatccaacagcaaatgcctggtggcccaacacttggagccccacaaagcaatcagtgtccttccatcgattgaggaggtgaagaygtgaggaagcgtgaggtaggaggcctgtcgtgcccctctccaggtgtcttctggaggactgttgtggaggaggcagtcagaccagttccctgtcaggggataaataggaagactttgatcttgtgaaaagctacaaagttgtttttccctcaatgtcactactcaaggtccagatgaagaaaatgtcttcttcatcttatttcccttctccttcctaactccacaaatgaaactgagccatctatcagagattgttgcttgcctccccctgaccccagagctgctatagcaacagaagttggaactggacacaagatcatgccacaaaagaccacatttcttagctccccatgcagctctgggtaccttgtgartagattctggtcaaygggaggtgattacaagtgaaaggaatgtgcaaagccttttccttcccatttttctattggctgaaacaaggatactttcttctgagccacttttgaccatgcaggcaagagcaacctacttagggagtgagggagcaatgacatggaaagagcctgggtccctgagtgttcacgtggagcagagacatctcccctggattagcttcctctgcactgttacacaagagaaaaataaatatgtatattcctatttcagttatggaagccaaactgatactctaatatgatagccttaaattagagaaaaaagaaaaaaataggaggggagaggaaggtctgggaagagtggtaagtaggaggtaggtgcaggagaatgtgaaaaaaatactggaccgcagatattttatttactccaaccccaaaagtaccatcagtctcagccttctaccttgggtttggaaattcacactcaatttttctgttgattgtcatgtaaaygtttgataaggaagcataagcattcatgagaagactatatcttttttctaaaagttccaataaaatgctgcagtatatcactttaaaatgattaaagataaggctcagtccctgaatttgtctttccaaggtattatataatccactcctaattattcactttccttttacatttttggaaaatgagatctattcctacaatgatttatgaaactcaattttgggcactataatctattttgctattagtctttgctgaatacatttagaaaaataaactgactaggatatatagtattctcaaaactgactacaaataatttggagcttattcttagaaaaatctgttcactggctgctgtccaatgacgtcctccttacttccacctggatggccatcttagcttcctaaggaaatgtggcagtctactatacctgtggccccaatgagccattcttctagtactcacacccttgtgtagtcccctccccttaatctgagttggtcctgtgatttgactaaatcaatagaattgggcaggaaaaccagggtgctagttcctagtttcagcctgaagccttggccgtgtccacctttgaactgttggatgccctgagcatccatttaagtattccggccacctcactggagagaccatgtggagagggagaggctccccatttgtgcctagacccagacaacccaccactgaatgcagccacataagtgccactggcacatccaacagaagcccagctaaattgcagatttgtgagcaaatataatgatcattattttaagccagggaagtcttggaatggtttgtacatagtaatagataaacaaataattagcctttcttgaatcacatggagctcctacttaagtttcctaaatggaattttctcacaattccatttgccacatcatcttctgttctaagtttttaaccagccagggtcaccatatactgttgtgtgggttgtacactgtacccaggcacctgccaagggagccagtggggactgcttacctggccttcacctggagagagcactttttctaaattgagtgaaaatgtcttatgggctcccagaggtctgataacaggcaccttgtagaattaaatccaaagttgttgaactggcctttaagaccctcctttaactgcctgttgccaccttcacccttcccttccaactttctccaacccagcctctcattactcatctccaagcttggcttagctgggttaccctacctcccattgtcagaygtgccccttctgcctgatgggcagcaatgtacacgatgctcccaaattagggccacgccttctaaaggaggatatagtcccgccaccagccctttgtgtactcaagcaccagtacattttcagtcttgtaaacctcagaggatctaatgtttgcttacaaggactttttttttttttattagaggtttccaagcatgttaaagtaagaagggatggtgtagagatgtgttattctgcttttggtcttcatatgtggagggccgagcccagggagatttggagctgctctttccccagggaactgtgcttcatctgtcaaagatctaaagcacaggaccttgctgtctgagccagggaagctggtctccagggaaaattctttcctcagaattcatagtgcaaccagaaagctaaatgttccaatacactgtgcaaatggacttggacttcgtgacatgggatacacgttgtcgaactttgtaatcttacccttcattcaatattcaacacatttatttgatctcttccttttctcagcgtccccttcttcttctgtgctcttccttcgttccccatcacccccacctccctgcctcttggaaggactgactcagagtcaccttcctgtcaggggagtggtcgaggggatttctagatgtgcaattagggaccaaggtgctgattgttttctttgatttgggactctagatgaagtacagttgcaggctggtgggattaaaggaaccatgaccttgagaggtgtgtgccacagactatccccggttacaccatgatacraggcaacgtccccaactgtagggaggaaaatgatggggtgctcacctgaatccatgcctgaaagggacagggtgcctggtcaaatgccccrtaagcaggtgtgctagtcacgatagggggcaccaatgaacatcttagggaaacttagcactcttcaggatagtgggtaaaactagcagtttctagctgaatattattaaggatggcccatttgagcctgtgatctctacaaatattgcaggatgaaaggccccttgaattataattggattccaaatatttacctggaataatagcttggcaactatatgctgggaactgtgaagtagaagtagtagtaatcatatttttatattcctataagtaataattactatgattgagcaaatatgcatattaagtgctctctattatctcatttatttttgttgttttttaattgtatttatttaaggtatatgacatgatcttttgatatacaaagtgatatggttactacagtgaagcaaatgaacatatctrtcatcccacatggttatccatctccctccttttttgacaagaacacctaaaacctattcttttggcagaaatctcaaatacaacacattattatttgatgtactcctcatgttgtacgttagagtcctagacttgttcatcctacatatctgcacattgcagcattactcacaatagccaagatacggaaacaaccaaagtgttcactgatggatgaatggatcaagaagctgtctgtctgtctgtctgtctgtctgtctrtckctrtctrtctatcyatctatctatctatctatctatctatctatcatctatctgtagtagaatattatttagctttaaaaaagaagattctgccactcaccacaagtgaacctggaggacattatgataagtgaaataagccagacccagaaataaaaattctgtacgatctcactatatgtggaatcttaaaaaagagaaaaaaaagtcaaatacacagagatagagaataaaatggtatttaccagaggcagagtgggggtgcagggaggaatgagaagatgtagggcaagggatatagtatctcatttaatcattacaccagccctatgaaataggtggtatctagttttggaggtgagagatccagagttcagaggtttaaataactttcttaagctggtaggtagttgacctgtgattcaaactctgagtaaggcccatactctcattctcatcctggcctgmccttccagtcatgagcaacaccacaagaccaggctcatctaggagcaggcagaggctcagtcagctcttctacacctgctgcctgtggctgccccagcccagcactgctacatggcaaatcctctggactgctcagccatcactctggggttctgcactttacatttgagaaattctggaataaagcaagttttgttacacaagtcactttatgcagattctctggccaagcctcaaggctctgacaccaccaggaagaggaaatctggtctgagcccagtgagaagcacataggcagtggggctgatgtggaggggctaggctgggggagaggatgcaggcccttctctctccctgcttagatgtttgtccrcattccacaatgtgtaaaaagagtcaagcctggggggmctgatttggggtttgatgggcacttgtagtttctttgtgatacactttgtggctaggtatggttgctcactcctgtaatccaggcacttttggaggccgaggcaggaggattgctgaggccaggagttcaagaccagcctgggcaacatagcaagaccctgtctctacttgaaacrcaaacacacgtacacacacacacacacacacamaaaatacactttggaaaaccacaaggtgatttcacacccgtttcttatagctgaggctgtgagaaaatctaagtaagatacgttaaaggcagtcactattctggatgaatttcctccaccagcagaggtgacgagtattttgtagggagaaagcattctttcccctcactcaactcagtaggagctccaggagggaggcggcttcaggacaggactggcgtcggaggtgactgacagcagtcagctgctgggtcatggctgctgcttaatgtcctgtccatttcgtgttcacgaaatgttctgcaggttgatgtcagtagaattttatctcaattttctttctaggtctgacccttgggaagaatccagcacgaggtaggagtgaagaaaggagaatgtagaagacagttttattccctttgtgatcaagaggttaggtcgcttgtggcattctggatatggaggtagacttcatttttattgatttaaactctctaaatccatgtagaataagcgtaattgtaaacccacaggcacaagctactgagaaaggctgtgtagtcatagcctgtggctacctctgagaagaagttcagtcagcacttacccatcccgggtgctttgatattatgcatgagtcaaggtagggaagtggtttggagagagacttcccctggatacctgggaactcggtgactttatgagttcattgcagtgagggggcattgggaccagcataatgggctggaagctggacaattgggtctgaggactggttctgcactcgcctgattgagaccacagacaagtctcataacctctccagcgcgccccttcttcatctgtgaattgatgaccactaaagatgataatggaaataatgcttctcttccaaggaagctgcaaatattaaataagttagtatgtgtggagatgctttatcatccctaaagcatgctacaactgtgaagctgaaatgctccacatgtgaggggctgtgctaccccagtgcttagaatgccacaggcagaggatgccctcaacaggaaaacatttataatgatattttacagtcatacaaagaaaagtatcgttattgttctgatgcaggatagaaacatttaaaaatgtttttatttgcatcagagacctctgaatatctgataaaaccgtgaatcttttctttctcttaaaacacacacacaccccacacacacacagagcaaacagcaaaaataaaccatgctaatacattcattcagtaatgctttacatacaatttctgggggctcatactttctcttagctcatagcttaagaaaatgcctgacctagagactggtgcaggcttgtactctcagactgtagtctaggagagaaatagactgcatagaagaatgaacaaaataacaatgtttagcatctgcctgagaaaaatgctacagagaacatctctggaattctaatagattcctacagccctcttgaaaaaacagtttatgtctgatgttaactagtctaagttaaaaatgtgctcrggctaaagaaagtgtctgccccacaaatgtggccacccttcagctcactgatgcttytgtgcaaaaagtcgtggtccggatatctgaatcctcctcctgcctccacaatgggctgctatccggtaacggctgtgaggtcccattaccgcagggcgaggctcttccaggacgctcagatgcctgctcagagcccagcttatcggggggatctgcgagctcctgtcaacgccctggtgtgtccaccctggcccatctcgggggactagattttaccctgagcaacacatgatttttgggtaagggctgtccctgctaagtagaatttcattttggattcagagaattcagaaccggagtcagctcagcccaggtggaaakgtaaaaattcacaccaagatcaactcaaactgagtgagaccatggccagcgatggaaagtgaaaaggaaagaaaataactgagcaggcaaagctctgtcccactttcttcatccagctggggccttccacgggagagcactgaaggtatttgcacycaatgcttcataaagccagccagggcactcatttttaagytcacagtgcgccaccttctatcttcgggttgtttatggcctcttggttataggatgtaaacatcccccatgggagatgtgcaggttacccacctgatcaagccggtgctccctgggatcctagagatcagaggcctcctggaaggcagatggtgcgaggcctggatgtcggcttctctccccgcatctagatcaagtggcggcagcacaggcagctggaaggtacccacagaaagaaatcgagcactatgttcagaaagatccactccatctttaactccagcccacagagaaagacggcggccgagagccccttctacgaaggagccagccccgcagtgaagctgattcgaagcagttccatgtatgtggtcggggaccacggggagaaattcagcgagtccttaaagaagtacaaaagcaccagtagcatggacaccagcctgtactacctgcggcaggaggaggaccgggcgtggatgtattcgcgcacccaggactgcctgcagtacctgcaggagctgctggccttgcgcaaaaaatatctcagcagcttcagtgatctgaagccccaccgcacccaggggatttcctcaacctcctccaaatcctccaagggagggaaaaagactcctgtccggtctactcccaaagaaataaaggtaagtgctgctgagcagtacaatttagatgagggtttttctgagagccttgggcaactgtttgaaagcttcttcctacctctgcatggcttaattaatctgacacattctgagccgcggcgcaatagtcctcagatgctttatgcggccatatccccagcctggggaagggtggctaagcccatgyttattactcatttatttattattaactttattttaggttcaggggtacacatgcaggtttgttatataggtaaactgtgtgtcacaagggtttggtgtacagattattttgtcacccaggtaataagcatagtgcctgattggtagtttcttgatccatgtttatttttaatacccaggaagcaaaaaggagcaggtagtggtgtccacagagcagctcggtggggaagacatgggttttggtgtcaggcggcaccatatttgcattgcacatctatcaattccttcccagtgttataggtgagataatgcttgcatggcatttggatgacagcaaatcatttttcaacaaattgttggtttttaaaaaattattgttgtcacatctaaaaatcctggtgaaaagtgaaatcatcacatgactagatgttttcaaatattgaggtgcttagccccacgcaagccaaacaactggaaaattcctccatctgtacctcagaccaggcatgtggtggctcaggcatagacacggagagagtctgtgtctcttgggagattcccggatggctttgggcactggaggtctccagacagtcacaagcatgaaatgagtgaaagaaataatttgcatttatctctttgtttatgcttattgcagtgttttgtatataccaacttttcttgagcgtcacaataaagccagtacagtaggtggggaggaactccttcagtatcacagaagggaaaaccgaggctcagtgacccacctctaggtgctaggtcacctaattttaattatgagccggcaattcattcagttactctttcctttatttcctcagacttgtatttatttagagacagagtctcctctgttgctcaggctggagtgcagtggcatgatcatagctcactgcaacctcaacctcctggactcaagtgatcctgccacctcagcttcccaagtagctgggactacaggcacctgccaccacacgcggctaattaaaattttttttttttgtagagatgggagtcttgctttgttgctcaggctggtctcaaactcctgacctcaagcagtcctcccgccttggtctcccaaagttgctggggttacaggtatgagtcgccaaactcagccagcttttatttatttctaatgcccgtaggttaaggctgttttgttgtatacttccatcagtcattttcctgatgaccagatgagatgtttgaagcaggcctgtctcccgcttccttgctttctccccagagtgtcctgtaggccgtgcaaactccattaatgttgaatgactgactggcccactatcaaatctctagggcttggcctaacccaattggtttcaactgtctgcatgttataccaggtgggagcagtttaaataatcattttaactctaaaagtatgtcagtgttgggggcccataaaaaagggtcctagtcacgagtcctggtgctgactctgtggccagccagctgtagatctgtgggccagccacctctgatgacagaaggggttgcagtggtttctggactcctttccagcttggatattctggggtagtaggcactggctagatttcctctaggtactacatttctctgcaaatggagctctctcttataggacctacctcccttccttgttgagctatctgaagatggagggaatagaagcagaatgaccagttctagccctttgaatggctgtgcagaggcacatgggcctgatataacgtagggatctccttcggagatgcctctcaccacagcgcaatcaggaaagagttttgaaaggacactgaagtcaatcagaccaagatttgaattttagttctgctatttaccagctgtgtgcctttgttaagggaagttcacctctctgggtctgtttttctgtcaggtagtaatggaaatgataatgtgaggagtaggctcctgcacgtaattgttcctagcacataccaggtacttactccagcgttcactgactctgaaatgttggatacaggaggctcttagccgtcttttcagctgctgtctttccccatggctctgacagaaacagctgtatgctgggcctgcctgtgaaatgatgggttcaggcttcatggctggtggggtggcccatggctgcctgggtctctgtgcattgccgggacaggggaccagaaggaatcctttgccctggaatgccgttaccccatgctttgggagaaagctctgctgacattccaggtttagggaaaacaccattctttcccctgactacctactatgagttgaactgtatctcctcaaaatgtatatgtggaagtcctaacccccagtaccacagatagtgacctcagttagaaactaggtgattgcagatgtaattagttacgatgaggtcatgctggagtagggtgggcccctaatcccataggactggtgttttcataagaagatggccatgtgaggacacagagatgcagggagaatgccacggacaaaagccaaggacctaccagaagccaggagaaaggcctggaacagacccttcaccagcaccttcagagggagcatggccctgcggacagcttctggcctccagaactgtgagatctatagctctaagctmcagaagctacccagtttgtggtgctttgttacagtggccctaggaaatgaatatacccctctatagaattagcctcttctcttctccggcattggtctgaacacacctctattttagctttcatcacatcctactgtggtttgttaaaatgtgcgtctcccctggtggactgcagtgaacttggtgagcttgaagctgaaacagtatctttctcatttttctatctccagagcataaaagtgaatactatcaatcatttgtagatgctttatagcctttaaaagtctgatgtcttttgtgccatacagaggggagagccggcctccatatagggagggagcagtgttctctgtgacaccagggcaccatggcaggccctttctgctgccctccctccctccatccggatgcaagcccctggcctggccacaggacctaagttcccttgtctgtccctcttttgtggtaagatagtggcttttaaactattttgattagaatccattgcagtaagaaacatattttggatattgacccagtttacccaaacacacaaacgaaacaaaagttttatgaaatagacttactcctgttccttgcttagcactctgatgttttccaaagcattctatgctattctaatttttttttaaaaaaattgtcatgacacagtaacttgatttcacaagccattactggatcaagacatatggctttcatgctctggaatgaggctttctaacaggtcccattgacatgtgaatggcatccaaggccagggtaccaaatggtctsttaccccagccccctggagatacccagagcctagaagaccacccatgtgggtcgatgggaggaggaagtcaggacacactagaagcgaggtgagcctcgggtgggtctgggagcccctcctgggaccctgcatggtgggagtctctgccaggccctgtggcaatgtactcctccctcagaataggtcattataaaaatgaatgaatgaaatacactttttgcaacattttaaaatcaaaacaacaaaaaaaatccgtacgtgagggtttttgtgtcagtgttgggaatgagctgcagtttgggactcattgtttaggtgctaaaaggttagaatttctaacccagggcataatgtgtgtggcagaaggatggcatgtttgaagtgtgtcttgtcaaggaatgtagagtctctgaaccaacaggacaagcctcctcctgctctgggcaccttgggtgtttcttgccagtcaggaggagcaatgatgttctcctctacacccacttcccctgctcccatgcaatcagctgtattcctgacttctaatcaccctccaaacctgacctgttggctattagcctcattctataaaggggaaaactggggcttgggggcgttaagagatttgtgtaaggccatgctcctgacgaagagaaagccaggatttgatcccaatctgtatcgtgccagaactcacacccttgtcaatgtatccactttgactggaaaacatgttttgatattgtataacctagaagatgcaagagtgtgcaccttaggatgtgtactgcaaaggctgttttatcctgcacacctgggccagggagagtcattagggaggcagctgcgtcatactgcacgtggattctgtgtagggtgaagccctcccaaagtgggagagactgggcttcttttcttcaagagaaacctggctgaaaggaagtggccagaaggtatgctttaaattgttttctttccacaatccgtggatggaatttatctccatcttgacttcttttcacatggctacctgtgattccagttttactctaggtctctgtagcattgaaatattgagtttgtatatcatctacttttgcacttctcagtacacactaggaaaagaactgaggaaacagtgcaagcacagctacaatcggaacttcatgatgggtaggtattatgtcctgaaatcatttttcaacaagatactttcatatctcccagctcattctacaaagtatctgagatgaagaatctatggcagctgaattagcttctgtgtagctgaattagcttctgtatcatgtcggaactcatactgtcaatatatctacagcatcttttgactggaaaacgtattttgatcttgtataacatacaagattcaagagcatacagaattgttaagtagcaccagaaattggaaaatcaggagagaaaaaaaatcatagaaaatcaagaccactcaaaataatatgcagatcatagaagctaattcagctgccatagatgagccttagatttggctctgtccttgctggaagctaagataaaaagagctggacttgtttcaaaattctgatgatctgagaagaaccatacccattgcttaggggagtgagattttccccctggctttgaatttcaaaatatctcatatggcacttgacttagggagtcttgtgtgatgtggttagtgatgcccttaataatattttagtaacagtttattaatatatcactcacttgtcccttaacacatatcgattgagcacatactatgtgtcaggagctgttctagatgctggtgaagaagacaaagtccttgtcctcatgggggtagtcggtcttgcgagagagcaagaccagaattcctatggtgatttctcagagccccagctgtaaccacacagggtgtggtcctgaactgcatcttagtgagagactatggattggcagcttagctgagctcagtagcttctgccagccccttctgagcccagggaagaattcaaatgccagaggtatggatacatcacacacccttcccaatggcctttgtcaaaatcctccgaagaattggttcaccccaggagagaaaaatgtctgtgaaaagtaacaagttgtcctgctgtgttttttgctatttccactccaccctgcatcctagcatgttagacagccgattgctccctgtggagtttgttccagggtcacgtatgggatgtgactggcatcagcctctgtgtgtgcctgtctcatttgcttgttcctgttaatttcttcaagctgcagccttctcctgctatgacgagcccttgggttattttacttctctcttttctcacctactcataaacatcacttttcttagcttggcttttttttttttttaatataatagctttaattcacatacataaaactcactctttcacagtgtacaagtcagtggtttttagtcgattcagtattgtgtaatcttcaccaccatctaatttggaaacattttcattacgaatttaagctttattttagtgtggtacaataaatgtaacataacttttaccattttcacacagcacttcatggttcctgaaatgagtgccttttagtgtcttcagattatgggtaatgaagtctattacagttaacaaattcttaagaaattaaatacttttctcaaactcctggactcaggcaatctgcccacctcagcctcccagagtgctgggattacgggtgtgagccaccacgctccatgtactaaatgcttttctttgaatgactttgtatcaatttttttaaaagtaaaagtgcatactactagatatccttcaaaatgttaatagccagataataaccagggtctttcacactagtctcccatgagcttttccaaattatcatttatataartgtataataattcatccaaaggattattaagccctaattaatgtatttttaggacactttattaaagtattgttagtagtaccctagaatacgaattccttaaaagatcgtggaccctctcaaagtacctcatttagaaatcaggagaatgtttttataaaaggtttgacaattatttctttaaatatgaaacagtcttttaaagtaaaatattttaatattaccattttaactattttaaagcgtacaatgcagtggcattaagtacattcacaatgttgtgtagtgatcactaccatccatctccacaactttttcattccaaacagaaactgcacccatcgaacacgaactcctcatttccccctttccccagtccatggtagtctctgttctactttctgtctctgtgaatttgcccattttagtacctgacataagtggaatcataytcattcttctgtgtctggcttatggcacttagcacaacgtcttcaaggcttgtctgggttgttgcttgtgtcagagcttcctttctttcttttttttgagacagagtcttgcactgtggcccgcgctggtatgcagtggcgcgatcttggcttgctgcaacctctgcctcccgggttcaagtgattctcctgcttcagcctcctgaatagctgggactacaggcgctcaccaccacacctggctaatttttgtatttttagtagagacggggtttcactatgttggccaggctggtctcaaactcctggcctcatgatccacccgcctcggcctcccaaagtgctgggattacaggtgtgagccactgcgcctggcccagaacttcctttctttctatgactgatcagtcttggtttcaatgggaggtgaagaggaaaagttgaagcctgtgctctgcatctgactagagtgcttgctggcatttggggtcctccctgaggacagctccccacacttttagggccagagaaacagcaacaaccacaggccactttgagaaatgggtcatctaagtggacccaagcctgactagatcacagagaagaggcttgggaggctggcgacagagccaggctgctgctttggggttggcagcagaaccctatggaaccccatggctcccacacagtccagatggttcacattggacattttctcaggcggggttacttgttgatatgacttgactaggtgtctccacccaaatctcatctcaaattgtaatccccacgtgtcaagggagggaggtgattggattatgggggcggtttaccccatgctgtcatgatagggagggagttctcatgggatcaggttgttttaaaggtgtggcacttcctctctcgcttgctcttctctttcctgacaccgtatgaagaaggtacttgcttctccttcatcttctgccatgattgtaagtttcctgaggcttccccagccatgtggaactgtgagtcaattaatctctttccttgataaattacccagtctcaggtatttctttaatagcagtgtgaacatggactaatatactggtcactcaccacagtcagaggaaacctcattaattctctcatggatccctgagtagcttggatttctgatatgtctgcctgaatgaactagttgcaaaatatacacccctccctgatcctcatctaatgaaagtcacctgttacaagaatggtttaaaaagaacccattgaattccraagaatacctgtcaaaagtgattgatttttagtgaaaatagttttattctgaaaatagttagctttcagaataattttctattaaggccactcagccttggttcataaaatgagaccatatcaacagcctgtagaggctctttctcctctatggcaggagggtctgaatccaattcatctaaaaagactccaaattgtctgtatattaattgcatatgggataggaagcaggttcttgatctgttttacaccattgataattatttttcagatctgttgagaatttctgcaaacacagtgatattaaaatgcaggttttctgtgagcatcagttactggcgggggctggggagctgtctgtatcacttggccagtgtctggtttacatagttgaaaggcagtaaaaattcaatatgaactgcaaaaaatttcctattatgcttggcagagttctccgcaagatggcagacagtataataatgattgataactgtgcatatgattcctgcagtccctctcagtcaagctgcaagatgtgtaattatattcctaatctatcctctgagcacaagctgtttgctctgcctagaaacaatacttcctcctcccttttttctctcccccacaccaccttgttcacctggctaacttcttgtcctttgagacagcagagacagcacttcctgggaagccttttctcacatccacaattccacacagtggatttccctcctccctgcgtctgagccttgttttagcactcagcacactgtaattgtctgttcttttgcttatctatgccactaactgtgagctcattgagcagaggcattatatcttatttatctttttaactccgacctttagcacggttttaggcacatggtagatgctcagtaaaccaattacctgagaaactccaattgtaatttaagaagaaaactgttataaactttgatggaagatctggaaaagtcataggtgtgtggttttgatgccttttcttttttttagtggaatagaatatggtttgcgtatattcatgtggaatcatatcctaataattaaaatagccattatgtaattgattagagcccaccatcaaaaacacacgctatacatttttttctgataataaagttatatttgcttataagatgaaattcataacacacagaaaagtatagggaagaaaataaaaatatcttagaatcctaccatctagatagaggtactcactgtataatttttaggtatattttcttttagtcatattttcctgtgtatttgcacatatgtgcattggggttgtaagataaaatgaagaatgcctagcaaaaattagaattttttagtataaggatgtcccatgtaatatttggcatgtatttatatgaaaaattattcattgtttatctgaaattagtcttcaactgccatgctttattttaatttgttaaacctggcaaacctcatgtccatatatgtataaatgtactaaatttggttcataccatatatacatctttgtattcttttctcagttaatgttatatattgtgagttcttttccatctcattaactactttttgaaaacaaaagcttaaaaggcaaatttaacaactcaccttctacaaacaattgctaaacgttataaataaacacattttactctatgtctgtaaggcattttttagcagagattcctaaagtgtgattaatgggttgaaggccaaaggtcattattttttagggattcttttacgtattactttccagaaacattttaccaatttatgcttttcatcgacagtgggtttctaataagctcttctatttgcattttatcagcatcaagtactgtcattaattttaaaagtttgccaatttgatagataaattgcagtatcttaaggtacttttattattgcttgcataatgacctttgcaaagggtcattgaagaatgaccttttttatcgtcataaaaatgcatacttcttatttagtggattgttcattcatgtcttyatacattttcttttggctgtattaaagttttgttatttatttatagggacacttcttcttatattttgttacttacagggatttttgaggatattagcgcattgtcttccatatatgttaaaatattttctccaagttattatacctcttttcatttatttgacgttttctgatgtgcagatactacttatttttgtgtcttcaatttttgtctgtaatttcttccgttgctttcatgcttagaaagtccttccatgttccaaggtcaattgcatatttgccatattatcctttttttaatagttccgtttttctttttttttwaaaaaaaccaatccctttgtctatcagcaatttatttggatatgtagtaggaactgagaacacaacttgaattttcccgaatagcaaagttttccaacactatttattgacaactggcatgtatataaaagtgtacattccttctcttagtggattgtgacatttcacttactgtatgtgaagattttacactatgctttaagtctgttaattcagttctatcagttaggcttctaacagtttgatatatatgagcaacattttattaacttagtgttttgttaaagccaaatgatcatttacatgacatataaggccaggagttacaaggggctaacaaaataagtaatggctttaagattataaagctgggccaggtgaggtggctcatccctataatcccagcactttggaaaactgaggtaggaggattgcttgaggccaggagttcgaggccactgtgaacgatggtcacggcactgcactccagcctgagtgacagagagatattctgcctctaaacaaacaaaaacaaacattataaagctggggaaaaagtaagcctaaaactgttagttggatccagtgagtctacaacctgttaccagaaacaaaagatatgcagctgttctcccaaaactattttaatatttagttataatagataataccatggtttagttatactagagtttctgacaaacttcttatttttatctctttgtgataattttctcagctcagttgtctatttcactgatttttttcttcagccctggcaagttgactatttagctcatctattgaaaatttgtatgtggctatgtgtgcctatgtatttaaatttcagtgatgatacttttttctaagtttttttcttcctagtctacagttcttgtttcataaactcccattctttttccataaaaccctgttcaattatgagcatacatttccttgggtgctgtaatataaaagaaatagataagtatcacttttgccttggtcctgtacctccatcccaaggatagcaaaaggcaaaaaagaggcactagatgaaacttttaaggtttaaaaccagaaaaaccttatttggtaatattaaattgcttgtgggtaaatttggcttgttttgcatttaatttcacccagttgaatgatccaagtataaaatgaccttctcaatcaggaccaattccacgttttaccctggaaatttcatcaccaatattgacattcagatacctaggtatgattatcccaagaaagtattattagtacctcacagaaatcgaaagtggagttcctaaaatttgccaaattaagtcccaaagtactgaaatagatgctcgatgttcatacataaagacaatatatttgccctaatgcagcccatagcttgaggcagcaactctcagtgtcattgtttgaaccacactggtgtgttgaggtgccttggatgagaaacaggtggaattacaagcagaacattgggagttgtgaatatcctacaacctgtctcatgtatgcagcagctggcagtgtgcatttatcagtaggggtatgtcatatttgtgagtgttatttgccaaagtcatctcacagaagaggttgaggatcattggtccagtatgaattaatacagtgtgcgatgtggatgtatccaatgagatagaaaatgagcatagaaaagatgtgcctgggtctgtctgcggcaattggtgaaagcttcagagaggagatgacacatgagttgaccctctgaggagatgaggggaattgccaagtagaagaggtgagagggggctggatgcttagcagtggtctccttggcattgtctgggttctcctttctgacacaatgttgctgtttacaacgggaagtttattttgtagaatttagatctcttgcagaaaaatactgacagagcccagaagaaaatgaacagactggggaagggagcatctcaggtacccggagggtggtgaagccaagcaggatggcaaactgatatgaaatgaaaaaaaagataaataatataaaattagaaactgccctcaaggaattggaaattgaaatgagaaacacaaaggagttttgtttggaaagtgcaaaggattccatctgagaaaagtaatccgaggctcaggcctagggtagggagatggagcagggaagactcggaaaatgataaccctaaggccatggagggttaaatgtgaaaggcaaactggagtggagctggcaataagatacagattctcttagagaaagctttgtctccctgggctacttcagggctgatggcaaagggacatggaccctgtgaaactcagccgggaaggctgcagcaggaaacagcctgcattacatttggcatttccaaagaccaaaaggtctgggctaggaaaaaaaaaaaaatcaagattgggagggaagcaatccacttttgcttggagttgtgagttcagggagggaagacttttgggtttcacctaggggtattgatgactaaaatctcattttgcacaaccacctctttgtaaagtagattttcctgtgacaatagcctgagccctgaaggaatctctgcgggaatgtcatagtgtaggttagaaagccccatggaaagtgtgagaaggcagaaaaagctgagctcagcatgagttcaatccagaaatagaaaaggctcagcccctgactggtagtttagacttggtacttagaaaatcatcatagaatccatttggtgacctttaaaagtataatttataaaaggacaatagaagctctattaaccaaaccctacttaactaacttgccagattacttgatgctcaccattccctcattaagacacccagaacaagctgggtatttataaatggaagcctatctctaactatagtattacaggcaaaatacaaaatgacatatgacaagacttttcattgctgcactaatagcaaaagattgcaaactacccaaagatctatcaataagggattgttgtttgcatctatgcatgtctgtacaatggagaacagctattaaaagggatgaggaggatctctatttactgctatagagtgatcctcaggatacgttgagtgaagaaagcagtactcacaggtgtacatggtatgctcctttttgtttttttaaaaagcagtaaatacaaatatgcttgcttgtattttcgaagaaatgatagaaagataaacaaaatactaaagcaaagatagaggaaatgaggagaagggactgacatgaaagcaagccctctcttgaatgtttgttatagttttggttttggagccatgcatattatttacatagttttaaaatattaaagcaaaaagaaaaaagcaatccttaaacatgaaactcaactgaagcataggaatctaacaaattacgaagtcaaaggcataatcacacagaaaagcattatttcaagagactttaaaacagaattttggtttatacagtccaaggacaaaacacacacgcagatgtacacacacatcttaaactgcattcagtgggcttactattggaatgttgaagttactattttgaaatgattgtatatagtagggtaaaataaataaataatcttgttaatgttgcatggaaccaagatattcagtttaatagagatacaaatatgaactaaagaagttaagtgtgaaacctctactattcaatttgaattagagagactgtcagtttctgctcaggatgtggagagcaggaaagaatgtcactctcaaccttacaaggccatggagaaggccacatccccagggacacagcgcctgcctgagactggggctttatcagaaaacagtgaatgccctcttgtctctcaccaccatcctaacaagcatcaggtagaaactgacagtggaatactgctaacagaggggcaaaagtgaggagggaaaccctctctttaggaaagcagaaaggaaagacctaaagctgaggatgcagcagacattgaggacaaactctctggaaaattagcctgtactttaaacacaaggtatttctagagagatttaaaatctgtgatgtatttcgagtaaccatagcaacaacagtcccagtcccagctaaaatcttatctagattgactcaaaaccaaactaaaggcctagccaaaggaaagaccatttgcaggcataaaaacctcagtgtctactgacctacataaaatgcctggctttcaacaaaaaaattatgaattatgtgaaaaagcaagaaaagaacaatgcagtaccaagcaacaaagcaactgatagaaccagactcagatatgacacgaacattggaactatcagacaggaaaattttaaaaaattataattaatatgttaaaagccctaacggaacaggtggaaaacacacaagatcagatggataattccagcagaaagatggaaaccataagaaagaaccaaatgaaaagaccggaaatgagcagcacagaacagagatgaagaatgcctttgctgggctcatcagtagacttgatacagctgtggaaaaaatcagcagacttgaagatgggtccaaagagatgaccaaaactaacacaaaaagaagatatagttaaaaaaaaaaccaaataagtaaataaataaaaaacagagcatccaagaactatgggacaacatcaaggggtctaatataagtatagctggaatcccagagaagaagaaatagagaggggggtatgagaaatatttgagggaacaatggctgagattttcccccaaattaatgacatatactaaaccacagatctaagaagttaagaaaaaccaagcaggatcaataacaacaacaacagcaacaacagtgataaaacctacatatatcataataaaattgctaaaaggacaaagagaaaaatgactcattacacagcataactaagataaaaattacaataaatttctcatcagagatgatgcaagccaggaaacaatggagttgtattagtctgttctcacactgctaatgaagacatacctaagactgggtaatttataaaagaaagaggtttaatggactcacagttccacatggctggggaggcctcacaatcatggtggaaggcaaaggagaaacaaaggcacatcttacatgacagcaagcaagagagcatgtgcaggggaactcccctttataaaaccatcagatctcaagagactcagtatcatgaaaacagcacgggaaagacacacccccatgattccattatctcccacagggtccttcccataacacatgggaattatgggagctacaattcaagatgagatttgggtggggacacagccaaaccatattaaaagtggtatctttaaagtgctgaaagaaagaaaaataatacttatcaacagagttctatactcagtggaaatatcttttaaaacatgaaagcaaaagaagtatttgttagacaagcaaaaactgtgagaattcatctttcagcagacctgtagtacaataaatattaaggatactttttgaagagtaaatgtggtaccagatagaaacttagatccacacaaagaggtgaggaggactgggaaaaggtaaaaatacaatttgtgggtttaaaacattttaaaattctctaaattrtaactaattgtctaaagcaaagagggtagcaatatattgtgtgtttacaacataattaaaagtgaaatgtattgtagcaataatacaaagtgtgggaagaggaaccgtgaacacaccgttttagtttgagttgcaaatatcagtatgaactcaagatttttttatttctaaaagattagtatttcctcatttattgcactgaaaaggcctagaagtaatgacaaccctgtagcaataaaatccgtaacatgtatattgtgctgtctaaatgccacttccaactaaaaattaagttttctttggagaagtaacagaatccaggtctggagtagaaaatgtacaagatgaatattgggcatttgttatgtctaaaagttcagaggttctcaaagataccaggattgtgtcaaagagactccggatccaccatgaaagagttcttgctgtcaaaatgcaggacagtgtgagcatcaaaaagaataattacaactgatgacaagacatcaaatatgttaaaaatacatgaattttaaataatacccccccaaaacaaacaagcaagtgaaccttattggttacctcgaaaactttctagggtatcaatttattatatgggaaaaaaagagcaagtattctgccattcctaaacagactatgtggttgatgagggaaagttattcataccaaaagcacagttaataaatgcaggaaggttgaagaactggaaaagcaacattttgcaactagtagtaaaataatgaatctagacaatgattgctaaaagcattaagtaaaaggtagatggcaaattttctagtagatggatcaagccaacatcacataaacccccaatcgatgtcaacatcgcacgaaacaggaaaatatgcactgtgtgcctcctggtgtgtgatacacagcaccactaaccttattatttaaaaaattaaatctgaattgaattaaacctttaaatctgaactttgcaattcagtagccaccagtcacatatggctatttaaatttaaatttaataattaaaagttcagttcctcaatcacggtagccactttgcaagtactcaatagccactcacatggctagtggctaccatattggacagtgcagatgtagaacattcccagcactacagaaagtcctactggacagccctgctccagatctgaggaccagttatagggaatttgaggaagagagaaatgtgaaccaatacccagaagaaggagtcagtcaaatccagaatgtgagaaagtctatggaacaagagatgcagattcttcaattaaatcacctgcataaatcattaaagagacttaaacaggtagcaactaaatgtggaccttgtttggatcctaatttgaacaaaccaacttgcacaagacatttttgagtcagtcaagaaaaatagaacataaactaggtacttcctgatattaagaaattatcagttttgttgagtataataatattgtggataatgttgctgaaaactcttatctgttaaagatacattttgaagtatttatgagtaaaattatctttttttaggattagctttcagaaaaaaaagtgagaggttgatagaggaacaaaaatggcagaaaggtgatggttgttgctgatgatgagtatatggggttcatagttctattttctatagtttttgtattgaaaaattttttataataaaacatttttaaaactaggatatgcctatgtacttctcagcttcacaagttgaatgacttgcttattaaaattaagttatatttgttcccaaactggtttatataatttggacttcttataatttataatcatgtattttaattaaatatgataatatatgaatgataaaatataatttcttttatggaaactaagttgagtgttttagaaagattcactaatagagaattgctttttaaaaagcaacaaaatgaggtttggaataagcaaatgtgacagatttgaaaaaaattataaattataaagaactagaaggattttacactcaagtttttttctcaggtgcctagatcactttaaataaaccaaatccggaaattttagatgagatattgtggataagatttaggtgaaaacaaatgaataattcaaatgaataaatcctattcaaaagattggtgatcaaaaacatggattaaagtgaagaatttaggaaaatgttatgcatatttacagtaacttgataataaaatgcagcttatcgcaggtggtaacagacttgggggaggtggcataacttgtggtttatatgataaaggaacaggtaatttatcccccaactagggacacgttggagagtgaaaagaggtactatgcataatcccactgggataacaggcataaactgggatgattcctgagcatgccaggatgttttgtcccctggacagtaagagatcagaatgggaaagtgcgcccctgtgggtgagatgttctcatactttgggccaataggagagagcagcaggggatggatggagtctcgttacctgggcctctctgtgtgctaagccataggaaggacacaaagacatgaggagtctgggccccttaacccagagttttgttctcgtccctcaatgacctgtatcctgtccccttgtgtcatgtcscctgtgttcttgtcatcatggagacactcctgtctgctcttgcaaacccagggagtataaccaggatttgaggttttccactctaaaccagtcattgaggtggagatcgtgggcccctttgctgtctcccctatgttcgggtccctgtagagtgatgattcagccactgtgtattagaatcacttaattgtctaaattaattggtttaggaaaagggcagcatagatattctttaaaagcaccccaggagagtctaacaaccactgggattaggtaccactgttacagagtcaccctgacactgatgggggatagcattatcactctcaggactgggatctcagactgggtcaaggggcagggaaggcaggcagggctaagtaggagaataaagcaatttgtttattcacttacatttgtttatgcccctgccttatcccatgaaggatttagggcaaggcagtggggggactaatgaggataattggacaagtggaggaaagccctcttttgtgatgagagttagttacacaggcacatatgggtcagccacaaataacgtcaccagtgtgccgccactgactcactccccagccacagcaggatccaaaagatctttcgatcttttataacgagttttataatgaccatgtattgactgggccagcagagcccgggaagtgggacctggaagaacaggctcttcagtgtcagccaagragctcacttgtcagtgtttcagagtgatcctgggatggtaattgctgctgagctttgcagaaatggcaaggtgtgggaaagtgacacaagtcttgaatcctaaagctgaaattttggaaataggcgacatgtttgaatatttggaatctcacctctagcaaaggtgcagctgaaagggctattgtccactagcttggatgacagagagttcagtggctgaggtggtgatttctatgctaatgttttctttttttagtttataaatgttatcctcagaggataatacttgaggagattcaggagattcacaacaagacaacattcatgttaagctagccaatggccggatgctttcttagcctttaatagctaagacaccaacattgactcttttcctaactctttaacaattaacagcaaccgactgaggctgctttgagctgctagccaaaccctccctccagagacacttaggactgaatcacttaaatcaaataatagggtaacccagataaaaaataatatgatgaacacaaacaagattgagacctttgcattaagctaaacgctgatgacagttgccttctgaagacttggagatgtgccctccatgtggaggtgggttttgaggtgcaaaaccaccatggaccttgcattactattaaataatacccatccttcctcaggggtcaggctgggtcagccaaagaatggctttgtccattctttgtttctctctcctccacttcaccaaaaatctctaaagtgatatctgtcatcatagacttaggttaggtaatgagacccatgggaacctagaggatggaaacttagcccaggagaggggtagccttcctggagaaggagcagttccagccaagattcaatggatgaattcggagtcagccaatgagaacatccaaggcaaaggaagcagcaagagaaaatgcagggagaataaacaagtgtggacctacctccaggtgtgagccttctgtcacctgccttcaagaaggatgcctggcagctgggcctgctgcactaagagactgagcctcctggttttttagtctcatcccatgcccagcccttattgtgcctggtgtcacccagtctagagcgtctccacttcctgaaggttgaattgtccctcttctcagctgccaccccacccatgatgttctgggacctggtcctcctgctccatcacattggtcacctctccatctgctttccaactggcagaagcttttggaaatttctcttccatggatggcctttctcttgttctctttgttctcgaggtttctacttttcctctcctcagtttcattttaaaagagaaaggccatctgtggaagagagatttccaaaagcttctgccagtcagaaagcaggtggagaggtgaccaatgtgatggagcagaagcaccaggagacactgctataaggatcctacccaagactgggtaatttgtaaataaaagaggtttaattgactcacagttccacatggctggggaggcctcaggaaacttacaatcatggtggaaggtgaagggagagtaggcagcttcttcacaaggcagcaggagagagagggcgagcaaaggggaggtgccacacttttaaaccatcagatctcatgagaactcactcactatcatgagaacagcaaggaggaaaccgcccccatgatccaatcacctcccaccaggtctctccctcgacatgtggggattacaattcagaatgagatttgggtagggacacagagccaaatcatatcaaggtgtatattgtggtccttcaacatcttcctctaagaaagctcttagagctttcctttgatattttgcaagtataaaaggaaaatcctcctatttaaaaatgtttcttagtagtacaaaatgcatacacttaataaacatcttgtacacatagagatgctgttttctttcctgacacaccagtctataaatcatattcacttttaataccatcctattttcaaaaygcccatataaaataaaataactctacattgaatcaaaatgcccatgttaacacatctgtcccttttttcctctcctcaagtcttcttatttcctaaattcctcagagagttttttattagtacacgtattgatttggtcagttctagagaccatgagttctccactgaaacccatcttggatcttgaacttccatggtatcagtcactcatgacgggattgttgtgaagatcatgaagggaacagtcaggaaagagcccggaacctcgtaagctactgaatagattcttgaaactctctattttattattccttgtacttttcaaacaaccatactaattttaatttattccacgatttgagtgtaaatttggttcctttagaaactgaaaacatctttatttaaaaaaatttttatttttaatttttgtgggtacatagtaggtatatatttatggggtacatgagatgttttgagacaggcatgcaatgtgaaataatcacatcatggaaaacatggtatccatcccctcaagcatttatcctttgtgtttcaaaaaatccaattatactctttcagctatttaaaaatgtacaattgagttattatagaaactgacaactgttagagcattttcaacatatctggagatctatcatctctttcctgtggtgagcgtctcaccacctacttaaggaactgtacaatctcctaattgggtgtttatcagcaaggaacaaggctaaaagaagacattattttgcctaatgtctgacagcaaatctgtgatgaagaaagaagtagatcttgttgtcctttcactctcccttcttgagacaattagaaatccattgacctacagcaattatggacctggagtatctaccttccttccacagggcacttattcatagttacctttgaaacctcacaaatccctaaccccaygcgcatttcgttttagcaacatttcacccttttctgagtctctggcttactggctcaggcaactctctcttctccccttcacctcttgcagaaagcaaccccaaagaaatactcgcagttcagtgctgatgtggccgaggccattgccttctttgactccatcattgcagagctggatacagagagacgaccccgggctgctgaggccagcctgccaaatgaagatgtggactttgacggtgagtgccaggaaggcagtgggaagatggtggctgaaggcgggtggggctgtgatgctgtgaggatgggctgggggctctggggtggacttatagaataggccatcaggaatcccacctccctgattaaagggaaaccctgcacctccaagctggagcctggccctgagcccatcctctgtggggatctcttacttcagttttctgtgctgccacggctctaggctgcctctccaacactctggtgccatgtttggacaatgttttccctgtggtccacttaccacggctgagacaggtgggactttcctaagactccaagaaggacagcaatagggaaatgatgaaggaaggagaatcgatgaggggtgtcatttaaagggtacactttcagttttttgagatgaaaaagttccagagatcgcttgcaaaacaacgtgaatatactgaacatgactgaatggcacacttaaaaaatggtgatgatggtaaattttatgttctgtacacttcaccacaacttaaaaaaaagaaatgaaatggacaaactgtatttgagaatccagcttctgaccatacgtaggctaggtagtagggtggtgcatagggcaggagaggcccacggtggctgcccagacccagcctggactgctggagctggagtggggtgaggcctgagttcatgcttccctcctcaccaaggcgtgtccttgggcacccctcctgatggagagcaaagaatccaaacacattcatcagttgagcaccctttacattccatcatgcgactgtcagacagtttgtttaatctttgacttgcccaccatggtgtaaattaatgatagttttattcagggggctcactggccccttatactaaggttagagcttttggtaccaatattaaataattcatgagtgttttctctaatgcttgaaagaagcttgtgatttgttgttgttgttctggccttgatagatgtgtatctgtgggatttggggtttcaaattgggttctttgcagtttcacagaaggttaactctgctccccaagcttattcttatcctcctcctctcccacgcagcccctccagtccctgacagacagcagccctgcccctgggagtgagggggcctaggaaattcaggatattggtgaaaggatgacaaaatccactaaggatgcaagggtcattttcagagttataatttttaataaaaatgaatgtgaccaagtcatttttattaagttcatgaaatgaccacttttctcctctgataacaaaaaacataccaaagcataaagaagaaagtaaaaaatatgacctgcaaaactgccacccagagataatcatcaccggtaacatttggggatatgtctttttgagtgtggttttaacacacacacacacactctstctctcacacacacactctcttacacacacacactctcacatacacacacacaaactcacaaactcattttaatttttttgccataaaactaggatgtcctttcatttaacaatttacaatacatcttgggctactttccaagcccataaatatagatctgtgtcttcttgtttttttttttgtttttttttgtttttttttttgagacggagtctcgctccatcgcccaggctgtgtgcagtggcacgatctcagctcactgcaagctctgcctgccaggttcacgccattctcctgcctcagcctcccgagtagctgggactacgggcgctcaccaccacgcccggctaattttttgtatttttcagtagagacggggtttcaccgtgttagccaggatggtctcaatctccttacctagtgatccacatgcctcagcctcccaaagtgttgggattacaggtgtgagccaccacgcctggccttttttttgagacggagtctcgctctgtcatccaggctggagtgcagtggtacagtctcggctcattgctacctctgccttcccagtagctgtgattataggcacctgccactacgcccggctaatttttgtatttttaatagagatggggtttcaccatgttggccaggctggtctcaactcctggcctcaggtgactggcctgcctcgaactcccaaagtgctgggattacaggcgtgagcccccgcacctggcctatgtccccatttttaatggacatatattccattgcattcctcctgcaccacaactgcagagtcaaatctgctttgcttggctattaggaacatggttgcctacacccatttcctgtgagtgttcagtccaatccgccctctcctttgccttatgcgcctcccaatggcaagcccttccttcctgggtcacatgcttttctcttctagtggccaccagctccagggagcacagcttgcattctaactggatcctgcgggcaccgcgcagacactccgaggatatcgctgcccacactgtgcatactgtagacggccagtttcgaaggagcaccgagcacaggaccgtgggcactcagaggagactcgagaggcaccccatttatttgcccaaggctgtggaaggggccttcaacacctggaaatttaagcccaaagcctgyaaaaaagagtaagtgyttgggctaaatagcatgaccaagatgttctcgtggcctccagacgcttggggtgatccttaaggtgcctccagccccatcttacatgccaaatattattcatatatatatatatatatatatatttgttgttgctggtggtggtgaggtcttagtttcaacatttttttttggtagtctgcactctagcctggtgcactgctcctaacttgcttcttcctgggtctgcctccctttctttctggcccacttagcccatgcactgtgccatccaccttcatggatttccccccagtgccattgacgcatggcatgctacagacttttaatgagtttgaggttcaacagagcatagcaccaagaggaaaccaacatcaaatgaatcagatgcccctctctaaaatgcaccgggcaggctccaagatgtagaacgtcttgctggccaggcccctcttgggccatcttaccaccatctcctctggcctgtctccttttagatcctcctcccccaggcctagttaccatcactaaccgtcaaattcctgttatccactcgctcagagcagtaagctctttctgggtttgggcaacccaggccatgctgcagggccttgcctgtcacaacggaagggcctgtcaagcctcatcagctgtcttcctttgcttctacaaaagccactaaaccctgttggatttaggggctttctagatagcatttcccttccacagkaacagaccatgcactggacatattaaaatcacaacccagccctcaccacccgtccttccccttcaaggccaggccaaggtccagctgaggtccacccatggcccccatggcgacaccatttggtcctccccaagacccaggactagggcagcaatctgagggtctccatgagaatggtggtcattgagcatcccttccctctgtgtggccggccaagccgaacttaaacctcctgcctcattccttccttcwagcctggggagctccagacagatccttttcaacttctcaggagaagatatggagtgggatgcagagctctttgcgttggagccccagttgtctcctggggaggactaytatgagacagagaaccccaaaggacagtggctgcttcgagaaagactttgggagcggayggtgccctgactccatctggattccttgacgtgtctcagactgggtccctgagaagctgtccgctttcagcgcagcatgaggtatttggtagagttgaaaatgccaattgtaacmcagtcaacccrctcagcacactgcctgctggtgccgtgccagtgccaaacagacctgtggcttcccaggggacaggtctcaggacactctcagagcttgagtttctctgcgtgggctgatgaccagggacttacagcctggctggtcttcaagagctgaaggaatggaaggtcttgagtggagtgtctgggctcactcccctgacctcacctggcctggtcctcattctccacgtgtctgtccaggtggctgctagcaatgtgctcagtaccagaaatgaactcacctgtagatttctgggccaaagcttcaaagaggtagctcctctttctatgaggctcagagacatgctggatctgcactgaggttgccgtcttgtgtgcagaatgcagttgagaaagcagctccttttgctctaactcttttcagagttttccagaaactcctgctgcattaagctaagatgaggctaatgccctggcaatggggtgagggaaggggtatgtcacgagcctgcctgggggccacactgtttcctcaggccccaaaactcagctccccttcacataggcaattgacaagagaagaagggagatggggtgattcttttctttttcttctaattcttacccagaaaaatctttttaaatatccatggaaccagtttatgacaggccacacctttccctttccccagttaagagaacaatcagaatcattacgttcttttggtatagaaaggatttctgtattttaggaactatctgaatcagaattacatttaaaatatattctttgtatttctaaatactttttacatttttgcaatagttgtacccattcaagcttgagaaccactggtttggagaatatactgaaatttatctattctcacttctttttttggcattttcttgtaaaccagtctgtgcatgtataagggtctttgggcagaaggaagggagagagacaaaaaacagaaaacaaaacaaaacaaagaaaaccacaatcatttgaattaagccaaggatgttctaggctaaggtcaggctaagaactgaacagaggcttcctttctgccatgcctgtgggatgatattcttattgttccattttttaggaagaaccttttgtttatgtgaacctgatcatatgaatctaagaatatgtaactcttacaaataaaaaacagctagtaattatattgcattcttagaaattttatctcaacatgttttcagaatgaaaccatactagaaatgttttaatacctctctttattatttttcgagtgccaatgtcaatgtttggaaagtttctttcattttgttgcttgtactaacccagctatagccagaagcttgactggaaagtaaatgtttaggagatttgttttataaactgcattaaagcactgccatttatcaccacagatcttttattttccctaaatgtggccttgtttgaagcctcatctataaaagttcattgttggggataaactcaggataaaggtgtctttactctgcctcttatcaaactacagtttatcatagatccaccctgaaattatgtggtgaagatactgtgtacattttgtttttaaagataagaaaaaataaacatgactgcgaggatgtttggagtcctgatttttttaaaagcatttattgcttatggcacatgaagctgtgccgtcttattttgctttgttttgtatgttttttgtctttcatgagactatacacagcctgaaaaattccatgattgggaaacagaaggttgtcttgtctttggggatcatttttaggtgtttgaagttggtgataaacccaaggatctgtgctctgcctggggaatcttgagatggtgtctggtggggtttgagataaatgaaatctgaaacaataaaagtcaattcagaaaacccagttgagttgacagattcttttcttccttggattggccagttattcaatggaatcaagctgatcactgaggctatgttagatctctggctttcccaggattctcagttttgatacatgaaaatctacctatccctagacagaatgtcaaaaagagaggatgtgcatccgtggcatctggcttgttttttagcacctggtttctagctcccgctacagactgtcttctgcttcatggggcaagatgcatggagctgctagtttgatttgaatcgtgtgtacccagccatgtgccatgcaactgagagcattgctgccaagaccgaccttcctggtgcccattctcagacacagagcccaaagtgtctctaacaggacactgtgttcctctcaccactgttcgcctttgcagagagaatgagtttcctgttgctgctgtaataaattaccacagacttaaaggcttaaaacaatatatatttatgcttttacagtctggaagtcagaagaaccaaaatcagtttcaccaggttaggtcaagatgttggcagggctgtgttccttctggaagctttagaggagaatccatttccttgcttttttcagctttcaggggcttcctgcattccttggctggtgaccccatccttgcatcactccaacctattgattccatcatcacgtctccacctgctcagtctgtgctcctgcttcccatttataaggattttttttttttttttgagacagagttttgctcttgttgcccaggctggagtgcaatgggcacgatcttggctcaccgcagcctctgcctcctgggttcaagtgattctcttgcctcagcctcctgagtagctgggattacaggcatgtgccaccatgcctggctaattttgtatttttagtagagacggggtttccccatgttggtcaggctggtctcgaactcctgacctcaggtgatctgcccaccttggcctcccaaagtgctgggattacaggtgtgagcctacgtgcccggcccatttataaggatctttgtgattacatcactctcacctgagcaatctctccatctccaaatccttaatttaatcaaatctgcaaaatatcttttgccatataaaatgacattcacaggttctggggattaggatggaaacatctttgggaagccattatctagccaaccatacagcatcacaagatgttctagtcctaacagacccagcccaattcccttttaagcttcattataaaagcccaatattgggaggagccaagatggccgaataggaacagctccggtctacagctcccagcgtgagcgacgcagaagacgggtgatttctgcatttccatctgaggtaccgggttcatctcactagggagtgccagacagtgggcgcaggacagtgggtgtgtgcaccgtgcgcgagccgaagcagggcgaggcattgcctcactcgggaagcacaaggggtcagggagttccctttccgagtcaaagaaaggggtgacggacggcacctggaaaatcgggtcactcccacccgaatactgtgcttttccgacgggcttaaaaaacggcgcaccacgagattatatcctgcacctggctcggagggtgctacgcccacggagtctcgctgattgctagcacagcagtctgagatcaaactgcaaggcggcagcgaggctgggggaggggcgcccgccattgcccaggcttgcttaggtaaacaaagcagccgggaagctcgaactgggtggagcccaccacagctcaaggaggcctgcctgcctctgtaggctccacctctgggggcagggcacagacaaacaaaaaggcagcagtaacctctgcagacttaaatgtccctgtctgacagctttgaagagagcagtggttctcccagcacgcagctggagatctgagaacgggcagactgcctcctcgagtgggtccctgacccctgacccccgagcagcctaactgggaggcacccccccagcaggggcacactgacacctcacacggctgggtactccaacagacctgcagctgagggtcctgtctgttaaaggaaaactaacaaacagaaaggacatccacaccaaaaaaccatctgtatatcaccatcatcaaagaccaaaagtagataaaaccacaaagatggggaaaaaacagaacagaaaaactggaaactctaaaaagcagagcgcctctcctcctccaaaggaacgcagttcctcaccagcaacggaacaaagctggatggagaacgactttgacgagctgagagaagaaggcttcagacgatcaaattactctgagctacaggaggacattcaaaccaaaggcaaagaagttgaaaactttgaaaaaattttagaagaatgtataactagaataaccaatacagagaagtgcttaaaggagctgatggagctgaaaaccaaggctcgagaactatgtgaagaatgcagaagcctcaggagccgatgcgatcaactggaagaaagggtatcagcgatggaagatgaagtgaatgaaatgaagtgagaagagaagtttagagaaaaaagaataaaaagaaatgagcaaagcctccaagaaatatgggactatgtgaaaagaccaaatctacgtctgattggtgtacctgaaagtgacagggagaatggaaccaagttggaaaacactctgcaggatattgtccaggagaacttccccaatctagcaaggcaggccaacgttcagattcaggaaatacagagaacaccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagagtgggggccaatattcaacattcttaaagaaaagaattttcaacccagaatttcattttctttttttttttaacattgataaaatactattatctaaaccacaatccctatatacagagttcatccattgtctcaacgatgccctttgtaagtaattattattctggttcaggatctatcatcactcagtacatttagttgtcctctttagatttatttaatctcaagtattttttttttttttttttaattgatcattcttgggtgtttctcgcagagggggatttggcagggtcataggacaatagtggagggaaggtcagcagataaacaagtgaacaaaggtctctggttttcctaggcagaggaccctgaggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcactttcagagagcgcagggttgggggtaaggtcacagatcaacaggatcccaaggcagaagaatttttcttagtacagaagaaaatgaaaagtctcccatgtctacttctttctacacagacacggcaaccatccgatttctcaatcttttccccacctttcccccctttctattccataaaaccgccactgtcatcatggcccgttctcaatgagccgctgggcacacctcccagacagggtggtggctgggcagaggggctcctcacttcccagtaggggcggccgggcagaggcgcccctcacctcccggatggggcggctggccgggcggggggctgacccccccacctccctcctggatggggcggctggctgggcggggggctgaccccccacctccctcccagacagggcggctggccaggcggggggctgacccccccacctccctcccggacggggcggctggccaggtagaggggctcctcacttcccagtaggggcggccgggcagaggtgcccctcacctcccggacgaggcggctggccgggcagggggctgaccccccacctccctcccggatggggcggctggcctggcgggggctgacccccacctccctcccggacggggtggctgctgggcggagacgctcctcacttcccagatggggtggctgctgggcggaggggctcctcacttctcagatggggcggttgccaggcagagggtctcctcacttctcagacggggcggctgggcagagacactcctcacctcccagacggggtcccggccgggcagaggcgctcctcacatcccagacg

SEQ ID NO: 17973 - DNA, 46215 bp, Homo sapiens
  misc_feature (1)...(46215): n = A,T,C or G, or insertion/deletion polymorphism (see Tables 1-2)
aatacatatttatccaaagacgatatacatgccataacaatataacaagtatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctaatctcaggtacccagggacacagacgctgcggaaggccgcagggtcctctgcctaggaaaaccagagacctttgttcacttgtttatctgctgaccttccctccactgttgtcctatgaccctgccaagtccccctctgtgagaaacacccaagaattatcaataaaataaataaataaataaataaataaataaataaaaaagatttctttggggggtgctgggaatgttctggaactcaatagtggtaactgcacaagtctgtaaatatactaattttgaatcattaaaactaaaattcattaacaatcattgaattatacacatgaaaacaagcgaactttatggattgcaatttttttttttttttttgaggcagagtttcgctcttgttgcccaggctggagtgcaatggcgcgatctcagctcactgcaacctctgcctccagatgcaagcgattcttacatctcagcctcccaagtagctgggattacaggcatgcaccaccatgccccgccaatttttgtatttttagtagagacagagtttcaccatgttgcttcgtctggtctcgaactcctgacctcaggtgatccgcccgcctcgacttcccaatgtgctgggattacaggcatgagccagcatggtggccatggagtgcaacttttatctcaataatgctgttttgaaaatagtacagagagttcttgtgtacccttcacgtagcttgagaactttttattttattttatttttgagcgagagtctcactcggtcacccaagctggagtgcaatagcatgatctcagctcactacaacctccacctccgggtgcaagcgattcttatgcctcagcctcccaagtaactaggattacaggcatgtgccaccatgccccactaatttttgtattttagtagagacaggttttcaccatgttggctaggctggtctcgaattcctgacctcaaatgatccacctgcctcagcctcccaaagtgctgggattacaggcgtgagccaccacacctgccccctgcccaccccccagaacttgttttttttttttttttggagacggagtcttgctctgtcacccaggctggagtgcagtggcccgatcttggcttactgcaacctctgcctaccgggttcacaccattctcctgcctcagcctcccgagtagctgggactacaggcgcccgccaccatgcccggctaatttttttgtatttttagtagagatggggtttcaccgtgttagccaggatggtctcgatctcctgacctcgtgatccaccctcctcagcctcccaaagtgctgggattacaggcgtgaaccaccgcgcccggccaccccccagaacttcttatacaaccatagagcgacaatcaaaccaggaaattgacattggtacaatactctttttttcttttttgagacggagtcttgctcttttgcccaggctggagtgcagtgactatctcagctcactacaacctctacctcctgggttcaagcaattctccttccttagcctctcaagtagctcgaagcacaggtgcgtgccaccatgcccggctaatttttttgtatttttagtagagacagggtttcaccgtgttagccaggatggtctcgatctcctgaccttgtgatccgccagcctcggcctcccaaagtgctgggattacaggcgtgaaccaccgcgcccggccacaatactcttaatgaaactacagaccatagtaggatttcaccagggcttagagcaatgtctggcacgtagtgaaccttacacaggtgaaaggacttcactaccatgacgatgatgatgatgaagatgataatgatgatgttggactttctagcacagccagattgatatggtgcctattttcagagcatgccatgttagtttctatatctaaaccttttttggcctggcacggtggctcacgcttgaaatcccagcaatttgggaggctgaggtaggcagattacttgagctcagtagttcgagaccagcctgacaaacatggagaaacgccatctctacgaaaaatacaaaattagccgggtgtggtggcacatgcctgtaaccccagctactcaggaggctgaggcaggagaatcgcttgaatcctggaggcagaggttgcagtgagccgagattgtgacactgcactccagcctgggcgacagagtgagactctgcctcaaaaaacaaaaaacaaaccaaaacccccactttttttctatgaaaccagcctcgctctgtcacccaggctggagtgcagtggtgccatcatgatcctcccacctcagcctcccgagtagctgggactacaggcatgtaccactatgcctggttaatatttttattatttgtagagatgagggtctcagtatgttgcccaggctagtcttaaactcatgagtttaaccaatcctctcgccgctgcctcccaacgtgctaggattacaggtatgagtcacggtgcccggcttctttcttaactctttctagtagttctaccacttgggattacctttttccttcctctccatttacctttatgaaatcctcacatccatccatctccatcaaatctttaacaattctcctctgtcttttttgactgtagggacctttagaacacccagcattaaaaaatagatttcaggccgggcatgggggctcacgcctgtaatcccagcactttgggagggccgaggcaggaggatttcgtaaggtcaggagtttgagaccagcctggccaacatagtgaaaccctgtctctactaaaaatccaaaacttagccggcagtagtggcgcgtgcctgtaatccagctactctggagactgaggcaggagaattgcttgatcctgggaggtggaggttgtgatgaattgagatcgcgccattgcactccagtctgggcaacagagtgagaccctgtctcaaaaaaacaaaaggaatattttttaaatttttaccgttctgaaagcacattgacatcctttgaatttttttctaattatttcactttgatttgtaaattctcaactagattcaggggctgtatgggttacaattcctctgcaccctccacggaatttcagacttttttttttcccccgagacagagtctcgctctgtcacccaggctggagtgcagtggcgcgatcttggctcactgcaacctccccctcccgggttcaagcgattctcctgcctcagcctcccgagtagctgggactacaggcgcccgccaccacgcccggctaatgtttgtatttttagtagagacggggtttcaccatgttggccaggctggcctcgaacttctggctttaagtgatccgcctgcctcggcctcccaaagtgctgcgattccaggcgtgagccaccgcgcccggccaaggtcttaattcttgcctgcctttctgctcccctgtgaactctactggttgtcttttttcctgctttatccctcgtcctcggtagacagtgatggttaaatgaatgaatgcatgaacaaatgactgtccaggagctagtactgcattgcatgtacacattgatgacaacagacatcgtacaatgcgcaatcttggcaaatttattcaaaccctttagacttcggtctctcacagtgcgacgccgggagcccatcacacgctgaggtctgtcagaggccccagaaacagcctcggaaatggaggaggcggggcctcaccccgaccacacccccttgcgttcaaagcctttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggaygcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaaggtgaggcgagagtgtggagcggcgcgcgggccggaggcggggcgggtgtgcgygcgcgcaggcgggtggggaccctccccgtttgggcagctcctgaggtgtcagctcccttgttatttccagttagtttttcatcaagtcattttaagcgcgtattatttgcaagcgctgatccagcgggggtacagtagtgacggagacaaaattcctgtccttacggggtttaaattacagcgggagagacagagaataacaaaaccttgaagctctgtaataaaaatgtcaggccgggcgcggtggctcacggttgtaatcccagcactttgggaggcccaggcgggcggatcacctgaggtcaggagttcgagaccagcctggccaacacagtgaaacctcgtctctacgaaaaatacaaaaatgagtcgtgtgtggtggcgcgtgtctataatcccagctactggggaggctgaggcaggagaatggcttgaacccaggaggcggaggttgcagtgagccgacatcgcaccattgcactccagcctgggagacagagtgaaacaacctctcaaaaaaaaaaaaaaaagtcagatagtgatcaatgtgatgaaaggaaaaacagagtaaaatggtaagggaattggcaaggggtgcttcttcctgctggtgcctgcttctccctcacactcactgacaggagcttaccctagggcaagaggtgaagaggattaggsggagggtgtgcaggcctttaaactgaggtgcctttccagctcgaaaatggcagcaattgcaggccaagcgctatgcagaaaagcggaagtttgggtttgtggatgcccagaaggaagacatgcccccagaacatgtcaggragatcattcgagaccatggagacatgaccaacaggaagttccgccatgacaaaagggtttacttggggtaaggaacatcctgaaataatttcatttggaatttggcccttttcycttctccctgtcccacagtcttggattgatgctttgacagctcatcttggtggatataagagaaaggagaaaaccagtaggagtctctgataatttctacatcttccacttttgcagtctgtttcccctctcttcccgatctgggactggtgctttaatttgtcctgttgatgatattataagatgtccctggccaggcgcggtggctcatgcctgtaatcccagcactttgggaggccgaggcgggtggatcatgaggtcaggagatcgagaccatcctggctaacacggtgaaaccccgtctctactaaaaatacacaaaattagctgggcgtggtggcaggtgtctgtagtcccagctacttgggaggctgaggcaggagaatggcgtgaacctgggaggcggaacttgtagtgagccgagatcacaccactgcactctggcctgggcgaaagtacgagactccgtctcaaaaaaaaaaaaaaaatgaaaaataagatgtccctatggttgagctggttgaagtccagagtgggatactgtgcatagtggcagcctgtcgctcctcagggacctgaattctgtgtttggggtatttaatttcagaggtttccctactcctgttttttctgtggctctaaactgggctagtacaggtacagatgtcttagcagattcctgttctatttggacacaaaaatgtttgccatgtaatgaactggaagttttgtttatttcaaaaaatacttagagaactgtgctggctgctggggatatagtagcgagcagagggtaacaatctccgcctttctgcagtgtgcggtctagtggcctgacagacatgagacaactggtgatagtgaagtatggtgaatactttattatgatttatgggaagatgcggagggaataggatgtgagagagccgcaaagctgtctccagagggatagccgttgatttagaggagctgataccagcattgtgggattatgacgtttaagaagagtggtgcaaggtgaagttggagagggagaggcagggtttctggttaggaagggcctgtgggctaagtttgggagtttggattgtaaggtaggactgtggaacatgaacatgtggcttctctgcatgggacaggtagcagaacacctcgtcatttctgatagccttctctttttctaatgtgccagtgccctaaagtacatgccccacgcagtcctcaaactcctggagaacatgcctatgccttgggagcagattcgggatgtgccygtgctgtaccacatcactggagccatttccttcgtcaatgagattccctgggtcattgaacctgtctacatctcccagtgggggtgagaaaggctgaaatatggtgggtggtggtggtggtggtggttgggaggcagtgggtagaaatggttgtgtgatgtcttgccttccaggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgytgagggacagcaggaagtgagtgatagatggagatactacacctgggaggagttctggaaatgcagaaggagtcytgggagatcagtaggtggtatgggtttgtctagctgcttacttgaggtgggcctttcattttttacctaggtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacagtgagttggagagattagggattttagacattttgagttgaatgaaacgtaatcttgatccttaaagtcctgatataacttccaaattagtctgtttacaccaggtgcagtggctcacgctgtaatctcagcactttgggaagctgaggcaggaggattgcttgagcccagaagtttgagaccaatctgggcaaaatggcaaaaccctatctttaccaaaaaatgtagctgggcgtggtgacactcacagcttcgtgtagtctcagttacttgggaagctgagctgtgggaggattgtttgagcccaggaggtcacggctgcagtgaacgatgatcatgccattgcattccagcttgggtgataagagtgagaccctgtctcaaaaaaaaaaaagtctgcttattcttgatgttgtaccctagggatgaagactggaatgaattcaaygatattaacaagattatcatccggcagcctatccgsactgagtacaagattgcttttccttacttgtacaacamtcttccacaccatgtccacctcacctggtaagagacctggaacacaacatttggaaaggagaaggctgctgtttaggttgggccarggcgggaaaactttggctgactcttcctttcrttttaggtaccatactcccaatgttgtattcatcaaaactgaggatcctgacttgccagctttctactttgaccctttgatcaacccaatctcccataggcactcagtcaaggtgaggaagggaagggatgctttccctcagctcttctaggagaaatgcgtgaggttggctgatgttactaaacgctcaggtggagggagatgtgttttccgtcttgctaagtgttccccttgagctataagcgaatatgagaattcagcatttgctttaaaacatgtcattggtataatcctgttttctgtgattatccttttggactttacggttcttttcttgggtgctctagataatctgtcccggtctgtctctattgtgtttgtttgttttagcctttatattgagatgtagttaacataccatacaagttatccatttaaagtgtgtaatttgatggtttttagcttattctcagagttgtcccaactgtcacgacatgcaatttgagaatatttttattacttgagaaagaaacccttagcagttactcgccatttctccccaacttccttacgcaaccactaatctactttctgtctatagatttggctattctacacatttcatatgatagaatgaaatagaatcgtacactatgtagtcttcagtgactggcttcttaagcttaccataatgtttttgatgctcatctgtgttccgttgtgtccaagcccagtgtttggagcttgggtgggagatgattgcaatgttgacctcctgtgatgttggggctccattgggaggctttctggtggtcagccagttgaggtgtgagaagtgacgcttgctttcctggtggccctgtcttgttctttgctgtcttggtttcctttgtgctggcacttcagggctgcttttgtcagacagcccagtttccatagcagatacaggctttgtgcttggccccagagaatttccctcatcttaagtctgtgcctagttcagcaggagctaaacccttagagggattcctttttcagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtaaggtttttccctgtggcagggggaatgatagtggatgtgtaggagaaaagactccaactaggtgggcatgtagccttttttttaaattctttttttttttttcccataaaaatggtagacaacccaaggcttgcagcctttagcagagtgtctggaagaagagatggccaaactctggtgggcttatttttccaggtatcgggagcattgtcctgccgggcagcctgtgaaagtgagggtctcctaccagaagctgcttaagtactatgtgctgaatgccctgaagcatcggccccctaaggctcaaaagaagaggtaaggtgccccaggggccctgcgcagacttctgttccagagatatcagtaggctgactcttactctccatgttcccacctcaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggtgcctgcattggaccctaggggcctcctgggcttcaaggacggacagttgttttcctctggttactgatgaaggcatacatcagttgggtccattgctcattcaygttctgtctgttttttgcatcttctccaggaaagaaagaaatctcgttttgggaatgctttccacctgtgtcgggaagttctgcgtttgactaagctggtggtggatagtcacgtgcagtatcggctgggcaatgtggatgccttccaggtaaggttaggtattcccaacccctgcctgggtgaggacgctggargaagcctgtgctgaccgtggagctggtttaagctccaggtctgatggggcaattgtattgcagctggcagatggattgcagtatatatttgcccatgttgggcagttgacgggcatgtatcgatacaaatacaagctgatgcgacagattcgcatgtgcaaggacctgaagcatctcatctattatcgtttcaacacggtgagaccttgactttactgactttcttttttttgagacagagtcttactcttgtctcttgggctggtgtgcaatggcacgatcttggctcactgcaacctccgcctcctgagttcaagcaattctcctgcctcagcctcccgagtagctgggattacaggtgcccgccaccacgcctggcaattttttttttgttttgttttgaaactgagtctttctctgttgccccagctggagtacaatggcacgatcttggctcaccacagcctccgcctcccgggttgaagtgattctcctgcttcagcctcccaagtagctgggactacaggcgcgcaccaccatgcctggctagtttttgaaattttagtagagatggggtttcactgtattggccaggctggtcttgaactcctgacctcaggtgatccacactcctcggcctcccaaagtactgggattaccagcgtgagtcaccgtgcccagcctcactggacttaactttctcagatcttttttcatgtatacatttagacagggctctttccagggacctatttggagagcagctatgactgtgtccttactgctcctttaaattcacatgggcgatcttagttcctggtttttgccttaaggtttctcatttacccttttgttttagatgttgaggtcccagagtttttttttctttttacccctctactgccatacctacattcctctgtatgtatattatacatatatgccccacctctgcccaggtttctattgttgtttaaatgcattgctaacttgtattcttaacttctgyttgggatcgtagggccctgtagggaagggtcctggctgtggcttctgggctgccggttggcgagtctggctstttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtrtgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtgggtgtctctttatttccttggaggcgtaaacatccgtctttagggtaggattaccacttcgggaatcattagggggctatctggctccaatctcttttcttttcccttttagacagggaaaagaagcaccatgttgcttaggctggcctcaagctcctgagctcaagcgatcctccttagcctcctgagtagcygggactacagatgtgtgccacagtgcctggctggatcctggcttgattgtgctttttggacttttaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggttgggcagagtaggctgggctgggtgtgagtggtgggggagtgggcaagagggaggactgtagagttgtgactgaaccttgttctggcaggatcgggctgtagcgggaggctaatttcatgtccaccttacaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttataggtgagtagtagggtagataggttcctgctgggaaggtgacagcagggaatggygtcatcctcagagtccaaagaaagaaggtgtagccccagtctttcctggttttacttcctcctagttttcccattcacccttcccattgcttttgtcagtgtgaagtctcggttgaaccagtctcagagggaggagctaggtctgatcgagcaggcctacgataaccyccacgaggcrctgtcccgcatcaagcgtcacctcctcacacagagagccttcaaagaggtgagtgaggcctcccaagttttctttttggttctaccaaaggtagcagttgcctttggttctaccaaaggtagcagttggtggattggtgtgaaccagcctccttgtcccacaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccrctgcttgtttacaagtggtgtcaaggtagaactttcatgagatcgccctgtgaggaacggggcaggaatttagttctacrtcaaaaatctcatctgggtagcaygattggtttactctcttgatgcgtggtagtaaagggaagtagtgttcgtgttaaactgaggaaaagcccrtrgtcaaagcaatccaratgaatacgtggaatcatagtgggattggttatggaaggtaatgatagttcctgtggggctagtcttgcaagaggatttctaacctgctggagacctgccttgctactcctcaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggtgcgtctcaggcgcagtagcatggaattgtgtgtggagtgcttgtctggcccactgactcagaatttgctgaggaggaggctgggtgcggtggctcatgcctgtaatcccagcactttgggaggctgaggcgggcagatcacgaggtcaggagttcgagaccagtctggccaacatggtgaaaccccgtctctacttaaaaaaatacaaaaattagttgggtgtggtggtgggcgcctgtaatcccagctactygggaggctgaggcaggagaatcacttgaacccgggaagtggaggttgcagtgagctgagattgcgccastgcactctcagcctgggtgactgagcacaactccgcctcrggagtggaaaaaagtagaatttgctgaggggagaacaaaagaggttaacyctggagaatcctggggcatggctcacattcttaagaattgtagttckttctttctaggacatgaaccatacgaattcatatgggatcatcagaggcctgcagtttgcctcattcatmgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggtgagggctttccyggattcctagccttgcagggtactgaggcatrtgctttgcctctgaaatcagctattgtacctgagttgacttaactgctgttggggctttaaaatggaatgaagcggccgggtgcggtagctcacgcctgtaatcccagcactttgggaggccgaggcaggcggatcacgaggtcaggagatcgagaccatcctggctaacacagtgaaaccccgtctctactaaaaatacaaaaaattagctgggcgtggtggcgggtgcctgtagtcccagctactccggaggctgaggctggagaagggcgtgaacctgggaggcggagcttgcagtgagccgagattgcgccgctgcgctccagcctggggaaagagcgagactgtctcaaaaaataaataaataaaaataaaatggaatgaagcccggggagggtgggggtaggatggggtggggtctccgtctattgagctggaggacttgtgggtgtcccaaatctcagtgtactggggcctcagcagtgtacctggtctggtgtaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttgtgagtctaggttggggctgtgtgagctggaaggacataagctaagggcccagagagggcatacctgaggctgcgtcctgggtgggagaggcgtggctgtgtcaggatgtcatcagttggcctttgaagggaagttccttccaagaaactgctgtgaccatgtgttctctgtgggcagaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggtacagcctgggcggggctgggagtgacatgaacgcgcctgcacttcctgggtcagtcaccggagtcttgttgggtggaaagacttgartggtgggcacagttggctcttgcttctgtgggagttcctcggacatgttaaccttgactttgtggtttaggttactaaggagcgcacagctcagtgtttcctgcgtgtggacgatgagtcaatgcagcgcttccacaaccgcgtgcgtcagattctcatggcctctgggtccaccaccttcaccaaggtacarggccgtcatgcccagcttccctcttgtcctctgctgtcctctgctcatttcacacccctttcacttcgtcccctgctggctgcttccttctcttctttgcttagtgtgccagtttccatgctctgtgccatagtggcttatagtatgtcaggtcacttcatcgttattttctgagcgttccttgtagaaattgtgtagcctccttcttgtggacttgtgatgattctaaattaaggcaagagtaaaagttggatttattattttgaacagaaaagcattatttttgcattttctcaggtgcttatctaagtcatgttaaccagtggcatagagaacctgtgaaaaagcagccctcataggcatctcggggttcgtttctccttcacttaccttcagaggcccagccgaaggcaaccggaattgagaaagaaaaatctgaggaattttgaactacgtatatttaaggttttgcaaaatttaaaaagttacctcggccgggcacggtggctcacgcctgtaatcccagcactttgggaggccgaggctggtggatcacctgaggtcaggagtttgagaccagcctgtccagtgtggttctgaaacctcgtctctgctaaaaatacaaaaattaaccgggcctggtggccggcgcctgtaatcgcagctacttgggaggctcaggcaggagaattgcttgaacccaggaggcggacgttgctgtgagtcgagatcgtaccattgcactctagcctgggcgacagagcaaaaactctatctcaaaatacaaacaaacaaaaaaaagttaccttactctggtttccattagagtaactcttagctataacatttttcttgcattccgaccttcatatctctaaatgtgcggcatttgcatgcgcagaatgttttctgttttttagttaagtctgttaaggatacgttctgttatgttttagaactattgcattacggttgagtttcctttatccaaaatgcttgggaccagaaatgttttggatttcagattttcttttttaatattttcattatttttattagagacagggtctcactgtcacttaggctgaagggcagtggcgctatcatagctcactgcagctcaagtgatcctcacacctcagcctcccaagtatctgggaccacaggtgcatacgccaccatgcctggctaatttttaatttttttttttttttttttttttttgagatggagtcttgctctgtcacccaggctgcagtgcagtggcgcagtcttggctcaccgcaagctccgcctcccaggttcacgccattctcctgcctcagcctcctgagtagctgggactacaggcgcctgccaccacgcccggctaagtttttgtatttttggtagagaaggggtttcaccgtgttagccaggatggtctcgaactcctgaccttgtgatccgcctgcctcagcctcccaaagtactgggattacaggcgtgagccaccacacccggcctgatttttaaattttttgtagagctgggatctcactctcttgtccaggctggtctcagactctggattcaagcagtcctcctgccttagcctctctaatgctggattataggtgtgagtcaccgtgcccagccttgaaatattttcattatacttacaggttcagcatccctaatccaaaatttgaaatgccccaatgagcatttcctttgagcgtcatgttggtgctcagaatgttgggactcagaaagtttcagctttttgtgagcattttgggttttagattaacctgtatgtgggaatctgtgagagcactagagttagtgattgctctagcccagtctggaagtggaagaggaaaggattcctgaaagaagtagcatgtgatgagacaggtgagggagagcattcctttagccagaagtgtggcgatgtaactagcttgtgtacatgggaccatggaaagttcaaggtttgctggagtaaattgtggaattgggaatgttaagagatgaggctggataaatagtggagagccatatcatggagggcatcgcacaccttaggaagaatcatataagggtcttaagcacagagtgactttgtcagatgtgtttttyttcttttttttttttggcttcccacactacagatgcagactttgtcaaatttctgtgttagatgattcactcttgcagctgtgagaaagatggacctgaaaggataggatgggagaccaggtttggggaccactgaagaagtccagataaaaatgatgagagcaggccaggcgcgggggctcacgcctgtaatcccagcactttgggaggcccaggcaggtggatcacctgaggtcaggagtttgagaccagcctgaccaacatggggaaaccccatctctacttaaaatatgaaaattagccgggcgtggtggtgcacacctgtaatcccagctacacaggaggctgaggcaggagaatcgctggaacccgggaggcggaggttgcagtgagccgagatcccaccagtgcactccagcctggcaacagggtgagactctgtctccaaaaaaatacataaatcaataaaaatgatgagagcactgaaagtagaggtaggaagaggggaacagatttgataagaagttagcagataaaatcagcagaactttgtggtcctgggatgctcaaagaaaagtcaaaaatgatgtgcagattttggcatgggtgactaggtgggtgttagtgccaccaactggaagaccacatgaacaagaacaggtttaggatcgaagataaagaaatctagtttaggatatataaagtttgaagttcctgagaacattcagatggagatttccccaggtatttatttataccttatttcttcagttccaagatacatatttaagtacatatatacacatgtgtagattcctgattccttctgctcccttagtggtgcctctttaattgatgatctgttagatttgatttaaaaagtatgagtgagacattccagggagagaaatgaaactagaaaggtaagagcagtcagggatagcttagaggttcctaggtgagaagcaatctgaagaaacatggagaacaggtctggattaaagatgtagatttcggagcctatccacaaaaggtcaaaagctcaagaatgagtgacatcacccagggacaatgtggagtgagaagaggagagggaggaatttggaaatgtggggaatactaagatgaagtgtggtcagaacctgtgggagggtgccgggtcttggaaccaaggccttcaggaacacgtgtccagaattggggtgatgctgagcagtgtcagttgcctaagagcatttcagttagatgaggactgaaaagtatccattggatttgacagttaggacgtcattggtgaccttagcaggagctgttacagaaatagtagggatggaagccagatggcagtgggtgaggcttcatgggaagtgagtgagtggagacagcaaggacaatctgtttgtcagttgaagagaaggaaggacatcagatgccacctagagggagctgtaagtcagtgcaggtgtttttgaatgacagtgacttgagcgtgttttaattaaggagcccagtagcagttgagtgtacaagagaaaagtgtggaattggctggacacagtggctcacgcccgtaatcccagcactttgggaggccaaggtgggtgaatcaccaagtcaggagttcgagaccagcctggccaacatggtgaaaccccgtctctactaaaaatacaaaaattagccaggcgcggtggcgggtgcctgtaatctcagctactcgggaggctgaggcaggagaattgcttgaacccgggaggtagaggttgcagtgagccaagatcgtgccactgcaccccagcctcggcgacagagcaagactccgtctcgaagaaaagaaaagtaggtaattgatgagcagaggtgcagagggtctccctagggatagaataaagagcaagcagaggaaaaatcctctgaacctgacaggaaagaggtctggaaagatgtggatatagatgaggttagtgggaagctataacaggattttgagtttttcagcttttcttgggctgcagttaggggaaagagttgtgcatagtgaatttcatggtattagggtatgatgattgctgaagaaactgagagggattggaaggtgtgttgggagctcagctgggttttgggaagacaactctgagcatttgtttttcccagaatcacccagctactcagtgacagggatgcagaaggtggatagattacactggtgattaaggaatagagctctgttagaagacagttgtagagtggtaaggcattgaatgcaagggaatcaagagtgcgggacccagccggccgcggtggctcatacctgtaatcccagcactttgggaggccgaggcgggtggatcacgagttcaggagattgagaccatcctggctaacgcggtgaaaccccgtctctactaaaaatacaaaaaattagctggatgtcgtggcgggcgcctgtggtcccagctactcaggggggctgatgcaggagaatggcaggaacctgggaggcagagcttgcagtgaaccgagatcgcgacactgcactccagcctgggtgacagagcaagactctgtctcaaaaaaaaaaaaaaaaaaaaaaaaagaatgctagaccccattgagatactggaagaggggagaggagagagagcagaagaggccattggcctgggaaagaattgtaggcatcagggaactggatatcagaagttagaggctgaggagtggaggagtgtctgagagggtaaggatgcagttgactctagtggttagaagcacaggctctggagtcagatggggttcacatcatatctttgtcatattactagttgggatcttgggaatattgcccatgctgggcctcaattccctcatctgtaaaatagggatactgataggacctaggtcagacggcttttgtgagaattaaatgaaacggggtatttagtaagccatattacttggtaaattgcatgataaagctgggcatggtggcttatgcctgcaatcccagcacttttggaagccgaggtgggaggactgcttgagcccaggaatttgagaccagcttaggcaacatagcaagatcctgtttatatttaaaaataaataaataggccgggtgcggtggctcacgcctgtaatcccagcactttgggaggccgaggtaggtggatcacgaggtcaggagttcaggaccagcctggccaatatggtgaaaccccatctctactaaaaatacaaaaattagccaggcgtggtggcacatgtctgtagtcccagctactctggagactgaagcaggagaaccacttgagccccggaggtggaggttgcggtgagctgagattgcgccactgcactccagcctgggtgacaaagtgagactccatctcaaaaaaaaaaaaaaaaaaaaaaagctatgtcatgggcaagttctataacttgttttttatgaagacataagaggtataacatatataaatttcttaccatggtacctagtacacgtagacctgagtaaatattattttccttcttgcctccccttatcccccaggaatttctgctatttagtaaaggaacactgggctcctcaggaatttatgcctcctccccttcagggatagagcactgttaactacaacagaaatactgtgttccattacacacatcagcaattccaagtgcagtccaagaatttactaaacctaatgggaatcatccacttgcctttaccccagtatctagcctatcctggcccctggccctcctttttttttttgagagggagtcttgctctattgcccaggctggagtgcagtggcacaatttcagctcactgcgacccccgcctcccgggtttaagtaattctcctgcctcagcctcctgagtagctgggattacaggtgcctgccaccatgcccggctaatttttgtatttttagtagagacagggtttcaccatgttggtcaggctggtctcaaactcctgacctcatgatccaaccgcctcggcctcccaaagtgctgggattacaggcatgagccaccgcacccggcccccctcctttctgtagatctgcctggttgtctcatcctgtggacatgcgagatgctcagtctagctttcatagtagggtttgagctgttatctcacctgcagtcttttctccttgcttgtctgaataccatttgctcaaggcagattactatagtaactccagccaacgcactctttcacctcaataattgttcagaagacattttttgccttaaagtcttgactatatcatttggtattttgtggtttgctatcttgttttattcagcttttcaaagaaacagctttggtttcattaatttttatcgtttttctcttttttgttgcattgattttttttttttttgagatggggtctctatgacccaggttggtgtgcagtgtcgcagtctcagctcactgtaacctctgcctcccaggctcaggagaccctcccaccttagcctcccaagtagctgggaccacaggcacatgccaccatgcctggctgatttttctttgtattttggatacagacagtttcgccatgttgcccaggctggtcttgaattcctgagctcaggtaatccacccccctsggctcccaaagtgctgggattgtaggtgtgagccaccacgcctggccttgttgcattgatttcttctcttatcattgccatccctttgctagtttgttaaggtaaaaggttagattatcaattttggacctttctctttttttttttttgagacagagtctcgccctgtcactcaggttggagtgcagtggcgcgatctctgctcactgcaagctccgtctcccgggttcacgccattctcctgcttcagctcccaagtagctgggactacaggtgcccaccaccacacccggctaatatttttttttgtatttttactacagacgcggtttcaccgtgtttgcgaggatggtctcgatctcctgaccaccacctgatcagcttgcctcggcctcccaaagtgttgggattataggtgtgagccaccgcacctggcctggacctttctctttttctttttttttttttttgagatggagtctcactctctcacccaggctggagtgcagtggcgcgatctcagctcactgcaacctccgccctctgagttcaagcgattctcctgcctcagtctcccgagtagctaggattacagatgcctgccaccgcacccggctaatttttttgtgtgtttttagtagagacagggtttcaccatcttggccaggctggtcttgaactcttgacctcgtgatccacctgcctcgtcctcccaaagtgctgggattacaggcgtgagccaccgtgcccagctgacctttctcgtttttttttgtttgagacggagtcttgctctgtcgcccaggctggagtgcagtggcgcaatcttggctcactgcaacttccgcctcctgggtttgtgtcattctcctgcctcagcctcctgagtagctgggactatagtcgcctgccaccatgctcagctaattttttgtatttgtagtagagacgggtttcaccgtgttagctgggatggtcttgatctcctgacctcgtgatccacccacctcagcctcccaaagtgctgggattacaggggtgagccaccgtgcctggccaacctttctctttttctaatagtattattcacttctgtaaattttcctctcagcattgctttagctgcattcctccctttttttttttttttttttttgaggcagagtctcacattttcgcccgggctagagtgcagtggcacgatctcggctcactgcaacctccgcctaccctgttcaagcgattctcctgcctcagcctcccaagtagctgggattacaggtgcccgccaccacacccagctaatttttttttgtatttttagtagagacaggtttttaccatgttggccaggctggtcttgaactcgtgacctcgtgattcacccgccttggcttcccaaagtgctgggcttacagatatgagccatcgtgcccggccccattcctcacattttaatatgttgtgttttcatttttatttagttaaaagtatattctaatttcccttatgagttcatatttcaccttaggttgtttcaaattatgctgtttacatatttgggggtttcccttattagtttctgctttgattccattatgattaggaaacatgttgtatatgatcttagttttaaaaaatgtatcaagattttttttttaataattaattcatttagaggtgggatctcactcttgcctaggttggacccaaactcctgggcgcaagcgatcctcctgcctcagccttccaaagagttgggattacgggcatgagctactgcacctggctgaggctgactttttgatgtcctagcgtacagtctctcttggtgcctgtcctatgtgtgctggaaaatatctgttaatctgtattctgctattgttaggttgagtgttttacaaacattaggtccagtcagttggttacattgcttaagtcttctatatccttagtgatattttttgtatacttctatcgattactgaggagtattagaaatctctagtaatcccagcagtttgggaggctgaggctggtggattgcttgagcacaggagttcgagaccagcctgggcaacatagcgaaaccccatttctacaaaaaaaatacaaaaattagctgggtgtggtggtacacgcctgtagtcccaggtgcttgggaggctgaggcgggagagtctcctgagcctgggaggtggaggctgcaatgagtggagatggtgccattgcactctagcctgggcaacagagcaagaccctgtcttgcttgagagaaagatccaactacagctgtgagtttattgtctttcaggtccatcatttttgaaattctgttattagttacataatgtatttaggattattaggtcttctgaacgagttgactactttatcgtatcaaatatccctctgtattcctgataacattccatggtctgaagtctttgtcttaatcagtagtgccactccagctttgttttgtgtttgcatgggtgtatttttccatctttttactgttaatctgtgtctttgtaactaaagtttatttcctatagacagcatatagttggctctttttttttttttttttttttttttttttgagatggagtctcttccttggttgcccaggctggagtgcagtggcatgatcttggctcagtgcaacctctgcctcccgagttcaagcgattcttctacctcagcctcccaagaaactgagactacaggcgcgtgccaccacgctcagctaatttttgtatttttagtagagacgggggtctcaccatgctgtccaggctggtttcgaactcctgaccccgaggcccgcctcagcctcccagagtgctgggattacaggtgtgagccaccatgcccggcctttttatttaaatccaatttgacaatgtttgccttacaaatggtctaaatacctcaattaaggttaatgtaactatcaatgtggcaatgtagctcagtttaaatctaccgtcttactcttttttttttaaattattttttctgcttttctcttgtcctgccttcttctgaatttagttgttttgtgactttatctccacttttcacttatttggctacatggtttttttcttattgtttgctctaaggtttacagtatatacatagctcacttactgkgatctactttgaccattagtctactacggatcacttcacatatagtacaagaaccttagaataatacactttaagttccactcccactcttagtagtatttttgtcataacattttaattgtacatgtattataagtgctataatactttgttactctttttgctttgaacagcctttatcttttgtagaaattgcaaaatgagaaaaaatatttttttgcattttacccacatacttaccatttctggtgttcttcactagtttgtatagctccatctggtgtgcttttttttttctttttcttttcttttttttttttttgagacacagtcttgctctgtctcccaggctggagtgcagtggtgcgatctcagctcactgcaacctctgcctcctgggttcaatttctgtatttttagtagagacggtttcatgttggccaggctggtcttgaactcctgacctcaggtgatccacccacctcggcctcccaaagtgctggcatgacaggcgtgagccaccacacctggcccaggggaaccatttttttttttttttcccctgagatggagtctcgctgtgttgcccaggctggaatgcagtggcacaatctcagctcactgcaacctccacctcccaggttcaagcgattctcttgcctcagccttctgagtagctgggattacaggcgtctgccaccacacccggctaattcttgtatttttagtagaaacagggttttgccatgttggccaggctggtctccaactcccgggctcaagcagtcctcccaccttggcctcccaaagtgctgggattataggcatgagccatcgcgcccagcctcattgtgttttgctttctatttccctagtgactaatgatgttgaactcaaatctttctttagtagtagggataaaactaactgcatcaagtagtctccaccctccccgcccctggctcatctgtaatttrctttttttyctactacctttagattgtgaataagtggaatacagctctcattggccttatgacatactttcgggaggctgtggtgaacacccaagagctcttggacttactggtgaagtgtgagmacaaaatccagacacgtatcaagattggactcaactccaagatgccaagtcggttccccccrgttgtgttctacacccctaaggagttgggtggactcggcatgctctcaatgggccatgtgctcatcccccaatccgacctcaggtacagcctggttcaacgtatttctaaaccctattgctcaggccctaagggaagtgggtatttctttagttttaggctttattttttctgtaatcttggttgtacacccaaacaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacaggtgggcacctaggagggcatgccaaccctggggcaggggcagtggtggcctttgaaccgtgtggagttcagggtcagagcatgccatggttgtatggaggtgagaaggctggttctactgaccctaattatttttggccaggaaggagtgctgagctcctcatatgagatcacgttttgacttgaatctttctttttttggaagacgcctgactttagaagacctagaagattcatgggatcgtggcattcctcgaatcaataccctcttccagaaggaccggcacacactggcttatgataagggctggcgtgtcagaactgactttaagcagtatcaggtatgtagagggagcagattttccctgagtcaggaaaatccatggctatccccgaaacttggggcaataggcacccagaagcttgaccgtgcctgccttgccatctaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggctyttctggtgaggattctcctctcttagagggacctgtcacaaccctttgagctcatctcttgtatgcctctgtgatttcctgtggtgtttcccagacagccacctccaggaggttagcagtgtgctgggaaatggcaggatatcacctcacctgcttctcttgctccccagggagaaggccagtggctttgaggaatctatgaagtggaagaagctaactaatgctcagcgatcaggactgaaccagattcccaatcgtagattcaccctctggtggtccccgaccattaatcgagccaatgtgagtgtgattgacactggagaggggaagctaaagacagttgctgcttcttgccttggttatgtcgtgagcgcccgagtctcttgatctctaatgtcacattgtcgttttcctggcaggtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgggctggaatcgaggggagagggtactgtagagagtcagctcaggtggaattgaggggagagggtactgtacagagtcagctcaggtggaatcgaggggagagggtactgtacagagtcagctcaggtggaatcgtggggagagggtactgtagagagtcagctcaggtggaatcgcagggagagggtgctgtacagagtcagcttaggtggaatcgcggggagagggtgctgtacagagtcagctcaggtggaatcgcggggagagcgtgctgtacagagtcagctcagcttgctcttttgcatatgggaaatccaccctggaagctctgaggatgagactcctattgcctcattatcttattgtacaaactctgattttaattgggcttccttaacaagtcttaatctctccatgttttccttcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaagtaagtgcctcaggacccagccctaggcagccaggacactttcgktttcctgttcttctagccctgcaactttaggaattgtcctgtctgcctttgtttcaaacttggagccagtgctaygcttggagcctgtcaacacccttagtcagatctgctgattctctggggtcctgctgacctggaacaagttggtggagtgggtgggatggttttgggatttaagtggttctggttctggggacattggttatgcccatggtttcttagaagcttgaaccctcttcatcctcagggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacaggtgagttgaggctcaggaccatgtattttcaggccaggcgcagtggctcacacctgtaatcccagcactttgggaggccgcggtgggcagattgtctgagctcaggagtttgagaccagkctgggcaacatggtgaaaccctgtctctaccaaaatacaaaaaattagctgggcgtggtggtccacgcctgtagtcccagctactcagaaggttgaggtgggagaattacttgaacccgggaggcggagcttgyagtgaaccgagattgcgccactgcactccagcctgggcgacagagtgagactccatctcaaagaaaaataataataataawaaataaataaataatccgtgtattttccattagctccatactttaacgtagtcatacttttttactttacctaagtgagaggaagtggcccattcctcctatgggtcactgattctcttctccagcctgtatgtacacatgrgcagagtgttgtcagcctggcgaacagtctttcttcctctgtagagttggcagcttgtcttgtttctggggctgtcattctcgtcttaacttttcttgacccttttatcctcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaaggtgagtgttagcagcagtgtataggtgcgggactcygtacatggctgtgggagagtaatgggctaagtgtgtacacatgctgggaagaaggcaggatggggatgtgttgtgtaggccatgctaacgaatgccgtcctcctctagacctttgaagggaacttgacaaccaagcccatcaacggagccatcttcatcttcaacccacgcacagggcagctgttcctcaagataatccacacgtccgtgtgggcgggacagaagcgtttggggcaggtgagcaggtttaaagatgaagaggctgtagaaccatgtkgcctcttattcttggggtggacttggyaatatttactggtttattagatgaaaggctgagaacatctcatttgaacttatccccaaaataccttgggaagtattctgtgggaggtccaagagtgtatgaggtgcttcgttcccttccagctggtctgtttcctgaatttctaaccttgaacagggctatcaaaaatcatttttccaaaggcaacgcatactctttttttttttttttttttttagccggagtctcgctgtgtggcccaggctggagcacagtggctcaatctcggttcactgcaagctccgcctcccgggttcacgccattctcctgccttagcctcccgagtagctgggactacaggcgcccgccaccacgcctggctaattttttttgtattttttagtagagacagggtttcaacgtgttagccaggatggtctcgatctcctgactttgtgatctgcctgcctctgcctctgcctcccaaagtgctcggattacaggtgtgagccactgctcctggccagcaatgcatattctctttttttttttttttttttgagacggagtcttgctctgttgcccaggctggaatgcagtggcctgatttcagctcactgcaagctccgcctcccaggttcacgccattctcctgcctcagcctcccgagtagctgggactacaggtgcccgccaccacgcccggctaaattttttgtatttttagtagagacggggtttcaccatgttggccaggatggtctcaatctcctgacctcgtgatccgcccgccttggcctctcaaagtgctgggattacaggcttgagccaccgtgcccggcccagcaacgcatattcttgaaacatccactttgaccaaatctcttctctacctcacaactcttgctgaattaactcttctttagcttcctagacgttcaacatctggctgggctgtatctgtccagccagtttctcttcctttacatttatagcatgtttcatcttacattcagtccaggatcttagtagcccaaacccctgatgctcatctccaaatctgtgttttgcttgtatttttctttctagaatgaactcccctctttgctctgttaatcacagtccctccttaagacacgtttttttgtgcagcttttttctgatcctagtagccttaatttcttttgttcctgaactctgtaaaacagtgtatagtttagcacatactcatgtgtcagcttgtggtattgtcttgttgaaaggggctgtcagcctggtcattggacacggccatttgatactctttgtaccttctaagtgcctaacatttaacatcagtgttcaatagaaacgtagttggattatttcaaaactaggatattctgttctagttgatctgggagggtagagactaaatttccattttcttctctcttgcttttaagttggctaagtggaagacagctgaggaggtggccgccctgatccgatctctgcctgtggaggagcagcccaagcagatcattgtcaccaggaagggcatgctggacccactggaggtaagagggtggggtggggtaggagaaaagagaccttgagaccttcaggstgtttctcatcttggacttgatcttgtcttaggtgcacttactggacttccccaatattgtcatcaaaggatcggagctccaactccctttccaggcgtgtctcaaggtggaaaaattcggggatctcatccttaaagccactgagccccagatggttctyttcaacctctatgacgactggctcaagactatttcatcttacacggtatgaacctcgggaagagaagatcgctggaggaggagygggtttagggttaggagaagatcctgtgtcaggtttttgccattttcacatttttagcctatagattgggtgggaactctgttgactttcatgagagtttaagaccttaaagttaaaaatcaactcttggggccgggcgtggtggctcacgcccgtaatcccagcactttgggaggctgagttgggtgaatcacctgaggtcaggagtttgagatcaggctggccaacatgacgagaccccatctctactaaaaatacaacaaaattagccgagtgtgctgggatgcacctgtagtyccagctactcgggaggctgaggcaccagaatcactggaacccaggaggcagaggttgcagtgagccgagatggcaccattgcactccagcctgggcgacagagtaagactgtctaaaaaaaaaaaaaaaaaggccgggcgcagtggctcacgcctgtaatcccagcactttgggaggccgaggcggcggatcacgaggtcaggagattgagaccatcctggctaacacagtgaaaccccatctctactaaaaatacaaaaaattagccgggcgtggtggcaggtgcctgtcatcccagctattcgggaggctgaggcaggagaatggtatgaacctgggaggcggagcttgcagtgagccgagatcatgccactgcactccagcctgggcgacagagcaagactctgtctcaaaagaaaaaaaaaaaattcttgggtttcatgaaaggttaggattaaagtgggagagcctcaagcagctgacctaccccactcttccaaatcttttcccaggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaagtgagcagtgctggtggggacacagacaggaggtctatatacggttttctggggttttttggaagcacttaggcttagaagtttctcaagaaggccaggcgcggtggctcatgcctgtaatcccagcactttgggaggccaaggtgggtagatcatttgaggtcaggagtttgaaaccatcctggccaacgtggtgaaactccgtctctactaaaaatacaaaagttagccgggtgcgatggcgcctacctgtaatcccagctactcgggaggctgaggcaggagaattgcttgaacctgggggcagaggttgcagtgagccgagatcatgccactgcactccagcctgggcgacaagagtgagactgtctccaaaaaaaaaaaaaaaaaagacgtttctcaagaaattatcttgtcttagccaggcttgagtgctcatgctagtaataccagcactttgggaggccaaggtgggaggattgcatgagccaggagttgaaaccagcctgatcaacaagagactgacgccatctctaccaaaaaaaaaaaatttaaaacaggtgtggtggtacacgcttgtagtcccagcttcttggaggctgaggcaggaggcttgcttgagcccgggggtttgaggctgcagtgagccatgatgatgccactgtactccagcctgggtaacagagcgagactcttgtcttgaaaacaaggaaagaaattatcttacagagtctcgaggaagagagatacagcagtgtcttcgaatagtatgggaagcatccctgttttagggcttcagtctgactcttggccattgtttctcactgttgccatttcaaacagggcatttctttactgtccatacatgggaagaattttgaacatccgagaccctaagtatccgagactgctgccaacacacacacacaccttcctcccctcgtctccctccctgtcatcgtggcaaccaaaattatccatagggtgacggacaataccacctctgattaagaaccagtattctagggtttctggggtttccatttctgagaacagttccatgccagagcattgttttggtcaaggaagcgtagggtttatggatgctaaacagtgggaaggtgcacacgcagtgtgctgtcccgcttggatctgacgaatcttggaagtgttagtgcacctccrtttcacacttcctgtagaagcagctcttgtggattgtctggggcgtgagtataggctgtcctgtcctaccaagttacaccctttccattgaggcagaagtgaccaaggggaagggatccttgtaatataacccacaccatccccacagtgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcaggtactgtcgggcaagagggtggggatggaaaggccggctgcactacctaaggtgctgggctgagcgatgctgacactccctgcctgtttttagggccatctctgctgccaacytgcacctaaggaccaatcacatctatgtttcatctgacgacatcaargagactggctacacctacatccttcccaagaatgtgcttaagaagttcatctgcatatctgaccttcgggcccaagtgagtaagtggactcagctaggccacagtgtgtgcccaactcattttgtgcctaaaactcagacctgagattgtctggaacttgagatgctggtttcaagattcatggatgagtaattatacaaggatagccaaaacaacgaggtgggttttggccccatgagatagcaaaagctgtggcagctgagagaaggtagtaattrtagtattggcctgatagtatttggaagagaacagatatggtcagaaacaaattcctgaccaggtgtgcgtgctggctcatgcctgtaatcccaacactcggctgggcacagtggctaatgcctataatcccagcactttgggaggcctaggtgggtggatcacctgaggtcaggggtttgagaccagcctgaccaatatggtgaaaccctgtctctactaaaaatacaaaaaattagccaggcatggtggcatgcgcccgtagttgyagctactagggaggttgagacaggagaattgcttgaacccgggaggtgaggtggagcttgcagtgagccaagattgcatcactgcactccagcctsggcaacagagcaagaccccgtctaaaaaaacaaaaccaaaaaaaacgtggctgtagtcccagctactcaggaggatgaggttgcttgaacgcaagcagtgagctttgatgaccccactgcactccaggctgggcacagtggctcatgactgtaatcccagcactgtgggaggccgaggtgggcagatcttttgagcccaggagttcgagaccagcctgggcaacatgacgaaatggagtctctacaaaaaaaaaaaaaaaaaactagccaggcatggtggcatacacctgtaatctcagctactcaggaggctgaggtgggaggatcacctgatcctggagggtggtgagtgtagtgagctgagatcatgtcactgcctgctagcctgggtgacagagtgataccctgcttcaaaaaagagaaaagatgcataactttactagtgtatcagggatattatagtttataaaacatcattttgggccaaggtgggtgaatcacttgaggtcaggagttcaagaccagcttggccaacgtggcgaaaccccgtctctcttaaatatatgaaaattagcggggcatggtggcatgtgcctgtagtcccagctactcaggaagctgaggcaggagaattgcttgaacccaggaggcggaggtcgcagtgagctgagatcacaccactgcactccagccttgctgacagagtgagactccatctcaaacccactatttagtggctgtcaggttggcaaatttgaaaagattgttaatatcctgtgtgggtgagtttatagtaaacagatcctctttctttcttggtgataatgtaaaacttaaaatagcaccaagtgctggttttccagatgttttcagcttgtgaaaatacactgagctgcatgtgtgctcatttgcttgtgaatactatgcttaataatcagctggggagcttgtgagcagtgcagattcctggaccccactcaggagattctgatgtggtaagtccgcgatgaggtccatgtctaacattttgaacaagcaccccagctgattctgatacagggggttctgatcacgttttaagaaactctgtcctcgttcttgggggaaggaaggaaacagagggctggcagctccaactctgacctggtactaagaagagttttggttcctgacccctttgtctccagattgcaggatacctatatggggtgagcccaccagataacccccaggtgaaggagatccgctgcattgtgatggtgccgcagtggggcactcaccagaccgtgcacctgcctggccagctgccccagcatgagtacctcaaggtaatggggagtgatggagcctgggagtgtggaaaagctggtgcgattcctgtctgtggatgggattcagctctgtactcctctttacctataggagatggaacccttaggttggatccacactcagcccaatgagtccccgcagttatcaccccaggatgtcaccacccaygccaagatcatggctgacaacccatcttgggatggcgagaagaccattatcatcacatgcaggtgggcctgggctccttgggaggaagtatggtggggcagggattgcaggccagggcccagaacagtggcctragctgttactctgtcctcgttcctcccccagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtaagtgggaggagcctggggatgtggggatagcagtagggataaggtgaggccatygccctttgcacttggggcctggctggcttggaggtggcgcaggctgcatgaggcaggagccctgttaacattggctgtttccttctccccraaggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccrtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaataggagttcaggggctggtttgttttttttttcccccccaaactcaaattctggatttaggtctaacaggaggctggactggagcggttcacagcaagatgctgggctcggctgtgaaggggggagtatgaggcccccttcctattcagggctttggggtagatagcccctggactcagtggagacctgaggcagggctgggctttcacactccgctgccttgaccacatttgctgctttttccacaaaactacttggaagctctcgcctcctttccacagttttgggagcagttgccctttcccgggtctaggaactctgtggcttgtgctgagcggctgcggtgtccagcccagccctttaagctttctgtgtcagtcctggtcaggaaaacaagcacacaggcaggcagtttgtgtacagccgggcggaggccagagaccggctgcctacctgtcacctctcgcctggagcgggccactgccaagttggccccatgactccaaacgggcggagcctggattgggcctgtggggagggctccactcaagtgaccacttgcagccctgaacctcagctcttggacgcctggctggaagttggctgtcttgtttcctgtgaccttgggggtggaaaggacagagcccaggcgacctagggcactatctccctaccccacgccttctcccttcctcgttcctccctacccttatcgcttctaccccgcccacaccgccctaaacggcttcctggggcggaactgtttcgcttttccccgtcccagtggagggtggggtgggggggtcgcagccctaagcctctgggagacatggagcccaggagggcggcgcccggggtgcctggctgggggtctcgggaggccgcggggtcggcatcggccgcggagcttgtgtaccatctagccggggccctgggcactgagctgcaggatctggcgcgccgtttcgggccggaggcggcggccgggctggtgccgctagtggtgcgggcgctggagctcttggaacaggctgccgtggggcccgccccggactcggtgagtcatggccctcccttcgccacccacggggccggcagggccgaagcctgagacccgggtctccccagctgcaggtgtcggcgcagccggcggagcaggagctgcggcggctgcgggaggagaacgagcgcctccgcagggagctgcgcgcggggccacagggtaagcgcagccccggccagggcagggcgggtgacgacctgctcgggtcctcccctccctcccgcgggccgcgcgccgccgccgctaagaacgccccttcctcagaggagcgcgcgctgctgcggcagctcaaggaggtcacggaccgacagcgggacgaactccgggcgcacaaccgcgacctgcggcagcgcggccaggagaccgaggcggtgagggcggggcggggctctggggcggggcgggggcggagcgtggcaggcgctgggcggggctccgggggcgggggcggagcgaggcaggcgctgggcggggctccggggggccctcggtgccccgcccaccccaccctttgctccgctcccagttgcaggagcagctgcagcgcctcctgctggtgaacgctgagctgcggcacaagctggcggccatgcagacccagctgcgcgccgcgcaggaccgcgagagggagcgccagcagcctggcgaagccgcgactccgcaggctaaagagcgagcgcgggggcaggccgggcggcccgggcaccagcacggacaggagcccgaatgggcgaccgccggcgcaggcgccccagggaaccctgaggacccggtgagtgccgtatgagggcaaggacccagcccaggacgcagcgtccagccctcggtgggcactcaagcaaggtttgcatgctgcacagcaggtcggccaggaagcggggaggtggcagacagatctgcgcccccggccggcctcggcccccgctctcagctggagcactgctctgttatctgttagggcacccttgtcccccaagtctcccggcccgtcacttcctctagcattcccatgatggccctggggcgggggaacgccagccgaggcgaccctctgactgtgcctgtccttccaaaggcggaggccgcgcagcagctcgggcgcccctcggaggcagggcagtgccgcttcagtcgggaggagtttgagcagatccttcaggagcggaatgaactcaaagccaaagtgttcctgctcaaggaggaactggcctacttccagcggtgaggacgctgggaagccggggggcctccgatcaccccacctcattctccagtcattgacatgtccacagtgacatgtgccaggcctgcgctgggaactgggaggacatgaattgtacagcccttgccctcctgcaatgtcatccagacaggggagagggacagtacaaagggttgcagctgcagcagccagggaatctctcctaggagggggccacggggccacctaatttaaggtctgagggtgtcagcaaggcagagcgcttcccgtgttcagggaagagctgcgtgcacaggtaccaggagtgaggactgcggctggcatctccactgctggcatccccatggctggcatcaccagggctttctccctccctgccccttttctttagggagctgctcacagaccaccgggtccccggccttctgctcgaggccatgaaggtggctgtccggaagcagcggaagaagatcaaggccaagatgttagggacaccagaggaagcagagagcaggtaggtccctgcctgcattcccacggagccaggcctccctccctcattctgctgagcctgatgacccagcctggtcaccctctgagcccattgtctcagactgaggctgtcaccccaacccggtcaccccttgagcctccctagcctggccgcttctagggcctgctgacctgctctggctgtgtcccatggccgctgtccagcctgcgcccttctccctggatctcaccactccccttgccttgcctgccatccattctgcctgacaacactgcctctccacattcattcttcaagttcctgtcttggctgggtctgtttattcttacgggggtgaaactgtagccgcggctgtgtcagggcctgctgtgtgtcaagctataaaataaacccttggcagggcgcggtggctcacgcctgtaatcccagcactttgagaggctaaggtgggtagatcacctgaggtcaggagttcgagaccagcgtggccaacatggtgaaactccgtctctactaaaaatacaaaaattagccgggcatggtggcatgtgcctataatcccagctactcaggaggctgcggcaggagaatcgcttgaacttgggaggcggaggttgcagtgagctgagatcgcaccactgcactccagcctgggcgacagagtgagaccctgtctcaaaaaaaaaaaaattaaaaattaaaggctcgacatcctgcatctccccagggttgccttctctccagccccgggggccctgcagtccctccatcccccctgctggattcctgttgtccctcagggccttgatcaatggccctcacttctcctctctcctctgtctcagtgaggatgaggctggcccatggatcctgctctccgatgacaagggagaccatcccccacccccggagtccaaaatacagagtttgtatgttggggaaaggggaaaggcaagagtgtggggagggaggaagggccctggctggtccttctcaggatcccctttcccgcttctctgcccatcaccctgctgtgcttggctctaagcacaccgtcccctcctgcttctctggccctggcccccatcaccttcacactccctcaggctgccctttcttccccctctccccttttctcaccatcccctgccctcacccatatccttgacctctctggcttcctggctcaaagtgcctctggctgtctctctccagctttggcctatggtatcggggtaaagctgaatcctctgaggatgagaccagcagccctgcacccagcaagctagggggagaagaggaggcccaaccacagtctccagctcctgatccgccctgttctgccctccacgaacacctttgtctgggggcctcagccgccccagaggcctgacttaggggtctggctgtggaaggatgtgtggcctcaaatgaggacagggctcccgccttcacagccctcgccaggggtctgccccaatcctggcctgcatcagggcaggacggggtctcagcccgcctccctctctacgtctctgtaccgagcctctggggccagatataagagtgcctctctgagtctcagtttccccatccatgaaatgagagctgactgcctagctcccagggctttgtgcagacggcctgagctcatgtaataaagaactgcccgtaatacacagaaactgttcctcgcctgtctgtccatgtctgtgccacctcccaaccctgccaggagcagaggcaggctgaggggtcctcgctggtctccttgctcagtcactgggtggggtggcttcttgcagctcaggccttgctttgggagtgtggcctgatggaaagccgtggctcccagcctcagtccacccccttccctggccccggcacccagggacctgcaacttcattcttctggcccttccaggcccaggccagtcagccctgccattgcctttctttccctttctttttttgagtgtcagtctttccagccaccccctccctctcagggaggtgcctcgtggcagcccgcccctccggcctggtttcctcaggaaaagccctgagaggaagcagggagggggttgggagctgtgggggccagacgaacccgagcgctcccaccgagctgcctgccatggggctggggctgctgctcccgctgctgctgctctggactcgggggactcaggggtccgagctggaccccaaagggcagcacgtctgtgtggccagcaggtgggtctcgtgggagtctgatgcgtgtggccagcaggtgggtctcgtgggagtctgatgcgggtggctgaaccggtgttgaggccgttaggggaaggaggagactaggaagggggcttaggctgaaaggaagggactgctgatggcggtctggcaggtagtggccagccagggcagatggtggaagggtcagggaaggagaggggaggggctggggaccctagctgtaaagatccattaggcctccccagggggctaaggcagcctcccccactgcagccagagacagtgatccaccttcctcagggccaggctgcaccccccaccatgtccggctgacccctttttgccccacagcccctctgctgagctgcagtgctgcgcaggctggaggcagaaggatcaagaatgcaccatccgtgagtagccaggacagaccctcagccaaggagaagggaggccgtagcccagtgacaacccttccttcctaccccatggggcctgcccctcctgataccaggagtcagggtttctcctgtgacgcacccccaggcctgaaggggcacctcttgaggaggcatggcccctggagccagtgagagggcaggggtgtcccctggtcctgctcccgtctttccaacctgggtggggtgtctttcagccatctgtgaggggccggacgcctgccagaaagacgaggtgtgtgtgaagccgggcctctgtcgatgcaagcctggattctttggggcccactgcagctcccgtgagtctcaagggccagatgaagttgctgggcagagctgggtacgggggcagtggtgtgggagcaggcgaggcaggtagccatgcagcctcaggacagcagggccagaatcccccccagcttcactgaggaattgcggtccagagacaggaagtgacacacactcccgggagatgacctgagtcaccgggtttttacccacatcc

SEQ ID NO: 17974 - DNA, 67858 bp, Homo sapiens
  misc_feature (1)...(67858): n = A,T,C or G, or insertion/deletion polymorphism (see Tables 1-2)
gaagatggaacagcatacacaaaggcccagaggtgagagggatgtggctgtgtgccattgaaagagttttagcttggtaagagtgtgacagtatttcaaagtagggagaggtggtgagaaaagagtatagagaccaggtgtggtgactcacacctgtgatcccagcactttgggaggctgaggcgggaggactgcttgaggccaggggtttgataccagcctggccaacatagtgagaccccatctctacaattaaaaaaaaaaaaaaaagagtgtagaagtaacagtgtctacctgaattggtccttctgccactctcctcatccttgccctcttccttgccctatttttgaggcctcctggaagatgctgagctgtgggtaggatgcattggggtggccagttcagctccagccaagctcttctgtctcctctgccagggatggtccctgtggcccaggcagggtcgtcagaggccagcctggctgcaggtgctttcccgccccctgaggacgcctccacgccattcgccatcccgcgcacctccagcctagctcgggccaagcggccatcggtctccttcgcggaaggtaccaagtttgcaccacagagtcgccgaagctcaggggagctctccagcccgctccgaaagcccaagaggctctcccggggggcgcagtcgggtcctgagggccgggaagccgaagagtccacaggcccagacgaagcagaagcccccgagtcctttccggcggctgccagtcccggggattcagccactggccaccggcggcccccacttggtagccggacagtggctgagcacgtggaagccattgagggcagcgtccaggagagctcgggccctgtgaccacgatctacatgctggcagggaagccccgcggatccgaaggccctgtccgctctgtcttccgccattttggtagcttccagaaaggccaggcggaagccaaggtcaagagggccatccctaagcctccgcgccaggccctgaatcggaaaaagggcagccctggccttgcctctggctctgtcggccagagccccaactcagccccaaaagctgggcttcctggggccacagggcctatggcagtcagaccagaggaagcggtccgggggctgggggctggcaccgagagttcaaggagagcccaggagccagtctctggctgtggctccccagaacaggatccccagaagcaggctgaagaggaaaggcaggaggaacctgagtatgagaatgttgtacccatctccaggccaccagaaccctgatgaccttgaatttggggagtggggagagtggatggactagactgtgctgtgtgctggaaaatgatcccggggccaggacagacaaaccagagcctctgcgcctccacagggaaaaggcaaggcttccaggccagttggcccaggcccctggcagtgctcccggaggggcccaggaaggcctgggcagagaccctgtaggatggggtcaggaagggttgcctgcagggacttttgctctgctgtcctggaccctgtgtgcctcataagggctattctttctttcacgtgcaaaacatttttctgaaatagcaaacaacctacatgtttgctgataaaagattggctaaacaaatttttttttttttttttgagacagaatctccctctgtcccccaggctggagtgcagtggtgcgatctcggctcactgcaagctctgcctcccgggttcacgcccttctcctgcctcagcctcccgagtagctgggactacaggtgccctccaccacgcttggctaatttttttgtatatttaatagagacagggtttcaccatgttagccaggatggtctcgatctcctgacctcgtgatccacctgcctcggcctcccaaagtgctgggatgacaggcatgagccaccacgcctggtctatgaactttttaaaaaggatgtatgtgtataaaaacagattcaagggaaaggcactaaatggttttttcctctggaagatgagattgtaggtgatatttattttcttctgaaacttttgtatagtttgcaaattttctacagtgaacattcttttttacttttgttactagattgaatttgataaagtataataaaaagcaatgatctttgttaaaaaaataaaaagtactaacattacagacatgtataaagtaaaacggagatttcctttctccccagaggcgtctgtgggtcaagagagaggtagaatctacttttccctggcagctttttggtcttgtttgaattctttgctcacatattacctagtcagaaaagaaaaggggcaaccctccccccgagctttatttttttttttttaagatggagtctcagtctgtcacccaggccggagtgcagtggtatgatctcggctcactgccacctctgtctccccggttcaagcgattctcctgcctcagcctcctgagtggctgggattacaagcgcccgccaccatgcccggctaatttttgtattttttggtggagacagggtttcaccatgttggccaggctggtcttgaactcccaaactcaagggctccacagcttcggcctcccagagtgttgggattataggcatgagccaccgcgcccggccaggggcagccccttctatctcagtgctcagagagtctcatcaacagttgaggtgctttctttcagatgtttttctgtgtacatgtcaacaaatattttaaacaaaaaattttagcatactaagcatactgttcctcagcttctttttttttttttttttttctttttgagacgaagttttgctctgttgcccaggctggagtgcagtggtgcaatctcagctcactgcaacctctgcctcccgggttcaagcgattctcctgcctcagcctcctgagtagctgcaattacaggtgtgtgccaccacacccagctaatttttgtattagtagagatggggtttcaccatgttggccaggctgttctcgaactcctgacccgcctcggtctcccgaagtgctgggattacaagcgtgagccaccgcggccagcctcaacttgcttttttacttaacgacatatcctggatatagttcaatgtccataaatgtaaagctaactctctttatttaaaaaatgactacatgagattccatctagcacaattatttaaatcattcccccgccaatggaaggttgggttgttctgatctgttttgatacaataagcaatgacatagtatacaactttgtccatatttatttatttatttattttttgagatggagtttcactcttgttgcccaggctggagtgcaatggcacgatctcagctcactgcaacctcggcctcctaggttcaagcgattctcctgcctcagcctctcgagtagccgggactacaggcgcatgccaccacgtgcagctaatttttttgcatttttagtagagatggagttttgccatgttggccaggttgctctcgaactcctgacctcagaagatcttcccaccttggcctcctaaagtgccgagattacaggtgtgagccactgtgcccagccactaaagcttctaaaaagtatatataatttttgtgtgtgtgtttagccatcaacaattatatctcattacaatttaaagttctatgagtattctaaggttgtttcttttccgtcttggctcactgcaacctccgcctcccaggttcaagccattcttgtgcctcagcctcctgagtagctggaattacaggcgcccaccaccatgcccagctaatttttgtactttttgtagagatggggttttgccatgttggccaggctggtctcgaactcctgacctcaggtgatccacccacctcagcctcccaaagtgctgggattccaggtgtgagccaccgcacctggccatttgccccttttcaggagttcatgttttcattccacaaactcatattgtgcaactgctttgtgcttgcttctctatcaagggctggtcatacaaagttgaataagacaccgtcctgcccccaaagagttcatagtcaattagagaggaaggcaaacagacgaatagctaattataaaacaatgccagcagtggacaaataaagtgaacagtattaatggggagtggttagggaaggcttcccagcggaggtgctgtccaaaatgaggctatgtcgcgagctagaggagagagaacagcaggtgcagaaaccacaggcaattccatgtgactggagcatcggggaccaggcaggtcagatgtccttcagagggagggagagggaggagcctgtgtgggtcaaattggggaactggaacttttaaattttgtttatttttttgagacggagtctcgctttgttgcccaggctggagtacagtggcacaatctctgctcaccgcaacctctgcctccccagctcaagcaattctcctgcctcagcctcccaggtagctgggattacaggcgtgtgccacatcacccagatcttttttttttttttttcttttcagacaaagtttcgctcttgttgcccaggctggagtgcagtggcacgatctcggctcacttcaacttccgcctcccaggttcaagtgattctcctgcctcagcctccagagtagccgggattacaggtgtgcgccaccacacccagctaattttttgtttctttagtagagacagggtttcaccatcttggccagactggtatcgtactcctgatcttgtgatctgcccacctcggcctcccaaagtgctgggattacaggcgtgagccaccgcgcccagccatttttgtatttttagtagagacagggtttcaccatgttggccaggctggtctttaactcctgacctcaagtgatctgcccgcctcagcctcccgaagtgctggtattacaggtgtgagccaccgtgcccagccaggaactggaactttatcctgttttacaaataatagtttctgaaggattttggcagaagtcacatttacatttcccttagtgccctgggatgagatgggggctggatttgaggaactgaaatctgaaggtggctcaacaacagtagttgcgggcctaagggcacagatggaccgattaggtaaatatgtaggagatacagctgtatcagtttgatggggatgcggtgagggagaggcagaatcacagcgactgcctaacaaatgtctgatgaaaggatggttctcagcagggcactgtgagtcatgcctgtaatccctgcactttgggaggctgaggtgggaggatcacttgagcccaagacttcaagaccagcctgggcaacagggcaagaccctatctgtacaaaaaatacaaaaattagccaagtgtggtagcatgcacctgtggtcccagctacttgggaggctgaggcaggaggatcacctaagcccaggaggtcgaggctgcagtgagctatgatcatgccaccacactccagcagtctgggtgcctgagatcctgtctcaaaaaaaaaaaaaaaagaaaaagaaaaagaaaaaagacagggttcttggtatctaacttcagtagacagtagtagtatggttatctgagagaaaatgtggaggacagttctgggggatatttgaggcatgtttgagccctgcagcgccgtcaggctgctcaaagaggagggaagggtgaagaaagagatttttcagatggcagttgaaaccttgggagtgggaagggttccacagggtgaggaaccgggtaggctaccagctggagccgccccccagcaggctgacagctccaagcgttgtctgggggaggttgccctcgccaggtggcccgggcggattctagacagtagggggcacactcggactggggcaggtggagcaagaggcgtttggggctcccacagccctggggtggtggtggggttttatttttggtttttattttggtagagatggttctcgccatgctgcccaggctggtctcaaactcctgtccccaagtggccctccgaccttagcctcccaaaccgctgggattccagacgtggacaccgcgcggcagccctggggtgctaagccagccccccggagcgagccagggtgaccaaggcgattctggggcagtcagagggtcttcccgggtcgggttagtgcctcgaatccgggggacgaagacggggagctgagctttcggagcccgggcttatcagacggggacccggagccccctcgaaccctccctagcttgtaccagctggcggacgtggcccgtagcatcgccctgcagaggggaccttccctgaaagggacggggaacggggtgaaggtggccagcgcgggcagggagcacccagatgacgatcaagggtggagggtccccggaggaccgagcagtgcgtgaacacgggcggagaaaggtcagtctgatggggggagctcaggagaccccatcctaggacgggacagaccagccccaaatccccttgcagatttccaagggccaacttccagggaccgggcagacgccaccggggagaggggaaggggtcggtgcatcagcggggggcgccacggctggaccgggtccgggatcccaggccccgaatacgccgggacgggaaccaccggggcgggggagcgaggaaccaggacccaaagcccgaggcggcggggacggcggcgctgcgtggggaggaggcggggtggggattcgagagtggaaccaccgtgcggagccggcgcatctgggcgtggtgacccgcgcgcagggggcagctggggacggcggggcggccgcgggagagcccggctgggggcgctggtggcccggcggcttctggggggagtccgctgggggccgggacgcggagccggagccccagcctcgcagggtcaggccgctggagaggccgcggggcgatgtcgccggggattcccggccgcgctgtgactcgggttgaaggctgcaaagccgaggcccggcccgcagcgcccaggcccctcccgtcccccatctctcttgtttgtctccgagtccggccggaaccggcttctgctcgcggcggggcgggcggggggctggctgctgattggtcgacgcctgtttccagccccgctcagccaatcagcgggcggcagtgttttcttcttggggtcggaataaaagggctggaataaaagagggcagaaaaggcgccgggcgggcccgacacacgccggaggagccgggtgagctgcagcagggaggggatcgcggccggggcgagggcgcgggggcagaagcggccgccgaaggggcgtagggagaaaacgtgggaacaagaggagagagatggagcgatgagrggccgccagggaagagatgacgaacagatgcgggctggggaatggaggcgcgggggtccgaggccatggaaacgggcgagttgccgggggaacgcccgagatgggggtcgcgcggctggctcgcgccgccggtttgaaccggctcctcgtctcccacgctgggttcgcgtggccgcagcgcctagcgacctagacggcggccaatggcgcggcagttcctgcgccgtccggccaatgagcgcgccggggcgggccgttccgtaggtctgggcgctgatcttgtggttgaagaaaccagctctggggaagggtctcgggcgcgggcgggagggcacctgtcagggtccctgggagaggcagccctcggatctgccsctgcccacctcacgctgcgttccatgctggccccaggcgatgtcagtcctgctgcaggccaggactagttccacggccctgagcatgcgttagccccttcttgcctccatgcctcagtttacctcggagtgagctgcgggagacgtctccctgcctggccggggcggctctgtcgtagcggagggcagcggtacgagccggccgcgggctcggggtgtcccaggtccgggcagggctggggttcgcttcctctgctgcgcgcaccggccgccgcggccggggaggggtggcaatcccgagccctgcggcagcggtcggggctgctgggggcggccgcaggggctgggcaagggccggccgctgacgccgagttctgtgcgcaggtggtgcagagccggagccggagccggagcygcgccgcgccgcaccatggcgcccaccctggccactgcccatcggcgccgctggtggatggcctgcacggccgtgctggagaacctcctcttctcggcagtcctcctgggctggggctcgctgctcatcatgctcaagtcagagggcttttactcctacctgtgtaccgagccaggtgagacaagcgcctggggttgcgggggggctcctggagctggggctttgggagggggcgggatgggggcgaagacctagcgagccacagcaccgcattgcccagtgcctctmgggtatcagaaggcccatctgatcctcacccagccctgccgggtacttgtcattgcccctgttttgtggacgaagacatcgaggctcagagcgatctgtcttgcgcaaggccgcagagcctgggcctgccatccacccagaaccccacctgctgtccagggtgttccttccacccgctacgaacaktgctggactgctctcctctcctcccagccctggaacatagcttggctggtagtaaacatgttgctgtctgcttgtgagaaagaggaactccagattaaggggctggggtgcagcaggagaggaagtggccttgcctccaccccagggagggctcatctagaatctagacgttcctcaggccattgtggagtctcctaagtgcttgctggacacaatttcttgtctatttttgctgccttatgattctccaaaggacatttcccccacgggctctgaggacatctccgtggctttccaaccccatggggatgaaggggaagagaagaaaggaacgtttatggaaatgatgctagggttgttctctcctctttgccttgtcactggaattgctgaaggcaggctgaggatgcttctctacatgacatctgcaccacccaacrcacacttaccttcacaccttcataccctgttggagggtcctgatgactacagggcagtaaattcagccccacaggagggccacagcagcccccagcctctagcctcctaccctccttcttaggcaaccttgacaggaaattttccctctgccttctccttgatcccaacggtagctgcataatagctgagctcacataatccctgtcgccagtgctagagtgcccttagatggaggtagcccaggtttgacttcctgaatccccagcagcaggccttttctttctagagctctttgcaggaagagaaagctttggaccagctcatgctgggtgtaatcctttgtggaagcctccctgtttcccttctctgatctgccccggagattcctgtgtgtcccagtctctagggagggaggcttagctggagaggttcagggcaggagaaagcaggagaatgcagaggccgcggggagaggacagaaagtatatcatttataactaacctttagcctttagccactcaaaaatatttcctaatagcctaagggttcttggcaggtctttccccacatcagcaagaaatcttgggagttgggaagagtcagaccttgttccctgaacaagctttctgctttggccaagagttgttaggagattaatgcctgtccccgaaaggcacaggttggagtgtttacttcttcctctcctttcctctctccyccsttagagatcgtgacccttcctgcttgyytccctggtgggctctttcaggctggacacagggtttaaaaaaaaaaaaaaaaaagcagaaaaaaagtcatcgtccccagagaaagcttttagtgtctcacccagaccagagaactgttgtgggcaggtgtttttttgtgtgttttttttttaacccaccatgatgtcggaaggtcagattctaggtgttttttgtttgttttttgttttttgttttttttttaatagaatgtccacggatttaattgattgtatggttttggcagaattgggtctggtcctttcattcctgcctcaacctcagcttcctcctctgtctaagtgggaggagtcccagagattgtgccagcgcagtgctgagttggtgttttaagccctgggcagacttgacaggtaactccactaaaccaaagtgaaggtgaagggtcaggattgtgggttgaacatcaacttcttatcccgaacttttgctcctgcctccaattttggtttttcttattatctggcaaacatgctgagcccacgttctgggcgggaaggctgctgattccacacagcttatctctctggtcacactgctccttgattcttggagtctgcatcaccagttttctttcaggccagaaatccccgcatttggctcgtctgggagtgcctggcgaagttagggtgaaggtttctgcttcagtctaacattttcaaacttggtgcatggctgaattgcagagaagcagataggccatttttgaatttattgaattagacttgtgaaagcctgagcagtgtccggctgattgagatgcaaatttgtcagcttcgtgtcactctaggacgatgctttagtttgttctctaaagaaaatttgcctgaacctgttgaaaggttcttagaactctttcttacgactccagccagaatctcgccacagacaccgtgttgggttccagcctggtgaggtggcagaaggaaggaaacagctcatttctcggctgccccgcagtttgttcttccttgcctgctgggagacgtggcaggctgggtttggggacctgggtgcgggaagttggcaatgggttttgcacaacgtcctccaggtgttggctgctggatgcctccctcgtccccctggtgagggcaggagaccagttgggttctcagcccgagaagcacggggcttcctggagctgtgtcctcttggcctctgggatggcaacgtgacggcccactcctgagctctttcttcattttctctgttgtccagtggcccccgcttcaacagggtcagggtcagcctggggggctgcggctacctgtggatggtttttttttatttgagacagggtctcgctctgttgcccagtctggaatgtagtgttgcaatcacagctcactgcggccttgactcctgggctcaagcaatcctcccgcctcagcctcccgagtagcagtagctgggactacaagtgtgcgccaccatactcagctaatttttgtattttttgtagagacagggtctcgccatgttgcctaggctggtctcaaactcctgggctcaagcgatcctcctgcctcagccttccaaagtgctgggcctgcaagcatgagccatcaaacccagttagttttttgtttttgtttttgggattacaggtgcccaccaccacgcccggctaatttttgtattttttagtagagatgtggttttaccatgttggcctggctggtctcgaactcctgacctcaggtgatccacccgccttggcctcccaaagcactgggattacaggtgtgagccaccacgcccggtcaaattttttgtagagatgagggtttcatcacgttgctcaggctggtctcaaaactcctgggctcaagtgatccaccagcctcagcctcccaaagtgctgggactacaggtgtaagccaccatacccagttaatttttaaatgttttgtagagataggggtttcaccatgttgcccaggctggtcttgaactcctgggctcagtcgatccacccacctcgggctcccacattgctgggattataggcgtgagccaccgctccaggcctacatgtggatcgttaatcccctctttcttgtaacctaaacattcagtaaacattgacgaaggtgcmgtgctgggtgcagaggaaacaagtcatcacacgcatacctgtgtaacccgtataattccagggggtggtcgggcccccaagaaagcagggcgccaggagctagaacagcagcggagatgtggctcctgctgggtgggagggcctctctgcggttcaggtggaagcctggaggttgaggaggggtgattcaggagaggagggyacaccctggaggagaggagggtacaccctggaggagaggagggtacagcctggaggagaggagggtacaccctggaggagrggagggtacagcctggaggagaggagggtacagcctggaggagaggagggtacaccctggaggagaggagggtacagcctggaggagaggagggtacagcctggaggagaggaggatacgccctggaggagaggagggtacgccctggaggagaggagggtacagsctggaggagaggagggtacaccctggaggagaggagagaagtgggaaggggcgggggctgcagggactgggaggccattcggggaaactgaattttattcccaagacaggaggaagccagggagatagaggagggcgaccatccaattcccctgttagaggcttgtgtgaattgctgagggcttgccacatgctggtatgtttgggtggcatagaaaccagaagtcatcacggcctctgcctgaggaagtcacccacagtctgaccatgggcatgaaggccgaccccagttgtatgctcttgacctctgcagtttctccrcctgtggtggtgggagagagcctctcaccctggcacagaggtccctgcgagctcgccctggcacagagatcgctgcaagggcagaggggctgccgcccaccttggggaagcaggcccaggcttgatccccacgggctgagtgaagctgcagatgtggacaggagatttctctgctgcctcgaggacctcttttcttgggggatggggaggagggaacggagtttcactcttgtcgcccaggctggagtgcagtggcgcagtctcggctcrctgtaacctctgcctctcgggttaaagcgattttcctgcctcagcctcccaagtagctgggattacaggcgcctgccaccatacccrgctaattttttgtatttgtatttgtattttattttattttatttttttgagatggagtttcactctgtcgcccaggctggagtacaatggcatgatctcagctcaccgcaaactccatctcccgggttaaagtgattctcctgcctcagcctcccaaatagctgggattacaggtgcccaccaccacacccggctaatttttgtatttttagtagagacagggtttcaccatgttggccaggctggtctcaaactcctgacctcaggtgatctaccagccttggcctcccaaagtgctgggattacaggcgtgagccactgcgcccagctcaagggcctctctttttagagtctctcctcacacccacaggcaagtgtggatagtttttttttttttgagacagagtcttgctctgtcgcccaggctggagtgcagtggcgcgatctcggctcaccgcaacctccgcctcccgggttcacgccattctcctgcctcagcctccccagtagctgggactgcaggcgcccgccaccacgcctggctaaatttttttgtatttttagtagagacggggtttcaccgtgttagccacgatggtcttgatctcctgacctcgtgatccacccgcctcggcctcccacaatgctgggattacaggcgtgagccaccgcgcccagccggatagctttcttaaatccagcctttcacttttattgctataaatatgacttttaaacttttcccccagtttatttggaattttaaaaattccatagcaatgggtaagaaggtttaaaggctggggccggcagcctcaggatgcgtctcagagaagagctggtggccttggctcttcccaccgccccagcctccctccttcttggttcgtgacctcatttccctcacagacatccactggccacccctggcttctggtgtccatgaaggtcctgtccagcttaggctggctctcagggacctcgtgggagagtcttagtcccattcccaccaagcgatattcagggcctcctggtgttgccggcacatgggcagccttttcccggctctgttctctcagcattttctctctgggatatgagcctctagcccaggtaggccagcatcggcacagaccgagtggtaagagcgggagctttggggtctgacagcctggagtcaagcccagcttccccagggacccccatgagaccttctgcaagtgacttacctgctctgagcatccctcggggacactctgacagtatcctcgtggggaatatggggtgggcgtgggcacacccgttgagcatggcagctggcacacactttcattgcacacacggcagccgctgctgggaccactgctcrggggccaggccctggtcagcccaggacggcctctgcctgtccgtgccctcctgcctgttgtttgctctgtgtctgagccgacctctcacctacatctcccctgccggactgaggactgagatgctgcttcctgttgccggatagactaaggatttgagagacgggagatcctgggcaggggccatcggtgggctgtccaggggcccgcaccctggagggggggctcggaaagcgactagtcagggaagggggcagctcaggaatttagaggggacctcaagccaggtacttcttggccccctcaagcatcatcttggaggcccccctccctttgtctccccggggtgtggggaggctcctctttgcctcaggggagcctggggggccacagcaccctcttttctccctgattcctctgtaaagatcttgtgcgtcttctgtgagtggggctgaacggtgtacgtcctccctggccctgggtctcctcctaagcagccctgttcctgttcttggcactcactggccacaccaactcttgcctgtcttctcagttcaccttctctggccaggctgggctgggccacttctggccaccccagaggaggcatctgtttaataaacaggtgcaggtgaggagcagagcagcctggccgggggtgagcagagcaggctggcccggggtcaagctccaggctgggagcagagggccaccccacgccttggcacttcctgggtgcttaatctgtttgtctctctcctgacccacggtggcccaggtgggagcagagggagaggaacagcctgggtgtgtctgtttgggcatctgctgggtgcatgtgggctgtttactgtcaacagagcttctgggctcaccaagggcttccttccctccagcaggagggagactctcaaattgctccacaagcagaaggagaagccgctcacctccccggccccaggcgcctctgttgctggacgggacggcctggaggcaggcggccgggcagagggcctggtggccccatcggcagggatttgtttaagacgagaaggctgttggcctacgtgcaaggtccctgcccctgtgtgtagtcgctccagggtaaaagatgggaaggacagatacccttgcctctaccctgaccttgcctcttccctatgtggttaaaggggtgaccagatctctaatcaatttaagacttttgtttgtttgtttgtgtgtttggagacagagtctcactctgtggcccaggctggagtgcagtggcacaatctcggctcactgcaacctctgcctcctgggttcaagcgattctcctgcctcagcctccaaagtagttggggtyacgggtacctgccaccaagcctggctaaatttttttgtatttgtagtagagatggggtttcaccatgttggccaggctggtctcaaactcctgacctcaagtggtccgcctgcctcggcctcccaaagtgctgggattacaggcgtgagccaccgtgcctggcctagccttgggatttttatcttctggctctagatgagaaaacccatgggtttagagacccagctgtggttcctccctggggtaactggaggtccctggtgcctttactcaggcagtgctgcytcacccactccattccttgtccccgtggctcctgcttgcagcagtagaacstgcagccccccaagccctcagttattccacggcccctgtgcagtcactgkccccacaagtcacccatcctgggccctggcgtgctctctccatccatcctctctgtcacctctgtgctggtttgctcctatctgcatgtcaacctggaaatggctgttgctttktagagaccctctttccctgacttcagagccaattcctttgctgctggcagagctgacatttgaaaccaacaccaactcacaaagcagctcctcctttccagaagctgccccactgtggatgggcgmgtggcccaggcctgtcggctgtggcggtgtacatgacygctctgagctccaccctgacgggctcgaggaccccgtctgccatgtgtttggctgaccgtgtggtagagcttctttttggaaaaccgagagaaagtggccgaggtgggaatctggttggtgacgttgtatttctgtggctccacatggttaacctcgtggctctgatctccttaaatcccccctcgattcaacgtggttctgttgattcctctctcgatctttttggccattgtgatctggtgccattgtttttgttttgttttgttctgttttgtttttcgagacggggtctcactctgttgcccaggctggagtgcagtggtgtgatctcagcttaccacaacctccgcctcccggcttcaagcaattctcctgtctcagcctcccgagtagctgtgattatagacgcccaccatgcccggctaatttttgtatttttagtagagatggggtttcaccatattggccaggctggtcttgaactcctggccttaggtgatccacccaccttggcctcccgaagggctgggattacagactgagccactgtacccggcctgattctrtttgtttgtttgtttgttttttgttttttttgagacagagtctaactatttgcccaggctggagtgcagtggtgtgtgatcttggctcactgcagcctccgtttaccgggttcaatgattctcttgcctcagcctcctgagtagctgggattacaggcatgcgccaccatgcctggctaatttttgaatttttagtagagacggggcttcaccatgttggccaggctggtcttgaactcctgacctcgggcgatccacccgcctctgcctcccaaagtgctgggattacaggcatgagccgccacacctggccctgttgtttttatttattcagtaaacagctattgtaggccaagacctgggtgagatactggggacacagaagtgaccacagtgcaggccctgcccttcggggctcacagcccagtgggggattagacatgtctttgcgcttccacacacgctgacgggactgtgctccccacagccactgcatccggctctgtgccagctgatggtgccgtgattccccgccggagcctccaatagcagcaatgatcatgataaccacgagaacagcagcaacttgtagctattcattattgagtgctttctatgcctgggtgagctccagaaggttttctgaatttttctcattgatcttcccccacactctaggaggtggatcttatcattatatgatgtccatgttatggacaaggaaactgagctagagcaaggtcatgcaggtagaaagtggagaaacaaacactggaagctagaaaccagattccagttccacgctcttcatccacacggccccggcggggctccttggccacacgttggcatgaagcacgagtccacctgtgcgcatcctttccagtaaccttggaggaaccccgagaggcctgagcaagcttttgcaaacctcggcgctacagccctggcgccagagggctgcaattggaaggcaggcagttaccggaagaagagcgtttccttgactctcccagcgtgacctcatgtctaatcaaagtcggctcctgttttctgcaggattagtcagcatctcttaactagcagtcccggccaggagagctcctcagccacgttcccagcccgtcctccaccctcccatcttcagctgccacagcacttttctcttcctttctgtgttgttttggtgctgggtggactttgaagggggccattaagggctgggtgtggcaaacacaccagactcagcacccagcgaggtctaggcatggccacgggatggcaccactgtgaccccggcaaggaaaataagaaaggtgcatatcggctgggtgtggcggctcacgcctgtgatcccagcactttgggaggcagaggtgagaggatcacctgaggtcaggagttcgagaccagcctgggcaacatgatgaaaccccatctttactaaaaatacaaacactagccgggcgcggtggcaggtgcctgtaatcccagctactcgggaggctgaggcaggagaattgcttgaacccgggaggcggaggttgcagtgagccgagatcgtgctactgcactccagcctgggcaacagagtgagactccgcctcaaaaaaaaaaagaaaaagaaaatatcagggggagaaggtggcatctgttctatgtttgagaaggcagctggacttcccattgaaggaggcgccgcagtctccccacatggacagaggagaaccaggctattggggtgagaccagtgcttgtgcttcccaagtggtctgggttctgcctccatactggctgcagtctgtccccacggacatagctgccgtgagaaggttctcaccagcctggggccccacagccaaggctgggccctgaggtctgccgttctagggtggcggatgctctcgaatgggactctcagcctgggcttcgttgctcttcaagggacacacaaagctcctgaaactgtggataaaccttggtgtgcattttctggggaggtctttattggatttttcaaagggtccatggcccccacaaaagttaagaacctctacattttcactccagggkacttgggccaaatggccatccaagcctgctgcggggtagcctgagccctcgagaggccgccagccagccctggcattcccagtggggggaytctgaaygggcacctgcccttctgatctttgggaatccctgtcatgaccctgaggtcagggtttccttccctcttcacacagagaatgtcaccaatggcacagtgggcggcacagcagagccggggcacgaggaggtgagctggatgaacggctggctcagctgccaggcccaggacgagatgctaaatttggccttcactgtgggctcctttctgctcagtgccatcaccctgcccctgggtatcgtcatggacaagtatggcccgaggaagctcaggctgctgggcaggtcagtgtgggtcccttagggggcagggagtgggcaggtggacccyctgggctgagttccccacagaagggtatcctggtygtacctgatatcaggtgtactgtggagctccctgaaggccctccagaatggagttcctaccccgtccgccaccgaatcagcaggtactgtggtcctcgccgtgctccagtacygaataagaaaagctccaggctccaggccgcccagggaccggagctgcttgtcactaagaacatgtgtttcccatccctttgtagttcataagcatgataattggggtttccctcgcatgtgtgagacatgcttccctcaaaccttgttacgaagctggcacagtatccatctgatgagaaaaaaaaccaacaacactggtttccacagcccgtttgaccttatagctccaccagaaaaaagattttcaacacgtacccccaatataataagcacatggaattataaatgatgtatatctgtgctctttttttttttttttttttcaagacggagtcttgctgtgtcgcccaggctggagtgcagtggcgtgatctcggctcacggcaacctctgcctccccagttcaagcaattctcctgtctcaccctcccgagtagctgggattacaggcgcctgccaccacacccagctaatttttatatttttcatatttatttatttatttatttatttatttatttatttatttattgagatggagtctccctctgtcgcccaggctggagtgcagtggcgcgatctcggctcactgcaagctccgcctcccgggttcacgctattctcctgcctcagcctcccgagtagctgggaccacaggcgcccgccaccacgcccggctaattttttgtatttttagtagagacggggtttcactgtgttagccaggatggtctcgatctcctgaccttgtgatccgcccgcctcggcctcccaaagtgctgggattacaggcgtgagccatcgtgcctggcccctatgccattcttttttttttttttttccttttgagttggagttttgctgttgttgcccaagcaactggagctggagtgcagtggctcccggccccctatgccattcttaatgtgctttataatacatatacaaaaatataaatgaaaatgggctgggcacggtggcttacactggtaatcccagctttttgggaggcagagttgggtgggtcacctgaggccaggagttcgagaccagcctggccaacatggtgaaaccctgtctccactaaaaataraaaaattagccacgcgtggtggtgggcgcctgtaatatcccagctacttgggaggctgaggcaggagaaatgcttgaacctgggaggcggaggttgcagtgagccgagatcgcgccactgcactccagcccgggtgacagagcaaggctctgtctcaagaaaaaccaaaaaccaaaaacaaaaacaaaacaataacactgaataaagtcataatggtaaataacattgcgtttctgcttggttttagcgcctgcttcgcggtttcctgcttgctgattgcgtacggagcaagtaaaccaaacggtgagtgtcctctccctccatcttctgtcagggaccggggagagagtgccctgagctgctcccaggcccacctgctcttggacactgtcctgggcctgctgctccctgctcaagttagaggggacacctgttacgcctctactcagttacttatctcaaatagacggcgagatcagagagcagccaccccagacaggagcttccagggtatgagcaacttccatctcatcaccaaaccaagcyagtccctcactgatgccaacctgagaggcaagttctaagaaccaggccggctgcaggggcatggtcatcggtgtgtgcagaagtcacaagctgagtcccctccaggcagcacaggycaaagcatgaaggatggcttagaagccacctggtccccaaccctgttcaaggatttgtagagcaaacaccaaaagaggactcgagtttcaccaaaatcttagccaggctcatctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagcttacwgcaccctggacctcccaggctcaagcgatcgtcccacttcagcctccagagtagctgggactacaggcacgcacacacacagctagctaatttttttkttgttgttgttgagacagagtctccctctgtcgcccgggctggagtgcaatggcgcaatctcagctcactgcaacctccacctcccgggttcacgccattctcctgcctcagcctcctgtgtagttgggaccacgggcacccgccaccacgcctggctaattttttgtatttttattagagatggggtttcactgtgttaaccaggatggtcttgatctcctgacctcgtgatccacctgcctcagcctcccaaagtgctgggattacaggcgtgagccaccgygcctggcttcacctggctaatttttaacttttttttagaaatggggtctcactttgttgcccaggctggtcttgaacccctgggctcaagcaattctcctgcttcagcctcccaaagtgttgggattctaggtgtgagtcactgcgcctggacactgctaatattaattggagaaaagaagatgggtgtgcagctttttcaagagcccacgctttgtgaaataggcaagaggaggctgggcatggtggcttatgcctgtaatcttagcgctttgggaggctgagatcggcagatcacccgaggccaggagttcgagaccagcctggccaacatggcaagacatacaaaaattagccgggtgtggtggcgcatgcctgtaatcccggctacttgggaggctgaggcaggaggatcacttgaacccgggagtcagaggttgcagtgagccaggatcgtgccattgcactccagcctgggtgacaagagcaaaactacgtctcgattaaaaaagaaaaagaaataggcctagaggagggggtgagaaaggggcagttccactccccagatgtcaggtactaaccccggcctgcgtttactggatttactgggagcctgcaccgcgcaggactctgggctggtccyggcttccctggagctcagctggggtctccactcacgagctttccatgtccctgcagctctctccgtgctcatcttcatcgccctggctctgaatggctttggtgggatgtgtatgaccttcacctcattaacagtgagtacrgattttttaaagctctgtagttcagtaatctgtttctaaatttgaggccgctttgattggtttctgtttccttgccttccatgtgcctgcatgtgmctgggtgtcccaaacagtagaggggctatgggcgaggtggcctggcagggcctcctcagctgaggtccacaggcagcagggcgtggcttcacaatcccttgcctttttttttttttytgagacggagtcttgctctgtcgcccaggctggagtgcagtggggggatctcggctcactgcaacctccgcgtcccaggttcaagcgattctcctgcctcagcctcccgagtagctgggactatgggcgtgcgccaccacacccggctaatttttgtatttttagtacacatggggtttcgccatgttggtcaggctggtctcaaactcctgacctcaggtgatccacccgccttggcctcccaaagcgctggggtgacaggcgtgagccacctggcctggccgacattccctgccttctgatctgggctttgatgctgcggaagcagctcactagccttgtgcccaaggaaggcagaggcaggaagacaaaacrctgccgcccactttcttttcctgttttcctcggcagctgtcatcagggtctccgggagcttcggctcatggagcagcctgaccacccgcctcccgtggaactgcctcaacctttgcctttgtccggagccagatggaaaatgcagggaacatctggtcttctgctcctcttgtttcctccgtgcccgggcacagacagtcgcctgggggagatgttttctcggggtactaarcacccccttgttgggagccccaggacatcacaaaatatgctccttcttgatgtcagggaggcagaaggaagatggggttgaaagaaagaaagtcaaaaaaggggctgggcatggtggctcacacctgaaatcccagcactttgggagactgaggcaggcggatcacttgaggtcaggagtttgagaccagcctggccaacatggtgaaaccccgtctctactaaaaaatacaaaaattagccgggcgggtggtgcatgcctgtaatcccagctactcggaggctgaggcgggagaattgctggaacctgggaggcggaggttgccgtgagccaagatcaagccactgcactccagcctgggcgacagagccagactctgtctcaaaaacaacaacaaaaaagaaagtcaaaagaggaaccaaaaagtctctcccagagggaagaagggaactctctgtgggctcgcccagttgggcaatcgtgccattccgagctggccattgggaaagaagtgagaataatagcttcttcagagaggcttctgtccatcaaggaaacctcgcctgcatcagtttaccggtgaaaaagtttctaagacacagtacctaccattactatttgtggtacactctggtttctgatttcccttgtcgtgccattgaagggttcttgtttagctttgagggagctctgggggcttctggacctcttcttttttcctttttcttttttttttttttgagtctgctcggttgcccaggctggagtgcagtgacgcaatcttggctcactgcaacctccgcctcccgggttcaggcaattctcctacctcagcctcccgagtagttgggactataggcgtgcaccatcacgcctcgctaatttttgtatttttagtagagacggggtttcaccatgttggccaggctggtctcatacccctgatctcagccaatctgcccgcctcagcctcccaaagtgctgggatgacaggcgtgagccacggcgctcggccgaaaaccagcagctctttcatcagcatgaaaactaaaaacctggcctcacctccattattttagtcacgcgacgcctctgtcacggcaggcctgaatttcagggataaaggaacgagatggtccttgagcttgaggacctcacaccccgaaatgccgagaggtgttttgtctgaaaaacgaccaagaatccctgttaagaaagactttaggccgggtgcggtggctcacacctgtaatcccagcactccgggaggccgatgggggtggtggatcatgaggtcaggagttcgagaccagcctggcccaagatagtgaaaccccgtctctactaaaatatacaaaaattagctgggcacagtggtgggtccctggaatcccagctacttgggaggctgaggcaggagaatcgcttgaggccgggaggcggagtttgcagtgagccgagatcgcgccactgaactccagcctgggtgacaagatcaagactccccctcaaaaaaaaaaaaaggaaaaaaagaaagactttaaaagggaccctgcggttggagctaataggccagtaagaattctttgtctttttttatgttttataattataaaacaaaatttttttcattacattttttattttcattttttacagatggggtcttactatgttgaccaggctggtctcaaactcctgggctcaacagatcctcccaccttgacctcccaaagtgctgggattccaggtgtgagccaccatacctggcccaaaaatgattttattttaaaaattcaggttgggagcagttgctcacacctgtaatcccagcactttgggaggctaaggtgggaggatcatttgaggccagggttgagaccagcctgggcaacatagcgagacaccttgtctctccaatttttttttttttttaattagccagggcatggtggcagttgcttgtagtcccagctcctcgggaggctgaggtgggaggaaggcttgagcccagaagttccaggccacagtatgccacaatgacaccactatattccagcctgtgtgacagagcgagaccttgtcccaaaaataaaagtaaaaatttaacatttcagaaatatgaattgtagactaaacttctatgagcctgccaggcgcagtggctcacacctgtaatcccagcactttgggaggctgagaaggttcccatcacctgaggtcaggagttcgagaccagcctggccaacatggtgaaatgaaaccccatctctactaaaaatacaaaaatattactcgggcatggtggcacacgcctgtaatcccagctacttgggagactgaggcaggagaatcgcttgaacctgggtggcggaggttgcagtgagccgagaccgcggcattgcattccagcctgggcaacaagagcgaaactccgtttaaaaaaaaaaaattctatcagcctgtcttcatcagtttggaatatatttcttcagtatttaaaagatctgcatgtaccagtgttattctttttttttttcttaaaaaaaaaagaactgtgataacttgccttttcccttaatgtatcttttacatcctttcctgtcagtacttagagatctgccttattattaagcagttctgtatattattctttaatatagatggaccatcatttattcaacctgtttccaactaatggacttttggcttggttcccaatttttccaatttatgaatgctgctgaagtgagcatccctgtacatgtatttctgtaaaataagttcctggcagccctgggccacaggattagcatgttttaaaatttaatatgtactgttaaatagtcttctaaaaatgttatctggccgggcgcagtggctcacgcctgtaatcccagcactttgggaggctgaggcgggcagatcacctgaggtcaggagttygagaccagcctgaccagtatggtgaaaccccgtctctactaaaaatacaaaaattagctgggcttggtggagggcgcctgtaatcccagctacttgggaggctgaggcaggagaatygcttgaacccgggaggcagaggttgcagcgagtcgagattgcgccactgcactccggcctgggcgacgagtgaaattctgtctcaaaaaaaagcctgcctgccaccacaggcccaccagcacgtacacgagtgtcttttcctccatgtcccttccagtgccatgtcattcctctttaaaacatagccactctgatcctatgaaaaacgacatgccatttttaaaatttatttcattattagtgagacagagcattttttctcctctttattggtaaattgcatttcttctgtgaattgcttctttgtgtcatttgtctatttttctacagtgctcttgattttattattattagtatttagtgactcgtaagagctctttcaaatacaaagacactagtgttctttccgagtgagcaggagatcttaccctggggttttcaggtctctacatggtccatgagtaagcttcaggagagccgtgcacacccttgaaattccatgccaacaaagcgtgtgtaggtgctgctcagctgtgtctttctggaggggagggtccattactttcactggcctctggcaggtctgtgtgaaggctaaaaaccactgcggtggccgggtgcggtggctcacacctgtaatcccagcactttgggaggccaaggtgggtggatcacctgaggccaggagttcaagaccagcctggccaacatgatgaaacccaatctgtactaaacatgcaaaaattagcctgggatggtggcaygttcctgtaattccagctactcgggaggctgaggtgggagaattgcttgaacccgggaggcggaggttgcagtgagctgagatcgcaccactgcactccagcctgggtggcagagtgagactccgtcttaaaaaaaaaaacaaaacacacaaaccactgtggcaggagcgtttctattcactctttgctctcccactggaggcaaaaagctacacaggctagagagtgaccaggcaagagagtcacctgatcaccatttgaagcgtttggctaccagaggtctgtctaagggaggctgttggtttgttcttcaaggttttcattttttgatctagagcaggagtcagcaaaccgccattgccaggccaaatccagaccactgcctgtttttgtaaacaaaacttcatggggtagagctgtgcctgtttgctcctgtctgtggctgcttttgtggtatctcatcagagtcaacgcagtcgtgacagaggccatatggcttgtaaagcccaaaaggtctactgtcttagccaggcacactagctcacgcctgtaaccccagcactttgggaggctgaggcgggtggatcacctgagctcatgagtttgagagcaggctggccaacatggtgaaaccccgtctctactaaaaatgcaaaaattagccagatgtggtggtgggcgcctgtagtccccacgactcaggaggctgaggcaggagaattgcttgaacccgggaggcagaggttgcagtgagctgagattgtgccactgcactccagcatgggtgacagagcgagactctgactcaaaaaaaaaaaagtctattgtctggccctttatggaaaaagtttgccaacccttggtccagaggccccaggaagctgctacgtcactgttcctcgtctgagggcatgtgctgacacccaccattcacacccacaccctctggttgcatgggccagctctccttctaagtcatctctttctgcctccccccagggtggagggagttccatgggcattcccctgccccctgaggcctctgatgagggctccagtgcctgctccttgagaacagaccccaaaagggaaatgaggtcagtgaggacagggctgaagcagttaagcaacactcttgggctgactggggcttctgctgagcagagccgaatctcattctgatacaacccaggacttcagaaagcagaactgtcgggatcagctcccagagacgccaagctcagggcacaatggcactttctgtttgtgtctcccacccgtgttctaatttgggggacaaaggagtctccagggtcgcctttaggaatttctaactccaatcttcaacaaccatgttggggctgtggataatagctctgtgataacccaggactctaggggacggcgttgctgtggaagccttaattcggggacttcctgggtcccggggcctttgtgctgcatgggctgtggtctaaatacagatgaccaggggctgcgagctgttacccccactggtaggagagggggctccaagcgggcacacgccttttccttgtagtccagaaggagatggccaygagccatccttccagagcccaagaggtcggcacccatggtggtatttccctcccaagtggaggctccgaggggcaagggtggctgtcgcgtcaggtaggctgcccagtagccagtgctggctctcccagggccctgcagcacagggcctgggccatcgcgtgccatccgtggagggcggacgccaggtcactccatgggggcagagcactccccacggtgtggatcctcagcctcccccgggacatctggacggcacgctcagtgtttgttcagtgcctcgcgtttgtacagccctttgcactcgcttcatcggctggagcacaaacacggccggcggctgaggccgcatcytggggtcgccaccctccaacccggagcctgggttgcttagagatgggagcagctgtagccaaaattgtgaacctgccatttccactccattactctgacccctgtccccgtgggtgggatggggatttctcagcagaagccacacagaaaagcgggtttcaaaatgttgccaggctccccgatgagacatttctctgtggattttcccttttgattccttcaagtctgactttaaacctgaggaaggcatgatttcatgggaggtgggatctgagggaagtgaagaggataaacatccctcttcagatcctggagaggagggcaggatggcagatgcccccagagaggggacaggagtttagtgccgtggctcagtagaccccgcgtctgcagccaggagagggtcccacggtggcccccggccagctctggagggtccaggagagggtcccgcggtggcccccggccagctctggagggtctaggtgcctggtgagcgggacttgccagtgcccagtgcctgctgtgcctccccaccttcctctctttctgtcctgtaccttggggaagctcaggcagtcagctacttgccattggtttggggagaatttgccatctgagggttctgcctcatgaatttgctgcagtatgtgaccacgttcagacggaaagggcagcggtattggcaggactggacccggccgggaaggcacaggaggtggccgggggaggggagcacacccttcycctcccttcagcactgaagcagaaaggtgaccacaaggaccttgtcccggrcagcatgtgcttggaggtgcccggttgttgtgggtaggaaacagcccagcctggcagagtctacctgtgcagtctggttccgggatcccggcctgtgcaggttgtacagaactctgggtgtgtactccagccacttggggacaaggctccctctggaggggacccgagggccagaatgccagcccccacccaccacccagctccccagcccccacccacctcccagctccgcagcccccacccaccacccagctccccagcctcctgcaggccagggaggactcgggagtccgtggatgtggaaagtcagggccgggggtgccacggttgccccttgtttctgcctgccagcaatgccatggcctgccctgggccaaaaggcacgtacgtccggcatcttagagaagctcccgcgcccgcactgtcccagggccttggccctgcaggcactcctgtccggtggtcawgctctatggccagaatgccaggggaggggccgcctgcagctgctgttttcccctctgggaaggtcacacagtccggcctgtttatgctgcagccagggggctgaaagagagagagtcacgggcttccctgtgtgactgaggctgcgtggaggcagtgagtgaacagcccgggctggcaggacaggttgacccgcacggaggcagaggcggcgagggggctgtgggaagcacctgagggcgggaagaggggcttgcactcccacctgtgagtgtggtggtgagtcaggaaacagctccggcttcctgcttggcagcaaagctggtccttcccctcctggggtccttcccctccgccagccctcgaggcccgcgctagggcgctctgctcagcgctcagccctcactccggcaccgcggcttcgaacagccattatgcgcagctgagaccggtggaggcagggaagctggggacggagtgagcgagagggggaatgtggggagtgacccagatgtcaggatgacctacgggagtccacaggcaaatgcaagcccatccgatgctgtggcgctggaccatggggaggtcagccgaaggcaacagcaggaggtgagggcagggggcagatgggtctaaaaggagcttcagaaggaatgtaagccatctctagttggggactgggcattgtggtatccccctgtagtctcagctgctcaggaggctgaggtgggcagatgagttgagcccaggagttctgcacaatagcgtgctgtgttgatgagatgtctacactaagttcagcatcagtgtggtgacctccggggggtgagggacccccaggttgcctaaggagggctgaaccggcccaggtcagaaacagagcaggtcaaaagtgtcctgctgatcagtagagggatcatgcctgtgaatagccactgcgctccagcctgggcaatacagcatgacctcatctccaaaaacaaatttaaaaaaatgaccgggcgcggtggctcacgcctgtcatcccagcactttgggaggccgaggcggatggatcacctgaagtcaggagttcgagaccagcctggccaacatggcgaaactccatctctactcaaaatacaaaaaaaaaattagctgggcatcgtggcakgtgcctgtaatcccagctactcgggaggctgaggcaggagaatcgcttgaaccagggaggtggagcttgaagtgagctgagattgtgctgctgcactgtagccttggcgacagagtgaggctctgtctcaaaaaataaataagtaaatgaatgaaaaataaacctctagttgaagggcgcagattggatcttaataaggcacatgtaaaagccgtgggatccaaactgaagtgtgtattggccggagccacaggagactccagagaggcagcgtggcctggggcctacacacagaggcttggcctggcttgaatccccaatctgaccattactagcttgggggagtcccttgacttttctaatctttaagtttttgttttgttttgttttgttttgttttttgaggcagagtttcactcttgttgcccagactggagtgyaatggcgcgatctcaactcactgccacctctgcctcctgggttcaagcgattctcctgcctcagcctgccgagtagctgggattacaggtgcacgccaccacgcctggctaattttttgtatttttagtagagatggggtttcaccgtattggccaggctggtctcgaactcctgacctcaggtgatcccctgcctcggcctcccaaagtgctgggattacaggtgtgagccaccgcgcccggcctcatggtgttttttgaccaataaaagtttttaaataggtggtcaaaagtgtgtttcagcttttagggagtacctagcatttgtgtcaaatgaaacctctctgaagagaacatgaaggatgaccttgaccagtgaaacccaaagcataaacatcctgacagcagtcaatgtgtggtcacaacagaataacaaggacaggagaagaaaggccatctctgtggacactaattatttatttaaaggggaatactaatttgtgttttatcctgtagtcggcttccttttcttcctcccagagctgtggttcctgccagaggacacttccctcgttggctgtgcccaggagcagcttgaccagaagattttccctgttatgaagtcataacacatatcataatagtaactattgttaatacctaccctatttatgatctttaaaaccctcggccgggcgcagtggctcacgcctgtaatcccagcactttgggaggctgaggcgggtggatcacctgaggtcaggagttcgagaccagcctggccaacatggtgaaaccctgtctctactaaaaatacaaaaattagccgggtgtggtggcgggtgcctgtaatcccagctacttgggaggctgaggcaggagaatcgcatgaacccgggaggtggaggttgcggtgagccgagattgcaccattgcactccagcctgggcaataagagcgaaactccatctcaaaaaaaaaaaaaaaaactgaaaaaacaaaacaccatgaattaagaagttaaatgacaaactaggaaaatttattcatagtatatagaactgtgaatgtcttcattttattttatttttattaatttttgagacaagagtctcgctctgtcgcccaggctggagtgcagtggcacaatctcggctcattgcaacctctgcctctggggttcaagcgatttttctgcctcagcttcccaagtagctaggattacaggtgcctgccaccatgtccggctaatttttgtatttttagtaaagacgaggtttcactatgttggccaggctggtctcaaacccctgacctcaggtgatccgcttgcctcggcctctgaaagtgctgggattacaggtgtgagccaccgtgcccggcctgtgaatgaatgtctttaatacataaagagccttcacaaaatcaatatacaaagattggccgggtgcagtggctcatgcctgtaatcattgcagtttgggaagccaaggtggaaggatcgctggaatccaggagttcaagaccagcctgggcaatagagtgagaccctgtctctataaaaataattaaaacaaagctgaaggagaccttgctatgcagccccctgccgcttgtgcacccttgtcgacccacacgcaccttcaggagggcggcgcacacctggggtagtcacagtgcaggactctggctcaatagcgcctttgcattggtttggaccttcgggagggcggtacacgtctggggtagtctcagtgcaggactctggctcaatagtgcctttgcattggttgggaccttcgggaaggcagtgcatgcctggggtagtctcggtgcagaaggactctggctcagtagcacctttgcatcagtttggaccttcgggagggcggtgcagaaggactctggctcaatagtggctttgcatcggtttggaccttccggagggtggtacacgcctggggtagtctcagtgcaggactctggctcaatagcacctttgcattggtttggaccttcgggagggcagtacatgtctggggtagtctcaatgcaggactctggctcagtagcgcctttgcattggtttggaccttcgggagggcggtgcatgcctggggtagtctcagtgcacgactctggctcagtagcgcctttgcatcgttttggacctttgggagggcggtgcatgcctggggtagtctcggtgcagaagggctctggctcagtagcgcctttgcatcagtttggccttggctcccagcactggttgtttccrgcggggttgtcggctgtgtgaagcaggccgtgtgcctctctggctgtggggctctgttcggtggtgtagcaggcctgagtgcttattagccatctcgggatccagggaacatttgggttttcccagctacacctggaaacttggcgggcatatgggaatgagattctaccactctggaagattcatgcccacaggtttcattgcagtttgctgatggtccgcaagcctgaaattagcgtgtggaacagacccctttggtagcagtctagtgccagctcagacctacgaagaattaaaaatctgcaaacttccactatttcaatgtttaagggaaataaatgcagcatttttgcatttctgacattttacttaaaacaaacaaacaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgtcacccaggctggagtgcagtggcgcaatctcagctcactgcaagctctgcctcccaggttcacgccattctcccgtctcagcctcccgagtagctgggactacaggcgcccgccaccacgcccagctaattttttgtatttttagtagagacggggtttcactgtgttagcgaggatggtctcgatctcctgacctcatgatccacccgcctcagcttcccaaagtgctgggattacaggcgtgagccaccgcgcctggccaaataattttttaagttgtagaaaaatgttgaaagtcattagtaaaagttttttgtttttttgagacggagtctaactgtgttgcccaggctggagtgcagtggctcagtctctgctcactgcaacctctatctcccaagttcaagcgattctgctgcttcagcctcccaagtagctgggactacaggtgcctgccaccacgcccagctaattttctttatttttggtagagacagggtttcaccatgttggccaggctggtcttgaactgctggcctcaagtgatccacctgcctcagcctcctaaagtgctgggattatagatgtgagccactgcgtctggcctcagggtgatttttaccttattctttttatactttgctccaaacattttgcaatggatatgcttttcttttctttttttgagacagagtctcactctgtcgccaggctggagtgcagtggcatgatcttggctcattgcaacctctgccccctgggttcaagcaatcctcctgcttcagcctcccaagtacctgggactacaggtgcacgccgccacacccggctaatttttggtatttttaatagagatggggtttcaccatgttggccaggatggtctcgatctcgtgatccgcccacctcagcctcccaaagtgttgcgattacaggcgtgagccaccgcgcccagcccaggcattgccgttctaaggaaaagatcataattaaaaatacaagatgtcagtgttggtttgaaggctacctagtgtggttcccctgaggcactctactccctaaggaatggccctgctgaccagaataacatgttgggaagaattttcttggtgctggtaagaatgttccaggcggcaagaggcagggcatcaaagggagcagctgggaggcccctgccctgtccaggcctgagggcaaggcctcatccatggacagatggagagtcggcctcttccccaggttctgctcttccccatcctggatctagtgctggggagaagactccagaagaccaggcagggccacatggtcaccccagggccctgtggctctgttggtctgtagcctaggttagggttaaggcaggcaggcttgagattaaaaaggtagaaggaaaatgcctagctagcaagctctctgcttttccggaacattctctagctctgttgaaaagtttgagacactctttttacccaaaggtgactgcagcaacctacatgttagcctcacctgaccctgcaccaagggagccaggctctgggcttccatttgcccttctggttgggttccaagccttctctgggcctcccttttttttttttttgagacagagtctcgttctgtcacccaggctggagtgcagtggcatgatctcggctcactgcaacctctgcctcctggattcaagcaattctgcctcagcctcttccccagtagctgggactacaggcacccaccaccacgcccagctaatttttgtatttctagtagagacaaggtttcactgtgttggccaagctggtctcaagctcctgacctcatggtccacctgcctcggcctcccaaagcgttgggattacaggcgtgagccaccgcgcctggcccctttctttctttctttctttgcgccggctgtgctggcatgccgggcaggaacacttccctccttccgcataagcagaacaaatatttgcattctcactgggrtagatatggccacggagatgcctttgctacagtgcagtaatggagcagcccaaatatgtgagcttgggaaccgaggcttgtcctttgaactgcaacctacctgggaggcaggtacccagagagtaagattgctcacctgggcgtgcctgggcacgtgtgagcacatcacatttcttttgtcttctgttggaagggatttcttttcttttctttttcttttttcttttttttttctttttgagacggagtctcactctgtcgcccagggtggagggcagtggcgatatcttgactcactgcaagctctgcctcccaagttcaagtgattctcctgtctcagcctcctgagtagctgggattacaggtgcccgccattatgcccagctaatttttgcatttttgtagagatggggtttcaccattttggccaggctggtctcgaactcctgacctcaggtgatccgcccaccttggcctcccaaagtgctgggattacaggcgtgagccacctcgcccggcctcatttcttttttttttttgagtcttgctctgtcgcccaggctggagtgcagtggcacaatcttggctcactgcaacctccaccacccgggttcaagcaattctcctgcctcagcctcccaagtagctgggattacaggtgcacgtcaccatgcctggctaatttttgcatttttttagcagggacggggtttcaccatgttcgccrggctggtcttgaactcctgatcttgtgatctgcccacctcggcctcccaaagtgctgggattacaggcgtgagccaccgtgcccagcctcttttttttaaaacgtagtcttgctctgttgcrcaggctggagtgcagtggcacgatctcggctcactgcaacccccgcctgggttcaagtgattctcctgcctcagcctcccgagtagctgggattacaggcatgttccaccatacctcgctaagtttttgtatttttggtagagacggggtctcactatgttccctaggctggtctggaactcctgacctcgtgatccgcccgcttcggcctcccaaagtgctgggatgacaggcgtgagccaccgcgcctggcctcactgtgactttttggtgtcctaatgggtatcaagtggtatctcattgtggctttgatttgaatttcactatgattaatgatgttgagcatctttccatatgcttattggccatttgtatatcttctttggagaaatgtctattcagatcctttgcccatttaaaaaattggttatttcaaaaaatagctgggcgtggtggcacatacctgcaatgggaggtgccgctcgggaggctgaggtgggagaatggcatgaacccaggagacagaggttggagtgggccgagatcgcaccactgcactccagcctgggagacagagcgagactccatctaaaaaaaaaaattggttatttatctttttattattgagatgtaggggttctttatatgttctattttttgttttttgaataactgttgggcactatgtttatatattctagatgcaagctcttgatctgtgatttgtaagaagtttctcccattctgtgcattcttttcactttcttgaactcctgccctcaagtaatcccgctgccccagccttccaaagtgctgggatgacaggcacgagccaccactcccagcctgttttcactttcttttttttttgagatggagtctcgcactcttgcccaggctagagtgcagtggatcaatgtcagctcactgcaacctccatctcccggttcaagggattctcctgtctcagcctcccgagtagctgggattacaggcgtccaccaccaygcccggctaattttttgtatttttagtagagatagggtttccccatgttggccaggctggtgttgaactgctgacctcgtgatctgcctgcctcggcctcccaaagtgcggggatgacaggtgtgagccaccgcgcccggctctcttttcactttcttgatgccatcctttgaagcacagaggttttaaattttgctgacatcccttactcatttttaaaagtgggcaaaacaggcagcagtgactgcagacaggtatgtcgccaagttcaaactccctccgctcagtaacagttaatttgcttgcaggcaggcaggtttgataaaacaaaaattatttaktttgggaggccaaggtgggagaagagcttgaggccaggagttcaagtctagcctgggcaatatagtgagaccccatctctacaaaaataattaaaggccgggcgtgatggctgatgcctgtaatcccagcactttgggaggccaagatagatggatcgcttgaggtcaggagttcaagaccagcctggcagcatggtgaaaccctatctctactaacaatacaaaaattagccgggcatggtggtgcacacctgtggtcccagccacacaggacgctgaggcaggagactcgcttgaacttgggaggtggaggttgcagagagccaagattgcatgtcagtgcattccagcctgggtgacagagcgataccctgcctccaaaaaaaaaaccactagctggggcatggtggcgtgggcctgttgtcccagtgacttgggagctggggggggaagatcacttgagccaagttggaggctgcagtgagctatgattgcattactgcactcccacctgggcaaccgaatgagaccctgtctctctctctctttttttttttttgacacagagtctcgctctgtcccccaggctggagtgcagtggcgcagtgtcggctcactgcaagctccgcctcccgggttcaagccattttcctgcctcagcctcccaagtagctgggattataggcgcctgcccccgcttccggctcctttttgtttttttcgtagagacagggtttcgccatgtttgccaggctgatctccgaattccctgacctcaggtgatctgccccccttgtctctctctcttttttttaactttaaaaagatacagaggcagggtttcgccatgttgtccaggctggtcttaaactctgaggtcaaaggcagcactctgggattgcaggcgtgagccactgcgtccagcagatcctgtctcttaaaacaagaaaaaaaggccgggtgcggtggctcacgcctgtaatcccagcactttgggaggccaaggcgggcggatcacgaagtcaggagatggagaccatcctggctaacgtggtgaaaccccgtctctactgaaaatacaaaaaaattagccgggtgtggtggcgggcgcctatagtcccagctacacgggaggctgaggcaggagaatggcgtgaacctgggaggcggagcttgcagtgagccgagatcgcgccactgcactccagcccggccgatagagcgagactccgtctcaaaaaaaaaaaaaagaaagaaagaaagaaaaagattcaagacaaatggggagtggtggggagggtggaggggacatagattaagtccccataagcagcctgaatttaatgaaataggttggcatggctatccagagggcagcccccaaggccagggacgctgggtgtggacaggaaaggtttgctacacacagtgtgatgtctcttgaggttagagaacctgtgcctctttgggaggatgtagtttgccctaggcctggatttcggtagaatgagcaagagttagccttgaagtcctgttcaggtgggccccctcttgccctgtacscagaatgagctgatgtgagatgccgagagtggcttcgttgggaagagagcccggaccttgcttcccgttggccttccaggatgctaactgctcgggccgaacatcctgtgggaagataatcccctgcttgtactgagaaattcagaagcaggaggccgggcgcggtggctcacgcctgtagtcccagcactttgggaggccgaggcgggcggatcacttgagatcagcctggccaacatggtgaaaccccgtctctactaaaaatacaaaaattagccaggcatggtggcgggcatctctaatctcgcgacttgggaggctgaggcaggagaatcacttgaaccagggaggcggaggttgcaacgagccgagctcacaccactgcgctccagcctggggaacaagagcaaaaccccatctcaaaacaaagaaaagaaattcagaagcaggaatcctgggccagcttcatcctcagaccgaagagaactgtagaattctgattgacatcttccaaaaacctaccctctccaaaccaaaagcagtttttgctgacatctggtctttctggaatgctgatatttttatttataaaatgatgctattatccccaaatagattcttatttttaacaggctttctccctttgagggctgcctgaggctcataactttgttctctggcatctcagtgttaccctgaaaagacaagaaggctcctgggctctgccaggagcagagagatagggagggttgccagccggaaagtcagacaactgcttgtattctgcattacctccctccttggccccatcagcctcagtccatgaaggagaaaccttcagtgagcggtcattgcccctgaactaatgccccygtgagtcacacaggaaggggcgcaggtgaagaaggggcctcatggggcctagttctctgtcccctcctcctccccttccctggtgcatcctccccactgaggtttctctgcttcttatctctcagctgcccaacatgttcggcgaccttcggtccacgtttattgccttgatgattgggtcctacgcctcctcggcagtcacctttccaggaatcaaggtgagcacgtgtattttgcactggtgtctgtgcagaggcctgctccaggctccttccaccctctctgaagagggaggcaattgtgggcacccggggtggcccctctccaccacccccacccgggcaggatgcacctgggcatcacaggggcgacaaatgaaaaccgcggggcctcaggggacgggaatcacgcatgtggctgcaggatctgccgcaggtgcctttgcatttcggggctggggcaggggaagggcggtgggtgagtctgtttccagttgtgagtcttgcccccgtctcctccgtcatcctggtctcccgctgctcccctgctccccaacccccagcctgctgttattgtaccgttactccccgccagccaaagcactgctcttggccaagtgtttcagctgtttccctcctaggcaggattttgagcctgtggaagtcacacagggtcaggacgaagcaaacacctcacagtccatcagcccaagttccccagaccctgtgggtctgccagggccccgtaggggcttctccyacctctgaccctcacactaagtaaaagcccctttcctcggtggtgtgtgtgggaatgctgttggcgaggagagggggwcacggtgtgggctggccacctgggcatcgaagtggtgggagctgggactctggggccagccatcctatggacttgcagagattctcatgcccctggactggggagcatcccgaaagwtcttcctcctcctttttttgggggggaacagggtcttgctctgtcgcccaggttggagtgcagcagcacgatctcggctcactgcaacctccacctcccaggttcaagtgattctcctgcctcagcctcccaaggagctaggattacaggtgcccgccaccatgcccggctaatttttgtatttttagtagagatggggtttcaccatgttggtcaggctggcctggaactcctgacctcatgatccgcccactttggcctcccaaagtgctgggattacaggcgtgagccaccatgcctggcttccttgagcatttctttggcctctgccatgtgagctctcagaggcactggggaagcatcagtggacggggctggccggttcccgccttcagggagctccgctaataccagacaagccgacggaccaggagcaccgtcccctctgctgggccgatcactatgagcctgcaagacgtgccgtggtcatggcggggcggtcaggaaggcctccgagtcggggggctaatcacacgccaggcccagatgaccagcagggcaggcacggtgggaggactggaaggcgggtgcctgatgccccaacgcccaggctggcagggctgtgcctctttgcgcggctcagcacagggacagcaggggtggccagacgcccctgcctgctgcggctctggcctccccgggctaactctgcccccyccccyccccaccccgtccccgcggtgcctgtcagctcatctatgatgctggtgtctccttcatcgtcgtcctcgtggtctgggccggctgctccgggctggttttcctcaactgcttctttaactggccccttgagcccttcccggggccggaggacatggactactcgtaagtagaggtgcccccgtcccgcctgcccccagcccccgccccccagccggggtcccgggcagcacccacagacactctcccggggccccagggtgaagatcaagttcagctggctgggctttgaccacaagatcacagggaagcagttctacaagcaggtgaccacggtgggccggcgcctgagtgtgggcagctccatgaggagtgccaaggagcaggtggcgctgcaggagggccacaagctgtgcctgtccaccgtcgacctggaggtgaagtgccagccggatgctgcaggtacccgcctgagaccgcagccgggcgacgggcagggagtgctctgtgggtatcggctcaccccattcccacctcacccmaaaaggggaggcggccccgcccgccctgttctgcagaggcgctcaggaaggcctgggggagggaaagggatttgcctgatttcacccaagaggtgaccccaccgcagcgccaaccccgttaccctcaccaggcccgtcccgagggccccctcctggcctccagcgtggagggatctgcgtgtcccccsggtggtggggacagtgtgccccggccctgagccccgcaccctctccctgcagtggccccctccttcatgcacagcgtgttcagccccatcctgctgctcagcctggtcaccatgtgcgtcacgcagctgcggctcatcttctacatgggggctatgaacaacatcctcaagttcctggtcagcggcgaccagaagacaggtaggtgccccgggcagcctcggtcgctgtcactccccggcctgagcccagcccactggccaccgsccrgaatgtgttaagctgagccgggccagcsgggccatggaaaggccgcatcccaggmgctgtctgcccgtcagagctattgcatcactgccagccccaactgtttcttcgtgtccccatcagggtttcctggtccaggagggagggaaggaccaaaatagcctcctgggtgtggggtgtggggtgtgtgttttccagtgcctgagggggaggkttgccgtgtgtgtctgtaaatgaaaacagaacagaacgctccacctgagcatggctgaaagacagcaggtcaagcccaaagtcctcccagaaagtggcacggtgggtgcgtggacaccctgggcatcgaggtcaggacggggctggagacgctggggcaactggcccacactgggatctgcatccctcaccgagaaacagggcagggcagagacttcctcggagcttgcgaacagttgaggcttgtcagctccaacaaacacagctgataacccacagtccacttttccaaacagggcaggtcttcagctgattagaggttttgattctacagagaaagtcaggacttccccggggcctgagctgagtcagccttagtcatccccaggcgggacaaacactccaaatcctttttattggcagcctccctggtgtgccactttttccgatggtttccttgtttttatcaaggtgaagataccctaggacttgtgaagaatcagttatcaggtttttaggggatgagaaatccagctttatcaaaaggaaaagatagcaaagggaaccagataacagccagttctactgtgaaaatggtagtctaggccaggcacggtggctcacgcctgtaatcctagcccttttggaggctgaggcaggtggatcatgaggtcaggagttcaagaccagcctggccaagattgtgaaacccccatctctactaaaaatacaaaaaattagccaggcgtggtggtgggcccctgtaatccctgctacttggaaggctgaagcagagaattgcttgaacccaggaggtggaggttgcagtgagccgagattgcgccactgcactccagcctgggcgacagagtgcgactccatctcaaaagaaaaaaaaatatctgtggaacacactttggggaaccctaatctatcatgtctctttctttcttgtttttttgaggcagggtctctttctgcgttgcttaggctggagtgcagtgatgtgaacgctgcagccttgacctcttagggctccccaggtgygcgccaccacacccagctaatttttaaattctttgcagagatagggtcttgctgtgttgcccaggttggtgtcgaactcctgggctcaagrgatcctcccctcttggcctcccaaagtgctgggattacaggcgtaaacctccacacccagcctgataaacattcagccctggagtggcggaaaccccaaagtgtgcagagagagctggtccctggccctcgaaaggctcatctccctgctgctgagtcagcgtctkttactcaagctgtctgagaaatcttttgctgcccaggaggaatgtttccaactgtttcgtatgttcaaaaagtcaatttcaagaagtagaggaagccaggccaggaaggttggtctgtggcagacgaggcactggttttccccctcctccttctgtgacccgttacacccaacacccatagccctagctccggccgagaggcagctgcagggtccgggtcactttcygcacactcgtgagctttgcggctccgcaggagggggtgtgccgtgctgctgaggaacggctcaaagcaccagagccatcgcctccgcgtacggccccgcgaccacccgcggcagaggctcccgggtgctggttccgaatggagactccaggccttgccgctgaccggtgactctgctgcctcccagcgtttgagacccgccrtcaaacaggagttgcggattcagggaaaccctaactagccagggtgctggcagctgggaaaaggccgccttttttttttttttttttttgagttggggtcttgctctgccacccaggctggagtgcagtggtgcaactgatagctcaccacggcctccgactcctgagctcaagggatcctcccacctcggcctcctaagtatctgggactacaggtgtgtgccaccatgcctggctaatttgttttttttttttttccataaagacaaggtcttgctatttttcccaggctggtctcaaactcctgggctcaagcagttctcccacctcagcctcccaaagtgctgagattataggcatgagccacaatgcccagccaaaaatacagtcttttttttttgacatggattttcgctcttgtcacccgggctggagcacagtggcatgagctcggctcactgcaacctccgcctctcgggttcaagcgattgttctgcctcagcctcccaagtagctggggttacaggcacctgccaccatgcccagctaatttttgtatttttagtagagacggagtttcaccatgtctccaactcctgacttcaagtgatccacgtgcctcagcctcccaaagtgctgagattacaggcgtgagccacgatgcccagccaaaaagccagtcttgagatggggaagacgtggcccatgctgtcctcagcagtgcccagtcccagccaaagtgggcactgctgcctcactctcccacccaccctcagggtgtggcacttactgggaagaagcaggcattgagaaacagaattgaggaggggaaacagtccagggccaacagtgcttggggattgaggcctgaaaatgggagcagggtacagaggctgtggctggccagatgggtcgggtgccccctgcacccccaccccctagtcaggggccacctgtcctaccctccctttgtaagagttgacaggtgacatgttttcctattgttgtccttgacttgataacaatctaggagttaaatagatactatcatctgtttacgtcatcatttatgatagatactatcatcatatacacctgaaaaacgaggcctggagykatggaggagcttgttcaaggtcagagccagcactcacatatgggtcttaagacactggagcagccaagggcctctagaccaggacattccactcggagcagcagctcaggggccaccaggcctctgtggcaggggggccatggcccaaggaaggggagcaggcccaggcatggtccccgttycttggagtggaagggagaccagctctggccatctggaggagacccatggtgtcagatgccttggctgggcgtcaggggcaggttctttgacctttccctctctctgagcacagcaggaggtagatgtgacagagccgcttcccgcaggcagtgtggtgacagggaccctgattgcaccaggtcttccgcatgcccgccacttccccatcacgctacccgccaacgtcacaggcctgattcaccagtccgcctgtgacccggcaccagcagacaggagaatgtcagcaggggcccgggctgggcattgtcccaagtccacttccagaggcctggctgcagctctgcctcccctgagcgccccgagtcacgcttggtgggaaatgcagtgcgggaaacgcagtgcgggaaacgcagtgtgggaaatgcagtgcgtgctgggcatggagtgagcctgcctcctctcccatctctctgtagcactgagatttctgccactaacctctcttctttctgctttttcacttttgctttcttgatgcagtgatggccacgggtaagcggggggtgggggggattgtcagggaatgctgtgatgtcccctcccagccagtctctgttcaacccagaagctcctcacctcaagctccagacatgcctcctggctagagccgtgggggtaaaactggggcaatcaacattcctcgtctgcttccctggaaaatccactgtcattttaagtctttgaatatggaagccctgacatcagagccccgtgagcggtgcctttctgggatatttcttttttttttgagatggagtcttgctctgttgcccagggtggagtgcagaggcatgatcttggctcactgcaaccttcacctcccgggttcaagtgattctccttgtagcctcctgagtagctggggttacaggtgcctgccaccacgcccagctagtttttgtatttttagtagagacggggtttcactgtgttggtcagtctggtctcgaactcctgacctcgtgatccgcccacctcgggctcccaaagtgctgggattacaggcatgagccaccgcgcccagccgttctgggctatttctagagrcagaaactaacggcccgtcrcttagcctccgtcacaggagttcccaagttatagcgacttcctggagctctgggaaggccattgtgacactctgggtttcattagctgtttcttagaaacaagcaggggatttggaaccgagaagaaggtgacctgccccgtgctccatcctcaacttcagagttaaggtctccgggctcctcgcaagacccatagtgacagggggttctggggcagaccccagaagagcctgtggggaccagccccttcccagctggtgcccagtccctgctccagggctgtctgccaggcgtccccatgacgcagcgccttcctccacagttggcctctacacctccatcttcggcgtgctccagctgctgtgcctgctgacggcccccgtcattggctacatcatggactggaggctgaaggagtgtgaagacgcctccgaggagcccgaggagaaagacgccaaccagtgcgtaggcagggccggtgccccggctcccagcccgcagcccctgcagaaagaccccagagctgcatgtcaggcacagggtgggtgggacagagggagagagcaatgcactccagctsctcccggagcccttagagagactcactcattcagctcagcatgcgtttcaactgctcccctctttatggaaattgtttggaatgcaatggaaatgctaaagtttgaggccaggtgcggtgactcatgcctgtaatcccagcactttgaaaggctggggtaggaagatcacttgaggccaggagttggagaccagcctgggaaacatggccagcccccactccccgtctctacaaaaaatttaaaaattggccagggagggtggttcatgcctataataccaacactttggaaggttgaggtgagtgaattgcttgagcccaggagttagtgaccagcctggccaatgtggtaaaacccggtctctactaaaaatacaaaaaattagccaggtgcggtggcggcgcgcgcctgtaatcccagctactcaggaggctgaggcgcgagaattgcttgaacccgggaggtggaggttgcagtgagccgagatcacgccattgcacttccagcctgggcaacagagcaagactgtctcaaaaagaaaaaacaataaagaagaagcattgagtaagaaggaagaaaaagagacacaggtgaaagtgtacagacaatggctagcagaccattttgctcctaagaccaccctccctccaccccttggcagtggctacaccatcttaaagcctcccaaagtactgggattaacaggtatgaggcaccgcgcccggctcagatggtgactttcattcattgcattcaatcatgcagcccaccaaccctttgttatctgcctgcaaggtttattccggtcagtttgagtagtaagttgctataaccatattatgtgttaatagagttgttcatgattgtgaagattaaacaaggtactggagtcctactttatgtaagggatgggctccaagatcagaggatgagttaaacgctgttttcttttttctttttctttttttttttttgagacggagtctcgctctgtcgcccaggctggagtgcagtggctctatctcggctcactgcaacctccgcctcccgggttcacaccattctcctgcctcaggctcccaagtagctgggactacaggcgcccgccaccacgcccggctaattttttttaatatatatttttagtagagacaggggtttcacagtgttagacaagatggtcttgatctcctgatcttgtgatccgcttgcctcggcctcccagagtgctgggattacaggcataagccaccacgcccagccaaacgctgttttccatggctccacaccttaatataataagctacggtttattgcctgaggccctccaccgaggactccatgcacagtatctcagtgaagactcccagcaccctggcgaagtggggaccagtgttatacccattttacagatgagggagctgaggctgggacttgcagtagtttgcctagggccgcacagttaggaagtggtgggcctgggactccctgcacatctgtgagcacctggggtccgttcttggatcatccagggtgtctgcgtgggtgtgagactgggatcggtaatcgttcattcacgagagataattgcagagggtgcytggccgggcgcggtggctcacacctgtaatcccagcactttgggaggccaaggcgggtggatcacaaggtcagaagatcgagaccatcctggcyaacayggtgaaaccctgtctctacaaaaacgcaaaaattagccgggtaaggtggcgcgtgcctgtagtcccagctactcgggaggctgaggcaggagaatcgcttgaacccaggaggcagaggtggcaatgagccgagatcacaccactgcactccagcccgggtgacagagcgagactccatctcaaaaaaaamcccaaagaacaaaaaaacaaaacaaaacaaaacaaaaaacagtgctgtgctatctaggtcaggtcctgcagccaagaggttatttgtgtccactccagttccatctgctgcctgctcatttcccctttaccctctcctgtccccacaaggggaaacccattcactcccctatttggcttgtatctggcttcttatcagcgtcctgcaagatttgggtgaacttgaagccagtggtgaagtgaggctttgccatgtgccagctcaggcacacgctgctacttctctccccgtcgtcttagctcagccttcacagagcactgcagcatatggatggccatcttcttgtacccgagaccccctccgagagtcacactcagcttgccactgagaagggccggggagtgtccgtagtgctggtccagccccgacacagtccctaaaacgtgcctgggtggcttctgagtcttgcgtcagtttacctgctgcgacgcttgaggcctgacttctcaggagcacccggcttcctccggggagccctcccacccctgcacgttctgtgtctccacagaggcgagaagaaaaagaagaagcgggaccggcagatccagaagatcactaatgccatgcgggccttcgccttcaccaacctgctgctsgtgggctttggggtgacctgcctcattcccaacctgcctctccaggtgggtgtggggagtgggaggggcaggtgggaggtggggcagtcagaaggaacatgtaaagactcaaaagtgtgtaatgtttcatggaagccatcaacaaagcggatgactttctttatttttttgagacagagtcaaactctgttgctcaggctggagtgcagtggtgtgatctcggctcactgcaacctcagcctcctgggttcaagcgattctcctgcctcagcctcccgagtagctgggattacaggtgcgcaccatcacgcccagctaatttttgtattttcagtagagatggggttttgccatgttggccaggctagtctcgaactcctgacctcaggsgatccacccgccttggcctcccaaagtgctgggattttacaggtgtgaggcaccgtgcccagctcagatgatgactttcattcattccactcaaccgagcagcccaccagccctttgttatttgcggagggcctgttccctgccaggctctgtgcttgctgctgcaggtgagctggacacctggattgtcttctgcaaagggactcctccccggaaggcatgtcttggttttgggggcgtcttgcataaccgtggataccaccatcatgccatttcccggaagtgtgtggggtcgctgtagagttccttgttttgtatcggctcaagcagctggaatctgacgtccaaagagatctggccaatctgtggtgttggtgggagcatctgctcccctgtcaccagagtctcacggggtttctacactgaacagagtggaggaagaccttgatggtggcttcatatctggattcaaaagcttcattccaggccggtggctcatgcctgtaatctcaacactttggtaggtggaggcaggtggattgcttgagctcaggagtttgagaccagcctgggcgacttggtgaaaccctgtctctacagaaaatataaaagttagctgggcatggtggcacactcctgtaatcccagctactcgggaggctgaggcaggagaatcatttgaacctgggaggcggaggttgcagtgaactgagatcgcgccactgcactccagcctggatgacagagtgagactctgtctcagaaaaaaaaaccaaaaaaaaccaaaacactttgggaggctgaggcaggtggatcacgaggtcaggagtttgagactagcctatccaaaatggtgaaaccccgtctctactaaaattacaaaaattagctgggcgtggtggcacatgcctgtaatcccagytactcaggagggctgaggcaggagaattgcttgaatccgggtggcagaggttgcagtgagccgagattgcgccactgcactccagcctgggcgacagagtgaggctgtgtctcaaaaaaaaaaaaaaaaactgaatttctttgccaaacttttgaggcttctggaacctgatttttgacagagattttgagtaaggtggcccttgtcacctgcctggctccacccactggtctgtgaaagtggtctagcagtaggttttggcccaatccctaaatttacaaatggtggagggacgcaagtgtggcttttccttccagagaggtgtagcctgagtccagatggcatcttgggtcaagtccaggagggaagtaagagtccctccctttttacaggaggccttgaggtacgttgaacacccaggtgtgccccaccgtgggaactgttgtgtgtacgtgccaacactgggcgtgcagagcgcagcgggccgtggaacatttgtgccggccccagggggtgctgcatccctccggccctccctggcctcctgggctgctttctctgcaagactggcagacctttgccctaaccgccttgtccagtcgaggggcagtgctcagtggggacagtcatctttttgttttatgtaggtctcactgaaagaaaagttgtaaaaaggcaacaaggcatttgaggtggggaggcctgcacagcktsygtgtgtgtgtgtgtgtgtgtgtgtgtgtgtgtgggcactgggcacagccctctttcaacactgccaagagcagcccctgcccccccaccacccacattcctgggaacaggtcctggctgctgagcgggatggcagggctgtgtacagaagacaaggcgaccacagggacctggtggccaagaggatggctcttaaaaagtgcctctcagagttggcggagtccgccagcagcagccttcctgggcagggggcctcccacagacagcgacagaactttactaggaccagcctgggcaatatggcgacaccctgtctctactaaaaataaaaattagccaggtgttgtggagtgcacctgtagtcccagctactcaggaggctgaggtgggagaatctcggctcactgcaccccgggaagttgaggctgcagtgaactgagattgcaccagtgcactccagccygggcaaccggagtgagaccttgtctcaaaaaaaaaaaaaaaaaattagccggcctggtggcacatgcctgtaatcccagctactcaggaggctgagggagaacaatcgcttgaacccaggagacagaggttgcagtgagccgagaccacaccactgcactccagcctggggtgtagagcgagaccgtcccaaaacaaaaccaaacaaaacagaacaaaccacaaaaagaaaacaaaacaaaaagcgaagaaacacttcacgagggaggtgagagggcagccacctgctgggagggccgggtgaccaggcttgggagaccctggagcacagtccgaggtgggcaaaggcagctcgaggccgtggtcagcaacctcttgctcagtgctgtgcccatacacgtctgtcagcagggccctggttctagtgtttgccgacttccacggtgcacrtgcactcaccgtggctgatttccagctgccyatgtgttgccactgactgtggaactggagagtcacagtgacacgtggtatttctacagtagatgtgaaaagcctggccgggcacggyggctcacgcctgtaatcccagcactttgggaggccaacgcgggtggatcacctgaggtcaggagttcgagaccagcctagtgaaaccccgtctctacaaaaaatacaaaaattagccgggcttggtggcatgcacctgtaatcccagctactagggaggctgaggcaggagaattgcttgaatccaggaggcggagcttgcagtgagccgtgccactgcattccagcctgggctacacagcaagactctgtctccaaaaaaaaaaaaaggaaagcctgatgcgtgcacaggctctagtgaaccaagtaaaataattaggaagggatgaggttttccatggttttgttcgttcattttgtttttttttgagacagggtctcactcccatcagccaggctcgagtgcagtggtgggatcttggctcactgcagccttgacttcccragctcaggtgatcctcccacctcagcctcctgagtagctgggactacgggcacgtaccaccaagcccagttaatttttatatttttttgcagagatggggtcttgacatgttgcccaggctggtctggaactcctgggctcaagygatcctcccaggcctcccagagtgtggggattacaggtgtgagccactgcaccaggccaggaagtgatgagttttcagagttttgagtattcattacctttaytttaatataatttatttatttagtcataaatttatgtaatttttttttttttgagacagagtctagctctgtcacccaggctggagtgcagtggtgctatctcggctcaccgcaacctccgcctccccggttcaagcgattctcctgcctcaccctcctgagtagctgggaatacaggcgcccgccaccacacccggctaatttttgtatttttagtaaagatggggtttcactgtgttggccaggctgatctcaaactcctgacctcatatgatccacccacctcagcctcccaaagtgctgggactacaggtgtgagccaccattctcggcttataatttaattattattattattwttwttttttttttgagacagagtctcactttgtcaccaggctggagtgcaatgccgtgatctcagctcactgcaacctccacctcttggttcaagcgattctcctgcctcaacttcccaagcagctgagattacaggtgcccaccaccacgcccagctaattttttgtatttttagtaaagacagggtttcgccatgttggccaggctggtttcgaactcctgacctcaggtgatccacctcctcggcctcccaaagcactgggattacgggcgtgagccaccttgcccagcctataatttaatttttaataatgactcggttaggctgggcgcagtggctcatgcctgtaatcccatcattttgggaggctgaggcgggtggatcacaacgtcatgagtttgagaccagccgggccaacatggtgaaaccccatctctgcttaaaaaatacaaaaattagccgggcatggtggcgtgggcctgtaatcctagctactccgaaggctgaggcaggagaattgcttgaatccaggaggcgaagcttgcagtgagccaagatcacgccactgcactccagcctgggcgacaaagcaagacttcttctcaaacaaaacaaaaaacraaacaaacaaacaaacaaaaaatgactgtgttaacgactggcttgcaaaatttctgaaaattcacaattggctccggaggatggggttgatccaactccaggctgacactgcccctggggtgagggcccccargaattggagggcgggggctgaggggacggtcccytaaggccttatgcccacagtcgccttttcctcccccagatcctctccttcatcctgcacacaatcgtgcgaggattcatccactccgctgtcgggggcctgtacgctgccgtgtaagtcctggaagccgcaggtggcctggtgggcgagggtgtgggaatggccggggggaggttgctggtgggactgagactctgaggcagggtcagcctgtcccagaagggctcatcttcctgcttcaggggacaggtaccagggtttctgctgggtgtttcagggaaaggccatacctcgtgggaagcaggtcagtgggcagacagttgggtgctcacaagccttggcattcaacacgaagtcagttcccccagccagggtcaggcacctgtgcagctcattatggcctcaggggccactacagccgagtcctggggctggccctggctgctcactgggaaggatgggtaggttctggctgcctgaagctaaatgcggaagttccagttgccctcatcacgggcagcaacatgggtgactgagtccagaatacaccagacgggcccatccagagcctcagtgcgcccagctctggccatagctttctccagccctggctaaaatgaaacctgtatctttttccaagaagccccagaaacataaaaggaaccacagtggttccttcttctctggctcaggccttgacccaaaaactgaaactcaaacatcatcatccacagtctctgatgtgggaccagctcatgtgttgctgggattcctttcccacctctgggccagcagagcctgacatgtgctaagatttagcccggaactctctcccaattcccgcaacagcccctggggtaatcccagctccgcttgccctccgcctgcccctccccaggcctggaggaagctgtggctgtcctggcagggtctgagggaggggggcgggatctgtggtgctgagtttccgcgattactcaatgcttctctggacgagggcactgcagagccaagcccagcctccacactcctctctgggcctgtttcccaaaccgcaggtccccgctggcaccacgctttccactcggctcagccagacacccacaggccctgggcacagctgagtggggtgggccctccccagagtctggggcctggagctggtccaaagagaaacactttgcagaaccacccagcagggccgggcgcggtggctcacgcctgtaatcccagaactttgggaggccgaggcaggcagatcacraggtcaggagtttgagaccagcctggccaacgtagtgaaaccccgtctctactaaaaatacaaaaaattagccagatgtggtggcgggcgcctgtaatcccagctactagggaggctgaggcaggagaattgtttggacyggggaggcggaggttgcagtgagccgagatcgtgtcattgcactccagcccaggcgacagtgcaagactccatcttaaaaaaaaaaaaaaaaaaacagaactgcccagcaggaaggaatccgagggctggcaccccacccttctctggcaccaacggtgcagccyggggtcaccagacacctggggccaagcaaagcccaggaggcaggatggctgtgagctgtcgcttgccctgcaggtacccctccacccagttcggcagcctcacgggactgcagtctctgatcagcgcgctcttcgcccttctgcagcagccgctgtttctggccatgatgggtcctctccagggagaccctctgtgggtaagaggggtcgggggatggtgggtcatgggcgcctgcccccttctgctaactgcgagctgcaaggtccccctcgggggcttcagggccccgaggacatgtgggagcgttggttaggattggttaagagtccctttgtgaatggtggcyaggcaggaaaaggaacatgtcctctctggacctgatttggggagaaatagaacagagttcctgggccgggcgcggtggctcacacctgtaatcccagcactttgagaggccgaggcgggagcatcacttgaggtcaggagttcaagaccagcctggccaacatggtgaaaccaggtctctactaaaaatacaaaaattagccaggtgtggtggcaggtgcctgtaatcccagatactcgggaggctgagacaggagaatcacttgaacccgggaggcggagattgcagtgagctgagattgcgccactgcactccagcctgaatgacgacagcgcgagacttcgtctcaaaaaaaaaaaaaaaaaaaaaagaacacagttcctgtccccgccccacctccgagggccagatttcctcaccaggtaccaggaacttgttccaagcccagaggttcagatcagcccgtgtttcctgggggcccaggccctgagggtggccacatggcctgtgaagagttgggaaccgggacgctggcatatgggacctcgtgggccttcctgtttcgttcccccytccaccccgtgaccttctcccctttcccaaacccgagtggagggcgggtctgcagcctcggcgcaccaccacgccctgtgatgcgcggcctccctgcctccccaggtgaacgtggggctgctccttctcagcctgctgggcttctgcctcccgctctacctgatctgctaccggcgccagctggagyggcagctgcagcagaggcaggaggatgacaaactcttcctcaaaatcaacggctcgtccaaccaggaggccttcgtgtagtggctgccgcctcggaactgcggtctcctgcctgtgcttcagtgactgacccctgtcctgcccctccagagtaccccacgcacccccaggaccttcgccgtctccgtgccagcgttcacgctccctcccggggccctgcctcggagctctgtggtggaaggacgggagagggccccggacacgcgmgttttctcctgccgaacgcaggggctgccctgactttgctctgccgccccccggggacccggggcctggggtctctgtggtgcctgcagcaggagccaggaacgcccggcaggcaggcgctctcccgccagtgtctggattctgcctcttgccaaagcagagggggctgccatcccctgcctgccacctgcccctcggctgcatgcccacagccrtacctgcctgaggacaaaggcttgcactgtctcgccygcgcctggcccccaccccctccccggccagcctgaggctgcctgaggaaggaaggacccgcttcctgttgtcggtgctaattcctttgtaattccagccccctgtcgcctgtccagggcctgcccacccgttggaggccggtggagaagccccacctggcttatgccctggagagggtttagcgggctgggtggacccctcgcctcctccccgagggccaatgccgcggacacgttttcactgtcaccctcgttctgtctgccacctgaagggaatttgaggaccgccgccagggcaccccgtacatacacacagctgcttttgtggaggtggacgaaaggctgtggccggcagacgtggaggtccaggccggggtggggacgtgggtgggtccgaggkgtgtgtggggtcggggtgggctctaggagttagcccttatccccactgaccaggcgggagccgccaggcctgcagctgggccagtgcccaggagccatcctggcgtggggccaggagcttgtccaaggccacaggcccacagcaccccctgccggcgggctccgtggggccctggagctgatgacgggggaggcccgtccgcctggcccaccaacccgcccaccttgactgcccccagaagtgtgtcttgagacctcctgggcgtgcttaraggggtgagttgtgtttggatttttagttattttctcttcagttttattagacttcttttttataaagcaataaatccattttcctccgggtaagggatgccccttctggcatatcagttaatagctgcatgtgcctattttgagcttgagaagaaaaggcaggacaagaytctctgccaccgaccagctccagccgtgcccagctgctcttcgtctctctgggggactgctgactcgggagggacagtgggccaggaaaagaccttcctccccaacccccaaacaaactgggcttgtgcagacatcttagaagtgtgagccaccctcctctaccgattttcccagccaaacaggcgaatcctggtccctttccatccctacacccttccacaaccctgaagattcccgctgggttcttctgcaggctcagagcagttcaggatgtgggcggcagggagggggatgaaaggagaagaggaaagggcaggtccaggccacattcaagctccacattaacagcttgggcgcctggaacacatatctcctaggctttatttcactcaaatatttaaaaaaagactgggcgtggtggctcacgcctataatcccagcactttgggaggccaaggcaggaggctcacctgaggtcaggagttcgagaccatcctgaccaacatggagaaaccccgtctgtactaaaaataaacattaatcgggcgtggtggcgtgcgcctgtaatcccagctactcgggagcctgaggcaggagaatcgcttgaaccggggagacggagattgccgtgagtcgagatcgcaccattgcactccagcctgggcaacagagcgaggctccgtctcaaaaagaaaaaaaaaaagagaacgagataaacatgcccactcctgagaacactcgttttgtgatgttagtggttattctgattttcaagaaagtattatagtcaagtttgggaaaggctgagttaaaagtcaagcctgtttccttacagccagcactgacagcactttgccaacgctcatgagctccgtggctcctcaggagcgggtgtgctgtgctgccgaggaacggctcgaaccatcagagccaccagcctccacgtgcggctccatgatcacccccagcagaggctcccgggtgctggttccaaatggagactccaggtcttgccgctgaccggtgactctgctgccagcatttgagacccgccatcacacaggagttgcagattcggagaaaccctaactagccagggtgctgccagctgggaaaaggccgcctttttttttttttttttttttttgagttggggtcttgctctgccatccaggctggagtgcagtggtgcaactgatagctcaccacggcctccaactcatgggctcaagggatcctcccacctcggcctcctaagtatctgggactataagtgtgtgccaccatgcctggctaattttttttttctttttcataaagatgaattcttgctattttgcccaggctggtctggaactcctgggctgaagcaattctcccacctcagcctcccaaagtgctgagattacaggcgtgagtcacaatgcctagccaaaaagccagtcttgagatggggaagacgtggcccgtgctgtccccagcagtgcccagtcccagccaaagtgggcagtgctgcctcactctcccacccaccctcagggtgtggcacttactgggaagaagcaggcattgagaaacagaattgagggggggaaacagtccagggccaacagtgcttggggattgaggcctgaaaatgcgagcagggtacagaggctgtggctggccagatgggtcgggtgccccctgcactcccaccccctagtcaggggtcacccatcctactttgccttgtgtggagctgacaggtgacatgttttcctattgttgtccttgacttgataacaatctgggagttaaacacatatgatcatccctgctttacaactgaaaaacgaggcctagagatactatcatcatatacacctgaaaaacgaggcctggagcgatggaggagcttgttcaaggtcagagccagcactcatatatgggtcttaagacactggagcagccaagggcctctagaccaggacattccactcggagcagcagctcaggggccaccaggcctctgtggcagggggacctctgtggcaggggggacctctgtggcgggggggggcctctgtggcaggggggtcacagcccaaggaaggggagcaggcccaggcatggtttccgtttctgggagccaagagccttctcagaagagggggagagagctactgcatggaatcatttgggccctggaggctgatgggtacttgggggagcaatccctggtgaccccaaccagcaagacaagtgccctgtgaaggggaagggactacagctgatcaaaggagcaggcaccagtggccgggcctcccgtctgcccctcatcctccaggctctggcgggaaggagcaggaagggctccctgcccttggggttttgatcagtgaggaggggggcttgggtctgagtctgggtctgggtctgctgccgaaacactgcccccagtccctctcctcactagactctggggtctaggcgtgtctttgtggtcggccttctccaaaccctctaggcctctgtctgcagctgctgctgcctggacctatacacaaggtcccacccctcaccggggccaaagacgtggtttcaggccctggtggatcctttctgttttgctccatccccgtcccctcttgcacccagcatcgtcctggtcagaacttccgtttaaaccttccttgcctgccgtgcactccgaggggggcgtcactttgccataggccccagggctgaaaatggcgggacatccagtattgggctcacgtgcataagactgtcccagacagcagcacaatcacgttcagccaagtggagtttccgacgcacttgtgtggcagccgcgtgaatgtgagccgatatgcagctgggaggggttgtgggcctcctgcggtgaggggctcctgccaggagctctgagaagcctccacagaatcagccgtcgggctccttcagcagcagctccccttatctgtgccaacgactgggggcctaactcaagggtgccagcccgtcttccgccaatacagactgtgggattctgagagttaggagcctggggtcccctggggtggggtggtcagggtgagcaggtgggctctgtgagcctgtttccccatgccctgactcaccccaatccctgggtgaggacagagctcctgaaggccactgaaggaggtgcagcacactccacctgggtggccttccgcagctcagccctcttcctgccagcaggaagcctctgcctgtgctccttaagttagccatcctcaccccctccgggcagctctgagactgagccagggccactagcagcacccagacctcgacccttctcagaccgaggcgccaccaccccaggccgaggaggcaaggagggaagaccaaagtctagaggactgtcttggtggccctgggcgagtcttgaactttggtgccatcatctgcaaaagggaggaaagaatgcctgcgtggtgcagctacgtggatacgcagtgaagacccgcatggtgggacgcctggcacttaacaatggtagcatttggccgggcgcggtggctcacgcctgtaatcccagcactttgggaggccgaggcgggcggatcacgaggtcaggagatcaagaccatcccggctaaaacggtgaaaccccgtctctactaaaaatacaaaaaattagccgggcgtagtggcgggcgcctgtagtcccagctacttgggaggctgaggcaggagaatggtgtgaacccgggaggcggagcttgcagtgagccgagatcccgccactgcactccagcctgggcgacagagcgagactccgtctcaaaaaaaaaaaaaaaaacaatggtagcatcgttttcagtgcccaggaagaaggcagctgggacagggaaagggccaccacaccacacccaagcccatacaacaggagagccactttcagcagctctgagcaggacagacttgtggccaagtcaagaaagtaaggtctggtcccagcgaggtggctcatccctgtaatcccagtgctttgggaggccgaagcgggggcggggtggatcacttgaggtcaggggtttgagaccagcctgaccaacatggtgaaacctcaactctactaaaaatacaaaaattagggccgggcgcagtggctcacgcctgtaatcccagcactttgggaggctgaggcgggcggatcacaaggtcaggagatcgagaccaacgtggctaacacagtgaaaccccatctctactaaaaatacgaaaaaaaaaaattagctgggcgtggtggtgggtacctgtagtcccagctacttgggaggctgaggcaggagaatggcatgaacccgggaggtgaagcttgcagtgagccgagattgtgccactgcactccagcctgggcgacagagcaagactccgtctcaaaaaaaaaaaaaaaaaaaaaaaaagtaaggtctgtatctgctgaccccacccttctccgaagccctctccgagcaaagccttaagaaactcttctctcgttcacttttcttttgtggctttcacgttttggtaagacttggccaaatagctgctcgagataatcaatcactggtggacaagtttctgctgagtgaggtttctgctgagtggggcgactcaaggcacggtcacgtaggcagcacctgtacaccgcatcctcatacagctgcgggaccgtgcctctgactgtgtgcgtgtgtgtttatctaagtgtgagatgcatccgggcatgtcagggtgtgtacatgttgggaagactgtgtagatttcttgtgtgccgctctctgaatggaggagaggggaagcgtcttacctcgctgaatccctttccattgctggaaagaacacctgggcaggagcggccccaagaccccgcccaggccctcggaagggagcctgaagggttaatccgtaccctgtattaaccagggtcaacccagcggctgacccgcctcttccctgctcctttgccgtttctagcacctggcttacttcctggcacacagtgagcactcaataaatgtatgctgagaatgactgcgagcggcttcctccttggctcctgtgtctctttctccctagatcacacatttctcgcctcttgtctggtgcccaggttccctgtcccttgactgggatgcgttcctgacccccacccctgccaggctgcatttgctggttgatctgcattgccatttgaaggagtgtgggagggcagagcaacaggccttttgggtgggaagaccaaggctgctggtgaattctgcttataaaggaagccccctcggatcacctgaagtcaggagttcgagactagcctgaccaacatggtgaaaccctgtctcttctaaaaatacaaaaagtagccaggcgtggtggcgagcatttccagcactttgggaggccgaggcgggcagatcacgaggtcaggagatcgagaccatcctggctaacatggtgaaaccctgtctctactaaaactacaaaaaatgtccaggtgcggtggctcacgcctgtaatcccagcactttggaaggccgaggcgggcagatcacgagctcaggagatcaagacaatcctggctaacacggtgaaaccccgtctctactaaaaatacaaaaaagtagccgggcgtggtgacgggtgcctgtactcccagctactcgggaggctgaggcaggagaatggcgtgaacccgggaggcggagcttgcagtgagcggagattataccactgcgctccagcctgggcaacagagcgagactccgtctcaaaaaaaaaaaaagaaaagaaagaaaaaaacattctttgaaggctggcgcatgctctgccttggtccccactctacccccagtgcctagaatcgtgcctggcatggaatagctgctcaataaatatttgggggacgaagtttaaaaagagagagagacagaaataccacagaaaagaagctaaaatagactaagaggctgggagaagagcagagcggaagatggaaacagtgaaatacagtctccccaggacacccagagatgggttacagggctggctataaccgacgcagtaccaagggtcaaccacccaggggaaaccatgctgagaactggaaccgtgagatccacagacacaatgatgaaagagtggccgggtgccgtggctcatgcctgtaatcctggcactttgggaggc

SEQ ID NO: 17975 - DNA, 16082 bp, Homo sapiens
tcttggggccgggcgtggtggctcacgcccgtaatcccagcactttgggaggctgagttgggtgaatcacctgaggtcaggagtttgagatcaggctggccaacatgacgagaccccatctctactaaaaatacaacaaaattagccgagtgtgctgggatgcacctgtagtcccagctactcgggaggctgaggcaccagaatcactggaacccaggaggcagaggttgcagtgagccgagatggcaccattgcactccagcctgggcgacagagtaagactgtctaaaaaaaaaaaaaaaaaggccgggcgcagtggctcacgcctgtaatcccagcactttgggaggccgaggcggcggatcacgaggtcaggagattgagaccatcctggctaacacagtgaaaccccatctctactaaaaatacaaaaaattagccgggcgtggtggcaggtgcctgtcatcccagctattcgggaggctgaggcaggagaatggtatgaacctgggaggcggagcttgcagtgagccgagatcatgccactgcactccagcctgggcgacagagcaagactctgtctcaaaagaaaaaaaaaaaattcttgggtttcatgaaaggttaggattaaagtgggagagcctcaagcagctgacctaccccactcttccaaatcttttcccaggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaagtgagcagtgctggtggggacacagacaggaggtctatatacggttttctggggttttttggaagcacttaggcttagaagtttctcaagaaggccaggcgcggtggctcatgcctgtaatcccagcactttgggaggccaaggtgggtagatcatttgaggtcaggagtttgaaaccatcctggccaacgtggtgaaactccgtctctactaaaaatacaaaagttagccgggtgcgatggcgcctacctgtaatcccagctactcgggaggctgaggcaggagaattgcttgaacctgggggcagaggttgcagtgagccgagatcatgccactgcactccagcctgggcgacaagagtgagactgtctccaaaaaaaaaaaaaaaaaagacgtttctcaagaaattatcttgtcttagccaggcttgagtgctcatgctagtaataccagcactttgggaggccaaggtgggaggattgcatgagccaggagttgaaaccagcctgatcaacaagagactgacgccatctctaccaaaaaaaaaaaatttaaaacaggtgtggtggtacacgcttgtagtcccagcttcttggaggctgaggcaggaggcttgcttgagcccgggggtttgaggctgcagtgagccatgatgatgccactgtactccagcctgggtaacagagcgagactcttgtcttgaaaacaaggaaagaaattatcttacagagtctcgaggaagagagatacagcagtgtcttcgaatagtatgggaagcatccctgttttagggcttcagtctgactcttggccattgtttctcactgttgccatttcaaacagggcatttctttactgtccatacatgggaagaattttgaacatccgagaccctaagtatccgagactgctgccaacacacacacacaccttcctcccctcgtctccctccctgtcatcgtggcaaccaaaattatccatagggtgacggacaataccacctctgattaagaaccagtattctagggtttctggggtttccatttctgagaacagttccatgccagagcattgttttggtcaaggaagcgtagggtttatggatgctaaacagtgggaaggtgcacacgcagtgtgctgtcccgcttggatctgacgaatcttggaagtgttagtgcacctccgtttcacacttcctgtagaagcagctcttgtggattgtctggggcgtgagtataggctgtcctgtcctaccaagttacaccctttccattgaggcagaagtgaccaaggggaagggatccttgtaatataacccacaccatccccacagtgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcaggtactgtcgggcaagagggtggggatggaaaggccggctgcactacctaaggtgctgggctgagcgatgctgacactccctgcctgtttttagggccatctctgctgccaacctgcacctaaggaccaatcacatctatgtttcatctgacgacatcaaggagactggctacacctacatccttcccaagaatgtgcttaagaagttcatctgcatatctgaccttcgggcccaagtgagtaagtggactcagctaggccacagtgtgtgcccaactcattttgtgcctaaaactcagacctgagattgtctggaacttgagatgctggtttcaagattcatggatgagtaattatacaaggatagccaaaacaacgaggtgggttttggccccatgagatagcaaaagctgtggcagctgagagaaggtagtaattgtagtattggcctgatagtatttggaagagaacagatatggtcagaaacaaattcctgaccaggtgtgcgtgctggctcatgcctgtaatcccaacactcggctgggcacagtggctaatgcctataatcccagcactttgggaggcctaggtgggtggatcacctgaggtcaggggtttgagaccagcctgaccaatatggtgaaaccctgtctctactaaaaatacaaaaaattagccaggcatggtggcatgcgcccgtagttgcagctactagggaggttgagacaggagaattgcttgaacccgggaggtgaggtggagcttgcagtgagccaagattgcatcactgcactccagcctgggcaacagagcaagaccccgtctaaaaaaacaaaaccaaaaaaaacgtggctgtagtcccagctactcaggaggatgaggttgcttgaacgcaagcagtgagctttgatgaccccactgcactccaggctgggcacagtggctcatgactgtaatcccagcactgtgggaggccgaggtgggcagatcttttgagcccaggagttcgagaccagcctgggcaacatgacgaaatggagtctctacaaaaaaaaaaaaaaaaaactagccaggcatggtggcatacacctgtaatctcagctactcaggaggctgaggtgggaggatcacctgatcctggagggtggtgagtgtagtgagctgagatcatgtcactgcctgctagcctgggtgacagagtgataccctgcttcaaaaaagagaaaagatgcataactttactagtgtatcagggatattatagtttataaaacatcattttgggccaaggtgggtgaatcacttgaggtcaggagttcaagaccagcttggccaacgtggcgaaaccccgtctctcttaaatatatgaaaattagcggggcatggtggcatgtgcctgtagtcccagctactcaggaagctgaggcaggagaattgcttgaacccaggaggcggaggtcgcagtgagctgagatcacaccactgcactccagccttgctgacagagtgagactccatctcaaacccactatttagtggctgtcaggttggcaaatttgaaaagattgttaatatcctgtgtgggtgagtttatagtaaacagatcctctttctttcttggtgataatgtaaaacttaaaatagcaccaagtgctggttttccagatgttttcagcttgtgaaaatacactgagctgcatgtgtgctcatttgcttgtgaatactatgcttaataatcagctggggagcttgtgagcagtgcagattcctggaccccactcaggagattctgatgtggtaagtccgcgatgaggtccatgtctaacattttgaacaagcaccccagctgattctgatacagggggttctgatcacgttttaagaaactctgtcctcgttcttgggggaaggaaggaaacagagggctggcagctccaactctgacctggtactaagaagagttttggttcctgacccctttgtctccagattgcaggatacctatatggggtgagcccaccagataacccccaggtgaaggagatccgctgcattgtgatggtgccgcagtggggcactcaccagaccgtgcacctgcctggccagctgccccagcatgagtacctcaaggtaatggggagtgatggagcctgggagtgtggaaaagctggtgcgattcctgtctgtggatgggattcagctctgtactcctctttacctataggagatggaacccttaggttggatccacactcagcccaatgagtccccgcagttatcaccccaggatgtcaccacccatgccaagatcatggctgacaacccatcttgggatggcgagaagaccattatcatcacatgcaggtgggcctgggctccttgggaggaagtatggtggggcagggattgcaggccagggcccagaacagtggcctgagctgttactctgtcctcgttcctcccccagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtaagtgggaggagcctggggatgtggggatagcagtagggataaggtgaggccatcgccctttgcacttggggcctggctggcttggaggtggcgcaggctgcatgaggcaggagccctgttaacattggctgtttccttctccccgaaggtgttcggcatgaccccaacatgaaatatgagctacagctggcgaaccccaaagagttctaccacgaggtgcacaggccctctcacttcctcaactttgctctcctgcaggagggggaggtttactctgcggatcgggaggacctgtatgcctgaccgtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaataggagttcaggggctggtttgttttttttttcccccccaaactcaaattctggatttaggtctaacaggaggctggactggagcggttcacagcaagatgctgggctcggctgtgaaggggggagtatgaggcccccttcctattcagggctttggggtagatagcccctggactcagtggagacctgaggcagggctgggctttcacactccgctgccttgaccacatttgctgctttttccacaaaactacttggaagctctcgcctcctttccacagttttgggagcagttgccctttcccgggtctaggaactctgtggcttgtgctgagcggctgcggtgtccagcccagccctttaagctttctgtgtcagtcctggtcaggaaaacaagcacacaggcaggcagtttgtgtacagccgggcggaggccagagaccggctgcctacctgtcacctctcgcctggagcgggccactgccaagttggccccatgactccaaacgggcggagcctggattgggcctgtggggagggctccactcaagtgaccacttgcagccctgaacctcagctcttggacgcctggctggaagttggctgtcttgtttcctgtgaccttgggggtggaaaggacagagcccaggcgacctagggcactatctccctaccccacgccttctcccttcctcgttcctccctacccttatcgcttctaccccgcccacaccgccctaaacggcttcctggggcggaactgtttcgcttttccccgtcccagtggagggtggggtgggggggtcgcagccctaagcctctgggagacatggagcccaggagggcggcgcccggggtgcctggctgggggtctcgggaggccgcggggtcggcatcggccgcggagcttgtgtaccatctagccggggccctgggcactgagctgcaggatctggcgcgccgtttcgggccggaggcggcggccgggctggtgccgctagtggtgcgggcgctggagctcttggaacaggctgccgtggggcccgccccggactcggtgagtcatggccctcccttcgccacccacggggycggcagggccgaagcctgagacccgggtctccccagctgcaggtgtcgrcgcagccggcggagcaggagctgcggcggctgcgggaggagaacgagcgcctccgcagggagctgcgcgcggggccacagggtaagcgcagccccggccagggcagggcgggtgacgacctgctcgggtcctcccctccctcccgcgggccgcgcgccgccgccgctaagaacgccccttcctcagaggagcgcgcgctgctgcggcagctcaaggaggtcacggaccgacagcgggacgaactccgggcgcacaaccgcgacctgcggcagcgcggccaggagaccgaggcggtgagggcggggcggggctctggggcggggcgggggcggagcgtggcaggcgctgggcggggctccgggggcgggggcggagcgaggcaggcgctgggcggggctccggggggccctcggtgccccgcccaccccaccctttgctccgctcccagttgcaggagcagctgcagcgcctcctgctggtgaacgctgagctgcggcacaagctggcggccatgcagacccagctgcgcgccgcgcaggaccgcgagagggagcgccagcagcctggcgaagccgcgactccgcaggctaaagagcgagcgcgggggcaggccgggcggcccgggcaccagcacggacaggagcccgaatgggcgaccgccggcgcaggcgccccagggaaccctgaggacccggtgagtgccgtatgagggcaaggacccagcccaggackcagcgtccagccctcggtgggcactcaagcaaggtttgcatgctgcacagcaggtcggccaggaagcggggaggtggcagacagatctgcgcccccggccggcctcggcccccgctctcagctggagcactgctctgttatctgttagggcacccttgtcccccaagtctcccggcccgtcacttcctctagcattcccatgatggccctggggcgggggaacgccagccgaggcgaccctctgactgtgcctgtccttccaaaggcggaggccgcgcagcagctcgggcgcccctcggaggcagggcagtgccgcttcagtcgggaggagtttgagcagatccttcaggagcggaatgaactcaaagccaaagtgttcctgctcaaggaggaactggcctacttccagcggtgaggacgctgggaagccggggggcctccgatcaccccacctcattctccagtcattgacatgtccacagtgacatgtgccaggcctgcgctgggaactgggaggacatgaattgtacagcccttgccctcctgcaatgtcatccagacaggggagagggacagtacaaagggttgcagctgcagcagccagggaatctctcctaggagggggccacggggccacctaatttaaggtctgagggtgtcagcaaggcagagcgcttcccgtgttcagggaagagctgcgtgcacaggtaccaggagtgaggactgcggctggcatctccactgctggcatccccatggctggcatcaccagggctttctccctccctgccccttttctttagggagctgctcacagaccaccrggtcccyrgccttctgctcgaggccatgaaggtggctgtccggaagcagcggaagaagatcaaggccaagatgttagggacaccagaggaagcagagagcaggtaggtccctgcctgcattcccacggagccaggmctccctccctcattctgctgagcctgatgacccagcctggtcaccctctgagcccattgtctcagactgaggctgtcaccccaacccggtcaccccttgagcctccctagcctggccgcttctagggcctgctgacctgctctggctgtgtcccatggccgctgtccagcctgcgcccttctccctggatctcaccactccccttgccttgcctgccatccattctgcctgacaacactgcctctccacattcattcttcaagttcctgtcttggctgggtctgtttattcttacgggggtgaaactgtagccgcggctgtgtcagggcctgctgtgtgtcaagctataaaataaacccttggcagggcgcggtggctcacgcctgtaatcccagcactttgagaggctaaggtgggtagatcacctgaggtcaggagttcgagaccagcgtggccaacatggtgaaactccgtctctactaaaaatacaaaaattagccgggcatggtggcatgtgcctataatcccagctactcaggaggctgcggcaggagaatcgcttgaacttgggaggcggaggttgcagtgagctgagatcgcaccactgcactccagcctgggcgacagagtgagaccctgtctcaaaaaaaaaaaaattaaaaattaaaggctcgacatcctgcatctccccagggttgccttctctccagccccgggggccctgcagtccctccatcccccctgctggattcctgttgtccctcagggccttgatcaatggccctcacttctcctctctcctctgtctcagtgaggatgaggctggcccatggatcctgctctccgatgacaagggagaccatcccccayccccggagtccaaaatacagagtttgtatgttggggaaaggggaaaggcaagagtgtggggagggaggaagggccctggctggtccttctcaggatcccctttcccgcttctctgcccrtcaccctgctgtgcttggctctaagcacaccgtcccctcctgcttctctggccctggcccccatcaccttcacactccctcaggctgccctttcttccccctctccccttttctcaccatcccctgccctcacccatatccttgacctctctggcttcctggctcaaagtgcctctggctgtctctctccagctttggcctatggtatcggggtaaagctgaatcctctgaggatgagaccagcagccctgcacccagcaagctagggggagaagaggaggcccaaccacagtctccagctcctgatccgccctgttctgccctccacgaacacctttgtctgggggcctcagccgccccagaggcctgacttaggggtctggctgtggaaggatgtgtggcctcaaatgaggacagggctcccgccttcacagccctcgccaggggtctgccccaatcctggcctgcatcagggcaggacggggtctcagcccgcctccctctctacgtctctgtacygagcctctggggccagatataagagtgcctctctgagtctcagtttccccatccatgaaatgagagctgactgcctagctcccagggctttgtgmagacggcctgagctcatgtaataaagaactgcccgtaatacacagaaactgttcctcgcctgtctgtccatgtctgtgccacctcccaaccctgccaggagcagaggcaggctgaggggtcctcgctggtctccttgctcagtcactgggtggggtggcttcttgcagctcaggccttgctttgggagtgtggcctgatggaaagccgtggctcccagcctcagtccacccccttccctggccccggcacccagggacctgcaacttcattcttctggcccttccaggcccaggccagtcagccctgccattgcctttctttccctttctttttttgagtgtcagtctttccagccaccccctccctctcagggaggtgcctcgtggcagcccgcccctccggcctggtttcctcaggaaaagccctgagaggaagcagggagggggttgggagctgtgggggccagacgaacccgagcgctcccaccgagctgcctgccatggggctggggctgctgctcccgctgctgctgctctggactcgggggactcaggggtccgagctggaccccaaagggcagcacgtctgtgtggccagcaggtgggtctcgtgggagtctgatgcgtgtggccagcaggtgggtctcgtgggagtctgatgcgggtggctgaaccggtgttgaggccgttaggggaaggaggagactaggaagggggcttaggctgaaaggaagggactgctgatggcggtctggcaggtagtggccagccagggcagatggtggaagggtcagggaaggagaggggaggggctggggaccctagctgtaaagatccattaggcctccccagggggctaaggcagcctcccccactgcagccagagacagtgatccaccttcctcagggccaggctgcaccccccaccatgtccggctgacccctttttgccccacagcccctctgctgagctgcagtgctgcgcaggctggaggcagaaggatcaagaatgcaccatccgtgagtagccaggacagaccctcagccaaggagaagggaggccgtagcccagtgacaacccttccttcctaccccatggggcctgcccctcctgataccaggagtcagggtttctcctgtgacgcacccccaggcctgaaggggcacctcttgaggaggcatggcccctggagccagtgagagggcaggggtgtcccctggtcctgctcccgtctttccaacctgggtggggtgtctttcagccatctgtgaggggccggacgcctgccagaaagacgaggtgtgtgtgaagccgggcctctgtcgatgcaagcctggattctttggggcccactgcagctcccgtgagtctcaagggccagatgaagttgctgggcagagctgggtacgggggcagtggtgtgggagcaggcgaggcaggtagccatgcagcctcaggacagcagggccagaatcccccccagcttcactgaggaattgcggtccagagacaggaagtgacacacactcccgggagatgacctgagtcaccgggtttttacccacatccacaaagcactgcccacctgagcatcttcctcttccacttctcagaaaacctgtgattccccttcattgtaaaatgagtgtattacttgcctttcccacatataccttatacatgggcagtggatggaagggggcccctggctgggctctctgccctctctggcagaaagagagggaagggaaaggggttgggaagcaggagagccagagggtgggcatcaggaatcaaggaatcactaggggaaaggtggcttctcccgacaccctggcgggcagtatccaggcctgagatcaggagaaagccagctctcctccagcccagcagagatccatctcggcagggaggagcaggcatggaggaaggcccaccaacctcggtgccacgctctgggcaagtcccctgcccactcaggatctctgagtgtgttctggaatgtgaagtggcaggctgagcctcccactaatggctaagggttttctgtaggtcagagcggagcaggaagtgagtgttgcccaggacaggctgccggatgttctgagggtctgtccccggctcttggaggatgggcccagcgccccttttccttgaggaaggggacgcagggtaagggtctgcgcgcggccctgagcccgctgacccctcccgtccccacccccgcaggctgcccgggccagtactggggccccgactgccgtgagagctgcccctgccacccgcacggccagtgcgagccagccacgggcgcgtgccagtgccaggccgaccgctggggagcccgctgcgagttcccgtgcgcctgcggcccccacgggcgctgcgaccccgcgaccggcgtgtgccactgcgaacccggctggtggtcgtccacgtgccgccgcccgtgccagtgcaacaccgcggcggcgcgctgcgagcaggccacgggcgcctgcgtgtgcaagccgggctggtgggggcgccgctgcagcttccgctgcaactgccacggctccccgtgcgagcaggactccggccgctgcgcctgccggccgggctggtggggtcccgaatgccagcagcagtgcgagtgtgtgcggggccgctgcagcgccgcctccggcgagtgcacctgcccgcccggcttccgcggagcgcgctgcgagctgccctgcccggcaggcagccacggggtgcagtgcgcacacaggtgagcgggcggggcggggacaggtgggctggcggggcgggggcggacacaagtgagcaggcggggcggggcggagacaggggggcggggcggagacagggggcggggcgaagacaggtgggcggggcggacaccggtgggcggggcggacaccggtgggcggggcgggcaccggtgggcggggcggacaccggtgggcggggaggggggccggggtggaaactggtgagcgggcagggtgggggcggggcgggcacaggtgagcggtcgggggagggggcggaggcggacacaggtgagcgaggctgcgcggagacctgtgagcgggcggggcggagcggagacaggtggccgcggcggggcgccgggaggaggggtcagggcttcgcggtgctcctctcaaaaaacatacaaagcagaggaacgagaaaggggaaaagtcggataggtggggtggctcacacctgtaatcccagcactttgggaggctgaggcgggtgcatcacctgaggtcaggagttcgagaccatcctggccaacatgctgaaacctcgtctctactaaaaacacaaaaattagccgggctgcgcctgtagtcccaggtattcggtaggctgagacaggagaatcgcttgagccctggaggcggaggttgcagtgagccgaggtcgcaccactgcactccagcctgggccagagagcaagactccgtctcaaacaaaacaaaacaaaaacttttaaaaacgctttgttgccccaggtccagcctcacctgctcatttcattgattactgctgtgcaaaatatactagcactgctagcaagccatatgtaggtaataagtggatcgagtccaacaatgatagactgggttaagaaaatgtggcacatatacaccatggaatactatgcagccataaaaaatgatgagttcatgtcctttgtagggacatggaagaaattggaaatcatcattctcagtaaactatcgcgagaacaaaaaaccaaacaccgcatattctcactcataggtgggagttgaacaatggaatcacatggacacaggaaggggaatatcacactctggggactgttgtggggtggggggaggggggagggatagcattggcagatatacttaatgctagatgacgagctagtgggtgcagcacaccaacatggcacatgtatacgtatgtaactaacctgcacaatgtgcacatgtaccctaaaacttaaagtataataataaaaaaatatatataaatatatttaaaaaaagaaaattaaaaaaatggtttcttacaaaaaaaataataaataagtggatcgagtgaccaagggtcctgagcaaggtccctttagggctcagtggctttcaaactttgactggctgcactcacagtaagaaatttcatccctggctgggcgcggtggctcacgcctgtaatcccagcactttgagaggccgaggcgggcggatcacctgaggtcaggagttcgagaccagcctggctaacatggtgaaacctcgtctctactaaaaatacaaaaattagccgggcatggtgttgggcgcctgtaatcccagctacttgggaggctgaggcaggagaatcacttgaacccgggaggcggaggttgcagtgagccaagatcgcgccactgcacgccagcctgggcgacagagtgagactcagtcttgaagaaaataataataaaataaaataagaaataaaaatgctggtcaggatcagctaaatggcttttataaactgcccttcttctcccctactaatgggtctgacccaagtatatgatcccagctagttaagcatctgagggagaaacttcaggtaactattaggcatcaatgggaaattaagatatggcaaatgtgaaattatattggtgacaacagtggtctccaaccttttggcaccagggactggtttcatggcagacaatttttctattattacactgtaatctataatgaaataataatatgactcaccataatatagaatcagtgggagccctgagcttgctttcccgcagctcgagggtcccatctgggggtgatgggagacagtgacagatcatcaggcattagatcctcgtaaagagcatggaacctggaccctcccgtgcgcagttcacaataggactggcgctcctatgagaatctgaggccaccactgatctggctggcagcggagctcaggcggtcaggctcccctgctggtcatctctacgctgtcgcccagttcctaacatgccacggactagtaccagtccatggcccagggtttgaggacccctgggtgaaaacactttacattttttgcatttcgtgtgatggggtagaagacactactgagtcccattcatgccagacctggggacggctcagtgtggaaaaaggaaaagtgaaaagagcaggagggaaggcctggcagacctcgcaaatgggactcagagcttggtggtgactcgcctgccctggctgggctgctggctcctgatggtcctgggacccagggaaagacggtcacagagcagatgcctggaaggaaagggatgggatcctgtaagagccctcatttgtcctcattgtacaacgtggggaaactgaggctcaaacctgcctgacccaggtgggacccgaacactctccagggcccccgaaggcctgcgtggagtacaggggtaggagggggtgggcgctccatccatccacccccactgttcccacgaagcccttctcttcccagctgtggccgctgcaaacacaatgagccgtgctctccagacacaggcagctgtgagtcctgcgagccgggctggaacgggacccagtgccagcagccctgcctgcctggcacctttggcgagagctgcgaacagcagtgccctcactgccgacatggggaggcctgtgagccagatactggccactgtcagcgctgtgaccctggctggctggggcccaggtgagggcaccattctgttcagggtggggtacaccttcccccaggaccctcagctcagcggctctctccgagagcaccaccctccccgacacacaggttcatgcggccccaggggcctccctcctgttgaagactgggggagagcagtgggttctgggggggcctgggcaggatcccagctccctcccctctgaggcttcctgccctcctcgccctctggggacttgtagtctgtcacctgctggatttggccccaagttcaaggccctatttgcacctgagcttcactgctgaggagt

SEQ ID NO: 17976 - DNA, 41399 bp, Homo sapiens
  misc_feature (1)...(41399): n = A,T,C or G, or insertion/deletion polymorphism (see Tables 1-2)
tggtgaacccttgtctctacaaaaattagccaggcatgatggtgggtgcctgtaatcccacctacttgggaggcgaggtgggaaaatcgcttgaatccgggtggcagaggttgcagtgagccgagatcacgccattgcactccagcctgggcgacagagtaagactccgtctcaaaaaaaaaaaaaaaacccaaacccacacaagatcaacctacctcttgctgcccagcttaaactagatgacaaaagaaagatttccatacaaagactggcagcttcccatctatacctcctggctgcaaaaactactaaaaaaggtacttcaacaacaagaaaataaacgtataagaaacaagcaaaaggaaccatgaggcaaaccaaacattactccccacctcccccttttttttttgagacagggtctggccttgtcgcccgggctggagtgcagtggtgctatcaccactcactgcagcctcgacctcccaggctccatccttctgcctcagcctcctgagtagcagggaccacaggtgtgcgctgctatgactggctaatttctttttttttttggtagagatggggttttactatgttgcccaggtgagtctccaactcctgggctcaagtgatctgtccaccttggcctcccacaggctgagattacaggtgtgagtcactgcatcttgccagtaaatagatatatgtatttttaaaaaggtacaatggccaggtgtggtagctcatgcctgtaatcccagcgctttgggagttcaaggcggggcggatcacctgaggttgggagtttgagaccagcttgaccaacatggagaaaccccatctctactaaaaatataaaattagctgggcgtggtggcgcatgcctgtaatcccagctactcgggaggctgagacaggagagaattgcttgaacccaggaagcaaagtttgcggtgagattgtgccatcgtactccggcctgggcaacaagagcaaaactccgtctcaaaaaaaaaaaaaaaaaagtaaaacgaatcctacaagactatgacactatgacagggaaactagaaaggggccttcagagggtattccaacactagttgtagctatttaaccttgttattttactaaaagatcagataacttccaagtcagcgagggaaaacgggaggacagagcggaagctggcaggaagagtgatgccaagacaagccaacttacaaactgcccctcgtcgatgcctatgacagccacgcccagggcctcctgggccacgtctcggagcaggcaggcgggcagtgcctccatggtgttcctgggaagagaaagccagagcgtgagcagggccagggaggccagaagccacaatgcaggggccagggaatggcactgtcgtgaccacctgctacctgcaaagcaggctcagtgttcacccagccgggctttgagaagttagcacctatgggaaaggccctcgtccagaaaaccagttatttatttattttttatgaaacagagtcttgctctgtcacccaggctggagtgcagtggcgccatctcggctccctgcaatctctacctcccaattctcaagggtctcaagcgattctcccacctcagccacaagagtagctgggactactggcacacaccatcacacccagctaatttttgtatttttagcagacatggggtttcaccatgttggccaggctggtctcagactcctaacttttaagtgatccacccgccttagcctcccagaggaaaaccagttatttatacaagccacttcacttgatgctttggattagaaattagtaatgtccagtacaaagctcaatgagactaaaaactcttccactgttcaggagctgggggcagactaggccaacttcatcaggtaccagggcccatgataccattaggggccagccaaatgtttccttttaaaattcagaagaatgaataactagaactgggcctgggttatatttgtctttatattaattatgttgcaaaacataaatttttaaaatcctgtattctggccagacacagcagctcatgcccgtaatctttggggaggccaagacgggaggatcacttgaactcaggagttcgagaccagcctgggtaacacagcgagacactgtgtgaaaaaaatgtaaaaattaactgggtgtggtggtgtgcgcctgtagtcccacctgctcagggggctgaggtgggacgatcacttgagcccaagggtttggggtcacgtaacagtaagctatgattgagccactgcactccagcctgggtgacagagagagaccctgtcccaaaaacaaacaacaaacaaacaaaaaaacatactttacaactattgtttcgttattaccttgctataatcctacttcgagttctggaaagaatgtgtgaaacagtattttgggcattttaaattccctcttccctccctaaacagagaaagacaaagtgagggcaggtgggaggccagctgtggcccctgcaagggcagcctctcgagccatcaatgctgctggcccagccttggcctctgtggcccgtgttagagatgacttgtgacacacgggcagaactcatatttaatcccggatctgactgactccagaagttgtacttccaacagctggaacgaagtgacctcctctgctttccctgtccccaccaggtgtaacaccaccctgtgccgtggacatcgcatcttaggaatgaggaagcaaatttggaaaagtaaatgacctacatcagacagcatggtcacgaagtgcggttaaattcccacatgcaactccaagccccaagcaccctccactccaccagcatctggcttcaggagcccctcagctcccaccgaaggccacacgccgggtggatctgttctctgcacagccatagcaactctcggatacagctcccagccagggctctgaggctgaagccctataatgtgtggcacagcatggctttgccactgggtgcccaggtggacaagtccagaggaccaagcaaagcgtctcaggctcagaaacatcaggcccacatctgctgccaaggaagtgaatttaactcccaaactgaggttgcaggcggaaatgtccagcgagctcaaacagctacacataaaacagggaagcgtgaaggctgccaggtgacgggggagccagccaacaacggacaactaaaaaattaaacaaaaatcaacgtgcaggccaaaccaaaccagtctgcagcctgtgtgaagctgaaaccctacggcagagtttctgaacactggcaggctcctgacatttggggccagctcgttcttgcatgggggccgtcctctgcaccataggacccttagcagcagtgtccctgatttctacacattaaagcccaaaagcatcccctcccccctccagttgcaacaactagaaatgtcttcaaacattgtcaaatggaccctggcggcaaaatcaccctcagtggagaaccactggctccagcccagggagtggagagtgtgcgctaccttgccaagcaccttggaaagtgtgctgatttgaatcattcaatgttcaaatgattaaccatccccattaaagagagtcctaacagtgtgtcctgtgccttgtgattttccactggacaggactgcagggggcagggactgaccggtcatgtgtgcagaagctgctgctgtagcgagtgtctttggcatacttgatcaccaggcacttgtactgagcaatctggaagcgacggacgcgtctcatcaactctgtgctgcaagaggagagagggtcaggtgaggtccacggcgggaggagtgggagaaggagacccctccccaacaagcctggctcctcattgtccctagtggtatgcagactgagcccaccacagccagaaaagagcagggcagagcaggcagggtataatatccctacaaagagggttggaagtcagaattctctatggggaagaggtccaggaatggtactcaggtggtcccaggaagtgtgggaggagtaaccttctccaagatgtagtggggaaggcagaagcaaaggctacatgtagagggaacctgcgactgcattccaaagtaacctcatcccagagttgttcccagagttcagagtttttctttctttctttttggggtggagtctcgctctgttgcctaggttagagtgcagtggagcgatctcagctcactgcaacccctgccttccgggttcaagagattctcctgcctcaacctcccgagtagctgggattacaggaggctgccaccatgcccagataatttttggttttttttttcagtagagatggggttttaccacgttgaccagggtggtctcaaactcctaacctcaagtgatcaacgcacctcagccttccaaagcgctgggattaaaggcgtgggccaccacacctggcatacagcttttctaaattaatttcagaaagtctttgtgtgcagcgtcaaaagcacttgcttctgggtccaagaagtccaactctgagccacatcttcctgagcaaggggtttgagctgaagtgatccccagggccataaaagaatgttggggcagggcatggtggctaacatctgtaatcccagcactttgggatgctgaagtaggaggattgcttgagaccaggagttcaagaccagcttgggcaacatagcaagaccccagctctataaaaataaaataaaattagctgggtggaggcgggggggtgcacgcctgtagtcccagctacttgggaggctgaggtgagagaattgcttgagcccaggagtttgagaccagcctgggcaacatagcaagatcctacctctagaagaacaaaaacaaaacaaaaagaatggtgcgtgggtagtttactcaagaaactcactagccccacccgggtcagggaatggttctatcacctcaggagagcagaggctccacggcttcagactccttggtttagaaagcgactacgtttccttggccttagaaggaaacagccacattgaataggggtgtacaaaaaggcctggcctacaggggacacaactggttgccaccttctcagaggacttggtggggaagacagctaagctgtaagcagctgtcaccagctccaggagggagtggcgtccacacaggacgaggggcttggcctgggcagaagagggcagagacttcctcctggactgaattcaagggaggagcaccccaggcgggagctgtaggaggctgtgctggtccttctaggggaagggaaggggagggaagggaaggggagggaaggggaggggaggggaggggaggggaggggaggggaggggagggacaaggggtccccggagaagaggaaggagctccaccccagccccgcgaagccattacctttttcctgagaacatcggcccgagaatcacctaggagagaaggtgaggtcatttgagggcccgccctgcgcggatgcctggacacaggctatcaccacgaccacctcatccccagccacgcgcagggctggcccccgcacctggatctgcccccgggtcttgctgggggagccaggcagcacagtgggcaggttaatgcagctcattgcgcctccgggaagttcacgaacccgagtactctccaaggccgtcccgcagtaagcccctggttcccgcgccgaccgctttaaaccacggcgtgctggccaatcacgagccggccccgccgccatggggccaatcagcgcccggccgctgacctggcgggagatttggccgcagcccgccccctcgtgggaggaatccgggacgtgcgcccagggactgggagggcctggaaatcagggcgatggacgtggctgatcggggtggggcctggtctgagccccgcctcggtccgcccaccaagtttaaaggggcggagcgaggcggggctctggccatataaacagagggacgcacgcccatgcggctgtagacgccatgatggatgtgtctggtgtgggtttcccaagcaaggttccttggaagaagatgtctgcagaggtaggtggattgcagggagggactaaggggctggggcggagttagctcatttattagwttggaattccaagaaggaagcttagaagccgtctagagcactcctgtgggcatgcagagcgcctagtgcgtgccaggtccccagtgcttgagcaccatggtgtattttaccttctcctaaggatttttgttaacctggttttcaggataaagaaaattgaagtcctgactatgctaataatatccgtagaccctgccaggcgtggcggctcacacctgtaatcctagcacttttggcggatcacgaggtcaggagttcgagaccagcctggccaacatggtgaaaccccgtttctactaaaaatacaaaaattagccgggcgtggtgatgtacctctgtaatcccagctactggggaggctgagacaggagaatcgcttgaacccaggaggtggaggttgcagtgagccgagatcatgccatttgtactccagcctggaaggctgggcgatagaccaagacttagtctcaaaaaaaaaaaaaaaaaaaaaaaaaaaaatccatagacccgcaggaggttaggggacaaagttctggaccttgatctgaggttacacaatgtttttgggtctgtgcttatgtggcacaggctgaaggattcagaacagctggtatttacattggggttgtgaaggttagaaacatacaggccgggtgcggtggctcaaaaaaaaaaagaaagaaagaaaagaaacccattgtataatcatgatcataaataatagcaacaaagatggtggtagtgatcacagagtgtgccaggtgtggctgtaaggatcctacaggtaataacctttccaggtacagattggacagatccaaggacctctgacaaagagctccttcactgggaggaagaagcaacccacactgactggcttgctttattttactcgcatgctttatctcttttaaccttgtgatttggatacatgccttctttttttgagacacagtctcgctcagtcacccaggctggagtgcagtggcatgatctcggctcactgcaacctctacctcccgggttcaagtgattctcctgcctcagcctcccgagtggctgggattacaggcacactgtagctggtactacatgcctggctaattttttttttttttcttttgagacagagtctcgctctatcgcccaggctggagtgcagtggcgcgatctgggctcactgcaacctcttcttccagggttcacgccattctccggcctcagcctcctgagtagctgggactacatgcgcccgcaaccatgcccggctaatttttttgtatttttagtagagatggggtttcactgtgttagccaggatggtctccaactcctgacctcatgatccgccccccttggcctcccaaagtgctgggtttacaggcatgagccactgcgcctggccaatttttgtatttttaatagagatggggtttcgccatgttggacagactggtcttgaactcctggcctcaagtgatccacccgcctcggcctcccaaagtgctgagattacaggtgtgagccactgtgccgggcctggatagataccttctaccagtcaggaaactgaatctcagagactaagtaacttgttgaggataaaacagtaagtaagtgagggaggtcagatggcatttgacctcaggccttgccatgaggctgccctgacttcccatttctcatgatggttttgagccctttcttcaaaatctggttccttgttacttttttttttttttttttttgagatggagtctcgctgttgtcacccaggctagagtgcaatggtgggatctcagctcgctgcaacctccacctcccgagttccagcgattctcctgcctcagcctcccgagtagctgagattacgggcgcccgccaccatgcccagctaatttttgtatttttagtagagacggagtttcaccatgttggccaggatggtctcgaactcctgacctcaggtgattcacccgcctcagcctcccaaagtgctgggattacaggtgtgagccaccacgcccagtgttttgtttttttttttttgaaacagggttttgctctctcaggctggagtgcaatggcgcaatcttggctcactacaatctctgcttcctgggctcaagcgattctcctgccttagcctcccgaatagctaggactacaggtgtccaccaccatgcccggttgatttttcatatttttcgtagagatagtgtttcgccatattgcccagactggtctggaactcctggactcaagtgatctgcctatcttggcctcccaaagtgctgggattacaggcgagagccaccgtgtccagcattttctgttggtttttttttttttttttttgagatggggtctcactctgtcgcccaggctggagtgcagtagcatgatcccggctcactgcaacctctgcctccctggttcaagctattctcctgcttcagcctcctgagtagctgggattacaggcgcgcgtcaccatgcctggttaatttttgtatttttagtagaaatggggtttcatcatgttggtcaggctgatcttgaactcctgacctcgtgatcccgcctccgcctcccaaagtgctgggattacaggygtgagccaccgcgcccagcctctgtttttttttttctttttttaattctccaaactgcctcagaatggttccttgttactttctgcataaagtgtgaaggtgttagcccgacattcaccgcccctcctcctccagcccagcctcccagcctcacctctgtgtgtcagccatagggcctgccagcatttgcaaactgacctttcattccttcctcctcacctctgtgcctttgactgtgcagtgacctcctgtggtcagaatcgcaccctctcagcgcagatcagctcctccttttttaatttttttgaggtagagtcttgctctgtcgctaggctggagtgcagtggtgcgatctcggctcactgcaacctccacctcccaggcttaagcaattctcctgcctcagcctcccaagtagctgggattacaggtgcacaccaccacgctcggctagtttttgttttcagtagagatggggttttgccatgttggccaggctggtctcaaacttctgacttcaagtgatccacctgcctcaggctcccaaagtgctaggattacaggcgtgagccaccgggccacctggcctcccctggtcgtaactgctgtgggagtggtgcccatgatggcattaactgaattcgtttgggggacctcatctccccttaaggctgccagctggctaaaggcacagcggtcgctggtatacctctagaccatggatctgagggcatcttggagaccctgggatactggggcgagggcttctaaggcagagaggagcagccgggcatgggcgagggggaggggcacactctgttgagaaggaaagtcttacggagcctcatgtttgtgccctgcaggagctggagaatcagtactgtcccagccgatgggttgtccgactgggagcagaggaagccttgaggacctactcacagataggaattgaaggtactagtgtgacctctccgtggccgcattgggtgtccttaagcatgtggcagtgattcagaatgctgggggttgggggggctgtgctgcaccacctgggcctcgaggggcatttcccaaacaccaggcactttataaacctccctgctcaggggcaggtgcccaggaccccttgctgcagggactactggaggcaggagaggtccgggggaggtccacggctcagtcgaccatgcctggcctttcttgctcagccatccatacccaggcccgtaaggctgcgggctgtggttggcatagggaggtgaagtgaacagaggaacgttccccatccgctgctgaatgtggaatgcggtcactattcctaaaaagcaatactttgggaggccgaggcaggtatatcacttgaggccaggagttcaagaccagcctggccaacatggcaaaaccctatctctacaaaaaaatacaaaaattagctggacacctgtaattccagctactcgggaacctgaggcatgagaattgcttcaacctgggaggcagaggttgcagtgagctgagattacatcattgcatgccagcctgggtaacagtgagaccctgtctcaaaaaaaaaaaaaagcaatgaagcctcttttttttttgagactgagtcttgctctgttgcccaggctggagtgcagtggcgcgatctcagctcactgcaacctctgcttcccgggttcaagcgattctcctgactcagcttcctgagtagctgggactataggcgcacctctccacacccagctgatttttgtatttttagtagagatggggccaccatgttggccaggatggtctccatctcttgacctcgtgatctggctgcctcggcctcccaaagtgctgggattacaggcatgagccatcgtgcctggccgccttttctttctttcttttttttgtttttgagacagagtttcgctcttgttgcccaggctggagtgcaatggcatgatctcgactcaccgctaacttcgcctcctgagttcaagtgcttctcctgcctcagcttcctgagtagctgggattacaggcatgcgccaccacgccctgctaagtgttttgtatttttttttttttttagtagagatatggtttctccatgttggtcaggctggtcttgaactcctgacctcaggtgattcgccctcctcggcctcccaaagtgctaggattacaggtgtgagccaccatggctggactttttttttttttttttttttgagacggagttttgctcttgctgcccaggctggagtgcaaaggtgcaatctcggctcactgcaacctccacctcccaggttcaagcgattcttctgcctcagcctcctgagtagctgggattacaggcctgtgccaccaagcccagctaattttgtatttttagtagagatggggtttctccatgttggttaggctggtctcaaactcccgacctcaggtcatccacctgcctcggcctcccaaagtgctgggattacaggtatgagccaccgtgcctggactttcaccttttctttctttaaagaaatctggacttgggaacctgtaaactagtgaagtmttaaggtccatttccatctctaccctgtatctgcaaagtgctgtaccacgatctgaacacctggtaatgcatccgtgctgggatggggagcaggccccgaggaggaagtgtaggtgaggacgcagccaaccatgcttggcaaattagctctgttgcagcaggctcaacacagcctttcagaggcagatgcctgggctcctgggcttggtggttttctaagcggagagaacccaggaggaggaacagacttgttagaagtgtattccagcaattccaccatcctcctgtctcaatagattgggggggagctgtttcctgggctcttcatgttccttgctgtgctcagctctgatccaaattcatctctatttgctcgataaatacatgagtgtggtgaaacatacaagagctgtaagcagccaggcgtggtggctcatgcctgtaatcccagcactttgggaggccgaggcgggcggatcatgaggtcaggagatcgagaccatcctggctaacacggtgaaaccccatctctactaaaaatataaaaaattagccaggcatggtggcgggcgcctctagtcccagctactcaggaggctgaggcaggagaatggtgtgaacctgggaggtggagcttgcagtgagccgggatcgcgccactgcactccagcctgggcgacagagcgagactctgtctcaaaaaaaaaaaaaaaaaaaaaaaaaaaagctgtaagcaaacctatttgcctgtcttaattgtcttgagtgataaaaagagctgaccctattgagaaagaatgtcagatgtaaaaagcacgcactattgaaacttcaagtcatatgaatgaaagaaaattaaaaggaaaggattaaaaaggaaaaaaaaaaaagaggccaggaactgtcacacacgcctgtaatsccagtactgtgggaggtcaaagcacgaggatcctttgaggccaggagtttgagaccagcctgggcaacatagcaataacctgcctctacaaaaaatttaaaggccaggcgtggcagctcacgcatgtaatcccagcactttgcggggctgaggtgggcagatcacaaggtcaggagattgagaccatccyggctaacacggtgaaaccctgtctctactaaaaatacaaaaaattagctgggcgtggtgcgggcacctgtagtcccatctactctggagactgaggcaggagaatggcttgaacccagaaggtggagcttgcagtgagctgagatcatgccactgcactccagcctgggcgacagagcgagactccatctcaaaaaaaaaaaaaaaaatttaaaaattagcagggtgccgtagtgtgcacctgcagttccacctacttgagaggctgaagtgggaggattactgctgccttggagttcaaggctgcatatttctttatgtattgggttttttttttttttctttgagacaaggcctcgctttgtcacccaggctggagtgcagtggcgtgattttggctcattgcaacctctgcctcctgggttcaagccattcttgtgtctcacattcttgtgtttcagcctcccgagtagctggaatttacaggcgcgtgccaccacgccagctaattttgtatttttagtagaggcggggtttcaccatgttcgccaggttggtctgggactcctggcctcragtgatctgctcgcctcccaaagtgctgggattataggcgtgagccacactttgccttctttgcaccagggagaattatattttttctcattttttatttgtattcgtccttacaatgccagcctgttaacttgcaatgagggatgttcgcttttaatgagtagacagcctcatccccatcaaggcctggccgccctcatctgggctcagggagaacaaagtctaactgctgtgtgagtatggtcagggcgcaggaggctggcagagagggggtttaagaaccatttcctttaccactagcttttaaattagttttactgtgaccttcagtaaaaatacttttttttttttaagacggagttttgctcttgttgtccaggcttggagtgcaatggcgcaatctcggctcaccgcaacctccgcctcccaggttcaagcgattctcctgcctcagcctcctgagtatctgggattacaggcatgtgccaccacgcctggctgattttttatttttagtagagacggggtttctccatgttggtcaggctggtctcaaactcccgacctcaggtgatccacctgcctcagcctaccaaagtgctgggattacaggcgtgagccaccgtacccggcccaaaaaaatacattttacagtcagcaaaatgctgtatatattttttatccagatacaaaagttcaaattctgtatgatttcatttaaatgaggtccctagagaagtcaaattaataaagacaagaaatggaatggtggttggtaggggcaaggggagggaggaatggggagtgagtgtttaaaggggacagtttctttctttttttttttcttttgagacagggagagtctcactctgttgcccaggctggagggcagtggtgctatgtcatctcactgcaacctccacctcctgggttcaagcagttcttgtgcctcagctkcccgaatagctgggattgcagatgtgcaccaccacgcccggctaatttttgtgtttttagtagagacagggtttcgccatgttggccaggctggtctcaaactcctggcctcaggtgatccgcctgcctcgacctcccaaagtgctgggactacaggcatgagttgccgcgtgcagccctgcagtcctgttttttttttttttkgggcggagtttcactcttgttacccaggctggagtgcaatggcgcgatctcagctcaccgcaacctctgcctcctgggttcaagcagttctcctgccttggcctcccaagtagctgggattacaggcrtgcgccaccacgtccagctaattttgtatttttagtagagatggggtttctccatgttggtcaggctggtctggaactcccgacctcaggtcatctgcccgcctcccaaagtgctgggattacaggcaagagccaccacgcccggccttgcagtcctgtttttaataccatgcacagcattataaattattattattattattatttttgtttttgagacggagtcttgctctgtcacccaggctggagtgcagtggcaagatcttggctcactgcaagctccgcctcccrggttcacgccattctcctgcctcagccacccaagtagctggtactacaggcgcccaccaccatgcccasctaattttttgaatagagacggggtttcaccgtgttagccaggatggtagcattagaaattatttctaacccaggctgggctccatggctcatccctgtaatcccagcactttgggaggccaaggcggtgggaatcacttgaggtcaagagttcacggccagcctggccaacatagtgaaaccccatctctactaaaaacacaaaaagtagccaggcatggtggcgtgcgcctataatctcagctacttgagaggccaaggcaagagaattgcttgaactcaggaggcagaggttgcaatgagcaaagattgcaccactgcactctagcctgggtgacaaagcgagaccttgtctcagaaaaaaaagaaaagaaattatttctacccagccaggcacagaggctcacgcctgtaatcccagcactttgggaggccagaggggggcagatcacttgaggtcaggagttggagaccagcctggccaacacgacaaaacaccttctctactgaaaatacaaaaatgagccaggcatagtggcacatgcctgtaatcccagccaccggggaggctgaagtgggagaatagcttgaacccaggttggggaggttgcagtgagtcgagaccacgccattgcactccagcctgggcaacaaagaatgaaactccatctgaaaaaaaaaacccagaaattatttctaacccaaaacaattgaaaacaggtactcaaacaagcatttttacacgcgtgttcgtagcaccatttccacatagcctgagttgtaaataatagcaatgaagcttttgctttaatgagaaaggaagtttgccataaggtttgttctggggtgtcttgctgaagccctcctgtgttcttgccctggggttcagggactggagggccctctgtggggggcatgagtcacttcattctctgtctctgcaccccagctgtcctctcctagagagaggcaatttctctttcccgaggttagtagagttttttaatatctgagagaggcttatgcatgataatgaacacctatagctgcttggttttaatggccattccacttagaacataaattccatgatgtttttcttaatcgtagcacaactttaatctagtccatttataggcttgagaactcctgtgtgaattaaatcacgaccttctgatgaagccactccgatgagcctgtgaggcacattgtcttcacactgtgctggggcagggttgttggcaaacccccatggatggcagccggcaatggcctcacagtgacaaatgcgtctgccttttgacccagaattctacccctgagagtgcgtcctacagatgcttgcaagtggtatggtaatggatgtacaaagctattcacagcaggggtgtttgtggtagcatggcctgggagacagcccagatggctttcagcaaaggattggtggcaggtctgcagccctggggcttatcagacaccaaccctgctggcaccttgatcttggacttccagtttgcagaactgtgagaaaataaaatttccattaagtttccccagtctggtattttgttatagccgcccaggctgactcagacaggagcccaggatggatgtgagcgtgttataaccagctcacgcttgtggctgtagggagtccgggtagaagctggaagagcctagaggggtggctgctgccttccagggaacaggtcaaagggtatccaaccagagtggtctcagtgcagatggggaggagactctagacccaggacaagcagtggagggggcatccaaggatttcctgatgatcagatgtggtttgagaaagagagggggccggtggcgcatgcctgtaatcccagactttgggaaaccaaagcaggaggacgcttgagcccaggagttcgaaaccagctggcaacatgcaagacctggtctctacaaaaaaattaaaaattagctgggtgtggtggtgcttgggaggctaaggtgggaggatcacttgagccctggagttcgagaacagcctgggcaacatggcgaaaccctgtccctacaaaaaatacaaaagttagccaggcgtggtggcacacgcctatagtcttagctactctggtggcagaggtgggaagcttgtttgaacctaggaggttaaggctgcagtaagccgagattgcaccactacactccagcctgtgtgacagagtgaaaccgtgtctcaaaaataaaaagtgaattcaggagttccagaccagcctggccaacaccgtgaaaacccatctttactaaaaatacaaaaattcgcctgggccagatgcactggctcgcacctgtaatcccagcactttgggaggccaaggcggggatatcactcaaggtcaggagttcgagaccaacctggccaatatggtgaaaccccatctctactacaaatacaaaaaaaaaaaaaattagccatgcatggtggtgcgtgcctgtaatcccagttacttgggaggctgcggcaggagaatcgcttgaacccaggaagcagaggttgcagatcacttgaacccaggaaacagaggttggagtgagcggagattgcgccgttgcactccagcctgggtgacaagagcaaagctctgtctcaaaaaaaaaaaaaaaaaaaattagacaggtgtggtggcgcacacctgtaatcccagctgctcagaaggaggagacaggagaatcacttgaaccccagaggcggaggttgcagtgagccaagattgcaccagtgggctccagcttgggcgacagagcgagcctctgtctcaaaaaaacaaaacaaaacaaaacaaaaccaaaaccacacaaggcttttcagtgaaatgctcactcctcttccctttcgtgtgcccagttcccctggcccccgtcaaggtggccactgttcttcatatggatatagactccccctccctttcatccaaatggccccgtagtacacacagttccaccctgccagtttcacttagtatttcttggagatgtttcctcatctgtacgtagatagcttctcgtcagtacgtcagtacgcagggagccctgcaggggcaagtggttggtaacgtgggtgctggcaaaacaggttttgcaacctcactggcgttstgcaaaggcagcttcctgcctggattggcccatgggcaacttccctttgatttccctcagctttaatccatccagctgaagtggagacagcccggtttatggttctgcattctggcatagacgcaattcgtacaagctctcagccccatgctttttcttcctctgccgtgtttacccttctggagttgcagaatgaatcacccacccgagggaagcacggttgtttttttttttcttttctttttttttgagacagtcttgctctattgcccaggctggagtgcagtggtgcaatctcggctcgctgcaacctctgcttcctggttcaagcaattctccttcctcagcctcctgagtagctgggagtacaggtgtgcgccaccacgcctggctaatttttgtatttttagtagagatggggtttcaccatattggccagggtggtctcgaatgcctgaccttgtggtccacccgcctcggcctcccaaagtgctgggattgcaggtgtgcgccgccscgcccggccaggcttttttytctctaggcctgctgtggycaccaaggctggggaccagggggcctccagggacagggatcccaagttgcacgttaatacacggagccctttctgagatgcaggttctacagggaactggattccacctcttttggggagatcaacccagcagcccaaggatcccctgatggtgcctgagcacagctgtgagaagggggtatctggatccttggggtgacaggatgggagaggtggagcatgggcctgcaggctggcccccagaggccttaggtctctgctgactagctagaattctgaaaactgtgttatgtaagacgtttagcatctgcagtgccaaataaaggtgacccccacaacgacataaaaaaaaaaaaagatatgtccaaatcctaaccctgggaacctatgaaaatcctaaccctgggaacctatgaaggtatttccttatttggtgtgttttgttttggtttggtttggtttggtttgtttgatacagagtcttgctctgtcgcccaggctggagtgcagtggtgtgatctcagctcactgcaacctctgcctccgggttcaagcgattgtcctgcctcagcctcccaagtagctgggattacaggcacgcgccaccacgcccagataatttttgtatttttagtagagacagggttttaccatgttggccgggatggtctcaactcctgacctcaagtgatctgcccgcctcagcctccctgtaaccagctgggattgcaggttcccggttggtatttccttatttggaaagaccatctttgtaggtgttattagctaaagtcaagtcattctgggttagggtgggccmtaaatgccattgactgctatcctgctaagagacagaagagggagggacacacagggaggggaccacgtgaagacggaggcagagacgggaagaggcagaggtgactggagtgacgtagccccaggccttggaacgcctggagccaccaggagctgcaggaggcaaaagaggcattggcagagtgtggcagtgtccacaccttaatttcagacttctggcctttagaactgtgagagaatcacgttctactgctgtgagacactcaatttgcagtactttgttacagctgccctggtaaacaaatgcaatatttattttcagcaaagcagggagttcctgcaaagatgactagaccaggttccttctcccaagagcgcagtgtcctagctgtgaatactaggagtgcgttgctgcggtgggaggggaggcagggtttactgactgatcattcccagtggtctggatgctctctttctttctttcctttctttcgagacagaatctcgctctgtcacccaagcttgagtgaccagaagctggagaaggcaggaaggaccctccctaggaaccctgcccacatttgacttgagacttccgttctccagccgctgtgagacacagccctgcaaggagtgcccagcttgtggcagtttggttgcggcagccctggaggaggagtcccccagggaaagtggaatctctcttgcagtccaccatccacatcccccgactcaccttccgctctgccagtatcctccgtgaaagaacaggaagaaaggcaaggctgcaaaaccaagcacagggcgtgtgagcgaggcccgccctgctgagctctgccactggacccccaagccccgggacccccagccccttcaccgacaaccttcagacgactcgtcggggaagtaaatgtccactttctccccttcgccgtctccataggggacatgcagcaggctcttcctggtggcccgggcccttgtggtggctgtctcagaaatggacaagtcgctgtcagcacaagctcaggtggtagaaatttttcttttcttttttttgagacgaagtctcactctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgcacccagcctggcagtcctctttcgatgggaggtgctcagagctgaagctcaacacgccaacttaagggagctttcagctggaatgtttctacctgagctgaaatagaaattgccgccacctggctgggcacagtggctcatgcctgtaatcccagcactttgggaggccaaggtgggtggatcacgaggtcaggagttcaagaccagcctggccaacaaccctgtctctactaaaaaatatatatatatatataaaaattagctgggcatagtggcgtgcacctgtagtcccagctacttgggaggctgaggcaggagaatcgcttgaaccggggaggtggagattgcagtgagccgagatcgcgccactgcactccagcttgggcaacagagtgagacttcgtctcaaaaaaaagaaaagaaaaatttctaccacctgagcttgtgctgacagcgacttgtccatttctgagacagccaccacaagggcccgggccaccaggaagagcctgctgcatgtcccctatggagacggcgaaggggagaaagtggacatttacttccccgacgagtcgtctgaaggttgtcggtgaaggggctgggggtcccggggcttgggggtccagtggcagagctcagcagggcgggcctygctcacacgccctgtgcttggttttgcagccttgcctttcttcctgttctttcacggaggatactggcagagcggaaggtgagtcgggggatgtggatggtggactgcaagagagattccactttccctgggggactcctcctccagggctgccgcaaccaaactgccacaagctgggcactccttgcagggctgtgtctcacagcgctggagaacggaagtctcaagtcaaatgtgggcagggttcctagggagggtccttcctgccttctccagcttctggtggccttagacagcccttagcttgtgtctgcatagctccagcctctgcctccattcacatgtgatcctggtgttcctgggtctcaaatcttcctctctctttttttttttttttttttttttttgagacagagtctcactctaacccagactggaacgcagtggtgcgacctcagctcactgcaacttctgcctcccgggctcaagcaattcttctgcctcagcctcccaagtagctgggattacaggtgcacgccaccacacccagctaatttttgtatttttagtagagacagggttttaccatgttggccaggctggtcttgaactcctgagctcaagtgatcctcctgccttgacctctcaaagttctgggattacaggcgtgagccaccacaccagcctccttttttttttttttttttttataaggtcatagtcacaggttctggggttaggatttggacatatcttttggggggacacagttcaacccactacacccagtgagaagcatgttcagcctcctcttgaatcaagggaaaagccagagtgaccaaccactgtcccagtttgcttgggactgaggaggggtttcccaggacatggggttttcagtactttaggaaaaaaaaatgagagtcccaggtaaaatgggacagttggtcactgtaagctaagcagtgggtatttgggaatttgggatcttggcagacactgctgttccctagggtcttcctacagagttgccttcaagcatgttcatgttaatagcttacatttaatggccaggtacggtggctcacgcctgtaatcccaacactttggaagggcaaggcggacggatcacttgaggtcaggagttcgagaccagcctggccaacgtggtgaaaccctgtctctactaaaaatacaaaaattagctggacgtggtggtgtgtgcctgtaatcccagctactcgggaggctaatgcaggagaatcgcttgaacccaggaggcggaggttgcagtgagctaagatcatgccactgcactccacccagggtgacagagcgagactctgtctcaaaaaaaaaaaaaaaaaaagcttacatttattgcacacaaaactctctacactgctagtctttaattctcaaaaacagttccctgagagagggaacataattgcctctattttacagatgacaaaaccaggcttagaagttacacaaattgccttgcacagtggctcacacctataatcccacacattgggaggctgaggcaggaggattgagttagaaaccagcctggtcaacatagcaagacccycatctctacaaaagaaaagataaatttgctgggcatagtggtgcacacctatactcctgcttgggaggctgaggcaggaggatcgcttgagcccaggaggtcgaggctacagtgatccatgatcgcaccattgcactccagcctgggcgacagagcgaggccctatcgcttagaaaacaaaaagttacatgaagttcccccaaggtcccgtagctagcatgtgatgtgkcagggagagagcctgtccgcttcactctctcacatgggaccagaaaggggtgatgctgtgcgtggacaggacatctggcaagtggtgtgtccaggacacaggaagcagcgtagtggccaagctgcctccagctgtcacatctgtgtgtctctgcagtaaggatgagtctgccttcatggtccacccgctgacggcacagggagtggccgtggtaatagtggcttacggcatcgcccccaaaggtaataggagtggttgctgcaggtccgagggccggtgggctttaggaggaagtgcatccctgacccagctcatgctctctgtgcaggcaccctggaccacatggtagaccaggtgacccgcagcgttgcgtttgtccagaagcggtatccaagcaacaagtgggtgttgccagtagattttcttcctgttggacctcagtgggtgggaggacagtgcaatcagtacctaggatacagccaagctgcccctctggcctgtggagcagaaagcaaattgggactcttcgaagggggcctgatgttgtggggaaactgcgtgcaaatccagctctctgctctgacccctcccaggggaatttrcctgtgtggacactcagccggggcccacctggctgccatgatgctcctggccgactggaccaagcatggggtcacgcccaacctcagaggtttccatgggagctacagcctggctgggcaaccttcatctccccatgagccttggggtttgggccaactgcttgaaatcctcccggccatgagtggcttgaccgcagggcttcgagccctctgagcaaggccttctctgcctcctctgtgccccttcccctggtcctgcccctctggcggtgggggtgggctggccctgccttgctccgcctggagcctggccctgtgacaattctgtaccttcacaggctttttcctggtgagtggggtctttgacctggagcccatcgtgtatacttcacagaacgttgctctccagctgaccctgtgagttacttggccaccacctcccctggctcaccaggagcctggctcctctctgtcctgacccctgtccactccccaccccagggaggacgctcagaggaatagcccccagctgaaggtggcccaggcacagccggtggaccccacctgccgtgtgctggtggtcgtgggccagttcgactcccccgaattccaccgacagtcctgggagttttaccaggtactcccagtgcaggtttgtggccagaggtcgagggtcatgtgggctcattattttcctctttcttttacccaagtggacaagaccctccatcatttatttaacacgtactgagtgaaccctgacctgtgccaggcatggccccatgtcctgccccacctcccctcccactgctcaggcccctcttcccatgtctcccctgcccagaccctgtgtcaaggagagtggaaagcctcatttgaagagctccacgatgtggaccactttgaaattgttgagaatctgacccagaaggacaacgtgctcacccaggtggggcctcatccctggcagccctttcatggtagacagcacaggtcctgtcgcagccccttagatgtgcaaaccaggagttcaagaccagcctggccaacatggagaaactccgtgtctactaaaaatacaaaacaaattagccagatgtgatggtacgtgcctgtaatcccagctactcaggaggctgaggcatgagaattgctttaacccaggaggcagagattgcagtgagccaagattgcaccactgcactccggcctgagcgacagagtataagactctgtctcaaaaaaaaaaagacctgagaacctaggaaagaaagaacctaagaaagaccatcttgtttctttctttttttttttctttagagacagggtctcctctcttgcacccaggctggagtatagtggcaaaatcttagctctctgctgcctcctgggctcaagtggttatcctgccccagcctcttgagtagctgggactacaaaggcgtgccactgtgccctgctaattattcaatgtttttgtagagatggggtctctctatgttccccaggctggtcgtcgtcgtcttccttcttcttcctccttcctccttcatcttctttcttctcctcctccccctacccccccttcttcttcttcttccttcatctcagcatattatacctctaaccagactgtcttcaactcctgagttcaagtgatcttcccacctcagcctcccgaagggttggggttgcagacgtgagccactgcatccagccctgtctcatttccttaatcaaattcctgcaaagagctgctctgattctggggcttttgtgtcttctcttcctgttccagattatcttgaaaacaatcttccagtagttctgacgatacttggagcctggtccacgtgcatcccaccttgggaagcctctccaaagagctttcggagctgacactgacagcttcagtttcccccagcacccaggagagccttgctgtgtctgtctgcccggcaagagtccattctcactgctgggacactcatgaaaatctccacgtcctccctcttcccagcctggatggagctccagggctggggaacgtccgcaagtcaatgctcagagatgcccggagctgcctcttagactcgtctggcccatctacctgctgacagagcatgacaaagatgacgctcaaaagtaatgccattacttcttttttttttttttttttttttttttttgagaaggagtcttactctgtcacccaggctggagtgcaggggcgtgatcttggctcactgcaacctccacctcccggggtcaagctattctccttcttcagcctcctgagcctttgggactgggggcgcctgccatcatgcctggctaatttttgtttttttaggggagacgggggttcaacctattggccaggctggtctcaaactcctaaccttgtgattcgcccgccttggcctcccaaagtgctgggattccaggcgtgagccactgcgcccggccagaatggcattatatttaaatagttcataaagaagcacaaaagaatattatttcataacatgtaaaaattatataaaacgtaaatttccatgttgataaataaagttgtattggaacacggccctgctcgttcatttacgtattgtctagggcagctttcaagctgcagggtggagctgagtggtggtgacagtgacctcctggcccgtagtgcctgaagcatttcctatctggcccttttcaggaaaagtttgcggacccctgggtaagggcttccccaagccagctaccctctgccttctgcttcagtctcctgtctgctctgtcctccatctccctgacatttgggtctgtccctgaatgccccggggtctcagcgttggggccaacaccttgaccttgacaggacaatgctacccacatgtaggacaagcttcctctgcacccgagagtggtgtgcatgtcccaagaagccagctatatccatccaccacccaccccaccacaccgcctctttctctcacaccgaatagcattcaagaatttccactgtgggctgggcgcaggggctagtgcctgtaatcccagcactttaggaggccgaggtgggcgaatcacctgaggtcaggagttcaagaccagcctggccaacatggcaaaaccctgtctctactaaaaatacaaaaattagccaggcgtggtggctggcgcctgtaatcctagatacgtgggaggctgagttaggagaatctcttgaatccgggaggcagaggttgcagtgagctgagattgtgcccctgcactccagcctgggtgacaaagccagactccatctcaaagaaaaaaaaaaaaattccactgtatgtgtgcagcaaaccatcatgacacacatttacctgtgtaacaaacctgcacatcctacacatataccctggaacttaaagtaaaagttgggggggggggtaaaaaagaatttccaccgtgacattattgagtatagcaaaaaaaaaaaaaacaagaaacagcctagtgttcattagggaataaacgcattcaagcagcatcaaaccctgcagccattacaaagagatctatgttgaccatgtggaatatctccaagagccacagtagcctcccttatctgtaggattcactccaagaccctctgaaaccatggataatactgaaccctatatacactatgttttttcttgtatatacatacctacgataaagtttaatttataaattggcaaagggtatataaatattccttctaagagattaacaataactaataaagtagaacgattaaaacaatatactrtgatcaaagttatgtgaagccaggtgctgtggctcaygcctgtaatcccagcactttgggaggctgagacaggtggatcacctgaggtcaggagttggagaccagcctggccaacatgacaaaaccccgtctctactaaagataaaaaaaattagccgggcatggtgacacatgcctgtaatcccagctacttgggaggctgaggcaggagaatcgcttgaacctgggaggcggaggttgcagtgagctaagatcacaccattgcactccagcctgggcaacaagagtgaaactctgtctcaaaacaaaacaaaacaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttcatctcaaaaaaaaaaaaagaaaaaagaagtccagaaacccgcggagacactatcacactatcccccccaggctggtagtgcagtggcccaatcatggctcactgcagcctcgacctcccaggatcaagtgatccttccacctcagcctcccgagtagctggaagtataggtgcacgcccgactgattttttttttttttttttagacggagtctcactcttgttgctctggctggagtgcaatggcaggatctcggctcactgcaacctctgcctcttagattcaagcgattctcgtgcctcagcctcccgagtagctgggattacaggtgcccaccaccatgcccggataattttttgtatttttaatagagacagggtttcaccatattggtcaggctggtctcaaactcctgacctcaggtgatccacctgcctcagcctcccaaactgctgggattacaggcgtgagccaccgggcatggcctttcctggctaattttttaaatttttgatagagatggggtctcagtgttgcccaggctgatcttgaactcctagattcaagtgatcctccctccttggtctcccaaagtgctgagattacaggcgtgagccaccgccccgggctggaaaatacttttttaaacgagggcaatgtgaatctgaaatgccatttgaggaaagatctgttcgcctgacatcctgtttgagcctgggtggacaggacagcacctgccagcatcgggaagcactgcagatgggaagaggcttggtcactctccaaaggtggcaggagttggagggggtgagctgaaggtaaggagaaaggaggtggggacccaggagacaggggctgcgcagcgggctcggggctgacacccccacggatacagttcactggggctcaaacataaaaggaacccaactattgtgggaggaaaagactcttctgcctttctgccttttctttttttctttttctttctttctttttttttttttttttttgagacagagtcttgctctatcgcccaggctggagtgcagtggcgtgatctcggctcactgcaagctctgcctcccgggatcacgccattctcctgcctcaacctcccgagcagctgggactacaggcgcctgccaccacacccggctatttttttgtattttttagtagagatggggtttcaccatgttagccaggacggtctcgatctcctgaccttgtgatccgcccgcctcggcctcccaaagtgctgggattacaggcgtgagccaccgcgcctggctcttttttctttctttttttttttccgagacagagtttcactcttgttgcccaggctggagtgcagtggcgcgatcttggctcactgcaacctccacctccagggttcaagcgattctcctgcctcagcctcctgagtagctgggactgcaggcgcgcaccaccacgcctggctaatttttgtatttttagtagagacagggtttcaccatattggccaggctggtctcgaactcctgaccttgtgatctgcccacctcagcctcccaaagtcctgggattacaggcgtgagccaccgtgcccagcctgacccctctgccctttcaaaaactatgttcgttctctcacagccttctcttgtcatattaagtccacaccgcaggcctaatttgtccagtgaatgctatgcaaatatttcatgcacctgctgatcgcaggaatgatatgtacttggtacgcactgatcgtacctcggggtgggagaagagagggcaaggaagcaaagaatagccccctcctttcctggtgcaccttcagatgtgccgatggggcccaggctcgctgcagatggcccccttcccagagacaggggaggatcstccacccactccccagcctccaggaccatcctgactcctgccttcaggcactcaagttatgcgtctagayatgcggatatattcaagctgggcacagcacagcagccccaccccaggcagcttgaaatcagagctggggtccaaagggaccacacccygagggactgtgtgggggtcggggcacacaggccactgcttcccccygtctttctcagccattcctgaagtcagcctcactctgcttctcagggatttcaaatgtgcagagactctggcacttttgtagaagccccttctggtcctaacttacacctggatgctgtggggctgcagctgctgctcgggctcgggaggatgctgggggcccggtgcccatgagcttttgaagctcctggaactcggttttgagggtgttcaggtccaggtggacacctgggctgtccttgtccatgcatttgatgacattgtgtgcagaagtgaaaaggagttaggccgggcatgctggcttatgcctgtaatcccagcactttgggaggctgaggcgggtggatcacgaggtcaggagttcaataccagcctggccaagatggtgaaaccccgtctctactaaaaatacaaaaaaattagccgggcatggtggcgggcgcatgtaatcccagctactgggggggctgaggcagagaattgctggaacccaggagatggaggttgcagtgagccaagattgtgccactgcactgcactccagcctggcgacagagcaagactctgtctcaaaaaaaaaaaaaaaaagtgaaaaggagttgttcctttcctccctcctgagggcaggcaactgctgcggttgccagtggaggtggtgcgtccttggtctgtgcctgggggccaccccagcagaggccatggtggtgccagggcccggttagcgagccaatcagcaggacccaggggcgacctgccaaagtcaactggatttgataactgcagcgaagttaagtttcctgattttgatgattgtgttgtggttgtgtaagagaatgaagtatttcggggtagtatggtaatgccttcaacttacaaacggttcaggtaaaccacccatatacatacatatacatgcatgtgatatatacacatacagggatgtgtgtgtgttcacatatatgaggggagagagactaggggagagaaagtaggttggggagagggagagagaaaggaaaacaggagacagcgagagagcggggagtagagagagggaaggggtaagagagggagaggaggagagaaagggaggaagaagcagagagtgaatgttaaaggaaataggcaaaacataaacagaaaatctgggtgaagggtatatgagtattctttgtactattcttgcaattatcttttatttaaattgacatcgggccgggcgcagtggctcacatctgtaatcccagcactttgggaggccgaggcaggcagatcacttgaggtcaggagtttgagaccagcctggcaaacatggtgaaaccccrtctctactaaaaatacaaaaattagcctggtgtggtggtgcatgcctttaatctcagctactcgggaggctgaggcaggagaatcgcttgaacccgtggyggggaggaggttgcagtgagctgagatcatgccactgcactccagcctgggcgatagagcgagactcagtttcaaataaataaataaacatcaaaataaaaagttactgtattaaagaatgrgggcggggtgggaggggtggggagaggttgcaaaaataaataaataaataaataaaccccaaaatgaaaaagacagtggaggcaccaggcctgcgtggggctggagggctaataaggccaggcctcttatctctggccatagaaccagagaagtgagtggatgtgatgcccagctccagaagtgactccagaacaccctgttccaaagcagaggacacactgattttttttttaataggctgcaggacttactgttggtgggacgccctgctttgcgaagggaaaggaggagtttgccctgagcacaggcccccaccctccactgggctttccccagctcccttgtcttcttatcacggtagtggcccagtccctggcccctgactccagaaggtggccctcctggaaacccaggtcgtgcagtcaacgatgtactcgccgggacagcgatgtctgctgcactccatccctcccctgttcatttgtccttcatgcccgtctggagtagatgctttttgcagaggtggcaccctgtaaagctctcctgtctgactttttttttttttttagactgagttttgctcttgttgcctaggctggagtgcaatggcacaatctcagctcactgcaccctctgcctcccgggttcaagcgattctcctgcctcagcctcccgagtagttgggattacaggcatgcaccaccacgcccagctaatttttgtatttttagtagagacaaggtttcaccgtgatggccaggctggtcttgaactccaggactcaagtgatgctcctgcctaggcctctcaaagtgttgggattacaggcgtgagccactgcacccggcctgcacgcgttctttgaaagcagtcgagggggcgctaggtgtgggcagggacgagctggcgcggcgtcgctgggtgcaccgcgaccacgggcagagccacgcggcgggaggactacaactcccggcacaccccgcgccgccccgcctctactcccagaaggccgcggggggtggaccgcctaagagggcgtgcgctcccgacatgccccgcggcgcgccattaaccgccagatttgaatcgcsggacccgttggcagaggtggcggcggcggcatgggtgccccgacgttgccccctgcctggcagccctttctcaaggaccaccgcatctctacattcaagaactggcccttcttggagggctgcgcctgcaccccggagcgggtgagactgcccggcctcctggggtcccccacgcccgccttgccctgtccctagcgaggccactgtgactgggcctcgggggtacaagccgccctcccctccccgtcctgtccccagcgaggccactgtggctgggccccttgggtccaggccggcctcccctccctgctttgtccccatcgaggcctttgtggctgggcctcggggttccgggctgccacgtccactcacgagctgtgctgtcccttgcagatggccgaggctggcttcatccactgccccactgagaacgagccagacttggcccagtgtttcttctgcttcaaggagctggaaggctgggagccagatgacgaccccatgtaagtcttctctggccagcctcgatgggctttgttttgaactgagttgtcaaaagatttgagttgcaaagacacttagtatgggagggttgctttccaccctcattgcttcttaaacagctgttgtgaacggatacctctctatatgctggtgccttggtgatgcttacaacctaattaaatctcatttgaccaaaatgccttggggtggacgtaagatgcctgatgcctttcatgttcaacagaatacatcagcagaccctgttgttgtgaactcccaggaaygtccaagtgctttttttgagattttttaaaaaacagtttaattgaaatataacctacacagcacaaaaattaccctttgaaagtgtgcacttcacactttcggaggctgaggcgggcggatcacctgaggtcaggagttcaagacctgcctggccaacttggcgaaaccccgtctctactaaaaatacaaaaattagccgggcatggtagcgcacgcccgtaatcccagctactcgggaggctaaggcaggagaatcgcttgaacctgggaggcggaggttgcagtgagccgagattgtgccaatgcactccagcctcggcgacagagcgagactccgtcataaaaataaaaaattgaaaaaaaaaaaagaaagaaagcatatacttcagtgttgttctggatttttttcttcaagatgcctagttaatgacaatgaaattctgtactcggatggtatctgtctttccacactgtaatgccatattcttttctcacctttttttctgtcggattcagttgcttccacagctttaatttttttcccctggagaatcaccccagttgtttttctttttggccagaagagagtagctgttttttttcttagtatgtttgctatggtggttatactgcatccccgtaatcactgggaaaagatcagtggtattcttcttgaaaatgaataagtgttatgatattttcagattagagttacaactggctgtctttttggactttgtgtggccatgttttcattgtaatgcagttctggtaacggtgatagtcagttatacagggagactcccctagcagaaaatgagagtgtgagctagggggtcccttggggaacccggggcaataatgcccttctctgcccttaatccttacagtgggccgggcacggtggcttacgcctgtaataccagcactttgggaggccgaggcgggcggatcacgaggtcaggagatcgagaccatcttggctaatacggtgaaaccccgtctccactaaaaatacaaaaaattagccgggcgtggtggtgggcgcctgtagtcccagctactcgggaggctgaggcaggagaatggcgtgaacccaggaggcrgagcttgcagtgagccgagattgcaccactgcactccagcctgggcgacagaatgagactccgtctcaaaaaaaaaaaraaaagaaaaaaatctttacagtggattacataacaattccagtgaaatgaaattacttcaaacagttccttgagaatgttggagggatttgacatgtaattcctttggacatataccatgtaacacttttccaactaattgctaaggaagtccagataaaatagatacattagccacacagatgtggggggagatgtccacagggagagagaaggtgctaagaggtgccatatgggaatgtggcttgggcaaagcactgatgccatcaacttcagacttgacgtcttactcctgaggcagagcagggtgtgcctgtggagggcgtggggaggtggcccgtggggagtggactgccgctttaatcccttcagctgcctttccgctgttgttttgatttttctagagaggaacataaaaagcattcgtccggttgcgctttcctttctgtcaagaagcagtttgaagaattaacccttggtgaatttttgaaactggacagagaaagagccaagaacaaaattgtatgtattgggaataagaactgctcaaaccctgttcaatgtctttagcactaaactacctagtccctcaaagggactctgtgttttcctcaggaagcattttttttttttttctgagatagagtttcactcttgttgcccaggctggagtgcaatggtgcaatcttggctcactgcaacctctgcctctcgggttcaagtgattctcctgcctcagcctcccaagtaactgggattacagggaagtgccaccacacccagctaatttttgtatttttagtagagatggggtttcaccacattgcccaggctggtcttgaactcctgacctcgtgattcgcccaccttggcctcccaaagtgctgggattacaggcgtgaaccaccacgcctggcttttttttttttgttctgagacacagtttcactctgttacccaggctggagtggggtggcctgatctcggatcactgcaacctccgcctcctgggctcaagtgatttgcctgcttcagcctcccaagtagccgagattacaggcatgtgccaccacacccaggtaatttttgtatttttggtagagacgaggtttcaccatgttggccaggctggtcttgaactcctgacctcaggtgatccacccgcctcagcctcccaaagtgctgagattataggtgtgagccaccacacctggcctcaggaagtatttttatttttaaatttatttatttatttgagatggagtcttgctctgtcgcccaggctagagtgcagcgacgggatctcggctcactgcaagctccgccccccaggttcaagccattctcctgcctcagcctcccgagtagctgggactacaggcgcccgccaccacacccggctaatttttttgtatttttagtagagacgggttttcaccgtgttagccaggagggtctcgatctcctgacctcgtgatctgcctgcctcggcctcccaaagtgctgggattacaggtgtgagccaccacacccggctatttttatttttttgagacagggactcactctgtcacctgggctgcagtgcagtggtacaccatagctcactgcagcctcgaactcctgagctcaagtgatcctcccacctcatcctcccaagtaattgggactacaggcgcaccccaccatgcccaccttatttatttatttatttatttatttatttattttcatagagatgagggttccctgtgttgtccaggctggtcttgaactcctgagctcaagggatccttttgcctgggcctcccaaagtgctgagattacaggcatgagccaccgtgcccagctaggaatcatttttaaagcccctaggatgtctgtgtgattttaaagctcctggagtgtggccggtataagtatataccggtataagtaaatcccacattttgtgtcagtatttactagaaacttagtcatttatctgaagttgaaatgtaactgggctttatttatttatttatttatttatttatttttaatttttttttttgagacgagtctcactttgtcacccaggctggagtgcagtggcacgatctcggctcactgcaacctctgcctcccggggtcaagcgattctcctgccttagcctcccgagtagctgggactacaggcacgcaccaccatgcctggctaatttttgtatttttagtagacggggtttcaccatgctggccaagctggtctcaaactcctgaccttgtgatctgcccgctttagcctcccagagtgctgggattacaggcatgagccaccatgcgtggtctttttaaaattttttgattttttttttttttgagacagagccttgctctgtcgcccaggctggagtgcagtggcacgatctcagctcactacaagctccgcctcccgggttcacgccattcttctgcctcagcctcctgagtagctgggactacaggtgcccaccaccacgcctggctaattttttttggtatttttattagagacaaggtttcatcatgttggccaggctggtctcaaactcctgacctcaagtgatctgcctgcctcggcctcccaaagcgctgagattacaggtgtgatctactgcaccaggcctgggcgtcatatattcttatttgctaagtctggcagccccacacagaataagtactgggggattccatatccttgtagcaaagccctgggtggagagtcaggagatgttgtagttctgtctctgccacttgcagactttgagtttaagccagtcgtgctcatgctttccttgctaaatagaggttagaccccctatcccatggtttctcaggttgcttttcagcttgaaaattgtattcctttgtagagatcagcgtaaaataattctgtccttatatgtggctttattttaatttgagacagagtgtcactcagtcgcccaggctggagtgtggtggtgcgatcttggctcactgcgacctccacctcccaggttcaagcgattctcgtgcctcaggctcccaagtagctgagattataggtgtgtgccaccaggcccagctaacttttgtatttttagtagagacagggttttgccatgttggctaagctggtctcgaactcctggcctcaagtgatctgcccgccttggcatcccaaagtgctgggattacaggtgtgaaccaccacacctggcctcaatatagtggcttttaagtgctaaggactgagattgtgttttgtcaggaagaggccagttgtgggtgaagcatgctgtgagagagcttgtcacctggttgaggttgtgggagctgcagcgtgggaactggaaagtgggctggggatcatctttttccaggtcaggggtcagccagcttttctgcagcgtgccatagaccatctcttagccctcgtgggtcagagtctctgttgcatattgtcttttgttgtttttcacaaccttttagaaacataaaaagcattcttagcccgtgggctggacaaaaaaaggccatgacgggctgtatggatttggcccagcaggcccttgcttgccaagccctgttttagacaaggagcagcttgtgtgcctggaaccatcatgggcacaggggaggagcagagtggatgtggaggtgtgagctggaaaccaggtcccagagcgctgagaaagacagagggtttttgcccttgcaaatagagcaactgaaatctgacaccatccagttccagaaagccctgaagtgctggtggacgctgcggggtgctccgctctagggttacagggatgaagatgcagtctggtagggggagtccactcacctgttggaagatgtgattaagaaaagtagactttcagggccgggcatggtggctcacgcctgtaatcccagcactttgggaggccgaggcgggtggatcacgaggtcaggagatcgagaccatcctggctaacatggtgaaaccccgtctttactaaaaatacaaaaaattagctgggcgtggtggcgggcgcctgtagtcccagctactcgggaggctgaggcaggagaatggcgtgaacctgggaggtggagcttgcagtgagccgagatcgcgccactgcactccagcctgggcgacagagcgagactccgtctcaaaaaaaaaaaaaaaagtaggctttcatgatgtgtgagctgaaggcgcagtaggcagaagtagaggcctcagtccctgcaggagacctctcggtctctatctcctgatagtcagacccagccacactggaaagaggggagacattacagcctgcaagaaaagtagggagatttaaaaactgcttggcttttattttgaactgttttttttgtttgtttgttttccccaattcagaatacagaatacttttatggatttgtttttattactttaattttgaaacaatataatcttttttttgttgtttttttgagacggggtcttactctgtcacccaggctgagtgcagtggtgtgatcttggctcacctcagcctcgaccccctgggctcaaatgattctcccacctcagcttcccaagtagctgggaccacaggtgcgtgtgttgcgctatacaaatcctgaagacaaggatgctgttgctggtgatgctggggattcccaagatcccagatttgatggcaggatgcccctgtctgctgccttgccagggtgccaggagggcgctgctgtggaagctgaggcccggccatccagggcgatgcattgggcgctgattcttgttcctgctgctgcctcggtgcttagcttttgaaacaatgaaataaattagaaccagtgtgaaaatcgatcaggaaataaatttaatgtggaaataaactgaacaacttagttcttcataagagtttacttggtaaatacttgtgatgaggacaaaacgaagcactagaaggagaggcgagttgtagacctgggtggcaggagtgttttgtttgttttctttggcagggtcttgctctgttgctcaggctggagtacagtggcgcaatcacagctcactatagcctcgacctcctggactcaagcaatcctcctgcctcagcctcccagtagctgggactacaggcgcatgccaccatgcctggctaattttaaatttttttttttctcttttttgagatggaatctcactctgtcgcccaggctggagtgcagtggcgtgatctcggctgacggcaagctccgcctcccaggttcactccattcgcctgcctcagcctcccaagtagctgggactacaggcgctgggattacaaacccaaacccaaagtgctgggattacaggcgtgagccaccgcacccggcctgttttgtctttcaatagcaagagttgtgtttgcttcgcccctacctttagtggaaaaatgtataaaatggagatattgacctccacattggggtggttaaattatagcatgtatgcaaaggagcttcgctaatttaaggcttttttgaaagagaagaaactgaataatccatgtgtgtatatatattttaaaagccatggtcatctttccatatcagtaaagctgaggctccctgggactgcagagttgtccatcacagtccattataagtgcgctgctgggccaggtgcagtggcttgtgcctgaatcccagcactttgggaggccaaggcaggaggattcattgagcccaggagttttgaggcgagcctgggcaatgtggccagacctcatctcttcaaaaaatacacaaaaaattagccaggcatggtggcacgtgcctgtagtctcagctactcaggaggctgaggtgggaggatcactttgagccttgcaggtcaaagctgcagtaagccatgatcttgccactgcattccagcctggatgacagagcgagaccctgtctctaaaaaaaaaaaaaccaaacggtgcactgttttcttttttcttatcaatttattatttttaaattaaattttcttttaataatttataaattataaatttatattaaaaaatgacaaatttttattacttatacatgaggtaaaacttaggatatataaagtacatattgaaaagtaattttttggctggcacagtggctcacacctgtaatcccagcactttgggaggccgtggcgggcagatcacatgagatcatgagttcgagaccaacctgaccaacatggagagaccccatctctactaaaaatacaaaattagccggggtggtggcgcatgcctgtaatcccagctactcgggaggctgaggcaggagaatctcttgaacccgggaggcagaggttgcggtgagccaagatcgtgcctttgcacaccagccaaggcaacaagagcgaaagtccgtctcaaaaaaaaagtaattttttttaagttaacctctgtcagcaaacaaatttaacccaataaaggtctttgttttttaatgtagtagaggagttagggtttataaaaaatatggtagggaagggggtccctggatttgctaatgtgattgtcatttgccccttaggagagagctctgttagcagaatgaaaaaattggaagccagattcagggagggactggaagcaaaagaatttctgttcgaggaagagcctgatgtttgccagggtctgtttaactggacatgaagaggaaggctctggactttcctccaggagtttcaggagaaaggtagggcagtggttaagagcagagctctgcctagactagctggggtgcctagactagctggggtgcccagactagctggggtgcctagactagctgggtactttgagtggctccttcagcctggacctcggtttcctcacctgtatagtagagatatgggagcacccagcgcag

SEQ ID NO: 17977 - DNA, 29142 bp, Homo sapiens
tcaaggggttattatgtgctgggccctgggttgggccctttcctatgttatcttcaatagtcgcccaccttcccccacagcttgaaggggctctagacaagggacatgaagtgaccctggaggcactcccaaaagatgtcctgctatcaaaggaggccgtgggcgccatcctctatttcgttggagccctaacaggtaagtggggaataaggtcttcatttatagaccttttcagtaataggaatgaatcacttgaatcaattcccaaatggatgaataaatgaatgaatgacaaattataccacagttaagtagtttatatctacatttttataaattggtttcatggctggctgcagtggctcatgcctgtaatcccagcactttgggaggccaaggtggatggatcacccgtgatcaagagttcgagatcagcctggccaacatggtgaaaccccgcctcttccaaaaatagaaaaattagccgggcgtggtggcaggtgcctgtaatcccagctactctgaaggctaaggcaggagaatcgcttgaacccaggagggggagggtgcagtgagccgagatcactccattgcactccagcctgggcaacagagcgagactccatcaaaaaaaaaaaaaattggtttcattcctaaggatttgcttggtcacattgggtagtctgagaagacagcctagtcttgctaatagaggttgaataaccctagttttatcagcaacatatttaaaatttctgcatatagctaagctcatcacttctatcctgatacctgttagctttaacttcagggagtaacattttcttatcttgcccctaagagctcttcttccctccacattttctagttttccacttagaaaaactctgtggtccttcaggtgtaagccaaaacgtttgttcccttaggaagcctgccctccgactccaagaccaaagtggacccctcagctatggctcccttaacacctgcgttgtaattacatccaatgaatgaaggctgaaattctggaagtgcgctatttggaggctgtagtcccctctgcaccagcaacacacatctttctctgctttttttctccagagctaagtgaagcccaacagaagctgctggtgaaatccatggagaaaaagatcctacccgtgcagctaaagctggtgagggaaaaacagcagatgctggggagagtctgggagtagctgcagccagtggagatgcagatttcgcctaaggatggagccattctggaggatccctgtcttatcccaggggcttatgcccactcctcctttctctctctatttctcattttttgttatttcacaagaggtagaagactgaatttctgggcaataatctgggtttattagcctgatcttgggagaagagacagaaactgtggctttgcttattcctagccaaatattgtaagcaaatttttttttttttttttttgagatagagtttcactctttttgcccaggctggagtgcaatggtgcgatcttggctcaccacaacctccgcctcccgggttcaagcgattctcctgcctcagcctcccgagtagctgggattacaggcgcccaccaccacaccctgctaattttgtatttttagtagagacagggtttcaccatgttggccaggctggtctcaaactcctgacctcaggtgatctgcccacctcagcctcccaaagtgctgggattacaggtgtgagccacctcgcctggcctgtgagcaaattttttactgtgtctgagtctgtctcaatttattcctctgtaaaatggggctaaaaatcaatgtgctgcccactgtatagggctgttcaaagacccagatggggttgtaatgtaaggtaaagtaaggaattctaataaggggaatgtaaccttcttgtgatttttgtgagttaggagaggagagaggtttccagttctttcttttcatgctgttttgattccctccaggtggagagcacgatggaacagaacttcctgctggataaagagggtgttttccccctgcaacctgagctgctctcctcccttggggacgaggagctgaccctcacggaggctctagtcgggctgagtggcctggaagtgcagagatcgggcccccaatatatgtgggacccagacaccctccctcgcctctgtgctctttatgcaggcctctctctccttcagcagcttaccaaggcctcctaatttgccttttacgtctgcttcatgactccctaatgccttcccaacctcgtggtgctgtgtccttaccacctaagggcatttcagagccatcagctgaagacatctgaaatctcagctggtcacccatgataaccaacttccacctgcccaaccatatatcaccccctacccctccagctccgcaacccactaagcccatctgctgatgcttaaattttctttacttttcttttctttttttttttttttttgagatggaggctcactctgtcacccaggctggagtgcagtggcttgatcttggctcactgcaacctccgcctcccaggttcaagcaattctcctgcctcagcctctcgagcagctggaattacaggcacgtgccacgacacccagctaatttttgtatttttagtagagacggggtttcaccatgttgcccaggttggtctcgaactcctggcctcaagtgatctgcccgcctcggcctcccaaagtgctgggattacaggcgtgagccaccgtgcccggcctgtgcttaaatattctaggagtagaagcactcagacttttaaaactatgagccgtttcagcaaaactgagaaaaaaagaagattaattaatttcctatcctaatccctcctacttatacttccccaaaaaacaagctttactggaattaatggaaaatattatgtcaatcttaggaatgatatgtcttttggtgtttttctttaaagaatttatcatacagaaattcttaatttgtgccagaaaaagaaattgttatcatactgcatataaatcatatgtacatgaatatgatgctgtactgtcctcaggcaaactggaaaatgctcagagggtatagaatgtggaatccagatttttttttctgttcaattagttttctttaatggaatctagagtctcaagtgagaagatatcaaagcagtttgtcttcaaagaagagcatttgggagtcccctagctctgggttgagggaaagaccgagagatatatagtagaagcccgaaacaaaaataagacagatttcaaatttattgaacagaaaatgcagatgggcctttaaaaaaaagggggacccaagaataagactaacccaaaactttaaaaactaaattgtgatattatttcacctttctctgttctgccctgaaatttagggttcttgtaggaggaagtagtgtgggtaggcttggcatattactactaatatggatattacaatctcatcaaaccgctgggtttatatcatcctcctctgcctaaaagctgggtttgaacatctttcaccaacctcttttaaagcagtatcaggaccggacaccgtagctcacgcctgtaatcccagcactttgggaggctaatgtgggcagatcgcttgaatccaggagttcaagaccagcctgggcaacagggcgaaaccctatctctacaaaatataccaaaaattagccaggcatggtggcatgtgtctgtggtcccagctactcgggaggctgaggttagaggatcacttgagcctgggaggctgaggctgcagttagccaagatagcaccactgcactccagcttgggtgatggagcgagatcctgtctcaaaaaataaaaataatttttaaaaaagtagttctatgagtgcagtacatgtctgtaatcccagcactttgcaaggccgaggcaggaggatcacctgaggtcaggagttcaagaccagcctaatcaacatagtgaagccctgtctctactaaaaattaaaaaaaaaaaaattaaaaattagctggacatggtggctcgcacctgtagtcccagctactcaggagaaggaggcaggagaatcgcttgaaccccagagggggaggttgcagtgagccaagatcacgacactgtactccctagcctggccaacagaacgagattccgtttaaaaaaaaaaaaaagttttatgagtggaagaatttctctaaggattttggtccgtggagtcagactctcccccagtgtcttagtcaccccctgcccagcctggttccctcatccaccaagaattcatgaccaactgccagaagctttgtgttatgccgccagcctccctgatcctgagcaccttccaaagcctcactctattgctcatggatatactgggttgttatctgctgacttggttgttttctccttgtgatgtaaacttaatagagagatgagctaacaccctaactatctagaagagtaactcctttgattgttaaggatgaacataactcatctgttttcttccttaccattctcgcccaccttcagttgcagatatggtgttatgaagaggttctaatgagtttattccaatgatgattcaaaagtcctgttatccaccccccagccctggagggtgagaggacagttgaggaggaactggtcaaggcatgttccctaaaactagagcacatatctttccagttagcgagtggctgtttaacgcaaggaacatcctgcaatcctatgaaagaggatgcaaaagatatgcaggataccctttatatatgcaaaggaggaggtcaaaacatatttcctgccttctaggtccttacaacagggctagattgtcttgtagggtccgtgaaaggtctaaaactcaggacttccacttatgggagagagaaaagtttcaaggtagggagagagtttttgttttgtgttctaagaaattgggagctatatccttcaccttgtttcaccttccctgcagaaccagtggggcagtcctttgaaaaataagtgggtagggtttcttgtccaatttgcttccccttaggtacaccactaagtaaaccatcattctctccttaggcacaccattattctgttccccatttcacaatgtctgtctggatgtataaaagccctctcaatgggctccctaaagcgtctgccagtaggggctcccaccctctttcctcaacactcccaatccaccgcagcccagagcacagtgtctgcttatctaaccatctgactcccccgtatactacattcttgagctgtttttcacccccctatttgctaaccgtgggccgtacatagggtggacccctatattttgttaaactggagtgattctacgcaaatgcacgctcctacctatcggcactcccagcctgcagaaattgtatgccttatgttcagcactaaactcaaatctaaccaaggaagtccggatcccataggggtcttcctactctccagttcggtttattttaaggccaacagccctagcttcacgtccctccttcacagccttctttccttccctcctgccggatgcgcccggcagccgttgagcacaagcccagcggatctggaaggagaccccgccgcgaccggggaaaattgagcgaacttgggcgcaaaacccgcccggcaactcgtgacgtcatctcgtcccgcgctcggataggctgtacccactccacgctggttgaggcgctcttaaagtcctttgtaacccagattggagcctgaggggacctctcgtggacgcccacagaaatgcactcgagaggaacataaaagcatcacacttaagcgctcgaaagaaagccccacgaacccataaaggctcctccccgctccttcctcgaagctcctccttcatcctgcacctcggctgtggatttatttcccctttgttgactcggccatcggcctgccgggcctggcgtttcccagaaggcccagcgccgggaaggggtttgcagctgctccgtcatcgtgcggcccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgccgcccggcggaggagaacaagaacccccaccgccgccggccccccaggatgtggagatgaaagaggaggcagcgacgggtggcgggtcgacgggggaggcagacggcaagacggcggcggcagcggctgagcactcccagcgagagctggacacagtcaccttggagggtacggcagcccaggccgggaacgtgccgcgatcgcgggtgacagcgacccctgtgatttggcttcttgctgggaagccacagcagcctccaccaccctcagttctttgggatcacccccagatacctgcttccactggccgacactccgattcaggcccaatgactgaaccttctctccaggctgggaaacactcccctcccatcccctccatccccatatctggggttgcatctatatctaggtcccagtgggcctggggactccctcttttaagtcctcccctctgacctattccgtttatatcccacccgactgattttagcgcctccaatatatgactgattgttcccgctggaaaccagtgtttgtgtctgtgtgtaaacagggccaggatgacctagaatattgactcctgagttttaaaactgtacagcagatttttgttgtcctagctgcctttagcacactcccccgaatgaaccatttcgacctagtatcttgtttcctacttctctaactgaagtgtcccaacagtccccttgctgtctcctcccttcaggtccttactgcccctctgtttctaaagggtttaagtacatacacacttaaaacttttcgggtgtcatctttgtttggttttgtaatactcaacctttggcctaaactcctatataccggtgtctcctatttcttttctccgaggttcctgtttcgagtgtctgtagtcctcttgttcctccaagttcatgttttacttttcccacttacagcgtcctgtttccatttgaagtgggcaaagtgagagcttcccactgtgatcctggtgccattttcctggttctggatcaagtgggaccagactacttactaggttttcttttcactaaaatgcgtgagaaactagctcaaaaacattgagataagcaaagttatcctcctaggtggtgcttttgaggatgtgatggtgttgactacatcagctcttactgtaaagttgagcaacaggatcgatatttaatagagatccttttacctaaagtagtggcagcaatgtcaaaggtgccactcagcattgcctactgggtgtgtttattacaggcacttcattttcttcttgtaaagtaattcatattcattgcagaaattgtggaatgtatgagaagttaaaagcaggrgataaaaaacatggttaacattttttcttgtgaatttttgagctgttctcctataattgagagcaagttatgtatacagtttgtatcaaggcataactaaatataaattttgaattttatgtgttttcattaacattcgtaaacataatcagcattcaatttattccagaaacatttattgaatacccaatataatggttaagagtacaagttctggaattagttccctcatctgtataaatacaagtaatagtacagtactttattgggttgttgtgaacattaaaatgcttaaaactgtgcctagcacataaatatcagctgttattatttatatcattagtgtggcccagataccctgtgctaatcgctgaatatacagaagtgcctaagaaactaytcattgattgcattcccttattgctttgcatttaaactgtttctagtttcttgctatcataaatagctttgaagcaatcatctttgtgcccaacttaaaaaatctacttttctaattatttcttcagtacagattcccaccaaaacctatatgcctgagtttaaaaggctgaacattttaaaggtttttgatagttattgtccagaaaaactgtgctgatttacattataccaggagaaatgtagttttcactgtactctataatttttttttttttttgagacggagtctcgctctgttgcccaggctggagtgcaatggcgcgatctcggctcactgcaacctctgcctcccaagttcaagcgattctcctgcctcagcttcccgagtagctgggattacggtcacccaccaccacgcccggctaatttttttatttttagtagagactgggtttcaccatgttggccaggctggtctccaactgctacccttaatgatccgccctcctcagcctcccaaagtactgggattacaggcgtgagccactgtgccccacctataatttttttaatgttacaaatttggtagtttaaaaatgtttccatttgcaattactcaaatactaatggaatataatttttgtctgttagctatttttcctctttgtatgttagttcgtctccatttttgttttgaaattgtggcaatataatcattataccattatatctcttaaccatttatacaagctctttatagaataaaaatatgaatctttgatcacatttgttgaaaatatttttcttttgtatacacagttatctaaaagggtttttttaaatgaagtcaagcccattaatcttttgtgcgtatgtgatttctcccattgttcacatttagaaagtcttttccattaagatctgataaatctggactccaggtttctgtagttaattggtttttcttttcttcctctgtcatcctctaccccatcctgcacccccactgtatgtttttcttgccacttggttatgtcttaaaatcagtgtgtggaatctgtaaatattatggaccccattagggcagaaaaggtgagtggtcgcattttgcccctctgtgagaggctccttagaactccttgcctggccggcacggtggctcacgcctataatcccagcactttgggaggccaaggcgggcagatcaggaggtcaggagatcgagaccatcctggctaacacggtgaaaccccgtctctactaaaaatacaaaaaatttagccaggcgtggtggcgggtgcctgtagtcccagctactcgggaggctgaggcaggagaatggtgtgaacccagcaggcrgagcttgcagtgagccgagatcacaccactgcactccggcctgggcgacagagtgagactccgtctcaaaaaaaaaaaaaaaaaaaaaaagaactccttgcctggagtggtgggggactaggagtgaaagtgacatcactttcttctctgctcttcttcagacatcaaggagcacgtgaaacagctagagaaagcggtttcaggcaaggagccgagattcgtgctgcgggccctgcggatgctgccttccacatcacgccgcctcaaccactatgttctgyataaggctgtgcagggcttcttcacttcaaataatgccactcgagactttttgctccccttcctggaagaggtgagtgagtcaggccaacttaaagggtgcaggcctggcctcagatccccaggaacagcattgttttccatcctaaagtcccatcttattacctgtggtagcatgaggagagaagccaaagcagtccatttgaatactcatctgcacagtgacaagggaaccgtccactgccctgtagtgtcattcttcmaagtcaggggatcaggaccctcccagccaaactcatttcccactaccctgcaacctgtaccccctactccagttgaggttgcgttgggtgacctctctgttgttctaggagagagaaggtgctgctgcctctttcttctgaagcttcaccatggaggaggtagagaacagtggttaggaggagcacagctgtcagggccaggcacagtggctcacacctgtcttcccagcactttgggaggctgaggcgggcacagtggctaacatcgtcatcccagcactttgggaggctgaggcgagcagatcgtttgagtccagcctggattcaaacaatctgcccgcccaggagtttgagaccagcctgggcgacatggtgagaccctgtctctgcaaaaagtacaaaaattagccaggcatggtggcacctgcctgtagtcccagctactcgggaggctgaggcaggaggatcacttgaatgcaggaggtggagattgcagtgaaccaagattgcaccactgcactctagcctaggtgacagggtgacccccctacctcaaaacaaaacaaaaaaaaccccacagattttagaggtagagttgaatttgaatccaaaccctgacagttagtacctgtgggacttgggcgagtgacttcattttgctgtgcctcgttttcttcatttgttaaacgtgatgaacggattgggaagcgggcagtataaagctcctagagcagtgcctggtacgtagtgaatgcagacgaagtcagtttggtggtggtggtggcgcctccgtgccaggagagacctctccttatcctctgtagctgtaaactctccctcatgattcatggcatgggccaggtctcagccttctccaattccactgaccttccagcacctgcatttccttaaaatcctgtatactcagtcagctccgtggatggggaaactcagaacatccctggaggcagggcagtgaagagtttcttgtctgggaaaggggaaaagcgtactgttcccccaactcyaccttgaatattttctgaccttcacatcgctaaactcacgaaacgtgattattttgggggtgactgtaacacattattttttccagtgtcagtgacaacataggaaaatatgttttgtttatatgttgactttccctaaattttctttgttcccacaagaaaccaktttttggtctcattattctgatttcatctctagaattatttcgttcagccctgtccagtagtatttgcagtggatccaggtgtggtggtttaatgtctccacttaggttgtagcctctttgaaggttccttacatcgtcctttgtctccattatgttgtgtaaagaaattttttgttctcctgtaacactttattgtgtttattaatattatattgccagcctccttgacttgttttgtttttttgagatggggtcttgctctgtcacccaggctgaagcacggtggcacacttatggcccagtgcaggctcagactcctggtatcaagcagtcctcctgcctcagcctcctgagtagctgggaatacaggtgcatgccaccatgcctggctagttcttttttattttttgagagatggggtctcactgtgttgcccagactggtctcaaattcctggcctcaagcattctcctgcctcagccttccaggtagctggcactaccggcgtgagccaccacacccagctcctccttgatttctttgggaaagactgtmatctttatttttttatccctagcacctaacaaaatcttggcacatggtagacactcaataaatatgttgaaatacatagtggatgctcaataaattcttggttacttgatcagactgagcttttccatggtaacttctgtcctctcctagcccatggacacagaggctgatttacagttccgtccccgcacgggaaaagctgcgtcgacacccctcctgccygaagtggaagcctatctccaactcctcgtggtcatcttcatgatgaacagcaagcgctacaaagaggtatccaggatgyrgtgagagcgattcataagccccaagtgatgcaaggggtttggcrgggagatggtccctggtgaagaaatggaaataatcattgattcttaagaactgtcccccacactctttccccatagaggtatgcgtttgatcccacatcccaggagaacccactcttgctctgggcactgtgggacagggcttgcagtggtcatgctgtaccggtctgtgggggataccagcgtagtacattcttggggaaaagtaggggcatttggagacagaaagacctgggttccaatcccagccataccctaggcaaattaatttctcccagctatatgtaagatggggataatagtgcctaccttacaagatggttagcgttacataaaataatttgtttagaaatacttagcacaatgatctgcatatagtaagctttcgtgatattttcataaatggtagctgttattatggactaatagctccatttgcaaactgcacttctaccactccccagctagggccagcttctttgttcatcatagccactgtcacaggagcatactcaggaagtaagttgcactccttaattccctggtttgtttcctttccttaccacactatttttggttgttgtttggttgggggtttttttgagattgggtcttgctttgttgcccatgctggagggcagtggtgtgatcacagttcacttgacctccccggcttaagtgatccttccacctcagcttcttgggtagctgggactacaggcatgtgccaccacgcccagctaatttttgcattttttttgtagagacaggatttcaccttcttgccaagctggtctccaacccctgggctcaagtgatttcctgggctcagcctcccaaagtgttagggttacaggcatgagccactgcgcctggcccactgttttgtttttactggagatggggtcttgctatgttaaccaagctggtcttgaactcctgggctcaggtaatcctcccgcctcagcctctcatgtagctgggattacaggcacgtgccactgtacttggctgtttgtttttgagatataattcacccctttaaagtgtactacaggccaggtatggtggctcacgcctgtaatcccagcactttgggaggccaaggcaggcagatcatgaggtcagacaatcaagaccatcctggccaacatggtgaaaccccgtctttactaaaaatacaaaaaattagccgggcgtggtggcatgtgcctgtagccccagctactcagaaggctgaggcaggggaattgcttgaaccagggaggcggaggttgtggtgagccgggattgtgccactgcactccagcctggtgacagagcgagactccgtcaaacaaataaataagtatactacaattgagtgggttttagtatattcccaaagttgtatatccacccctaattccagaacattttcatcaccccacaaagaaacaccatacgtattagtagtcacttttcattttccccttacccagcccctggccgctactaatctgccctgtctctattgaggatttacttactctggacatttcatgtaaatggaattacacaccgtgtgcccttggtttctggcttttttcacttagcatcatgttttcaaggttgacccatgttgtagtgtgtgtcagtacttccttcctttttaaggctgagtaatattccctcgtgtggatgtgccacattttgtttatctgttcatcagctgacgggcacctgggttgtttctactctttggttatgaataatgcttctgtgaacattcgtgtacatgcttttatgtgagcctaagtttccagttctcttggcttgcatacctaggataggaattgctggctcaaatgacaactccatgtttatccttttgaggaactgccacttgattctcttttggcttcctccccaggcacagaagatctctgatgatctgatgcagaagatcagtactcagaaccgccgggccctagaccttgtagccgcaaagtgttactattatcacgcccgggtctatgagttcctggacaagctggatgtggtgcgcaggtacaggcagccaagcatctcacttggggtccgtggggtcagagacttggtcagtcacaagcacacagctgtggatctgcagagggcgaagaacctgtagatgtaagcagggaagaggggcagtggttcccatgccctgcgccacgtgaggggtgtgggagagagactggtgctagatgaagaagtgggtcactgctgggctgtaaagaactgtccccaggttcttcccttcaccccacatcaaggtaggactgagggtgggttaggggtggagggacaggctagaaaacattttacttctttgctcaaaacctgcagtggcttcccgtctcaaggaaagacaaagtccttacaatacctcataaggcctgacgtgatctgctccattttgacctcccagacttcacctcctcctgctcctcagccccactggcctgcctttcctctggtgtgcccggcacactcttcttcagagcctttgcactggctgcccctctgtccagaacactcttctctccgcctccttcaagccttcccttaactgatcccttctcagtgagtcctgccttggccaagctattgaaaagttcaactcatctttctcacgtcctgcattccccattgcagttcccctggcctcacaggcctcccatcttctgtcacactgcaggctgtgcttctttctcatgaccattgcctcccccactgcactgcattccctaagggcagggttttgtccctttgtcgcacccagaatagtgctgtacaccttaggcactcgatagttaacagtattcagcaaataaccagaaaagcaatttgtataacttttttaaggaattgagaaagagcgaagagttaaaggcagttcagagagttgtsatttgaaggctttgacatctttctttccttcttgaagcttcttgcatgctcggctccggacagctacgcttcggcatgacgcagacgggcaggccaccctgttgaacctcctgctgcggaattacctacactacagcttgtacgaccaggctgagaagctggtgtccaagtctgtgttcccagagcaggccaacaacaaygagtgggccaggtacctctactacacaggtgagcagaggggcccaacccataaatcagaaggtgtctcaggcctgcctggtgcaaattttccaaggggtggtgcataagaggcccatttggcaccctggcttgtcggtggggagttggatgaccctactctgttgaccaactctcctctcctccactcccagggsgaatcaaagccatccagctggagtactcagaggcccggagaacgatgaccaacgcccttcgcaaggcccctcagcacacagctgtcggcttcaaacagacggtgagccacaactaccatcatccctttgcctctttttttttttttttttttaaatggtgtcttgctatgttacctgggctggtcttgaactcstgggttcaagaagtcctcccacctcagcttcccaaagtgctgggatcacaggtatgagccaccatgcctgrcccctttgcctgttactcattccctaccacttcagttctcttctctatgctaggggctaggaaaggcatccttaaccttcctatccagaaggacttcaacttttattattattttttgtgtgtgtggagacaggcatatcactgttgctcaggtgagaactcctgggctcaagcaatccttcggcctctgcctccctaagtgctgagattgcaggtgcgagctgccatgtctgcaaaaggttgcttcacatctatttgtgggtgtcaatgaagcagacactacctgcacctctggcagtggatattcagagtgttyctggcagataggtttagaatattcctgattccccagcgctcctgacagtcattccaggcttggacctagattgtgttgatacaaaccccaggtttttatctagtccttcatgttcacatttggaaactgtattgtctgtggccaaggaacccagaaaatctctgcaaggctgagtggctcaagtaaacataaaacttggccacttaagagctgtcagtcagcaagtatttaagcatcaaccttggtattaggcactgtaagggataggaagggaggataataagtgatctttctttcttttctttcgttttttgttttctgagacagagtctccctctgtcactcaggctggagtgcaatggcrygatcttttctcactgcaacctctgcctcccgagttcaagtgattctcctgcctcagcttcctcagtagctgggcaggcgcctgccaccacatccaactaatttttttgtttgtttttttggttcttttttttgaaacggagtcttgctctgtctcccaggctggagacagaggtgccatcttggctcactgcaacccctgtctttggggttcaagggattctcctgcctcagcctcccgagtaactgggattacaggcgcctgccaccacgcccagctaattttttgtatttttagtagagatggggtttcaccatgttggccaggctggtctcgaactcctgacctcaagtgatccacccayctcagcctcccaaagtcctgggattacaggcgtgagccaccgctccaggccaggtatttcttattattagagtatttcaaagagataaagaatgttgtgtcagaaagcttgagggtgtatgtgaagtcacagagcccagtagccaggatgtagacccagtcttcccaaattcaaacctctgctcctaccttcacacaacatccacctccatggtgtcttgacagggaacgggagacgtgtgttgattaggtcaatgtagtaggagattcattttatttctgttcagaagttcagagaaagtcagatttgtttttgatcaaataatgaaagagaaagggtcttaaagaaaaagttggctaggtacagggctcacacctgtaatcccagcactttgggaggctgtggcaagaggattgcttgagaccaacctgagcaacatatggagacaccgcctctgcaaaaattaaaaacctagctgggcgtgatggcatgcacctgtagtcccagctacttgggaggctgaggtgcaaggatcacttgggcccaggaagtygaggctgcagtgagccatgatcgtgccactgcactgcagcctgggcgacagagcaagactctgtctcaaaaaaaaacaaacattaaaattgaactggtctttgaaagatgggtaggattttcacaaggagtaaaggcttttcagacacacagggtgcgtgagcaaaatgttagattgcttacaatatgagagacactaaagtttcttttgaaaatcactaaaaatactagtaattaacatatataaaatgtgtcatgtaccatgagagaggctttcaggcatttaaatctcagtggcaggaaggcgtagagagctggaagagaggtctcgggctgttggtgagggagcgcagggagagagagggcgggagtgaaggcatgtttgggagaaggcctgcaaccagccctctgccctctgccctcacacacctttgccgtacccctgtcaccacccagcttacagaatcacctggggctctgatgaagctgtagattccgattcagagagtctgtgttcctaacaggccttgggtgatgccagtgctgctggtggcacagagcgctctgaggagggcggtgctggctcatcctgttcaaagcggaggtcagctagcattcattcctgcagccaccttgtctcttgtaaacttgaatgtctctctccgcccattttcaccctccctgtctttacttaacaccagcttcactacctgtgttttccatcacactccttcctctctcttctagccttggcccatcacctgtttgcttcagtctccgggaagaaaacccccagccctgctgcttcctctctcaggckscckrytcctgtctcccctggctccctccccaacagtgcactggccagccccttccctccagtgttctctctgctccttctcaccacctgggcctcagcagagcactctgagagcttctctgtcgatagtaaaaccctcattctctccttgagtgaccttgtttgctttcccagcttcagcgctcgcctgcatgatgctcttcagcccgtacattactaactccgttactctgctggcactgccaccgcaaggtcccacagacttggcggcttaaacaaccgaaattgatttcatcacaattctggaggctctaagtccaagagcaaagtgtgacacgattggtttcttctgagggcctctctcgtctgcttgtcgatggccrtctcctggtgttttcacatggtcttccctctgtgcgtgtctgtgtcctgcttttgtcttagaaggacaatagtcatgtaggattagggtccacccatatgacctcactttaccataattacctctttaaaggccctgtgtccaaatagagtcccattctgaggtactggggtttaggtctctaacatgaacttgagggggatgcagtttagcccataacactaactctgacccctctcacgagcatcaggcctgcagatccagctccccctcccactccccatgtctctctctacagcgtgtcccaaagagacccttcctggcccccttaccattccttcctcctgctttcccgatccagatcagggccttgggatcatctctgactctcccccatcctccttcccatcacttggtcgtctgttgaattgtctgcacatcttctgtgtttgcctgttccttcatattgccagtgccatggtttgagccactaacattcccagacacttctgcctggtcatcttcctctccagcagcccagcttacattcacttgccttactaagcagagctccagctctgtccttcccttgcctgggaagcttccattgctccccactgctgtagggtatcataacggtcttgtgaggtagacaggctaggtattgttattgttatttggtagttttagagatgaggaactaaggacccagttgctcagtgtttcctagctagtgaatagagactagacaccaagtgttctacgtgcagactttatactgctcagcctggcacacaaaatggcaatggcatagtccccagactgtggtcccaactgtctctttcctaacagctccccaggcacccacacttttctgcctctttttcaatctgtacccttgaccctcctcctttttctgctttgtcagactccttaaggcacttcataaattaaccatttccagggatttcccctcacacatgagttattccagtggacagggcagcctcatgggtgcctgtggagggtgaagggtctgcctggccgtaggtgtgatcacacactcccgttgtaacccctgcctcctgtgacacttgctgccccacgatttagctgctttgtgttccgtgcctcctgtttgctggtgaactcctgagttggggggcgtcattccctccactgtagttcttccgcgatgctgaatccacccacggtcagcaccactcggaaatacttcacagtcctgtagaggaagacaggtccaggtttccagttacccttctatgtctggatactctgctcattcactgaagccaggccccttcctgcacttatgcctctacccagataatgagttctacccactgatgacctcctctcctctagtaacagtccgcctccctaatgagcatctctggctgacacacgttccgttctccaggcctgtgagccctggtccctcgctgttgctgagccacagcacccgcccttctggcctcactttagagcactgtcatttcagagcagactacgcgcggggtggccaggtgaaatgcagctgacggctctgcgaccaaatgtgaccaaagggccacattcccagtacccggctccaaaggcagagcttggattctatgcccagcacaggttttcagggcttcctcctctctctgggcctaaacagtgatccctttccctgtttcccactacatctggcagaatttaggccacatttcattttcttcttccgcccatggggctccctgcccactgtgttcccctgtcactctgtccaggtgcacaagcttctcatcgtggtggagctgttgctgggggagatccctgaccggctgcagttccgccagccctccctcaagcgctcactcatgccctatttccttctgactcaaggtaaggctggcttccccaccccagagcccactaggcccccttcagtggggcctcttacatgcctgtgcctatttgcatcatccaatctactcctgttctgcctgcagctgtcaggacaggaaacctagccaagttcaaccaggtcctggatcagtttggggagaagtttcaagyagatgggacctacaccctaattatccggctgcggcacaacgtgattaagacaggtgtggatcaggatctgaggggctgttggaggagcagaagccaggccagggcaaacctagtgggtatccttgggcaagtgaagggtctgtgtccactctgcccaccccatcgctccttcctctcccaggtgtacgcatgatcagcctctcctattcccgaatctccttggctgacatcgcccagaagctgcagttggatagccccgaagatgcagagttcattgttgccaaggtggggctggttcaggaaccacagtgaccaggttgtcactttcctgccaatctcaggaggcaggagtgggaggagtttggccaaggaggggaataggtaaagcaatggcatagtcatttcagggcgtgcccgtcatttgcagtgaagccaagaagttgccagagagagcatggatgtgcgtgtgagtgtgtgagtgtaggtgtgtgcacatgttgagtttatgatagtgcctgtgagtgtgagaatataaggagggcagaggaatgggatggaacaagatgttctctgacttagaagatgggcgtgctgggccaggcgcagtggctcatgcctgtaatcccagcactttgggaggctgacatgggcagatcacctgaggtcaggagtttgagacaagcctggccaacttggcgaaaccccatctctactgaaaatacaaaaattagccaggcctggtggcaggttcctgtaatcccagctacttgggaggctgaggcaggagaatcgcttgaacccgggaggtwaaggttgcagtgagctgagatcgcaccaccgcactctcctgcctgggtgacagagcgagactccatctcaaaaaaaaaaaaaaagaagaagctgggtgtgctggtgaactttcctctttgggggcctgcaggccatccgggatggtgtcattgaggccagcatcaaccacgagaagggctatgtccaatccaaggagatgattgacatctattccacccgagagccccagctagccttccaccagcgcatctccttctgcctagatatccacaacatgtctgtcaaggtgagaagcccgtggctgcagagtcacrcctggcagcagcacacccctccctccacactcatggattcctcagagaagactggcttaatttgtggcccacgtcccagccaatctctgtaaaatcactgagctgcagcacagggggcccagaatggggaggggacttggccatarttccatagccagttgccctctcctattgcgtttaagggatgatgtggtcaccagggaggaccaggcagggattcagagggcggggttctacatttggttccaaatttgaggcatttaacttctcaaagctctgtttctccatctctgaagctgatagggaggtgttacctgtcttgcttgcttcacagggttggtaagattaaaagaagtccctgtattgaggcacttagcgaagtctaaattgtaaaaaagatggcgctggtatctagctccacaaaagggtgagcccttatcctcagttaagcactgagtttggcgctgttactatttgcttgccatgtttttttctggtctcctccgaggaaactaggatattgctgccttgcttaaaatctggctaagccctactccacgtgacatgcaaggccctttgtgacctggtcccttaggtcaagcctcccctcccactcctgccccaccacccagcagccagcccactgggtgcaggccaggcccctcccacatggaatcctccaccgggaaggcctctccccgttgccacatccactgtgttcctccttttcctcctccctgcccagtcaagagagttggtcgtttattcctcttttttcagcatttcccacagggcactgtaataattcctttgatgcctagccccccactagactaactggagaggggcccgccgcttcctgcctggtgtctagctcacagaggggacgcagggagtgcaggttgcgtgagtgcctcacctgcttccttccctcgctcatctcctctctttgctgtgccccaggccatgaggtttcctcccaaatcgtacaacaaggacttggagtctgcagaggtaagctctctgctttctgggtgagaccgaaaggtcaaacttccacacagaaggggagtcgggcgagtgtctggaagggctgagctgctctgaagctttggcctcacttgcctctctccccaggaacggcgtgagcgagaacagcaggacttggagtttgccaaggagatggcagaagatgatgatgacagcttcccttgagctggggggctggggaggggtagggggaatggggacaggcwctttcccccttgggggtcccctgcccagggcactgtccccattttcccacacacagctcatatgctgcattcgtgcagggggtgggggtgctgggagccagccaccctgacctcccccagggctcctccccagccggtgacttactgtacagcaggcaggagggtgggcaggcaacctccccgggcagggtcctggccagcagtgtggsagcaggaggkgaaggatagttctgtgtactcctttagggagtgggggactagaactgggatgtcttggcttgtatgttttttgaagcttcgattatgatttttaaacaataaaaagttctccacagtgctttgtgcatcagttactatacttcactgcagtattggcaggctcagattttgggttttttggccttagagtactagccccaggtgtgtaatctgagggcgatgggtctgcagatggggaggtgcccaggggaggatgaagggaccctgacctggggtcgggggcctaggtttactctcttttcgtacttgtgtggctttggtaaggtcttgttaggaaaggtgtaccatgtgtccatcaccagctgcagaccttcatctcccaatacacctcatggtgcttcacggttattgcagtttttacaaattgaaggtttggccaggcatggtggctcatgcctgtaatcccaacactttgggaggctaaggtgggcggatcactaaaggtcaggagtttgagaccagcctggccaacatggcaaaaccccgtctctactaaaaataaaaaaatcagctgggcatggaggcaggcgcctgtaatcccagctacttgggaggctgaagcaggagaattgcttgaacccgggaggtggagcatgcagtgagccaagatctcgccactgcactccagcctgggcaacagagtgagactgtgtctcaaaagaaaaagaaaaggacaaattgaaggtttctggcaacactgcatcaagcaaatctgtcggtgccattttcccaacagcatgtgctcacttagcgtctctgggtcacattttggtaaatcctctcgatatctcaaactttttcattatatctgttatggtgatgtgtgatcggtgatctttgatgttactattgtcattgttggggcaccacaaattgcacccatataggatggtgaacttagccgggcacggtggctcgcgcttgtaatcccagcactttggcaggccgaggcaggtggatcacctgaggtcaggagttcaggaccagcttggacaacatggggaaaccccgtctctactaaaaatacaaaaaacagccgggtgtggtggcaggcgcctgtaatcccagctacttgggagactgaggcaggagaattgcttgaacccaggaggcggaggttccagtgagccaagatcgtgccattgcactccagcctgggtgacacagtgagacattgtcaaaaaaaaaaaaaagatggtgaacttaataaatgtcgagtgtgttctcactgctcacactgctcactccattccctgtctctctccctcttcttgagtctctccatgccctgagacacaaaataatattgaaattaggcctgttagtaaccctacaatggcctcttaagtgttccagtgagagaaagagtcattggccaggcctggtgactcacgcctgttatcccagcactttgggaggccaaggctggtggaccccttgagctcaggagttggagatcagcctgggcaacacaatgaaaccttatcgctacaaaaaatataaaaattagctgggcatgtggcacgcacctgtagtcccagctactaggaagcctgaggtggaaggagcccttgagcctgggaggtgaaggcagaggctgcagtgacctgagatcctgccactgcactcccacctgggcgacagtgagaccctgtctcaaaacaagaaaacagaaaaagggagaaagaatcacacatctctcactttcaatcaaaaggtcaaaatgattatgcttagtgaggaaggcatgttgaaagctgagagaggccaaaagtcaggtctcctgcaccaaacaggtagccaagttgtgaagggggagttctttaaggaaattaaaagtgctgctccaggttgggcacggtggctcacaactgtaatcccagcactttgggaggctgaggcgggcagatcacaaggtcaggagttcgagaccagcctggccagcatggtgaaaccccgtctctactacaaatacaaaaactagccaggcatggcagtgggcgcctgtaatcccagctactcgggaggctgagataggagaatccttgaaaccggaaggcagaggttgcagtgagccgagatcacaccactgcacttcagcctgggtaacaaaagcgaaactctgtctcaaaaaaaatgttttaaaaagagttcgagaccagcctggccaacatggcaagaccccatctctactaaaaatacaaaaaattagctgggcgtggtggtgcatgcctgtactccgaactacttaggacgctgaggcaggagaatcgcttgaagtggggaggcggaggttaccatgagtcaagatcgcaccactgcactccaacctgggtgacagagcgaaattctgtctcaaaacaataaaaaataaaaatgataaattaaattaaaagtgctgctctagtggacacacaaatgatatgaaagcagaatagcattattgctgatacggagaaagtttgagtctggaaagaagatcaaatcagccacaacattcctttaagccaaagcctagtccggagaaaggccctcactctcttcaatcctttgaaggcagagagaggtgagaaagttgcagaagaaaagtcagaagctaacagaggttgttttgtgaggttgaaagaaagaagccgtctctgtaacataaaagtgcaaagtgaagcagcaagtgctgatggagaagctgcagtaagttatccatcagatctagctgatctcactgacgaaggtggctacactcaaaaacagactttcaatgtagacaaacagccttctattggaagaagatgccacctgggactttcatagctacagaagagaagtcaatccctggcttcaaagcttcgaaggacaggctgactctcgttagggctaatgcagctggcgactttaagttgaagccaatgctcatttaccattccgaaaatcccagggctcttaagaatgatgctaaatctattctgcctgtgctctgtggatggaacaacaaagcctggatgacagcccatctgttcccagcatggtttaccgaacattttaagccactgttgagaccaactccttcgtcggctctgtcggccaggctggagtgccgtggcatgatctcagctcactgcaacctctgcttctaggttcaagcgattctcctgcctcagcctcctgagtagctgggattacaggcatgagccaccgcactcggccaaaaaaaatattttttaaagttattactgctgattgacgatgcacctgattacccaagggctctgatggagggataccagggaaataatattgttttcattcctgctaacacatccattctgcagcccatggatgaagaagtaatttcaactttcaagtcttttttaagaaatacattttgtaaggctagagctgccatagtgattccgctgatggatctgggtaaactgaaaacttagaaagcattcatcattctagatgccattaagaatattcatgattagggccggacgtggtggctcatgcctataatcccagcactttgggaggctgaggcaggtggataaactgaggtcaggagtttgagaccaagctggccaacatggtgaaactccatctccactaaataaataaataaataaataaataaataaataaatacaaaacttagtcaggtatggtggcacgcacctgtagtcccagctactcgggaggctgagacatgagaatcgcttgaatccgggaggcagaggttgcagtgagccgagatcgtgccaatgcacttcagcctgggtgacagagtgagactctctcaaaaaacaaaaaaagaatattcatgattaggccgggagtggtggctgacacctataattccagcactttgggaggctgaggcaagaagatcgcttgagcccaggaggccaagagcagcctgaataacaaagtgagaacccatctgtattaaaaaaatttaaaaattaggccgagcgcagcggctcacacctgtaactccagcactttgggaggatgaagcgggtggatcacttgaggacaggagttcgagaccagcctgaccaacatggtgaaaccacatctctactaaaaatacaaaattagccgggcatggtggcgctttcctgtaaccccagctatttgggaggctgaggcaggagaatcgcttgaacccgggaggcggaggttgcagtgagccgagatcatgccattgcactccagcctgggtgacaaaagcaaggctccatctcaaaaaattaacattagcaggagtttgaaagaagttgattacaaccttcatgggtgactttgaggggctgaagacacacttcagtggaggaaaaaactgcagatgtagaaatagcaaaagaactagaattagaagtggaccctgaggccaggcccactggctcacacctgcaatcccagcaatttgggaggccagggcaggaggataacttgagctcagaagttccaaaccaacctgggtaacatagcaagacctcgtctctacaaaaaaaaaaaaaaaaaaaaaaaaagtggagcctgaagatgggactgaattgctgccatctcatgataacatttgaacagatgagttgcttctatggatgagcaaggaaagtggtttcttgagatggaatctactcccggtgaagaggctgtgaacattgctgaaatggcaacaaagatttaggatattacatatacttagttgataaagcagcagcagtttgagaggattgactccatttctttctttctttttttttttttttgagatggagtcttgctctgtcgcccaggctggagtgcagtgcagtggcatgatcttggctcactgcaacctccacctcctgggtccaagaggttctcccacctcagcctccccagtagctgggactacaggtgcacgccaccacgcccagttaatttttttctatttttggaaaaaatggggtttcaccatgttggccaggctggtctcgaactcctgacctcaggtgatccacccgcctcagcctcccaaagtgctgtgattacaggcgtgagccaccgctccaggccagcattgacttcaattttgaaagaagttctactgtgggtagaacgatgtcaaacagcatcatatgctatagagaaacctttctagaaatggagagtcggccgggcatggtggctcacacctgtaatgccagcactttgggaggccgaggcgggcagatcacctgaggtcaggagttcgagaccaacctggccaacatggtgaaatctcgtccctactaaaaatacaaaaatgagacgggcatggtggtgggagcctgtaatcccagcttcttgggaggctgaggcaggaaaattgcttgaatctgggaggcggagcttgcagtgagccgggatcgtgccactgcactccagcctgggcaacagagggagaccccatctcaaaacaaaacaaaacaaacaaaaacacaaaaatgaaaaaagaaaagtcaattgatgcagaaaatttcattattttcttattttaagaaattgttttcacctgaaggcactaggaaaaataaaaacaaaaataaggaaaaaaaaaagaaattgctacagtcaccccaaacttcaccagccaccaccctgatcagtgagtggtcatcaacatgaggcaagacccttcactagcaaaaagattaggacttgctgaaggcacagatgattgttagcatttttagcaataaaggttttttgttttgttttgttttgttttttgaggcagagtcttgctctgtcacctaggctggagtgcaatggtgcattcttggctcactgcaacctctgcctccggattcaagcgattctcctgcctcagcctcctgagtagctgggactataggcgccagctaccacacccggctaatttttgtacttttagtagagacggggtttaactatgttgtccaggctggtctcgaactcctgacctcaggtgatccacccgtctcggcctcccaaagtgctgggattacaggcacgagccactgcgcccggccaattatttttaaattaaagtat

SEQ ID NO: 17978 - DNA, 16998 bp, Homo sapiens
ataagcttttacagagctccgttgggagtcccatgtttctttatggcataatgggtgagaacacagacttggaagccaaaccacctgaatttgaaccccagttccatttaccaactgtcaaaagcttaggctttgattctgagcctgtttcctcaactgctgttctaaagattaaataggctaatattcataaggcatctgggacagtggcttgtgtgtatagcaaccattatataagtgaattatctactgagcaccacagcacttcttcactccatggtgtggtgaccagaatggagatgagacagagaactgcaggttctgcttcgagtttaagttaggatttcccttgaccaatgagacctgacttggaggagtcctggcctcattccattaccccaaacaccctctagtctctagatgaacagatcctgaatgtccaggccccacgtggcctgttctaaggcctgagatggaattggatacaggacacatccagccttgagatcttttgctaagtgtgacacagtgcccccagccctgtgctcatgttcatgcctagggaaaggcttctatcaaaagagttgaacttcttcccactggggatggaagaccatttcctcccttaaaccttggctctccctgcttccttcaggccaccaacaacacatgtgcaggatatgaaattgctgaggcatcactgctttcctacttcccttccaagtctcagctcccttattttaaaaaatatttggcctcaatgatcatttctcaacaattcctcaccgcaggagcctctgaagctcccaccaggccagctctcctcccacaacagcttcccacagcatgaagatctccgtggctgccattcccttcttcctcctcatcaccatcgccctagggaccaagactgaatcctcctcacgtgagtgcaatgccttgtcttccttccaacctagagcctgcagggaaataagcaggagtgaggttggggctcaggggaagaccaggagcagggactcagaaaggagggctggtatcttcttgaaattgtgtgtatagcaacattatataaatgaattatctactgagcaccacagcacttcaccccatggtgtggtgagcaggatggagatgagacttaggactgtaggttctgcttaagagtttaagttgggatcttccagccttgaccaatgagacttgacttgggagactccaggcttcattccactaccccaaatgccctctagtctccaaataaacagatcctgaatctccaggcctcacatggccttgatctcttatcattgccccccaggaccagtccccccttgccctcaaggacatggagtgagaccagcctgcctctctactccctcaatttctctctctttgccgctaagcaaaagagtggcccaccccatttggggtatatttcctcagggagattaggagcagtgtcttgagcccctcaagggcatttttctattggcctcctgaggtttgggcccagcctgcttccagcgtcacctgtgcccagtgagtgcagcattgcttgggtatgggctggggggaaacacgacagtgtggggtccatcctaggcccccttttctcagctgatttcttagaataagctgcctttagagataaccaaaactatttatcactcttccattttacctactctccttttcagaaactggggggaaaccgaaggttgttaaaatacagctaaagttggtgggtatgtgcacagtttgacttgccctctccgatgtcatttgtcagctcagaggaacaaggtgggagagtataggagctctgactgggtctcaggaaacaggggccccttatgccgttctttggatcgtgaggatgctgcctggaatggagctggaaaacaggatgagacccttccacccagacatctggccaccctcagtgacctctgaggccattgtgatgcacatccatgattctatgaagcagggtcacataacatgcacacacctgatttctccactccataaccacaacatgtgcctgtttgtacagggctcttggcctacaatgtccttcctgctacctctataattcaagcttggggtggctgctgtcaccttgcttctcctataaaagccatgaaacttctcaatcagaaaatagatgaaaaaatcacccaatccagtgatttttaaaactttttagaccacaaaaccttttcttcaagcaatatcttccacagaggcccaatatgtaaaacagaaaaaatgggttgagtagggtacaagacaccactctcaaatgcagcaaggcctccacaatagtccctgaggcccccagagctccagggagctcagtgtaaaaaccactgatgcagtccaagggcctcatttacagaggagggaacagggggaaagtaaaatggccacagtacacaggaagcacaggcaaggttaggttaggatttgggtgccctgactctgtggcctttgtccttggggcttgctgtgggcatcctgctctctctgcaggttgtcggttcaatggggacatgggcagggtggagcactaggaggggctgggtttgcattcccaaatggcatgtctccaaatccctattgggatttcttccaaatattcctcctatttggagcacctttcccgaataaggcatgaaggctgcatgatattggccaagtccctagccttctctgccagtcggcccccagagatggtgtaagaagatctgagtgtgctgctcttcaatcctggagttgaaagtcatccaccagtctttccaagaggggttgaagaaaaggaggaagggtgattgatgatgagggaggagaaaaagaagagcccaggagtaccatggagaaggagaagagaagatgaggaaagcctactctcccctccaagttctgaggggctgtctcctccttccttccctcctccatgccctcagcttgcaggagcagccaatggtatggcctttaacaaggggcccctcctcagcatctgatgctctctcctcagggggaccttaccacccctcagagtgctgcttcacctacactacctacaagatcccgcgtcagcggattatggattactatgagaccaacagccagtgctccaagcccggaattgtgtaggtggtacacacacatcacactggggggagagggagccagcagggcctcctggagggaagcagggagtggtggtggaatggggacccccagcgtacctcccaggtgtgactacatggggagaggcagctgaggggcaatctgagcgctttctggctggagcctgcaggagccatggggaaactgaccccatggatggggagatgacagagaagggagaagaaggcaagagggcacttcctcagggggacacagagactagatgggtctaggggtcctaggaaccgaagagtatgtctcagagaggagactggctctaagctgcctctgtggaagaaaggaaaagcagtataggtcaggtggggaatttaggagggagggaagatgggctgtctcttccggccactgggcccctcggtttgtgatccttctccctcttgctccacagcttcatcaccaaaaggggccattccgtctgtaccaaccccagtgacaagtgggtccaggactatatcaaggacatgaaggagaactgagtgacccagaaggggtggcgaaggcacagctcagagacataaagagaagatgccaaggccccctcctccacccaccgctaactctcagccccagtcaccctcttggagcttccctgctttgaattaaagaccactcatgctcttccctggcctcattcctttctacgggatttactcattggccatgcactgaggacaccagggtgtggcaccctcggcatcaagcctcgctctgcagaagttttgctggagcctggtacaaaaaataggtcaggcctgcaatgcaggtagtgagaagcagaaagtgagaaagaaaagcagtgtaaagaccgtctcctcctcagcaacaacagtagcagaccccgttttcttaatgctttctatactccaagcactctgctaggcagtctgtatgcattatcttatttaagcttcatgacaagtgtaaaagctacaaatcatcatttgattttttaggtaacacttcataaagggctctctatagcagtcaaactccatagtccttttttctgtgctgttttcaaggcctttcttcactgctgtctggaataggaatgatgcatgaagacattttatccaacccctccccttcgcttacacacatcagattatactatattgttttactaacttttttatcccctagaaggcttagcagaaagcctagcccataccaggtgttcaggaaatggatggatggatggatggatgaaggaagggaagaatgtgtggatggaaggatgaagggaaggaggaatggatggagggagggaagcagggagggatgaagggagggaggaagggaggaagggagggaggaagggagggagggatggatggatggatggagagaaagagggagggagggatagagggacagatggaataagacagaaatcaagaggaggactatgctccaagaataagctctcaaacctatcttcagggcccaaggaggagctctgtgtacttggaataagagcttgcccagagtagggattatgaccaccctttcctggcctccagccttccacagataaggaagggcttgtgggccacattaagggccatatgggggcctgcatgccaaagtcacaaccaggcttctcaggccttgtcacctccataaacagaggtcaagaggatgccccacatacgtaccctccctgccctcacaaaaagccacagcttcaccaccaggtgaagccttgaacccaccaggagtaactgcattatacggtttacctatctatgagcagtcatgccaagcagaaagccccataaggatctgcacagtccctgtttctgcccctgcctcccactgccctcaacacctgaaacacatcacctatgcctctaaagcttgctgtccatcaacagcaaaatcccttatatctttgatctcttctctaaatgcagctttcaacatggaaaagggtcctgaggcacctgaagagagaggaagctgtgggacaggtccagccagagcccaggccagaggggcagaagctggagtcctggagcacagacgcaggttgtcaggtgcacagagttggagggtcccctgctggtcatggttggccatgggggcacccaggagggatcagcgagctggctacacctaaaaatcagtccaaagtccgaggtccaaagagataaataaaaacattgacaaataagtcaaacggtccagcaacaaatggggacccaaggatcaggcacattgttttttttttttttggagtattagcatacactgtgacatgaaagagtgtgagctcaatcatgtggccttggactgggagagggcatttccttctcagaggcaactaagccctacctttgcctcagtctgggctctgtaatcctgctttgtgctcatctccccaagactgatcacctgggggaagctggggtggttcaaccctgcctgcccttccccaacatacagatggtggcaggtaacatggtgaaatcaaacagatctggtttttcatccgcctatccacccaggtgaccttggacaatttatttagcctctaggcctcagtagtcccagggaagtaataatcgctacttcactattttaaggattatataagatagggcatgtaaggtagctgacacacattcgcccatttcttcacgtgaattcagattctactgaattcagctctgcaccaagtcccatcctctgctgccctctgtttcagcaaacactgaggcctgttgtttctcctcctctaccggctctgatgcggtcaaggtccagagagctgagtagttggcaagcggaccaccagcaacagacaacatcttcattcggctctccctgaagctgtactgcctcgctgagaggatgaaggtctccgaggctgccctgtctctccttgtcctcatccttatcattacttcggcttctcgcagccagccaagtgagtccacttgtctctgtagggcaggaacgagaaagggggatggagcagctggcagggaggtagtgccaagggcgctgtcgggtctctggcctcataagaccctgtgggctctccccaccttcatgcatagcttctgacctccaattctcccctttgtaagtagagctggggttggtccggatctttctggggtaagtagttccaggaaactgggtcaccatttcctcaggagtcccaagcgtggtgagcaggaatgatcattcaggaggagaggccaagaaagcagcagaaaatgcaacaagaagtgcatgcaatgaaagggagggggaggcacgcggatgagaaagaaaagtggcaggtgccctggaagaatgagtggcgagaggaaggaaggttcaaacaatcatgtgggtctaagtccaggaattgggagtctgaaccgagagagcccttcctcaacatggctggcacaggttgctgggactatcagacaaccaaaatgagtcccagtggaatggctgcttgggaatctatggtccccttctccatcccccagcctatgactaaataaaatctgcagaaaagaggaaaggggttgaaaggttttggagctgtggggaaagggagaattggggcctatggaggagggggtttgttttgcccctccgtatctcctccctctatcattgtttacgaggacctggtgacgggggtggggaggacaaagacgtgtacctgccctaggctgccccagccattcttttcgcttttgtttttttgtttgtttgcttgttgkgttttgttttgttttgttttgtttgtgatggagtttcgctcttgttgcccaggttggagcgcagtgtcgcgatctcggctcaccacaacctccgcctcccgagttcaagtgattctcctgcctcagcctcctgagtagctgggatcacaggcacacaccaccacgcccagctaatttttgtatttttagtagagacggggtttcaccatgttggtcaggctggtctcaaactcctgacctcgtgatctgcccacctcggcctcccaaagtgmtaggattacaggtatgagccaccatgcctggcctcttttctctcttaaggtcaccctggcatgtagtctggcctgactctgcctgtgtaaacacaaaggagcaagggtcaagtgcaccatgtaatctgcccacatactctcaggatgaccctggtctttgtaaactttgctttgagaaccagtgatatgagcatcacttacagagggactgtgtgggaggggggaacagtgctctttgggagagtcaatcaggccagtgcagtgggttcaggcttcaagaaagagaaaatggcccacccaaagcatggatcagcaagatggtgctctcaagatgtcccaagctttgccactcactggaggcaaaggggtcaagctacaaaaagatttgcactctgaaggtttgggggctgggagagatctctggactgacctcttgtgtagtatccccaattgatgggtagtcaggacagctcaaaggaaacacagtgacaataaccaatcaagtccagtatcctgcatacatcaaagagatggggggaagcgccatttccaaggcaagaagagcagtcattactaccattggctcttaattataataagcactgattgagcctttctgtgtgccaggctctgagttaagggctttccaatcattttctcaccgaattctaaccatgatcctaggatacaagtaagtatcatttacccccacttaatagatgaggaaactgaaacctagggagattaagaaatttgcccatgattcaagtcaaaattcaaatcaagtcaaaattccaacccaagctgtctgaccccaaagcctaaatcatatactttttcctcctgctctaacttctgtctctaaaggctctactctctcacccttccccctaacctccgcctctccaatacctctaagatagagtccaaattcctcagtagctcagcaggtatgtgaccagaccctcctcctctctccagtttcatctctgcccattcatttcttcctaccttgcatgccagccacccaaactgcccagcactcccaagacacactgagcttcccctaccttcaggctttcctgcatttctttcttccagattctacaagtcctttgtgtgtctaaatccttttttttttttcttttgagatggagtcactctttcgcccaggctggggtgcagtggcgcaatcttggctcaytgcaacctctgactcccgggtttaagtgattctcctgcctcagcctcccgaatagctgggattacaggcatgtgccaccatgcctggctaatttttgttagtagagacggggtttcaccatgttggccaggctggtctcaaacttctgacctcaggtgatccgcccgcctcggcctcccaaagtgctgggattacaggcatgagccaccacacccagccgtgtgtctaaatcctactcatcctttacgaatcaatgcaggcctcacttgctttgagacttcttcctcaaccaccaaggatgggttaggggcccttcattctgttcccatagcaccttatgccaaagtctgttctatcctggaccacattctgtggtagtgtttgtttaacttttcaatttctctttcaaccctgactagtctgtaagttacttaagggtagtgactgtatcttcctcatgtttttacccccatagagcccagcatataatactagctcaacacatgtttgcccgatcaagtcaccaataaacaaaagaatgagccagcttcctcccggttccttggcaagtgtgaataacyaagtcatttgtagttgacactcagctcagaggctgagggttctaaatgtatgtcccccaaagggattcatcttatgcacttcattaccagtcaagctatcattggtctcctctaacagacggctttgctatcagaggagtgaaacacaaatggtgggagacagaggtgggcagctgtggtctcccctctgcttccctggctcagcttgcaatgtgattccttcagaagttcctgagtgggtgaacaccccatccacctgctgcctgaagtattatgagaaagtgttgccaaggagactagtggtgggatacagaaaggccctcaactgtcacctgccagcaatcatgtaagcacgtccttttagatatttctgtggagagggacagggagcccaggggcaggaatgagatacatgggatcaagaggtctccatgctagaagcagtggagcagtggctaagggtttggcctttggctctcaggggcctgggattaattcctaattttgccacttttagctatgtggttcattatgaaacccaagcttgagggtctaggctgagtggagaagggactgagagaagggatggtaaggttctgaggccagagagagaggctgtctgagggaacccagccaggacaggcccagggaagctttaaagaacataaggtgagctccatgtgaaccagaggtgggggtgggcaccggactcctgcccgagtctgcagcccatgacggtctaattctgcctctgcagcttcgtcaccaagaggaaccgagaagtctgcaccaaccccaatgacgactgggtccaagagtacatcaaggatcccaacctacctttgctgcctaccaggaacttgtccacggttaaaattattacagcaaagaatggtcaaccccagctcctcaactcccagtgatgaccaggctttagtggaagcccttgtttacagaagagaggggtaaacctatgaaaacaggggaagccttattaggctgaaactagccagtcacattgagagaagcagaacaatgatcaaaataaaggagaagtatttcgaatattttctcaatcttaggaggaaataccaaagttaagggacgtgggcagaggtacgctcttttatttttatatttatatttttatttttttgagatagggtcttactctgtcacccaggctggagtgcagtggtgtgatcttggctcacttgatcttggctcactgtaacctccacctcccaggctcaagtgatcctcccaccccagcctccygagtagctgggactacaggcttgcgccaccacacctggctaatttttgtatttttggtagagacgggattctaccatgttgcccaggctggtctcaaactcgtgtgcccaagcaatccacctgcctcagccttccaaaagtgctgggattacaggcgtgagccaccacatccggccagtgcactcttaatacacagaaaaatatatttcacatccttctcctgctctctttcaattcctcacttcacaccagtacacaagccattytaaatacttagccagtttccagccttccagatgatctttgccctctgggtcttgacccattaagagccccatagaactcttgatttttcctgtccatctttatggatttttctggatctatattttcttcaattattctttcattttataatgcaactttttcataggaagtccggatgggaatattcacattaatcatttttgcagagactttgctagatcctctcatattttgtcttcctcagggtggcaggggtacagagagtgcctgattggaaaaaaaaaaaaaagagagagagagagaagaagaagaagaagagacacaaatctctacctcccatgttaagctttgcaggacagggaaagaaagggtatgagacacggctaggggtaaactcttagtccaaaacccaarcatgcaataaataaaactcccttatttgacagcttgattcctaacctcctgcttttttttctgctagggtgaaagaagcttaatctcagtttttttcaggggcttctccacatttcttgagacttttgtcaaggttgggggccatttatattcaatcttcccctctgtctccagcttaacagcagacagctgactcagctcgcttggattcaacattctcccaaaacgctgttgtgaagacaaaacaaaagccaggtaattaagaccggatggttaagacaggtaattaagaccggatggttaagagaaacaaataaatgcagtgaagtgtcaagctgaaaacgggccaatgaattggattctggtaaactgactcataactgccccccagtggccatgttgttaaaacccgagcctcctcccttggccggcgcggtggctcacgcctgtaatcccagcactttgggaggccgaggggggcagatcacgagctcaggagatcgagcccatcctggctaacacggtgaaaccctgtctctactaaaaatacaaaaaaattagccgggcgtggtggcgggcgcctgtagtcccagctactcgggaggctgaggcaggagaatggcatgaacccaggaggcggagcttgcagtgagccgagttcgtgccactgcactccagcctgggcgacagagagagactcttgtctcaaaaaaaaaaaaaaaaaaaaaaacgagctgcctccccagcccaagctcatcttcccaggatggccatctcatctagctggccaatcagactctcagagagatttgaaatttggacctgagaaactcagtctggttgctgctagagcagaagtgagtttctggcagtgtcccaaggaaagaggtctatgaacttctgtcctgaggtccctggaactgcctcacttcctgccccagctccaggctgggaggttcagctggtctttcagttccatgagatgtcccagcatctttcctttaaaaaaatttctaggccaggcgcgatggctcacacttgtaatcccagttctttgggaggccaaggcgggcagatcacttgaggccaggagtcttgagaccagcctggacaacatggcccatctctactaaaaatacaaaaattagctgagcatggtggtggtcgcctgtaatcccaaccactcagatggctgaggcatgagaatcgcttgaacccaggaggcagaggttgcagtgagctgagatcatgccactacactccagcctgggcaacagagagagactccatctcaatttaaaaaaaaaattcctaaagggccatggtggcaatttagcacctcaggaataacttactggtttaggtcagttcttggtgggggatgatggacgtatgtgtgttaaaatagacataacaggggctgggcaaggtggctaacgcctgtaatcccagcacttccagagtctgaggtgggcggatcacttgaggccaggagttcgagaccagcctgggcagcatggcgaaaccccacttctaccaaaaatacaaaaaaaaaaaaaaaaattagccgagcatggtggcctgggcctatggtcccagctgctcaggaggctgaggcaggaggatcccttgagctggggagtcagctgaaatcgtgccactgcactccagcctgggtgacagaatgagaccctgtctcaaaaaaactgtgtgtgtgtgtgtgtgtgtgtgtgtgtgtgtgtacacacataacaaggccatgcacagtggcttatgcctataaacccagcactttgggaggctgaagcaggaggatcatttgagtccaggaatttgagatcagcctgggcggtatggtgagatcttacatattttttaatctctacaaaaaaaaaacaattaactgggcacggtggtgtgtgcctgtggtcacaggtactcagaaggctgaggtaggaggattgcttgagcccaggaggttgagactgcactgcagtgagccataatatcaccactgcactccaggctggatgacagagcaagactctgcctaaaaatacatatatatatatatatatataggtgtgtgtgtgtgtgtgtatgtgtgtatgtgtgtgtgttatatatatatatatatagagagacaaaatttaccattctaaacatttttatgtgtacaatcctacattcactttgttaggcaaacatcaccactatccatctccagacttttctcattgtcccaacctgagactctgtacccattaaatgctaactcaccattctctcctcccccagcctctggtaaccactattcttctttctgtcactatgaatttgacagctctaggtatttcatgtaaggggaatcacatagcatttgtccttttgtgactagcttatttcaccagcatagtgtcgtcaaggttcatccaagttgtagcatgcttcagaacgttattcctgttagtcactaggctaacattccattgtatgtatctgccacatttcgtttatccagctaatctgctgatggacgtgtgggtatctctcttttcttgctagccagagtttgcagatcttggtttctgttacttgcaccaaaagcacctgaacttgggcaacaacccatcaatcacccgggcattgactcagaggagccccatgtgcttgctgctcttgctcctccacagaggcagtgctacctgctttggtccctccctggactgtgagtccctgctccttgatccaggaatttctctccaccctccttgctatcaggggttacagctaaatatgatcaaactccttcctccaggagctcccagcctggggatgacagaatcaataacatacaatgtagtcaggcccagacctttgcttgcagaggccaaagcaaacatgggggtgggagtgaggccggcagggcctaggttgacagaaaagtcaggacaacatcagatgcggcaagaagtttcaaagtccttagccagcaccagggtcaaagccagggagtcagagttcaaaggcctaaaaaacaggacaaggctaaaaacaggaagctcagggccggggttctggcaagctggaacagaatgtcgttgtcttgtgttttgttttgttttgtttttaaattcaggagcactgaggtgtcagtctgaaaacctgagtaatcgagagtctatatacacaaagtcaaatccccaccctagcacataataaaaagcctgccagaaacttctgatggttcagaactggaagagcttttctcacgtgcattcagttgcttttcaagaaggatattcccagtcttttcaaggcaggcagatagatggctgaccttaaacacacacaaatacagaaaggacttcggtcattctgatatacagagttttccagctgtggtcatcctaaagcaaataaaccttttcttgaacaacttgtatgactgaccttttgccttgtagaatacaggtggctgggtacatgggggaaccaactggaacaggaagggaagaaaatgagagaacaactctggatagtacaaagagcattttactgggagtcacagaggacggctcgcatgtcctctttctacacagccgtcttagacaccatgaatccttgaagcagatgaccagatgtcctgcggctggtttcagcaggcctgtttgaaatattattagtctttctcagatgggctgcatgaacacatattttcttcccatgagagcatacatgtgcttgcacgtgtgagagcaactattgagagtcatcagcagcctgagctggcacttggggacacagctgatgcaatggtttaaaagcactgtctccaagccaggtgcagtggtgcatgcctatagtcccagtaactcaggaggctgaggcaggaggatcacttgagcccaggagttcgaggctgtcatgtgccatgattatgcctgtgaatagccactgcactccagcctgggcgacatagcaagaagaccccatatcttttatttaaaaacaaaaagagtattatctccacactcagactctgacagaccatctatgtttgagtcccaactctgtcactcactgtgaggtcttgggtaactactaatcctcctaagccttggtttcctcatctgtaaaatagatcaattatgatacctaccccccagtgttgaaaggatgaaaaggcaatgtgagagagtgcttagcagataagtgctcaataggccttattgttccagaatctgacttttttctaggaccacagaacataagacagaaaggagctttctgtcattatgaagataagggaattaaaggccagagatggaaagcgatttagcaaaggtcatgctacaaattacagaagatctggcactagaactggaggctatactttaaaaagaagaaacctctgatctacacaagcctgaggctggtatgaatatatgaaagattggggtcatctgactaaagaagcaatagttcaaagcctgagacctccttttgcatgacctggtctccctggagagcctggcctccattcatgtatctttgattctcgccaaggagactttgaagaaggaatgggcaaatgcagaaagggacctcaaatctctccagagcctggtatttatgagcaatagccttaacctttctgagcccagtttcctcttctgcaaaatggcgctgataccttacagggctgctgtgacaactgccagcttctggtacaggatctggaacaaacatcataataaaatggaaaacagtattaatctcttagcagctaaagcaggaattcctatcatggaggaaataacctttgttaagaaaatgaattggcaaccctggttaaggaaggacactcccccaggacatggagctgagacttcacaggaagggctgaagttgttccaagcaaaccaggagaaacagctttgcccctgagagccagaggggagggagacagagggctggagaaggggatagaggctgtgcaatgagcggcaggactgccctccttcctggagtcctcaaaagtgccatcaattattttgcttcctggccggcgcagtggctcttgtttgtaaccccagcactttgagaggccgaggtgggaggatcacctgaggtcaggagcttgagaccatcctggccaacatggtgaaaccccatctctactaaaaatacaaaaattagctgggcgtggtggtgcatgcctgtaattccagctactcaggaggctgaggcaggagaatcccttgaacccaggtggtggagcttgcagcaagccgagatcatgtcactgcactccagcctgggtgacagaccgagactccgtctcgaaaaaaaaaaaaaatggagatggaaacaccaacaattacaggttattgggagaattacactggttaacataagtaaagtgcctagtattggacctggctcacagcagagattgggtgcttatgggttcccttgccagagaaacgctgcttctgtcttgcaagttcttgctggaagaggcaagacagagtcaggtgacacttatcggttcccacaactacaacacaaatgctgatggaaaaggaatcatgtaatgagcaaaagaatcaagaagtcacttgaatcaagaaacagttatttccacccctagcacacactcagaacttccccctcgctcctcccttgcattctgatcaaaaaatgagtcttagccgggcgcagtggttcacacctgtaattccagagctttgggaagccgaagtgggcagatcacctgaggtcaggagttcaagaccagcctgaccaacatggagaaaacctctctctactaaaaatacaaaattagccaggcgtggtggcacatgcctctaatcccagctactcaggaggctgaggcagaagaattgcttgaacccgggaggtggaggttgcggtgagccacggtcgcatcattgcactccagtagcctgggcaacaagagtgaaactctgtctcaaaaaaaaaaaaaaaaaaagttcaaagagata

SEQ ID NO: 17979 - DNA, 14943 bp, Homo sapiens
agctgctgaacagctggcagggggtggaattgtgacacctggatcctagcctcctttctctttcctcctcctccagcgctagtcctgctgatgggcaaagaaggtgtccacggtggtttgatcaacaagaaatgttatgaaatggcctcccaccttcggcgttcccagtactgacctcgtctgtcccttccccttcaccgctccccacagctttgcacccctttcctccccatacacacacaaaccattttattttttgggccattaccccataccccttattgctgccaaaaccacatgggctgggggccagggctggatggacagacacctccccctacccatatccctcccgtgtgtggttggaaaacttttgttttttggggttttttttttctgaataaaaaagattctactaacaaggtgctgtgtgatttgagcttgggtgtcagaatgggggataggcactgtgacttgcctcctttatcgtggcttgggagcagggaggttgaggtactacaaggtgcaggaatttgagcttctggccaggtggccctgcccctccacagtggcatttccaggcctaagtcctcagtgtgctggtcaaattggtggatgatggaatagagccatctggaccagagaatgggtgcaggcctgcaggcaaggcagggctagttgagtcatccttgtgggtggggctcccccttctgagtcatagcaaatgccggctggggctgtccccatgactataggttagtgtctctcagcattcccttgctccttatggctaaaggggtgattccaccaaagggttaagttcacctgtgtgagaatgatcttacccttccttagtccacaaagaaacaattttattagcccaagaagtgaagacccagtccctctgcttgccccagccccaccccaaagcccctcaaaaggataggtgtgggtaagggagaagcttgggatggaatgtcccctatccctcagaagactggagggaagacgacggtctgtgcaaataggtcaccagaggtgtatgtgtggggggttattagaccaggataacaggggaagagggaggggacagtgggggatctgttgaaggcccaggaaaaacaaggggagctggggctaaggaaccaaaggaggtgggaagagtggggctagaacccaaaagtggggtcctttctgaggcagggtggtcccttggctccccttcatcaccctcctcttgcccttgagtttcttcctcttggtcttcgtccccaggaccccgatgaacaggctgcttgcaaatggggcaggtcttccgggtctgagtgagccaggggtccacgcagcggctgtggtaggctgcagagaggaacaaggtgaagcacctggtggctgctggtggcagaggggcatgggcaggcagtgagggcctcaccatgagcacaggggagtacccgcagcttgtccccatcctcatattcatccaggcaaatggcacagacatcatactggtctcctgggacagaaagaaaataatctagtccttcactgagccacaatgacccagggctaaggcttttaaagccttgcaaaaatttcccctcacctacaaagccagtggaagagataagacaggtaggcaggataaggtcagggcagaacatggaagaatttagggctagaagggacaagcaaagagaagcagaggtaagaagggaagtgggtttttggggaggtgtgagggtggagatagggagtggaaggaacggaaatgggcagggcttctgccacagccttatacgggcactggaggccccagggcctaaagccccagccccttggtaccggtttcttccttctctaactgaatcctccccattcctcccatttttctgctctgtccacatcccctataagcaaagtctgtccctctattgtttcccacaattatttcacttaatcatctttgctttccatctcctctcccgtcttcgttgtatttatgcataaaaacagaagaaaagacagcatctcaagctgaaaccttcctactgccatctttatttttattattatttttttgagaaagggactccctctgtcgcccaggctggagcacagtggtgcaatctcagcccccgacaacctccgccttcctggttcaagtgattctcctgtctcagtctcccaattagctgggactacaagtgcacaccaccatgcccagctaattttatttttttatagagatggggtctcaccacattgcccaggctggcctgaactcccggggtcaagggatccacttgcctcagcctcctaaagtgctgggacttttctgttttatcatgtcacccaggctggtctcaaactcctgggctcaagtgacctgcccaccttggcctcccaaagtactgggattagaggcacttgggattacgtgagccactgtgcccggccactgccatctttgtataccctatcttctgggctcaaagtccttcagaaccaggtaaactgtgggaaaagccctcttctcccctaaccccctcacccttctgatagtcatgtgtaggaatctgtttcagttgctctttggtaagtcgattccgctggagccgtttccggtgctggatacaacgagctatctgggggaagcgggggtggatggacaaggcttaggaacaaaactagacaatctaggacaagccactcccatctcccaactccagatccagtctggcctcacaggcctcagtgcttcccatcatgttccctcagctactcaccattactgctcccatggccaaaaccagcagtcccacaatccctgtgaaagggatgaggtaatagcccaaggggaaggtattgtctggaaccagaagcacccgagccctgggaaaaggatgaccagtctcagcagggcgagaaaggcaaagggagaaaaaaagagggacaaagtaactggctctggacaaagcccataggtggggacaggaatgggaagaaagtcaaagaggcagggaaggaaggacaggaggctgaatggttcgggtaatgaggaggcctgggctccaggttggcatggaactgcttgctgaaggaagaatgggaaggaggcacatgtcctaccccttctcgtagacaaagagggcacgcaggtactcggagcttctctccccaataaatacagacgggatccagatctgctgctggatttcctctgcagggatcaaggtgttactctggggactcacaaccttctactcaaatcctctgggaaccctggcatcttgcactttggccccaccccacctaaaggattggcttcttttcctgaggccttcagccttcccaccatctctgggtcctactgaaagcccagctgtatagattcccccagccttaccactattccacaccatgttcagaagttcattggaattcacattgtgtactacagcggcaccatatccagccttctgggcatttaggacctagggagacaaggcagaggacaaggagccatcatgggccttacctgtcttcattcctggtgccttttttttaccctcagctgcccagctccccttcctcattcagcaaccttgaggtcaaagttgcagtcgaatcttcgaagcagcgcaataaagactgacccattgaccggggctgggggtggtggggcaatggggctgcaggcattgtctgggtgagcctccacaaggaacccctgaaggatggaagcaaacaacagtgagatttctcctttctagattctgctctctacaggggccaccaaacacaccagcccacatgctgcacatcctctatcctcacttcctcctccttcctggggtctgagtgagcatcccaccatcacaaccttctcttagcctcttgaaaaggcaatgacataaaacatcccttcaccaaactctcccatcatccctctcgctgtcccagatgggctaatctgtaccctatactgcaagctaatgcaattatttttgccttctaatattccaattgtaattcaattctcaaaccacccatgtcactttctctcaagttctgtttcacagtcccctctccagcacatactcatacagacacactcccctcccttcagttttctttttgtttttcttttttttgagatggagtctcgttttgtcacccaggctggagtgcagtggcgcgatctcggctcactgcaacctccaccttccggtttcaagtgattctcctgcctcagcctcccaagtagttgggactacatgcgtgcaccatcacgcccagctaatttttgccattttagtagagatagggtttctccatgttggccaggctggtcttgaactgggattacagatgtgagccaccgcgcccggcctcttcaattttctaattacccatctcacaaacaactcgactgctactaaggcccaactgagttcttgctatgtggcagtctttgggatgaagtactaccaaaattgcgtatctactttgatcttcacaataaccctaggaaaacttctaatatcccattttacagtaaaacaaactaaggctcagagagattaacttgcccaaagtcatataagcaataactagcacctgagaccttcctgataaggaccgttgatcctgccttctgtcttcgtccactttcagtctccctgataacctcggagttccaggggtggacactctgtcttctccctctagattctgggttctacactagacgtgctcagttcctaacttcattttcctacctccagtttcacccaggacaaacctccccaaccccagcctaggatggaggatcttgcgaaatactaaaaaaagaaaaaagacagaaaaggaaggaagggagggaaggaggaaaagaaaagaaagaaaatcacctggaggccctcctggctcaaggtagccccaaacagagctggaaggtctgcaaagtccatgctggcattgtggtccgaggtctgcggacaaaaaaggcgatgttccccttcagcctgcaacccttcctttcagcgccctttccccatccgtccctcagactcaccgctcgaatgagcccccgggtcggggccgctccccacagcacagcggccacaaccacaggaagcgggaaggctgcagggtgcatggcagcgggaggaaagaggctgaggaggccgcgcgtcctggtagcaaggagcagaagcggagttctgcgccctccctgcccctcctttaggatcccaggggtccaaccacccccaggtcccacttcccagctacatgggggcgccggggaaggaacaccaactcaaagaatgagatatccaacccgtttagtggagctgggtgggaggcactaaatgtatccttttctggtacggggataaaacgcggaaaggggacggagcctaacacaggtgacagaaaaacttcgggaagggtggcggagctcaaggaggtgggacttcctgctaggtgggccgtgttcccagcctctggaaaagggcttccggtagagaaaatcaggccgctttcagcattggatgcttgagatgaaggacttccggtcctaaaaggccggttaaaaaaaggttagcgatggagggactgcctgtggagatggaaggggcactggtggcccagaagacgacctaataaaagtgcccggaaacccggagcctcctagtttacaaacctctcctccctctggcctccgccgctccttcaaatctcgcgagagtgctcaccacctctcccgtcccctcgcagctgaatagttgctgtgtctatcgcgagagcgctccaacttggcgagccgtactcactcgatctcgcgagaccttcaaacaaactcttctctattttcccgcgattctaattcggtgaaaacagcgcctttcctctggtttccaaatcagttacgccccttctcgcacgcttccatcaagctcctccttcagctccgccttactcccggccgcctttgcgctgcgcgcctgcgcccgcgccggcttccagcgggtgtcggacctgagagctggaggggcgtgcgcgcgccctcgctctgttgcgcgcgcggtgtcaccttgggcgcgagcggggccgcgcgcgcacgggacccggagccgagggccattgagtggcgatggcggcgacggcgagtgccggggccggcgggatagacgggaagccccgtacctcccctaagtccgtcaagttcctgtttgggggcctggccgggtaagctcaggccccagggatgggaaaagaggaggaagggaagggcaaaaggaaccgggcccggttcatctctgggtctgttgcagtgaactgtgccggcacggggtcagcgcgatctccagcgtattgcgagttccccsatgggctgctagggccccattgcaggacccttatggactgcatgcagggtcgttgcacaacccccgccgggccagctgagtttcccagcgcattgctaagctcggccgggcggcagggggttccaggccattaaatggctcctgcaggactacctggagtcctaaatcttggatgccccttcctcccctccctgtgtcggactgcgtgcagccccaggtcactgcttgactgtcatgaagctgcttggagcactttcattgcatggcccctactggacaactagacttttcagacccgttgcacttggtgtacatatagactcttatacacatgctcaccagcatcctgattcttgaatcgcatggcaggccctgacctttgtaacctcttgctgccaggctccagtgggcactggtagatctggaatgcctggcccttcactccacctctgtcttcccccaggatgggagctacagtttttgtccagcccctggacctggtgaagaaccggatgcagttgagcggggaaggggccaagactcgagagtacaaaaccagcttccatgccctcaccagtatcctgaaggcagaaggcctgaggggcatttacactgggtattggggcctcaggatggagggtagactgtgggttggcagctctagaccttggcctgatatgctgacccctctgctcctcaggctgtcggctggcctgctgcgtcaggccacctacaccactacccgccttggcatctataccgtgctgtttgagcgcctgactggggctgatggtactccccctggctttctgctgaaggctgtgattggcatgaccgcaggtgccactggtgcctttgtgggaacaccagccgaagtggctcttatccgcatgactgccgatggccggtgagttccaagtctgaacctaaccccagccccattccctcgaatctagaatgaaaggaccagttttttatcccggatctggagcagagtgtttacctgttctggccttcctttctttgcacctgtgggcaatcctgatcttgacctctttctgccttcccaccaggcttccagctgaccagcgccgtggctacaaaaatgtgtttaacgccctgattcgaatcacccgggaagagggtgtcctcacactgtggcgggtgagtggaggggctggagacttgggggctgtgaggtctggttttaggggkttctgactcttccccgctcccctccctccagggctgcatccctaccatggctcgggccgtcgtcgtcaatgctgcccagctcgcctcctactcccaatccaagcagttcttactggactcaggtgagatccagagctgggcccttagttcccagcctggcctgagccacctctgagctgactgccacccccgcctcacctcccccaggctacttctctgacaacatcttgtgccacttctgtgccagcatgatcagcggtcttgtcaccactgctgcctccatgcctgtggacattgccaagacccggtgagtgtgcagcctgggcctggaggtgggtgggagggtgccctttcggtctctcatgcccctgcrtcctctcctgcagaatccagaacatgcggatgattgatgggaagccggaatacaagaacgggctggtgaggaagccattctgggggcctgggagggggtgtcggatcccctgggaaaggtgtgaaggcagctgggtgagggggatggggacctagagtcctagccccagcgccctgcctgtctgtgtctaggacgtgctgttcaaagttgtccgctacgagggcttcttcagcctgtggaagggcttcacgccgtactatgcccgcctgggcccccacaccgtcctcaccttcatcttcttggagcagatgaacaaggcctacaagcgtctcttcctcagtggctgaagcggccgggggctcccactcgcctgctgcgcctatagccactgcgccctgggggcctgggctctgctgccctggacccctctatttatttcccttccacagtgtggtttcttcctctgcggtaaaggacttggtctgttctaccccctgctccagcttgccctgctygtcctgatcctgtgatttctctgtccttggctattcttgcagggagctggaaaacttcctgaggatttctggcctccccctgggttttagtttcagggcacacaggacagcagaagatcccctttgtcagtggggaaaccaaggcagagctgaggggacagggaggagcagaagccatcaagatggtcaaagggcctgcagagggagatgtggcccttcctccccctcattgaggacttaataaattggattgatgacaccagccccaaatctggagagtctggggggtggctaggagaggggaggagactggacaaagaagctggagaataggaactggagwttttaagaaaaattgttaaagaaaaagcagccgctggttttttgcaaatgctgtataaatckgtcatgccacagcagctgacagggccagaaaaactcaaatcccaggcccggtgtgtttcctccagccactcgcccaagaatgccaccgatgcccagatcatctcacataatccccaggaaaagcccctcggtctgatgactgcttctgcagcctaaagagggaggaaataaagagacttagagaggaagtcagaccactgtgggctggaggcagtgcaggtggaaggccagggcttaagtgggtgggcactggaagcttgaggaaaggggaatgctggccagagacctgatctgggtccttggctggggagagtgagaaccttgtccatttctttagaagatgtgtggttcccaggccagccttcaaggagccttaaaacctcttggggcacaagagagtttgggaaggtcaaactgaggagtgcttgccaggctaggggacaggcaggcagcaggtgggagctgtccctttggcagagcctcatcagcagaagaggtggagctcagcatcctggcgcccctgctgctgcctctgtgtacactgtcctgcgccttggtggctattgtgagatgcctgaagcctagaccttgtccttaaggagttcctggtccagaagacaagattatacaggagcagttgggaaactgagtgtagcaatagtgttgcagggtaacttggagcacctggcctcgcctgggagtagtgacttgcagactgagtggttagactggctggggatggggcaaggatagcacacctggctggactgagggcaaaggcttagagtaaaacactgttggggagcaggtgatctataggcttgtgatagttggagcacagactgtgaggtatctcccttgagatgaagctggactgtcagatggggtcagtgcttggcactccctgactgccaagctcaggagttggtcctccacctggggagagattcggtcagactttcaggtttgggagatcttcaggaccatctggagggggatgggggtctccatagtcccattctctgggccccaagccttggattgggctggagacaaggcaggagaggaagccacaccagtgtgtttagagaatggcaggatttatgagaaaagaaatggggttccatttgcctgtgtcccagcctgagagcaggaaacccaagactattcagtcacaccaagatggtgcatgctgcagggtccaccccttgctgtcctgctgacctgggcagtgaggagagctgcacttctgaggctgcaggtgcaaagcaggcacccacctttgcccctagtactgcaggctgctgccaggtaggtcccagcagttgtcattaaactccaggaaggcaatttttgagctggatctgatgcctggggtggcctggtgggtggccagccctggaggagaggaggcaccccaggcaggggaagtgtaggctgtaactggaggtctattggataagtagttgtgaccagggtagggcatttggagccttgtgaattctcatgacaggtgccccagccactcttcaccaaaagaagccaagttgttttgagacaggctctcactctgtcacccaggctggagtacagtggcaccttcagggctcactgcagcctccatctcccaggctcaggtgatcctccctcctcagccacccgggtacctgggaccacaggtgcatgccaccacacctggctaatgttttgtattttttgtagaggtcgggttttgccatgttgccaagcctgggccaaactcctgggttcaagcaacccacccgcctcagccttccagagtgctggaattacaggcatgagcccctgcacccggccagaagttttttttttttttttttttttttttagacggagtctcactctgttacccaggctggagttcagtggtacgatcttggctcacggcaacttccgcctcccaggttcaagcgattctcctgccccaccctcccgagtagctggggttataggtgtgcaccaccacgcctggctaatttttgtatttttagtagagacagggtttcaccatgtttgccaggctggtctcgaactccctacctctggtgatccacccgcctcggcctcccaaagtgctaggattacaggcatgagccatcactcccaaccctaaaattattttttattatacagataatatacaataatagtggaaaactagaaaatgctaaacagggaaaaagaaaataaaaccacccatatttgtaacatccagacacaacgagtgctcacatcctgataaatcactttccagattttcttctgtgcatagatgcatgtgggaaccatgctgtattctgccaaaatggttcaccgtgagatctggcagcgccccatgcagcatcgggagctttgtcttgtccccccgccaagtccatgtcattaccccttctgctttggctgggactgaaattgtgtgcctgtgttgtgaagacagggcttctgatacagaaaaaggaactaagacccctcccctatcaccctgtgttccttacccctccaacccccaactagattccaataggagagcccacaggctcttctctcaaggtccccaaacctcccaccctcagaggctgtggccagagtacctaatgctcactgtgctcagcaggtcctgaccacgaccctgactcagagctgagggcctccttcctgccactagaggccccacacggccattaggccgtacccacaggaagaggctggagcggaaagtgggaagcgaacctcgaaggaagagcagccaggcccggggcactgtcacttgccgtcccctctgcagctccaggtgtgtggtttgtgtggctgtggtcagagcagcaccttggccagagtccagggcctgtggtttcacatgcccaacccagctcagcagcaggatgaggaccacagaggcaaagagcagccagaagagacccaagacatagaagcccagggggaggaggcagcaaaagtcggggtggagaaaagggtcatttctggagctctccaaatgcccttggagcaccccacggagctttggtggctgatcaagttcagggatggtttttttggtggattctaagagtgatacgggttttgtggtagttaaaaatgtgctttttggagtgatcaggcttgtggcagacaccaggatggtcgggcttgtggcgatggtcgggattggggtgggctccggggtggtcgggctgggggcgggctctgaggtgggctctggggtggtcgggcttggagtgggctccagggtggtcatgtttggggcgggctccgggacgggctctgaggtggtcgggcttggggttggttcagtagtggattttggagttttggagaatgtgatggattccatgtgaagtgtgaaatttggggtccatctaggtgggaatgtggtctgctccttagtggattcttgtgttggatgcaaggaggagggcatttggctgtctagagaagcagtggaccatgagtagaatagaccccagggggttgtatgggctttggtggggaacttgaccacagtccttgtggcacgcaccttatcgccctcagtgtcctcttctgggtagtaatcatataggtctgtgtcaccttcatcaccaagggtggggcacccctttcctgggtatttgtagacgggaaacttgtctgaattgtcacactgcacactggccacgttagaggtcatggccttgacgtccacaccttgcttccatacgtagacattttcagcattgtcctgcagccagcgacgaaaatagaggatctcacagttgcataaccaggggttcccgtggagaaaagcaaaaggcaggaggtgggacccaaaaaagccctttggtattgtatacagcgagttctcttggaggagaagggtgtcgagattctccagcccattcaggagcccagcggggagctcagtcaagttgttgttagccagactgagcttctccagcttgggtgtgggcgtcaggagccctgggggcagggtcttcagctcattgcctttcaggtagagctcttggagttcgccaagaccacgcagggcaccaagaggcagcgaggtcagccggttgaaggagacgtccaggacggtgagagcaggcagtgtctgccctagcaagggcaggctttgcagctgattgtgggatagatccagggtccccagcactggcagcgtcccatcgacctggagcttggtgagctcgcacctatctaggttcagctgagtgaggcgagtgtaaggcatcagggttgccagggagaaggtgtacaggaggttctcactcaggtggaggatggttgtgtctttcggcaggtctggaggcagcgctgtcagattcctcttgtcacagttcacttctaggtggctggccactttggagacctcacagatggggtgggggtgtaaggggcttggcagcaggagcagcaagaggaggagaggcatgaggacctgtgggcaagggagccttgagtggatccccctgcatcccctggaagcatccccccaggccccagcccccttccccctgcagcttcgcttccagaaacagcatccacacctcctgtcctccctactcccatctcccacccttgcctgcagaacttaaaactactagctccaggtccttggctctttcccctccctcagacccctctcctgccccagcaccaaccccggcttacaggcaggcagaaagacctccgaaggcacagagcgtcttctagggtgccactcgactccgtccttctctcttctagccccatggaggactaagccagtggcaaggaaggggatgggggtgaggaggaaatgcaggcctgatagggattccagtgaccgggaatcccctggacacaagcccttatcgcctcactccacggctttcccccaggccctctttgtggttctctcttccgctttccttttacacaggggagatgggggtggactcctccaaacagccttctgccatcttttaaaaacctctccagggccgggcgcgtggctcatgcctgtaatcccagaactttgggaggctgaggcgggcggatcacctgaagtcaggagttcgagaccagcctgaccaacacggggaaaccctgtctctactaaaaatacattagccaggcgtggtggcgcatgcctgtaatcccagctactcgggaggctgaggcaggagaatcgcttgaaaccgggaggtggaaagaggttgcggtgagccgagatcgtgccattgtactccagcctgggtgacaagagcaaaactccatcttaaaaacaaaaaaacctctccagatgcccgcttctcttcctcttcacagctgcattctgagagttgcctacttttaattctctcccacctttctctctgccttctcaccccagtctatgctgatttctttcccctgctactccattgactcggttcttaccaaggtctttaatgctctccctcctctacatccatgggaaacttctccactgtgatcttactttatttcggcagcctgcatacccatggccactcgccccttgggattctccttttggcctctgtgacacatgaccctgtaattttcttggttttcttcttacctgtttggttgggccttctcagtctccttcatagattccccttcttgaacaattaaactgcccccagagtttgtgcttaggctgtcttcattcccagctaatttttatatttttagtagagacggggtttcaccatgttggtcagcctggtctcgaactcctcatctcaagtgatccacccacattggcttcccgaagtgctgggattagaggcatgagccaccgcgcccggcattctcttcttttcttacgctatgcaaccacctgagattatcctcatccattcccttgccttcaaccaccacctacaacctaatgactctcaaatctatgtctctagtccagacccttctcctgagacacaagcacatatgtccagctgccttctggacatct

SEQ ID NO: 17980 - DNA, 17149 bp, Homo sapiens
aaaccatccctgaacttgatcagccaccaaagctccgtggggtgctccaagggcatttggagagctccagaaatgacccttttctccaccccgacttttgctgcctcctccccctgggcttctatgtcttgggtctcttctggctgctctttgcctctgtggtcctcatcctgctgctgagctgggttgggcatgtgaaaccacaggccctggactctggccaaggtgctgctctgaccacagccacacaaaccacacacctggagctgcagaggggacggcaagtgacagtgccccgggcctggctgctcttccttcgaggttcgcttcccactttccgctccagcctcttcctgtgggtacggcctaatggccgtgtggggcctctagtggcaggaaggaggccctcagctctgagtcagggtcgtggtcaggacctgctgagcacagtgagcattaggtactctggccacagcctctgagggtgggaggtttggggaccttgagagaagagcctgtgggctctcctattggaatctagttgggggttggaggggtaaggaacacagggtgataggggaggggtcttagttcctttttctgtatcagaagccctgtcttcacaacacaggcacacaatttcagtcccagccaaagcagaaggggtaatgacatggacttggcggggggacaagacaaagctcccgatgctgcatggggcgctgccagatctcacggtgaaccattttggcagaatacagcatggttcccacatgcatctatgcacagaagaaaatctggaaagtgatttatcaggatgtgagcactcgttgtgtctggatgttacaaatatgggtggttttattttctttttccctgtttagcattttctagttttccactattattgtatattatctgtataataaaaaataattttagggttgggagtgatggctcatgcctgtaatcctagcactttgggaggccgaggcgggtggatcaccagaggtagggagttcgagaccagcctggcaaacatggtgaaaccctgtctctactaaaaatacaaaaattagccaggcgtggtggtgcacacctataaccccagctactcgggagggtggggcaggagaatcgcttgaacctgggaggcggaagttgccgtgagccaagatcgtaccactgaactccagcctgggtaacagagtgagactccgtctaaaaaaaaaaaaaaaaaaaaaaaaaacttctggccgggtgcaggggctcatgcctgtaattccagcactctggaaggctgaggcgggtgggttgcttgaacccaggagtttggcccaggcttggcaacatggcaaaacccgacctctacaaaaaatacaaaacattagccaggtgtggtggcatgcacctgtggtcccaggtacccgggtggctgaggagggaggatcacctgagcctgggagatggaggctgcagtgagccctgaaggtgccactgtactccagcctgggtgacagagtgagagcctgtctcaaaacaacttggcttcttttggtgaagagtggctggggcacctgtcatgagaattcacaaggctccaaatgccctaccctggtcacaactacttatccaatagacctccagttacagcctacacttcccctgcctggggtgcctcctctcctccagggctggccacccaccaggccaccccaggcatcagatccagctcaaaaattgccttcctggagtttaatgacaactgctgggacctacctggcagcagcctgcagtactaggggcaaaggtgggtgcctgctttgcacctgcagcctcagaagtgcagctctcctcactgcccaggtcagcaggacagcaaggggtggaccctgcagcatgcaccatcttggtgtgactgaatagtcttgggtttcctgctctcaggctgggacacaggcaaatggaaccccatttcttttctcataaatcctgccattctctaaacacactggtgtggcttcctctcctgccttgtctccagcccaatccaaggcttggggcccagagaatgggactatggagacccccatccccctccagatggtcctgaagatctcccaaacctgaaagtctgaccgaatctctccccaggtggaggaccaactcctgagcttggcagtcagggagtgccaagcactgaccccatctgacagtccagcttcatctcaagggagatacctcacagtctgtgctccaactatcacaagcctatagatcacctgctccccaacagtgttttactctaagcctttgccctcagtccagccaggtgtgctatccttgccccatccccagccagtctaaccactcagtctgcaagtcactactcccaggcgaggccaggtgctccaagttaccctgcaacactattgctacactcagtttcccaactgctcctgtataatcttgtcttctggaccaggaactccttaaggacaaggtctaggcttcaggcatctcacaatagccaccaaggcgcaggacagtgtacacagaggcagcagcaggggcgccaggatgctgagctccacctcttctgctgatgaggctctgccaaagggacagctcccacctgctgcctgcctgtcccctagcctggcaagcactcctcagtttgaccttcccaaactctcttgtgccccaagaggttttaaggctccttgaaggctggcctgggaaccacacatcttctaaagaaatggacaaggttctcactctccccagccaaggacccagatcaggtctctggccagcattcccctttcctcaagcttccagtgcccacccacttaagccctggccttccacctgcactgcctccagcccacagtggtctgacttcctctctaagtctctttatttcctccctctttaggctgcagaagcagtcatcagaccgaggggcttttcctggggattatgtgagatgatctgggcatcggtggcattcttgggcgagtggctggaggaaacacaccgggcctgggatttgagtttttctggccctgtcagctgctgtggcatgacagatttatacagcatttgcaaaaaaccagcggctgctttttctttaacaatttttcttaaaaactccagttcctattctccagcttctttgtccagtctcctcccctctcctagccaccccccagactctccagatttggggctggtgtcatcaatccaatttattaagtcctcaatgagggggaggaagggccacatctccctctgcaggccctttgaccatcttgatggcttctgctcctccctgtcccctcagctctgccttggtttccccactgacaaaggggatcttctgctgtcctgtgtgccctgaaactaaaacccagggggaggccagaaatcctcaggaagttttccagctccctgcaagaatagccaaggacagagaaatcacaggatcaggacgagcagggcaagctggagcagggggtagaacagaccaagtcctttaccgcagaggaagaaaccacactgtggaagggaaataaatagaggggtccagggcagcagagcccaggcccccagggcgcagtggctataggcgcagcaggcgagtgggagcccccggccgcttcagccactgaggaagagacgcttgtaggccttgttcatctgctccaagaagatgaaggtgaggacggtgtgggggcccaggcgggcatagtacggcgtgaagcccttccacaggctgaagaagccctcgtagcggacaactttgaacagcacgtcctagacacagacaggcagggcgctggggctaggactctaggtccccatccccctcacccagctgccttcacacctttcccaggggatccgacaccccctcccaggcccccagaatggcttcctcaccagcccgttcttgtattccggcttcccatcaatcatccgcatgttctggattctgcaggagaggacgcaggggcatgagagaccgaaagggcaccctcccacccacctccaggcccaggctgcacactcaccgggtcttggcaatgtccacaggcatggaggcagcagtggtgacaagaccgctgatcatgctggcacagaagtggcacaagatgttgtcagagaagtagcctgggggaggtgaggcgggggtggcagtcagctcagaggtggctcaggccaggctgggaactaagggcccagctctggatctcacctgagtccagtaagaactgcttggattgggagtaggaggcgagctgggcagcattgacgacgacggcccgagccatggtagggatgcagccctggagggaggggagcggggaagagtcagaaacccctaaaaccagacctcacagcccccaagtctccagcccctccactcacccgccacagtgtgaggacaccctcttcccgggtgattcgaatcagggcgttaaacacatttttgtagccacggcgctggtcagctggaagcctggtgggaaggcagaaagaggtcaagatcaggattgcccacaggtgcaaagaaaggaaggccagaacaggtaaacactctgctccagatccgggataaaaaactggtcctttcattctagattcgagggaatggggctggggttaggttcagacttggaactcaccggccatcggcagtcatgcggataagagccacttcggctggtgttcccacaaaggcaccagtggcacctgcggtcatgccaatcacagccttcagcagaaagccagggggagtaccatcagccccagtcaggcgctcaaacagcacggtatagatgccaaggcgggtagtggtgtaggtggcctgacgcagcaggccagccgacagcctgaggagcagaggggtcagcatatcaggccaaggtctagagctgccaacccacagtctaccctccatcctgaggccccaatacccagtgtaaatgcccctcaggccttctgccttcaggatactggtgagggcatggaagctggttttgtactctcgagtcttggccccttccccgctcaactgcatccggttcttcaccaggtccaggggctggacaaaaactgtagctcccatcctgggggaagacagaggtggagtgaagggccaggcattccagatctaccagtgcccactggagcctggcagcaagaggttacaaaggtcagggcctgccatgcgattcaagaatcaggatgctggtgagcatgtgtataagagtctatatgtacaccaagtgcaacgggtctgaaaagtctagttgtccagtaggggccatgcaatgaaagtgctccaagcagcttcatgacagtcaagcagtgacctggggctgcacgcagtccgacacagggaggggaggaaggggcatccaagatttaggactccaggtagtcctgcaggagccatttaatggcctggaaccccctgccgcccggccgagcttagcaatgcgctgggaaactcagctggcccggcgggggttgtgcaacgaccctgcatgcagtccataagggtcctgcaatggggccctagcagcccatcggggaactcgcaatacgctggagatcgcgctgaccccgtgccggcacagttcactgcaacagacccagagatgaaccgggcccggttccttttgcccttcccttcctcctcttttcccatccctggggcctgagcttacccggccaggcccccaaacaggaacttgacggacttaggggaggtacggggcttcccgtctatcccgccggccccggcactcgccgtcgccgccatcgccactcaatggccctcggctccgggtcccgtgcgcgcgcggccccgctcgcgcccaaggtgacaccgcgcgcgcaacagagcgagggcgcgcgcacgcccctccagctctcaggtccgacacccgctggaagccggcgcgggcgcaggcgcgcagcgcaaaggcggccgggagtaaggcggagctgaaggaggagcttgatggaagcgtgcgagaaggggcgtaactgatttggaaaccagaggaaaggcgctgttttcaccgaattagaatcgcgggaaaatagagaagagtttgtttgaaggtctcgcgagatcgagtgagtacggctcgccaagttggagcgctctcgcgatagacacagcaactattcagctgcgaggggacgggagaggtggtgagcactctcgcgagatttgaaggagcggcggaggccagagggaggagaggtttgtaaactaggaggctccgggtttccgggcacttttattaggtcgtcttctgggccaccagtgccccttccatctccacaggcagtccctccatcgctaacctttttttaaccggccttttaggaccggaagtccttcatctcaagcatccaatgctgaaagcggcctgattttctctaccggaagcccttttccagaggctgggaacacggcccacctagcaggaagtcccacctccttgagctccgccacccttcccgaagtttttctgtcacctgtgttaggctccgtcccctttccgcgttttatccccgtaccagaaaaggatacatttagtgcctcccacccagctccactaaacgggttggatatctcattctttgagttggtgttccttccccggcgcccccatgtagctgggaagtgggacctgggggtggttggacccctgggatcctaaaggaggggcagggagggcgcagaactccgcttctgctccttgctaccaggacgcgcggcctcctcagcctctttcctcccgctgccatgcaccctgcagccttcccgcttcctgtggttgtggycgctgtgctgtggggagcggccccgacccgggggctcattcgagcggtgagtctgagggacggatggggaaagggcgctgaaaggaagggttgcaggctgaaggggaacatcgccttttttgtccgcagacctcggaccacaatgccagcatggactttgcagaccttccagctctgtttggggctaccttgagccaggagggcctccaggtgattttctttcttttcttttcctccttccctcccttccttccttttctgtcttttttctttttttagtatttcgcaagatcctccatcctaggctggggttggggaggtttgtcctgggtgaaactggaggtaggaaaatgaagttaggaactgagcacgtctagtgtagaacccagaatctagagggagaagacagagtgtccacccctggaactccgaggttatcagggagactgaaagtggacgaagacagaaggcaggatcaacggtccttatcaggaaggtctcaggtgctagttattgcttatatgactttgggcaagttaatctctctgagccttagtttgttttactgtaaaatgggatattagaagttttcctagggttattgtgaagatcaaagtagatacgcaattttggtagtayttcatcccaaagactgccacatagcaagaactcagttgggccttagtagcagtcgagttgtttgtgagatgggtaattagaaaattgaagaggccgggcgcggtggctcacatctgtaatcccagttcaagaccagcctggccaacatggagaaaccctatctctactaaaatggcaaaaattagctgggcgtgatggtgcacgcatgtagtcccaactacttgggaggctgaggcaggagaatcacttgaaaccggaaggtggaggttgcagtgagccgagatcgcgccactgcactccagcctgggtgacaaaacgagactccatctcaaaaaaaagaaaaacaaaaagaaaactgaagggaggggagtgtgtctgtatgagtatgtgctggagaggggactgtgaaacagaacttgagagaaagtgacatgggtggtttgagaattgaattacaattggaatattagaaggcaaaaataattgcattagcttgcagtatagggtacagattagcccatctgggacagcgagagggatgatgggagagtttggtgaagggatgttttatgtcattgccttttcaagaggctaagagaaggttgtgatggtgggatgctcactcagaccccaggaaggaggaggaagtgaggatagaggatgtgcagcatgtgggctggtgtgtttggtggcccctgtagagagcagaatctagaaaggagaaatctcactgttgtttgcttccatccttcaggggttccttgtggaggctcacccagacaatgcctgcagccccattgccccaccacccccagccccggtcaatgggtcagtctttattgcgctgcttcgaagattcgactgcaactttgacctcaaggttgctraatgaggaaggggagctgggcagctgagggtaaaaaaaaggcaccaggaatgaagacaggtaaggcccatgatggctccttgtcctctgccttgtctccctaggtcctaaatgcccagaaggctggatatggtgccgctgtagtacacaatgtgaattccaatgaacttctgaacatggtgtggaatagtggtaaggctgggggaatctatacagctgggctttcagtaggacccagagatggtgggaaggctgaaggcctcaggaaaagaagccartcctttaggtggggtggggccaaagtgcaagatgccagggttcccagaggatttgagtagaaggttgtgagtccccagagtaacaccttgatccctgcagaggaaatccagcagcagatctggatcccgtctgtatttattggggagagaagctccgagtacctgcgtgccctctttgtctacgagaaggggtaggacatgtgcctccttcccattcttccttcagcaagcagttccatgccaacctggagcccaggcctcctcattacccgaaccattcagcctcctgtmcttccttccctgcctctttgactttcttcccattcctgtccccacctatgggctttgtccagagccagttactttgtccctctttttttctccctttgcctttctcgccctgctgagactggtcatccttttcccagggctcgggtgcttctggttccagacaataccttccccttgggctattacctcatccctttcacagggattgtgggactgctggttttggccatgggagcagtaatggtgagtagctgagggaacatgatgggaagcactgaggcctgtgaggccagactggatctggagttgggagatgggagtggcttgtcctagattgtctagttttgttcctaagccttgtccatccacccccgcttcccccagatagctcgttgtatccagcaccggaaacggctccagcggaatcgacttaccaaagagcaactgaaacagattcctacacatgactatcagaagggtgagggggttaggggagaagagggcttttcccacagtttacctggttcwgaaggactttgagcccagaagatagggtatacaaagatggcagtggccgggcacagtggctcacgtaatcccaagtgcctctaatcccagtactttgggaggccaaggtgggcaggtcacttgagcccaggagtttgagaccagcctgggtgacatgataaaacagaaaagtcccagcactttaggaggctgaggcaagtggatcccttgaccccgggagttcaggccagcctgggcaatgtggtgagaccccatctctataaaaaaataaaattagctgggcatggtggtgtgcacttgtagtcccagctaattgggagactgagacaggagaatcacttgaaccaggaaggcggaggttgtcgggggctgagattgcaccactgtgctccagcctgggcgacagagggagtccctttctcaaaaaaataataataaaaataaagatggcagtaggaaggtttcagcttgagatgctgtcttttcttctgyttttatgcataaatacaacgaagacgggagaggagatggaaagcaaagatgattaagtgaaataattgtgggaaacaatagagggayagactttgyttataggggatgtggacagagcagaaaaatgggaggaatggggaggattcagttagagaaggaagaaaccggtaccaaggggctggggctttaggccctggggcctccagtgcccgtataaggctgtggcagaagccctgcccatttccgttccttccactccctatctccaccctcacacctccccaaaaacccacttccyttcttacctctgcttctctttgcttgtcccttctagccctaaattcttccatgttctgccctgaccttatcctgcctacctgtcttatctcttccactggctttgtaggtgaggggaaatttttgcaaggctttaaaagccttagccctgggtcattgtggctcagtgaaggactagattattttctttctgtcccaggagaccagtatgatgtctgtgccatttgcctggatgaatatgaggatggggacaagctgcgggtactcccctgtgctcatggtgaggccctcactgcctgcccatgcccctctgccaccagcagccaccaggtgcttcaccttgttcctctctgcagcctaccacagccgctgcgtggacccctggctcactcagacccggaagacctgccccatttgcaagcagcctgttcatcggggtcctggggacgaagaccaagaggaagaaactcaagggcaagaggagggtgatgaaggggagccaagggaccaccctgcctcagaaaggaccccacttttgggttctagccccactcttcccacctcctttggttccttagccccagctccccttgtttttcctgggccttcaacagatcccccactgtcccctccctcttcccctgttatcctggtytaataaccccccacacatamacctctggtgacctatttgcacagaccgtcgtcttccctccagtcttytgagggataggggacattccatcccaagcttctcccttacccacacctatccttttgaggggctttggggtggrgctggggcaagcagagggactgggtcttcacttcttgggctaataaaattgtttctttgtggactaaggaagggtaagatcattctcacacaggtgaacttaaccctttggtggaatcacccctttagccataaggagcaagggaatgctgagagacactaacctatagtcatggggacagccccagccggcatttgctatgactcagaagggggagccccacccacaaggatgactcaactagccctgccttgcctgcaggcctgcacccattctctggtccagatggctctattccatcatccaccaatttgaccagcacactgaggacttaggcctggaaatgccactgtggaggggcagggccacctggccagaagctcaaattcctgcaccttgtagtacctcaacctccctgctcccaagccacgataaaggaggcaagtcacagtgcctatcccccattctgacacccaagctcaaatcacacagcaccttgttagtagaatcttttttattcagaaaaaaaaaaccccaaaaaacaaaagttttccaaccacacacgggagggatatgggtagggggaggtgtctgtccatccagccctggcccccagcccatgtggttttggcagcaataaggggtatggggtaatggcccaaaaaataaaatggtttgtgtgtgtatggggaggaaaggggtgcaaagctgtggggagcggtgaaggggaagggacagacgaggtcagtactgggaacgccgaaggtgggaggccatttcataacatttcttgttgatcaaaccaccgtggacaccttctttgcccatcagcaggactagcgctggaggaggaggaaagagaaaggaggctaggatccaggtgtcacaattccaccccctgccagctgttcagcagctgtccagccctgggggctgtaacccaacctcatctctcccaacccgcccccccaccacacacaggcaggctgtcagtcaccctgaaacaataaggcttttcaaaagaggaaaatcaagcttaaacgctggagaggaacagactaaaaacttaggggtcaaaggctcatagactgttgattcatgtgttcaggctagaaagggctgtggatgtgcatgccacctccaggttctaacaaaagaactcaaacgatgaactcgatgattcaggaccccaacaatctacctatactcctagaaaacagtttctaatccgagctcaaggcagtaagtaatttaagaggtaatgcagttcagcaacttcgaattacaagatgaggaactgagacagaatggagggactatcccatgttccagcatccagcagacaaggaacacaatactggtctgactcccttcatgttggggaatcacacaaaaaagcaccctcaagattaccagaaggcggtacattagagatcttggagctaaaggaagggtaagactcaggaactcactcttgtcagtcttggtgacagtgacattgaaggtgggggccccaccggtgctcttggtacgaagatccatgctaaattccccatcctgcagcagtgagtcccggatcaccgaacatttctggcccccaagtgtcagcccattcacgtaaaaacttgaccggtctttgccaaccaggacacccacctcagctggctggaagaggaaccaagcgcccatcaagttagtcagtgcaccaagattcccaccgtgttctccaaagacccacctgtcttccacttctgagaaccaccccgccgtgggggctaagtataaattatatactcagtacacatcaatgaactgtgagaaactctgaggactgtgggacgttagtgcagaaaaagatcatgattctgaaacttagaatatggaaccagggaggaagggatgacatactcctctagagatttagatgtcagtgttaatggggaaagtaaacccaggaaataaagggagtcagtgaggtaagtgaggagcctttggatgctcagaactctccttcaggaaaagcagaagcggagaggggaagggaggggggcgggcgaggcaagagaagcaactttgcccttatttggtcaaaggttctgcaggagctgttagggcccggacgcctgggtctccaagtaacctagagtttagctccaggtatctctgctctgagatgaggaagcagacccctgggggctttccgggaaagttggaaaacttttgaaggtggacaggggccagacccggcaggccagctctcgggtctaggtaccccgggaacctttcccccctccccctttcaccccaagcccccacatccggtcccctcccgcccggaaacccccttccccccccttttgaacttccgctccccctccccacttccgggcagtgtggacagggagatggtggtgggagcagcggtagtaaaccaatatactttcgcttatgctgtctcagaacttctcacaaagttcccctgctccaggccccgccggatggcgggaagggagggcgaggggacttccgggattggcctcgcaggaatgttgaatccaacgtgctgagctgggggggcgtgtggtggcctcgccctctctaacggagttaggaggggccaggagcccacagagggtgggcaagggaccaagaccacgcgcctggggctcccttccgcaccaggagaaacaatggtagagggacgcgggctggcagccggacggggagctgggggtccaaggatccccgggtcccctctcaatcccaatccccagtaaaaactgaggcgcgtccccgccccgccctgggagaggcggaagtgggccgccgcaccgggcgccgcgcccctccccgccctgtgccccggatgtaacgccccgtcgcggaaagcggggtagcgggcgggatgggcgccgccgcctggggcataggacctacgggcaactgagggacccactcacgtgcagccgccattcgcgccgcttccagggcaagcacccagtcagggcctctcgctgcgcgccctagaccgcgcccgcccccacccaagtccctccctcagggtccaaaccggagcagtgccccggaccgcgcaggcctcgcagtaccgtgatgttgacgaacgttttcccggggacggcggcccagacggagggcgagtccttgtagcccacgatggccgcgtcctgacaggtcccgtccgccatgaggttgtcgatgtaggcgttccacccggccatggcgctgctactggggctgctctcggcgctgctgctggggccgcggactgggctcgagctgcctcggctggcgggcggggggaggcggagagctcggggcacgcgctgccgtccggaccgcggctccgctcgctgtgcagcagccctcgcaccgccacttcctgctcctccccccccccgccccgctagatttttatttgcaaaggacggtaggggcggggcctactccccattccctccctcccccactcgccagcccagacaccgaactttgcaaatgcaattttaaaaatccctccccctattgcaaaatttgcagagttcgatggaaagcaatgcagaaggatggggggtggcgggagagaggtgaagggtagggtttgctccaatttgcactgaatataaaccagactttggtatcggggcagggagtgagccagaagaaggaaggaaggagaaagcaggaggaattagcaagctgcaaatttagcaaattaaggagagttcggggagcccagggttaaacgggatgactcctccttcccccacctccgccgaagggaaggaccggcgggcggcggcgcgtgtgcccgcgcctgcgcctgcgccggggccgggagtgcatggggcggtcggggccggagccggctgcacgggagcgcgcccggcccgacccgtgtggaccctgcgggaaaggaaggcgggctggggacgtgtctcccgcctggcggaaggggcgggggcgaagccgtgcgcgctgccgcctcaccacccttgattttacttattcaagtaataagaaagcaaagaagagtttggccaaatcctctagtcgctctcatagctgaaggcacccaccggggccacttctgtccccagcgtcttctcgggtcgtgcaggttgggttcaccagggcccattctcagtctagaggattgtcccttctctggatcggctctagcccagggcctcaccccacatcccagccccgcccgccccaggcaggcaatgtctggatcaccggccgtgccccttggcctgtgtctgcagaggtcacagagcgcggacacccgcggggcttaacaggcggggctatttttcgaggcggaagaatactcaagttgcaagagtggcaactttttcaagaaggggaaagtcccacttcgggccctttgggtttcttcgcagtcagatgtgcgctcacagccacctggggagggcgggacgggcgggacggccgtgcggcggccgcggtgaaaccgcctcctccgacccgccgccgagggctgggcggcttccggagcctgggctaggggcaaggggtcaccgagcgcggcccgggcggaaagggggttggttttctctctcctcccgagcgcggcgcgcatccctggcgtccacgccgaatcccacagtccccgacgcccctcgagtccgtgttcctcgacagccgcgcggctgagtcactggcgggctcgggcggggccgcacccgggcacgtggcggcgctccccgcccgccatctcctgacccctggcccaccgcacccctaccccagggtggaaaaatcccgggaggagcggcctgagatgagggggcggggcgagaggggagactggacgggtggcggggcaggtggcctggggtgggggctgggaggccgcgcgggccggcggggcggggagcaggggtggggagagggcggcgggggtgagtcaccgggcgcgcgctgccccggcgccgacgggaagggcctccgagtcgggccgaggcgccgtgtgtcccccgccggtcggctggtatggctgcagaggagctcggggcagaccccgcactggccccagagccggcaaagtggagatctctaccgagggcagagacctacctccccgcagtgctacaagtggggcgccggaagagccccaggcgtgcagaagctcacaaaaggccacccgtcctcggtccattcatttttgttcactgttgattcagccccattcattgatgggctggggccgtgcgctgagcgcccacagtcgatggggaaaggggctctgaccgacagtccccacgccgggcgacaagtgctgtcccagcgttatcagtcgggcgccttgccagccgaaagggcctgtctaaattcgtttcctgtcccctaactcatcccggcgctggctggcctggagagggtaggatggggcggcgccgagaatggccgttatgaggaccctaagaggtgagaccctctcgccttctggggtggggggtcccgtcctttcccccactgaggacagaggcccgcccagcgatctgagcatgtgtggacgtcaatcttgcagcccctcttccaggccccctccccagccttgcagggctcaggttacccctggcctttcctaaaggtcactcattcctcttgacgtttgcaaaaggggaatgtaatcctggggtggggggagacccctcatctgtagcccctcccttgctcctcccaaagggtggaattagaacagggactgttattgggagacagaaagtgggggatagtagttgacctttggtaagggggcaggtgcccagggccagaggcttctgcttcaggctgtagtgggcacttggctgccagcccagtgtgaaggggggaggatggagagaaagagaggcggggctggctggggaccgagtggctcagggataaatgcgcagcctgagagggggtgagctgacactgtcccagctgccacctagactcggagctccatccaaacctccagcgaagacatcccaggtcgggtgaatcttccagccctgggggtggaggtagtaaagggt

SEQ ID NO: 17981 - DNA, 18097 bp, Homo sapiens
acatggtgaaaccccgtctctactaaaaatacaaaaaattagccgggtgtggtggtgagcacctgtagtcccagctactcaggaggaggcaggagaatcgcttgaacctgggagatgggggttgcagtgagccgagatcatgccactgcactccagcctggatgacagagcgagactccgtctcaaaacaaagcaaagcaaaacaaaacaaaatacacatagaatttgtccaagttattatcacccagtgtgaaaagcagattttatagtataaccgtttttaaatgaggggcctaagagagggcagtggctggttagtcctatgttagatattaacaaatacgtgtaggctggatgtggtaggtgacgcctataatcctcgcaccttcagaggccaaggtgggaggatcacttgactcaggagttccataacagcctgggcaacatagagtccgtctctaaaaaacaaaaaacaaaaacaagtatgtatacagtgcctaccatgttgtcaggggtcagtctcctttattacactttttgtaagaataagccacagtttaccctcacaaacttccattcttggctcaggtattagagtcaggtgccacaggtatataatgaaccggcagatctggaaaggataaagaaattgagagatgagctctgagatcaaggacagtgtttgggggatgagagcttgaactagggaatcagatgaagacatcaacactatgacctggcccacagtaggtgctcagtgaaaatttgtgaattgaatgactggccctcacctccctccacagcttcatctcccactagcttgctctagccatcttctccatgatgttgctccaagcactagtccttgtgcctgtggtggcttccttccctctccactgtctacagtccccgactgactgtcctcagagggcccagagtcaaccttgtgcagacaaccttgatacttgtgtgccaaggccaggtttccagccacctgagagccactgggtcaggatgcctgtcaggaaggctctgggtccctggggggagggttcaaaggtccagtttacctggagaggactgcggtgactgccccctcctcctcttgcacagcacataggaaagggctgcggtgaggatgaagatgatggccaggaggcacaggaccggcactgtggctgatgtcctggctgtgggaccagcatttttttccggctgcttctggttctccccagcctcaggcccaactgccagactgtggcccgcagtgtgaatggtggtttcattgggacgagtgagctctttgtccgaggacagtgatcctactgggagggtggggcgctgagtggactgcaaggtggacaggagcatctgggcaggggtgtggatatctgaagatgccccctctgaggcctgagaaattggggggctggtaggaagtaaatgcttctggtgggccacaatccccgagtaagcatgtccacattctggaaaggaaagaaatgaggaatcaggactatcaggagacaaggtgaaaaagcagatagaggtgtaggggagaaaaagtaatatcttttcctcacccatcgcaagggtcaaggctgatacccctataaataaaaaacattaacaagagaaaagcctaacatttatttaatcacagttttacatgacataggaaccttcagaaacaaagacccgagaaaagtgcatttttatgcttaggcttgctgtgaagaatggacagctgtatagacgtatgattggattggccgggcgcggtggttcacgcctgtaatcccagcactttgggaggctgaggtgggtggatcacctgaggtcgggagttcgagaccagtctgaccaacatggagaaacccagtctctactaaaaatacaaaattagccaggcatggtgtcatgtgcctgtaatcccagctacatgggaggctgaggcagaatcgcttgaacccaggaggtggaggttgcagtgagccaagattgcacaactgcactccagcctgggcaacaagagcgaaactccatctcaaaaaaaaaaaagtatgattggacaaaaaggatatgatctaatggcaataaatggggggtgggggaccagcaaggcctgtccagattcttcttggcctccaagtatagggcaggacccctctgaaatgagagcctatgacctacttccacgtgaagttagagaattcctttatggccagctctcacagaaaaacagaaagagcagagtgagctacttacttctgctgttttcttaattaccaaggtgccatgttttggagtgtcatgttctgagctccaacagagggaagagtgagtcagggaggttatcacgctgaaggccagaagaggaaggcagatgacagacggaaaaggtaggggacaaggaagtgagcgaaccacgagacaagtgggtgtcatgaactgggaaatcagaagaccagggttggattccaagctctgctgtaaagtagctgtgtaacctcaagtagctgtgtaacctcaccccttgtccctaacctctccggaagtgatatcttccagctgtaaaatgaggataattgtagtaccaagggccagggttcctgggaggatgaaaggaaatcatagaggtctaggcagacttaaaggcagtatggatgacacagatcctacaaaactttagctaggacatggaagaaccttttgtattttaatggttgtatatttattttaagagaaaaatataaccaatgcatcaaacttgtgacttcacagatattattgcttaggataatttactatttaagttttctttctttttttttgttgcccaggctggagtgcaatggcctgatctcggctcactgcaacctccgcctccaggttcaagtgattctcctgcctcaacctcctgagtagctggaattacaggcacatgccaccatgcctggctaattttgtatttttagtagagatggggttttaccatgttggtcaggctggtctcaaactcctgacctcaggtgatccaccggcctcaacctcccaaagagctaggattacaggagtgagccaccgtcctggcctctacttaagttttcaaaactagtttgtgcacacttaaaagtaattcatttcattgtatgtaaatttgaactcaaaagaaaaaaaagcattaaaatattgaactctacttaatatacatgctgaaatgtcttgggatgaagtgcaatgatgtccacaatctgccttgaaatgcatcaagaggccgggcactgcggttcacacctgtaatcccagcactttgggaggctgaggcaggtggatcacctgaggtcaggagtttgagaccagcctgaccaacacggtgaaaccccatctctactaaaaaaatacaaaaattagctgggcatggtggcgggcacctgcaatcccagctactcggaaggctgtggcaggagaattgcttgaacctgggaggcggaggctgcagtgagctgagggcaccattgcactccagcctgggcgacagagcaagactccattaaaaaaaaaaaaaaaaaaaaaaaagaaatgcatcaagaaataaggtgatggatgatggatagaagaatgaatagatggatacttaataaagcaaatatcgtgtaattgctgtaaaattgatagtgtaaaatatatgtttatgtaaatatgtaaaatatacatatataaataaaattgtagaatctaggtggaggcactggatattcagtgtgccattctttcaacttttgtatatgtgtaaattttcataataaaatattggaaaagaaaaataggccaggtgtggtggctcacgcctgtaatcctagcacttttggaggccgaggcgggtggatcacaaggccaggagttcgagaccagcctggccaacatggtgaaaccctgtctctactaaaaatacaaaaattagccaggcttggtggtgcgcgcctgtaatcccagctactcaggaggctgaggcaggagaatctcttgaacctgggaggcagaggttgcagtgagccaagatcgtgccactgcactccagcctgggtgacagagtgagactccatctcaaaaaaataaaataaaatagtactttgatttcaagaaaaatattaataagtagacaatagcacacgtggtagaatgaattggcaaaactcatgaaggtgatggtgaatgatcaccccgtttggcaaacagggactcgagtctaagtactttggacaggatcagaagaaggttctaggaatgtgcggccccaggggaaaaggctcaggtaaagaaaactgtcaggtggaagctgctaagccctggaggcagagcctgaagagcagtggaaaagtctcacctttgagatcaagacagctcatcaattcctgaacccatgggtccttgttgcccccacacacgctccaggaaaggagctggaacctgcggaggagagacctgggcttagctgcggcgccttctttccttccccggctccttcctcattccagaggcgtgaagttgccaccaagaaagagccctttctcctgggactgggaaactccccagtaggtgagacggagtcatgaagtttcggggaatgagagcaaacggaacccggagatggggctcggtgagccgggaaggagttcaggctggaccagagagggtcctggaggcacctgcaaggaggggccgcccaggcgctgccctcgcagaggcaggtgaaattacctcgtgtagtatagacaccgatggtaagctctcaggtgtttccggagacgattcatgaactgaaccgatggcggggagtcggaagaaattcttttaccacaataacaacttccagtgacgctgccctcgttgccattgcctgcgcgggacggaggtggtcggcacccattcccaggcccagggtccccactccgctgttccctggcatccaatccacagccccatgacagcctctcggtggacccagggtcagagcgccaggctcaacccacacatcatcacgcccccgacaacatccataatcccgcccggagccaggcgtccccgggcctctgtccccaaccccaggcggctggctggctttcctcttgtccccgctgccttcatccactcaactccgtgggcctcgtgtcccctccccaactcacccccttcccgtgacaggggaatctgggtcccctgccccgcccccggctaacctggctgagtcaggtacaccagcaggagcagaagcaggagcaggagcacgcgggacccgggccgcaagtcccgtcccatctcggggctccgcggactctgcggggatggagccacctcgctctgactcccagacatgctccggcgcgtgacgtccagctggtgtctcaatggctttcgccggggaccggaggagacggcggccggagaggaggcgcgagccagctgcaccccccggccctgctgtgccccgaccgtgcgctcagtactcggcccgcgccatgccagcctctggacgcagggaaagccgaggaggtggagctcccgcgccctgcgcccccgcactgggcccggctccgtcgagggaaggccaggaatcttggaagaaaccgaaagaaaactccggcggcgggcgaggaggggcgggaggacgacggcccgaggagccgattcggttcggttcaggaggccgcccgcctggcccgtccgccgacctgtgaggcggctgcactgccggaccggccctcctcctccgaggcactttcacttccccgatccgggcgccgcgggacccagccgcgctgcatgagcctcccgggcggcccggtggagagagtcgccgccagccccggccgcgcgcacctgcggggcagccacccgcggacgcaccgagcccggggggcgtggccgcccgctgagccggcgagggctcgggcagccctgacgtcacaaccgcacccgcgcaccctccaccgcgaggtatttaccttcgaaaagtggtggcggctgcaggtaccggaggagtggggcggccgggaggggctaggtctaccggggctgcccgccacgcagatccgagcccagggaaccccctcgctcccactcccataccccacagacgcatccaaaatgcttccctccccaccaarccgttcccgataggattagccctctctcctctctagccttaatttaaactctgcttttgagggtgtgaactctccaattttaagccccaaataccatctcatccctgagtagtcttctccaaccctggtcacccactttcaagtccagcccccattttcctccctaaactcccatcctcagccctgaaaaatcctcttctccgctcctagcatatccacggatccaaccctaagtgactctcaaacctaccctctccctcaatttgtgacccagccccaaactccatcattgctctcctgtccctcaccatrtatcccttcttttgctcagtctgggccggggccctgtgccgctgaagacatggagtttgtgtctggataccgggatgagttccttgatttcactgcccttctcttcggctggttccgaaagtttgtggcagagcgtggagctgtagggactagccttgagggccgctgccggcagctggaggcccagatcagaaggctaccccaggaccctgccctttgggtgctccatgtcctgcccaaccatagtgtgggcatcagcctggggcaaggggcagaaccaggtcctggaccaggcctggggactgcctggctcctgggagacaaccctccactccacctgcgagacctgagcccctacatcagctttgtcagcctagaggatggggaggaaggggaggaggaagaggaggaagatgaagaagargagaagagagaggacgggggtgcaggcagcacagagaaggtggaaccagaggaggaccgggagctagcccctaccagcagggagtccccccaggaaacaaaccctccaggagagtcagaggaggctgcccgggaggcaggaggtggcaaggatggctgccgagaggacagggtggagaacgaaacaagaccccagaagaggaagggacagaggagtggtaagaacccagggctggccctgccctaccccttgcccagccatcctcccttcggragccctcccctgccactagttctgagtgctggccttcaggccaatctggcctgaaaaggtgtttttattgacccacagtggggtttttttttttaatttaatgtttaaacattgcaagaaaaaaagtatccagaagtctggatttacacattcccaagaaaaatctcaagctctgacagtgggcctacatttctgcatggcagcgcattctggtcctctgtagcagctgtcccctttagaaggagcgtgccctctctacccagagccctttactcagtgaggttacttgcctagccccgtaggtatttgagtttggtactcctgaccctgaccacatttgtctctcgctgccccctaccacctcaacttttccctctttccccagaggctgcccccctgcacgtttcctgtctcttacttgtgacggatgagcatggcaccatcttgggcattgatctgctagtggatggagcccagggaaccgcaagctggggctcagggaccaaggacctggctccttgggcctatgctctcctctgtcacagcatggcctgtcccatgggctctggggatccccgaaagccccgacagcttactgtgggagatgcccggctgcatcggtatagaaatctggtatctgaggctggggaggactcgggccctggattcccaagcacctcctccagcctgatgccatctcccccccaactgcatttagagagctggagagcttggtcccaaggctaggtgtgaagttagccaaaaccccaatgcggacatggggtccccggccaggcttcacctttgcttcccttcgtgctcgaacctgccaygtgtgtcacaggcacagctttgaagcgaagctgacaccttggtgagcagccccaaagctgggggagaggaagaccccaatagrcaaatagaaggaaggcagggtggtggggggcgcctagcagacagaaggagaggcagggacatgagaagatgcagaggaaacaatacagactgttacaggcggttagagggtgtaagacaaacagaccgagtgacatatgggcagctgctgggcagttgaacagcagacaggacctacagaggttaacactaggtgcccaccaccygctgtgtccccagcccccagtgtagtgctgtcttgtattgtggagaggcttgtctccgggctgactggcagcggtgcccagatgatgtgagtcaccgattttggtgcccaaggcttgcagccttcatggagcgggcaggagaactggcaaccctgccttttacctacacygcaggtaccataaggaggtcagaatggttgggggaaactgggaccaggtctttgagactgggaattagatgtctgggaacagggtcctgcagttgaaggctgagtgtctggggctagagcctagatccctggaacaagggcaggggctgggtgtttggggctggagacagggtctctgaagccgaggcctgagtgtctgggtccctgagagmgtgcagggattgggggacagggattcaaacacttacttgcttcccagctccaccactaactgcagtgtgrccttaaacaaaccactttacttcttgaagcttccgtgtcctcatgagggatacggagaaggcccatggaattgttacaaggattatcttggcttggtgcctggtacgctggaggcactcagaaatggtagttcccggcctgactggaaccagacttagaaccagggtcctcgcgggaggctagggagagttcaaggctggggttctaggccgggcaatggttcacacccgtaatcccagcactttgggaggccaacttgagcccaggaatttgagatcagcctgggcaacatagactctgtctctacaaaaaatagaaaaaattagtcaggcatggtgcactcgcttgtggtcacaattctcgggagactgaggtgggagaatcgtttgagtccaagaggtcgaggctgtagtgtyccgtgatcacgccactgcactctagcttgggtgatagagcaagactctgtctcaaaaaaaaaaaaatgtctggggttctagcccagcacctcaactcctccccttctccttctccagaggtgaccagtgaaaccttcaacaaagaggccttcctggcctctcggggcctcactcrtggctattggacccagctcagcatgctgattccaggcccgggcttctccagacacccccgaggcaacacgccatccctcagccttcttcgcggtggtgcgtggggtctctccaggcrtgggccccttggcctagagggaaggactgggaagaagttgtctgggtcccagatgatccctccacatacacactgacccctaccaacagcaccagggccatttcaggcctttcccagccctcaatggaatcacccctaccaactccacccagaaaccccatccctatgcaaacccccattcctcttactgcggctgtctcagggaatacagcccctttggaaggaagaargaratgggtcaggtgggggtctccctgaccccaggcccctcyttctttcatcctctcaggagacccctaccagcttctccagggagacgggactgccctgatgcctcctgtgcccccacatccaccccggggtgtttttggtgagctggaggggccctgtggaagctaggggtagggccagggactggagaaccagagcctgggtggctgtgaagaagaggtttgttagactagarggggtggsggtccagggccaggtcctctagcaaccctctcctgccaggctcatggcaggattactacacatggcggggcctcagcttggactcccccatagccgtgcttctcacctacccgctgaccgtgtactacgtcatcacccacctggtgccccagtcctgtaaggagagcggagtggggggtggagcaggatgggggagtgagagtggaccacatccttaaagcgctggtttttcacccagtccctgagctcaacatccaaaacaaacagtcactgaagatccacgtggtggaggccgggaaggagtttgaccttgtcatggtgttttgggtaagtcaccccaggcctgaaggttgggcattttggtatgggggtgggcacagggtagaccccagatctttctttctttctgtccttcaggagcttttggtcctgctcccccatgtggccctggagctgcagtttgtaggtgatggcctgccccccgaaagcgacgagcagcattttaccctgcagagggtgagggctgagggggccctgcttttcagccctgacccctccagtgacctcctggttgggtcctgcccttctgccccccactccccatcttgcctggtgcatcctccagttccctgacttccagtggcttttccaccccactcctggggcccctcaggacagcctggaggtgtctgtccggcctggttccggcatatcagcacggcccagctctggcactaaggagaaagggggccgcagggacctgcagatcaaggtgtcagcaaggccctaccacctgttccaggggcccaagcctgacctggttattggtaaaagcctgggtctcagggttaggcatgtggggaaggtgggagagaagcccaccgtgggagccagcttctccctcctctctgtctgcaggatttaactcygggtttgctctcaaggatacgtggctgaggtctctgccccggttacaggtgggcaatgggggcaaaagggaacttctctcccctcckgcctggcccctccccatctccttttctgaaagtctctgggctctcctcctcttcaccatcacctgctccacaaacctggggagtgcccacgggtccccctgcctctctctgtgtctgtctccgtcctccccctgctcccctccgcccggtctgtccggggacctcggctttcagcccggtctgtcattctggctgctgggatggatttggggaggggcctctcagagcgactctcgctccaccccagtccctccgagtgccagccttcttcaccgagagcagcgagtacagctgtgtgatggacggccagaccatggcggtggccactggagggggcaccagccctccccagcccaaccccttccgctccccctttcgcctcagagcggccgacaactgcatgtcctggtaagggtctgcgaccctatttccttcctgacccttaacttctcttactctctggctccacatcctcgaaggcccacctctaccctagtccctgctgtcctggggccctcctgcccccagcccagcaacctgccttctctgtccccactactcgtcgcccccatgggaggtctcgacatcccccagcacacccctctttagatctagctcacggaatctccccaacccacaaaagaccccgcgaccctccaacagacccaaccctgagtctagccccacgccctggaactcagaggggcaagccccgccccctggtccctgaccgcccggtggagccccgccccctggtccctgaccgcgcccctgggagccccgacccctgggagcgccgacccctgggagtcccgccccgtggtccctgactgcgccccgcgcccccgcaggtactgcaatgccttcatcttccacctggtttacaagcctgctcaagggagcggggcccgcccggcgcccgggcccccacccccatccccaactccctctgctcctcctgcccccacccgaaggcgccgaggagaaaagaaacctgggcggggggcccgccggcggaaatgaatgctgataccctagtagtccccagctcccaaacactgaaaggaaaacgtgaaaacactcaaggcctagggggaggacaggttggtaaaacaygaaaaggtaaataaaattacttgtttgaaaccactgagtcatggatcttttgattacacgctcataattgggccattaaactgggaacgaagagaaagatttttttgtttgtttgttttttgagacggagtttccctcttgtcaccgaggctggagtgcaggggacacgatctcggctcactgcaacctctgcctcccgggttaaagcgattctcctgcctcaccctccggagctgggattacatgcatgcgccaccacacccggctaatttttgtatttttagtagagacagggtttcgccatattggccaggctggtctcgaactcctgacctcaggtgatccgcccgcatcggaaaaggagttagggatgacttactttcccccagacccttttagtcccctcaacggctgtcatttctttaactcacagtcagggattgtgaccctccttggtaatcccatggttctcctaattatgtgttggctagtcactttccagccccggtaaccctcagggaccggccccaaggcaaggaaagtggcttcttcctgggggcgggagaagcaatcaacctcctgggaccacacagatccttggtttggattcagtgaaaggccccagccacccaactccaccttttctcaccacctcgtattcaataatcaactcctgctgagctcttctgaaatcactcaagtccatcaaggtatgtccattcctgctgcaaactccaccgtatctcatcgccacattgcagcccagagtattcctcctcaaaaaaagacatctgagggccgggcacggtggctcacgcctataatcccagcactttgggaggccgaggcaggtggatcacctgaagtcaggagttcgagaccagcctggccaacatggagaaaaccccgtctctactaaaaatacaaaattagccgggcatggtggcacatgcctgtaatcccagctacttgggaggctgaggcaggagaatcgtttgaacctgggaggcggaggttgcagtgagccgagatcgcgtcattgcactccagcctgggggacaagagtgaaactccatctcaaaaaaaaaaaaaaaagaaaagaaaagaaattaaccgggtgtggtggcatgggcctgtaatcccagctactcaggtggttgaggcaggagaatcatttgaacctgagaggtggaggtggcagccaagatcgcgccactgcactccagcctgggtgacagagtgagactctgtctcaaaaaaaaaaaaaaaagacatctgacctcatttctccctcgcttcagtcccttcagtgacttcccttagctcttaacagtgtgggctgcccttaatgacttcagtcactgagtatagatagggaaaaacagaggagaaacctggcagataccaccttaaccaagggattaaggtgaacaattaagtcctgttgatgttactcttttttttttttgagaaggagtcttgctcagtcgcccaggctggagtgcagtggtgcaatctcggctcactgcaacctccgcctcctgggttcacgcaattctcctgcctcagcctcccaagtagctgagactacaggcgcacgccaccacgcccagctaatttttgtatttttagtagagacagggtttcaccatgtcggccaggatggtctcaatctcttgacctcgtgatccgcctgcctcggcctcccaaagtgctgggattataggcgtgagccaccgcacccagccctgttgatgttactcttaagtctctttcattttgtaacatacctccttggcttttattttttatttcatgacactgatttgacaagacacagaatcatttgtcccgtaaaatgttcctcactcaggagctggctgattacttcctcagggtgttttttcatgtgttcatttatcttcttcagttcctgtcaaccagtagttagatcgagatgacaaggttctgctgatgtggtccctgccaacctctgcaggctgatctcatgccatttccttcccctgtcaactctgcagccagatgcttctaaataaagacgcgctctctcactgtggaacttcccatgtgttttttgttttgttttgtttttgagatggagtttcgctcttattgcccaggatggagtacagtggtacaatcttggctcactgcaacctccgcctcccgggttcaagtggttctcctgcctcagcctcccaagtagctaggactacaagcgcctgccaccacgtgcagctaatttttgtatttttggtagagacggggtttcaccatgttggccgggctggtctccaactcttgacctcaggtgatccacccacctcggcctcccaaactgctgggattacaggtgtgagccactgcacctggccagaacttcccatgttcttgctcaactaattcttagcctaggtggcagcctaaatgtcacttccttaggaaaggaagcatttcctgacccccagatgaggttagacacccctctccctattaagccctcatagcaccttgcatatgccctttgatgacctttatcacacaatttcttgtctaccctttcaacggtcaacccagaaggggtgggtgctacctctatcccccagggtctagcctggccgggcatatggcagcatacagtaggagctcgttaactgcttatcagattgctttccccccatactttcaaccctccctcctcatcttttctctcagcttcacctcctacagccagaaaggggaagcctgggtctctcgtggactgaggagaaatagaccttttcaccactccgttggccaaaaaataagcttttcctaactcctgacatctattacataacaataggaaaggatgtggttatctcccagtggtggggttactaaggatttgtttattcattttatttagctggactgctcatttttcttccatgaacacaagtgcttttgtaataaaaatgcttaatatacaaattgctctttaataattcacttaccaactattgattgaatacacaaggctttgtgccgaaccttagcgacgcaatggggaaaaaagacacataatggtctctgcctccataaagcttacagtttagggcagggatcagtaaactacggcttccagccaaatgtagcccaccttttgtttttgcatggctcgtaatctaataatcagatttcacagccgggctcatgcctgtaatcccatcacgcctgtaatcccagcactttgggcgcccgaggcaggcggatcacgagttcaggagatcgagaccatcctggctaacacggtgaaaccccgtctctactaaaaatacaaaaacaaaaaattagccgggcttggtggcgggtacctgtagtcccagctacttgggaggctgaggcgagagaatggcgtgaacccaggaggcagagcttgcggtgagccgagattgcgccactgcactccagcctgggtgacagagcgagactccgtctcaaaaaaaaaaaaaaagaagatttcacgagaaaattattcgaaattcaaattacagggtctataaatttatattgaagcagagccacaaccatttctttctgtattgtccgtggttactttctggatgcaaacggcagggtttgagtgccgcaattgcagcagaatccctatatgacctacaacgtctgaaatatttatgaacagatcctttgcagaaagtctgccagcccctagtccaggacaagatttccaaaatgcaggtttatacaattttgtgtggatcatgaagtcaatttagtgagcctcaagcagcatctttttttaatgaaatagaatagataaaaatatgtatcacatgtataattaataactattttgtgaaacatttgttatacatacgatatatgcttatatgtgtatgtgctgcatcctgatgtaaaatgtatttcttactgtggaccatgttcaaagcatctgaaaggctgggtgcagtggcctgtaaacccagcactttgggaggctgacgttgtaggatcacttgaggtcaggagttcaagaccagcctgggcaacatattgagacttcatctctactttttaaaaaaaaaaatctgaaggtgtctggcttagagggaagcctggaataaacagagaagtaagcagaaaataacagtacagtgtaattggtgcaatgatgagttacagacccttagggtatatcagaggcacttaagacagcctcagggctgtcagtgaaggctaccaggaggaaatgacacccaaacagtgacctgaaggacacgtaagagttagacaggtaaagaagagaagagccgccgggtgcagtggctcacgcctgtaatcccagcactttgggaggctgaagtgggtggatctcaaggtcaggagttcaagatcagcttggccaagatggtgaaaccctgtctctactaaaaatacaaaaattagccaggcgtggtagcaggtgcctgtaatcccagctacttgggaggctgaggcagagaattgcttgaacccaggaggcagaggttgcagtgagctgagatcacaccactgcactccagcctgggcaatagagcaagactccatctcaagaaaaaaaaaaaaaaaaagaagtgtggtgggatgggaagggcagcatggatctgtttgggatgctagtctcaacccagcctcatggactgacgtctgagccctgcaagaggaaccacaggcagaggctgaaggaagagtcactgtatagagcctctggaaggtcagcagggcacaaacaccacagcacagcacctaaatccccggaatcagtgtcacacggggggcagggatccccccatttctcaggggacacagtgtggttttgagaggcattgagaatcccaaggaacccaaaaatgtggctctgtatgacttcaatcgtttttcttttttcttttatttttttgagacagagtttcgctcttgtcgcccaggctggagtgcaatggtgcaatctcgtctcactgcaacctccgcctcccgggttcaagcgattcttctgcctcagcctacctagtagctgagattacaggcatgcatcaccacgcctggctaattttgtgtttttgtgggtttttttgttttgtttttgctttcttgggttttgttttgttttgttttgttttgtttttgtttttgtttttgttttgagactacaagcgcccgccaccgcacctggctaatttttttcttttcgtgcttttagtagagatggggtttcaccgtgttagccaggatggcctcgatctcctgacctcgtgatctgcccgcctcggcctcccaaagtgctgggattacaggcttgagccaccgtgcccggtctaattttgtatttttagcacagatagggtttcaccatgttgcccaggctagtctcgaactcccgtcctcaggggatccaccctccgtggcctcccaaagtgcttagattacaggcgtgagccacagcgcctggccaatttcaattttttaaaatgtattggggttggtttgatggcccgggatatatgcactatattggtatctgttgcatgagtacttgaatacgtattctcctgtcattgggtggaatgatctataagtattcactacatcctgtttgtttatgacattgttgagttcttctatctccttactggtttttgtctagttgttcaatcaattgctgacaggtgaaccatgaactatgaatttaaacaaacctggtttgaaactggactcatctggttactagctgggtggtcacgagcagatttagaattagactctggagaaactcttctgagatccaaactttactggtctgacatggaaattacaagtagcaaacgttcatatagcgcttactctgtgccagactgtgttctaatcacttggcatttatcagtctattcctcacacaacaaacttaagtcaggtgtttattaccccccattttacagatgagaaaactgaggcacagggaggtgaagataaa

SEQ ID NO: 17982 - DNA, 17114 bp, Homo sapiens
aatagaggtcagaggcgggggctttctgccctcaagtgccttttccccctgggcaggtatgtggaggggatcgtccacctcttctaccaaagggatgacatagtgaagggggaccctgagctgcaggcctggtgtcgggagatcacggaggtggggctgtgccaggcccaggaccgaggtaagatccattctagagacagaagaagctcctgggagactctgccagggcgccttcccagccctgcccttctggggacaggaccccagcctctcatcacgcctcccttcctccctccacacgggaaagcatgtgtatcccattcccacctcctccgactcaggacaattctagagacccaaggactgtcctcctcagagaccctggccatcaacccctagtcccactacaccccagtcacagatgcccctgaactgccatatcctggggccccccaggccatatccacagctgggaggggtctgcacagtccctgctgggctcatattctctcctgatggttccgttttcctaactgaggatgtaaatgggaagattttccctccgaagcccacaaggacccaccctggctttccctccctctcttcctgcctgccactgtgcagcacgcacagagggtccaggaataccgcacgcttgctacagtgcaaggtcagctcttgatgcaagctcaatcctatacatgctttgcctcaaacccaaactcagcaccctgatccttggggctcaggtttctttggctaatccaactcttccaccctaaccaccccttggccaaaatctagccactacctttagtcaactctcactccccacatttgaacctctgaggaagaaaaagcctttgctgagctcttaggtttaatcacacaggcaccagcctggactgctgtcactcatccttcggcccctccccctcacacttcagatctaggctgtgaataccatcctctgcctctgtgagacaactacagacatttactggggagcccttatggcgaatcctgggaatgtggcaaacctccttaccctggagggagcctctccctggggaatctgcaccaccctacccttccaggaccaaactctctctagttcttctcagtacagtcccttaggctcctagcagtttgggctactacaacaaaacactagctgggcacagtggctcacgcttgtaatcccagcactttgggaggctgaggtgggtggatcacgagctcaggagttcgagaccagcctggccaacatagtgaaacccgtctctactaaaaatacaaaaattagccaggcgtcgtggcacgcacctgtaatcccagctactcgggaggctgaggcaggagaatcgcttgaacttgggaggcggaggttgcagtgagctgagatcacgccattgcactccagcctgggcaacagagcgaaactccgtctcaaaaaaataaaataaaaaaaaccacacaccatagactgggtggcttataaacaacagaaatgtattcctcacagttctggaggctgaaagttcaagatcaggttctggtgagacccctcttccaggctgcccacagccgatttctccctgtatcctcacacagcagaaagatagcaagctagcactctgtcctctgctcataaaggtatcaaacccattcaggagggctgcaccctcacaccctaattatcatgtggggctccacctccaaataccatcacaataggattagatttcaatataaaaatttttcggagccaaagacattcagttcatgacacatgttaactttaacctccactaaccaccctcccccctgttctctttcagttctcatagctcacttttgtctagttttcccagcagacattttagaggctaaaattaaaaatgccatgggattagcagtcaggaacctgagttcaagatcagcctctgccttttcccaactatgcagtcctgacagtttattctctatgggctttgattttcttacctataaaatgagagtaattatatttattccacttaactgataagattattgggtctcccagcactttaggaggccaaggtgggcagatcacctgaggccaggagttccagaccagcctagccaacacggtgaaactccatctctactaaaaatacaaaaattagctgggcatggtggtgggagcctgtaatcccagctacttgggaggctgaggcaggagaatcacttgaacctgagaggcggaggttacagtgagccgagattgtgccactgcactccagcctgggcaacagagcaagactccgtctcaaaaaaaaaaaaaagattatcgggtctctgagcccccatatccactgcaaaatgagtggactgagataacctttgtgggagcccctctcagctgtgacactggaaatccatgacttattccccacattataacgcagacacttgtaattctgtccgggaataggattacgcattcctaaattatttatttattttttaatttttaaatagagacaggctcttgctctgtcacctgactaccagcaatcctcctgccttggcctcccaaagtgctgggattacaggcatgagtcaccgaccacgcatccctcaattggtttttttttttttttgagacagactctcgttgtgtcgcccaggctggagtgcagtggcgggatctcagctcgctgcaagctctgcctcccgggttcacgccattctcctgcctcagcctcccgagtacctgggactacaggtgcccgccaccacacctggctaacttttcgtatttttagtagagagggggtttcaccgtgttagccaggatggtctcgatctcctgacctcgtgatccgcccatcttggcctccccaagtgctgggactacaggcgtgagccaccgcgcccggccgcatccctcaattcttaaccactttttgaggcaagggatatttggtcactcagaacttttcagcccccaatccttccataacaataattattacttacttattgagcatttattacagaccaggtgattttgatacatcatctcatttataatgtaggtatcgtccatattttacaggtgaaaaaaactgaggttcaaataggttaagctggcctatggtaactaagtgtaagtgactgagccaggacttaaacgcatgtctgatgcaaatacgtctaaataaaataaacaaattcatcaattctaaaatatgggcatcccaaaacaacagcctttgttcctctcctcttatgctgtagcttctaactgctattcctttcctgcccaggtttccctgtctccttccagtcccagagtcaactctgccatttcctcaccatgtgcgtcttcacgtgcactgcccagcatgccgccatcaaccagggccaggtatggacagctgaaagcccaggtccctgaaggcaaggtgacctgagggagagatgggagttcaaaccctaagtaccagggttctagggttacagtttcttcctccagctggactggtatgcctgggtccctaatgctccatgcacaatgcggatgcccccacccaccaccaaggaagatgtgacgatggccacagtgatggggtcactacctgatgtccggcaggcctgtcttcaaatggccatctcatggcatctgagtcgccgccagccagacatggtgagaggggactctcgggagagggaaatgacagttggaaaggaaacatcagagtgaggggctgggctctaggtgcgtttgtctttagaaactgactgatcctttgttctgtctcaggtgcctctggggcaccacaaagaaaaatatttctcaggccccaagcccaaagctgtgctaaaccaattccgaacagatttggaaaagctggaaaaggagattacagcccggaatgagcaacttgactggccctatgaatatctgaagcccagctgcatagagaacagtgtcaccatctgagccctagagtgactctacctgcaagatttcacatcagctttaggactgacatttctatcttgaatttcatgctttcctaaagtctctgctgctaaggctctatttcctcccccagttaaaccccctacattagtatcccactagcccaggggagcagtaaactttctctgcaaagactagatccttttttacgctttgcagaccgcatagtcactgtctcaactactcagctctcctgctgcagcatgaaggcagccacagacaacatggaaatgagtgtgactatgttccaataaaactttatggacactgagatatgaatgttacatcacaaagtagtcttcttttggtttattcaaccatttaaaatgcaaaaaaaatccacaaacaaatgtgctttgtttgagacatgcacagccaggctacagactggatttggcccttgaaccctgcactagcctgaggccctgaccctacttccaaaacatccaagatcatggagcagggggatttcttagaaaaatcagcttacctcagctaactctccattcccaggaactaaccttcatgcctggtggccaatgtacaaattcctgactcagttctttggcaaattccttccacccatatttctcctattcacccatgtaccccaaaagtccctgaataagaatcatgtttttggggcagaatacaaaccactgccccaaaatggcttctttctccaaacagtcccagatgaaaggcacataattcatgtcttaaggctacttttccagcccctttaatactctgggatctatgtgtttcccacattccaagttatctttcacaagccttttaagaacaacatgcacaaaataaatggacaagaactacaaagttattctagccaatgatagtgtttatttgttaggtcctggggtctcaaggtcaaatgatccctctcaattattctgaggtcactgtcctcactagagtgggtacaacttgctcactgcaaaactgtgttcttcaaacatccctacttcttttcttttctttttttttttttttttagaagtagtctctatcgcccaggcgggaatgcagtggcgccatctcagctcactgcaaccttcgcctcccgggttcaagggattatcccgcctcaccatcccgagtggctgggatcacaagctcatgccaccacatccagctaatttttgtaatttttagtagagacagggtttcgccatgttgacctggctggtctcgaactcccgacctcaggtgatccgcccgcctcgacattcctatttctaaataattattacagatctgtcactcaccagttaaacatacaaacggcttttttggaggggatgacctatttatatttttaaatcttatatcctaccttattcaaaagtcctatcagttttcctagtttagagaagcaaagtgacatttttgtgtacatttaacaggactgcttaccttcacaacctgctcagtcggctttccctggacttctcctaaccgcccatttttcctggatttggcaccgagagttacagtatttcacgtgcgatgataaaatgttacttaggagaaacagttccaataccaagaaacttcagcaattttaaagcattttaaagccacaaaaccatgcccgatccccaaaagggggtcctaactcctttacactgtcagaatctcaattttaaaagggaggagtagagaagagatagaaacgctctctgttggtgaaaatctgtcttacttaccatttccccaacacaggagagactaaggaatttcaggtaaaaatcagatggctccaatcctccgatactaagagcccatcgccccagttcccaggagttccgccagttagactttttcccccatggcctcgctaaggctagttcctcgtcacgtgacgtgacaggcttggtcacgtgacataccagctccttccattcccgtgtgcggggggagggggaccaacaaaccggaggccctcgctcttccaatactcacgccctagctacagaggtcaaggaaggtttccccaggagcagttttggtttcagacggcgccgtctcccgcgaaagtcctgagaggagcccagccttttccgcctgccgcccccggatgggatggttgaggccggggccacgccccctctgcccccctgcgagggcatcctgggctttctcccaccgctttccgagcccgcttgcacctcggcgatccccgactcccttctttatggcgtcgctcctgtgctgtgggccgaagctggccgcctgcggcatcgtcctcagcgcctggggagtgatcatgttggtgaggggactccccggcaaggatcggagagggcctgaggggctccgggctgggagggctgggaggcgaggaaactctgggccgcaggcaggccggaggggccggggatctacaggccccggagaaggagacagactgaaattgaaaaatgggaactgttcgagaccagcctgaccaacatggtgaaaccccgtctccaataaaaatacaaaaattagccgggcgtggtggcgcccgcctgtaatcccagctactcaggaggctgaggcaggagaatcgcttgaatccgggaggcggagggtgcagtgagccgagatcgcgccactgcactccagcctgggtgacagagcgagactccgtccccaaagaaaaagaaaaaagggaactggagcggagggccctggagtgggaggagccagggctggtaaaggtggagacccctcaaggtaggagaaacaagagcggggtkcctgagaggtgcttgagttgaatggaggacatgggaggaaaagagagtgcttgttccagaaatgtgtagctgggccttgttttcccagtaatccacccaccgccacttcaagaagaaatgatatgaagaagtgccggttctccctcccctcttccgcactgtcccgtgatgatgacgcctccagagaggacgataatctgggttcctgggagagatggcttggtcactattcccacccttgcctcgaccacttgtctcaatgtcaccacctcacgccctgttccaggtggctgagtccgaatccagtaaccaccacctcgttttggttaatctcaggctcgggtgttgtagcaacattggaaatgggaggggtttacgaagtgaacatgaggtcaggtgcctgaattcaacagtctacccattccccttttccagataatgctcggaatatttttcaatgtccattccgctgtgttgattgaggacgttcccttcacggagaaagattttgagtaagtattcgggtgggggaggcgggctgggagcaggtgggaggtggcgaggcctagggtcagaattacgtctgggaggcccggtgcttagggcccctaggttagaggacttggagaggagagcggctttcttgagaatgtggttaggagccagggagtcagacctcagcggccatcccaaacccaccaccttaggtgtgacctctttaggtattttacttttctgtgcttctcagtmcacctctgcaaaatggctatgacagatctcaccccataggatggtcaagaagattgaataaagtaatacacgtaacagcgcctaaacaggtgtcgggcacatagtgctcagaaaatgttggctcctattaawgtttgacccctttgcttcattcccacccccaggaatggcccccagaacatatacaacctttacgagcaagtcagctacaactgtttcatcgctgcaggcctttacctcctcctcggaggcttctctttctgccaagttcggctcaataagcgcaaggaatacatggtgcgctagggccccggcgcgtttccccgctccagcccctcctctatttaaagactccctgcaccgtgtcacccaggtcgcgtcccacccttgccggcgccctctgygggactgggtttcccgggcgagagactgaatcccttctcccatctctggcatccggcccccgtggagagggctgaggctggggggctgttccgtytctccacccttcgctgtgtcccgtatctcaataaagagaatctgctctcttmagccctgtgtctgtgcttgagtgggggcgagcacggggctgagactagaggtcggcctctgcctggaaagtcccgatstctgagcggaagtggagcgaagtgtggcgcggaagtgaggcgaaggctttccccatcgactgggcgcgccgagcggtctaagcgactgcgtctgatggggcggggagccgccgggttgagcctatccgctgcggggagggcgggacttcctgcgcgggggcccgagccgctcagtctccctgctctccgtggtcccggctcgcgtgtagcggcggcggcggcgtctccgtgaggaggcgcgcggggccatgacgtcagcgtccacaaaggttcgacctccctcgcggacagcgctccctggcggccacgggagggcgggccccccacttggctcgcggctcttccgccccgggcggggggcgggcgggagccgagcctggggtggggctaggggctccgggcgggacggggagggcgggcgccggccccccgtgacgctgccccgcccccaggtcggagagatcttctcggcggccggcgccgccttcacgaagctcggggagctgacgatgcagctgcatcccgtggccgactcttctcctgcggggtacgtgagcccggactgggacgtggacgctgagagcgggcgcttggactcggtcacagacacggaccctctctagcacagggacagacattagtttccctttgtgcstggcacagcacagagtcggtgttaataaatgatcgttgggtgagggaatgaatgacagataaaaatacagacaggcccatagcccagactcctgtttcacagttctccctgctgcgaacgggtcgaccacaaaccaccgccactcccaaccaccccagttcatggaattcccccagacggctgcaggctgtgttggtgggtctgttttgaaaagcccttcctggcgagttggtttcagtgtgctgtgtacagcagccgtttaacgttgatggtggaaaggggtgtctaaggtggaggtggttgtgatttcttgtgattggggtcctcccggttcccgcagggcctcaagagctttccgcctccccttacggaggacctctttatgcatccgtggaaggggtcccagaaatcggaaggaggcggctggttggctgtgggatgcatagcctgtgggcgggctccacaccccccctcccatttttgctatcccccctctccccttctgacagygcgaagtggacggagacggaaatagagatgctgagggctgctgtgaagcgatttggggacgatcttaatcacatcagctgtgtcatcaaggaacggacagtgtgagggagggtggctgccaraaaagggcgggtgggcmgccttcttcctccttacccaaggttccatcgtcctcagaactcctttccagctcagctgcttccctactttgtcactagttttttagaatccccttgaggactgaaagaatagaattgtcacagttggtcagaagttcctaaaatgytgtggtaatccttccaagaatgtgaatttaggttgcctgagatgctgttattgtatttgatgatggaagtcccctggttatttatataaatgtttgaggaccccactgcagtgtttccagggatatggtgaccctgaactagttgatcagtaaatctcaatccacctgtaaatcaccaagctctacctgatgtctctcccagaagagaattaggagatgggcctttcccactactcagttcagggactccactctcyacactccatccatcctgagtgagtgtaaaacttcgagaaagtgagaaccctaccaatgggttggggccccgacctggattcttatgaagggactcccagaaccccttcccctcccgtcccctcttctgttagtctctctgatgactcctttcctaacctcttctctcttttcttcagggcccagataaaggccactgtgaaacgcaaggtatatgaagattctggcatcccccttccagctgagtcacccaagaaagggcccaagaaggtggcatctggtgtcttgtcacctcctccagctgcccctcctcccagcagctccagtgtccctgaggccgggggtcyccccataaagaaacagaaggctggtgagggctgtggagttgctgcctaggggttaaaggtcccatctgaggtttagtgagagaattgggcctgggtcaaagaagggtcagtctctcttcctgtccctgtggaggttcccagagaggggcagaggggaggggagaggaggcacaaagctttgggaagcttggggctgggggagaggctgtcaggggaacctagaacctagcttatgcccccttcccagatgtgacactcagtgctctgaacgactcygatgccaacagtgacgtggtggatattgaagggctaggagaaactcctccagctaagaaactcaacttcgaccagggtaggagtcctcctcctcccacacagctgacggggttggggagaaagggctcacctggatggcagggcacggtctccgcaggggcccctcccttgtataggggtttcagaagagaaggtgctctcatacacagcgcagggcattggatcagtacgtagcagggtgtttcagggaggtgggagtggccttggaagcacactgggggctcgctccatctcggcccattttacttcctgttccagacagcctgaccctggattctggccttctcatgacctctgctgatcctcctctcctctcctgctgagccttccacctctgacctctcactgttcatgccggacctgtggatctcctgggactccgagcaaggcctgcacgagagagggctgaaaggctgctggggctgccacctcgctattcccgcataagcatctgcccccaacccctttgaccttcatctgatggacatttttatacagaaaacaataaagatttccctctcagcttcgtgctgtctgcttaacattattagcaggagaggcctgttccctcttctctcctcggcccatgggggctcagcccctcctcggtagttttcaccaccctgcctggagcagcacagccaatattggcagactcgcttccctgtgccaatatttctgtgctgctagagccagggaagctgggtgtgggcaacaaagactccactttgttctcttgaggcagaacttactcccagggtctctggccatcagtattcttgaaactgccctggagattttagaggggtgcttacataccccaccctctccttgcccacctggcaagaagtttgtcacaaggccccagatgttttttgtgtcacttctccaggatggcctcccagggccaagcctcggcggtgcctcccccaccctcgctctaacaccacagtgtggtttggacgtggccacagtgccgtacaaaccacagtgtgctgctggggcgggagcaggaccggggtgggttgaaaggaagagagcacatagcagtgctgggaagaccccagcaccacctccaggagcggggggatagagaagccttaaaaggcaaacatggcccccaaaaacgtttgggaggaaccagggacgggctgagcaggcaactggaaggcgacggaccatggggatgagctcacagtgtagtaagattggaccatcttccctctgtaggaactcagctcaggggatccctagggtggggtcagaggcagaagaaatagggaatgactggaggggccaacacactgcctcctgtctcagcaagggcagggacccaaggcttcctgtgtccgtccttcctctccctgggtcagaacccaagagaaaagcaaggagagacagagggccaaggccagcagggttgggagttggcagtccagaggtggtggggccggaacatggttgggagaggggggccggaagtcgccctgggccctgggcctgccacaagatggaggccaaaggcaggaaatggagaccagggggaaggggagcagcagagcccaggaagagggccatctggacctggggggccaggtattcaacccccagtgctgttcccactccccagggcccctgaggacccgagccggcccccacagcaacctccatcagcccatccaccaggccagggcaggcgggcccaccccagagagccacgtttaagctgagacaaacatgcctctccccacccccaactccaggccttccctcagcccttttctcctgtccaggacttgattttttaaaaacacccctcagaaagcaaaatccaagggccaaaactccttttgcaaatcaaaatatgaccccctaaaatccagaagttatcttcctatatcccatcgcatcttttaccaccccctcttccgacacaccccccaaaactcttagcaatctgaaagatccaaggtggtgtatgtaagcagtctttttaggcccccgaagatgccagacccctcccggacacccctatctgtcctccatcaaatcttgccaaggcctcctgctcctccaccaccctccatagcccccaaactaacagttgcccccagctcctacctcggcagagcctttgtggggggtgaaagagaaattaaacactatcctaacggctggggatgttggggggctctctggtctcagcctttggtttccgtctggggggctgcagtttaggggtataagagaaagcctctccaatcatccccccaattccaagactgacaaagccaaccccaccccagcacgcacctccaaacctcccccccaaccgccacgtctctcctgaaaacagaggacacttccctccccacttacctcagctactctcccctgagatcctggtcccctattttgaaaagagcaaaatttagggtgcatccctcacatttggggtgcaggagaaaggagccgccccagtcgcatcgctggcctccttcctctcggctggctcagggactggggagtgccctggggagggggcacccccacaagagatctcaggaggggttcctccactcccagtcagaattggggacacccccccaaaacccgtcccagcccatccgtctccaactcggcgggagaggcagctgcaatgccccagtcagattcacccaacactacattcctcaccccatctagaggggtcccggggtccccaaaaaatcccaaaaaaatctaggatgttgggaggacggtcctggactagctccccaaatttggggtcctcagatacccccgttttttcaggaaaattccgtcttttgcctgcctcccgccagccctgctctgtcccgatgccaattttggaagtcactccctccttcctcctccccgtctctccaggccccccccaccgctcgggggctagggtccaggacacctggcttccagaccggggggaatcactcctcaaagggctaggggccaggaggtcaagctcattgcccctgtcttaaggaagcaggaaagcccgttcctcccttcccctcccccctggctggtcaccgtggtggtttaggaaagcctggaggattggaatctgccattgctgttgcacaggcagttttttttcttgggttgggggggtgggcggtgggagggagagaggggaggagggccgaagagagaagggacccaggcgcgaagagctggcctggcttaccctgtagccccggctgccgtggggaacccctcccccccatctcacccacactcccagtcctctgtctgctttctgtttggggctcatcctagaaaatcagggtgcaagaatcacctccttgtaccccaccagcacccctccttgccacagttccaacagcactgccctggtcaggggtgcccacttggccaagggacaccccatttttctccaacttcccccaaactaaggggtgctcccttaagaaattgggattcagagtctgaaaccgccttttctccctctcttctccctcaagccacataataataaaaggagataccacaccctttccaagtttctcccttcaaatcctgggcttatttgggggttcactaaagaaacttctagaatctggggtgagagggcactataagcaaaagacatcccaaaccagggtccaaattaagtgaactcccaaatcagtctcaccttatgattatcccttagcttcaccaaaagcagccagagtgacaaaacacccccaaaataagaacaccccagaactttagtctcctgtcctcgcggccctcaccttgtttctcccctggggaaaaagcttcttgggtatccatggatacacaggaataccccacgtctttccactttgtggaacgtgagtgtccacaagactcaaatataaaagtttgctccccgctcccaggacccccaatcacagaaagcttcgaacttgctcccagcttcctataatgttccacctcaaactaatttttaaaactccaaattgaacttattccccaaatctaatctgagccttgaaacttagatggcaccccaaaatagactgcacccccaaatcagcatgagtactttggttctgctgatagtccaagatgacacaggtgagcacaatctccaaattgtgggtgtcagaacccccagaactaatgtaacttccaagtcagccccatacctgaaacttaccatataggcctcaaaggctgaatgcagccaccggtgctcacaatcaaatcaacaccccataataaacagacaccccacaactgatcaaataatactccatcctgatgccaaagggagagcccctagtctaattctcatctccaagctgggcagagacctaaataaccctcacatgtcaaagccacctcatcgtcctgaatttcccagttcccggtttctcagctgttctttcatgcattcaaataaagacacactccggtctgaaggggagggccccgggcctgatatccagccccgtggaccatggtcggccattcctggccaactgtacactctccccagcccaaatccggggagcttctgccttgcagctggattcagctctagcaccccttctccaaatgagctttgccttgcctgcccgcaatgtctcccgaaacaaaatatgagggtgtgatccatgcccatctctcagatcagggacttcaaattagggtggttaagccccctcctgccctctctccctcctccttgttttcccttctcgtttaccccacccaattttaatgttcaattaaaagtcacctccaaagacatctgggtagcagtgtctagcttaattcgaaaagaaaacccggagttcccaggctcaggtcccgcttcttgtcccacccattcccctggctcctaaagcccgcgatttctcacctcgggtaggaaccccagcctgaggggaaagtcccctcggtctcctaactctagctccctccgcccagccctagtcccctcctaggagacagaggtgcaaaataaacccgcgcaaaggggaggaggctaaaggtttcagccgcccagaccaaatggatcctgcgcccgggtctgagcgcaccccaggccgggtggagacgaggggcgaggcgaggccagtgctcggccgccccctcgtggaaggagccgcacattgccgagccttgcctacttgccgcgctggaccccggcgtcccgccagcctccaagcgtagccgacgggcgggtgcccgaggccctcgtgagctgggattgggggaaagcaagcgggctttgggcgggagtccatctctctggatccctacaaggacccagaagagagtcgggagcgagagaggccggacgcctaggtctcccgagcgtctctcgcccctccacccccacctcggggctttccccacctcctcgaggggaagcagctggcggagccgtccggtcgcaggacaatggaaggaaaccaactagaaatcatatccgccctctccgtaccccgcccggccagagcccccctttttgtaggcccgggtagagtagcctgtcattcacaccacaccctccccgtctgagaccctacgggagcccactgtcgtctgcccaaacctgctgtctcgttgggctcccccttttctcccttaacacagtacaagagagggagagggggttgccgtatgcactttgtcctgcagcaaaggttggctcctggcaaaccctcccaaaagccaacacaccaattttcactggcccaggccttccgacgactcagactcccgtattgccaacctcgatatccctcacctcctccccaattccaatatccccgtcctcgtgtccacttgcagtgacccaagaccccctacgttacgaccaccccttgtttctgaggtcccgccctcgagacggagaccccgccctggactcgccatctggagagcgagggaggaaggaaggatacagacccaggcgttcaccccacctccacccccgcccccgacatcccggccagataaaggagccgaggccaagaggggagagagaccccgccccccttaagaagagaagccgcggcccctgcaggacgggggtaagaacaagagactgagggagccagactcctgggtcccccaagagggtaggagcttgtgtggagcttgccatcagcgagcctgagtcccagaaattgggctaaactagggattggggactagataggagtcgcagaattccgtagttcggggaagggagcctcggctgggatttggaggtgtgtggacggcaggccgtgagatctcgaggcagggttggacacctgagacacaggcgcgcagaggggagtggcggtgctggaggggcactgggggtcgaacccagggcgatgggcgcgggattccccacgctcgccaacgacgccgcggtgtggaaccttcaactggctccaagcgctgtgggatctggaagaggcaagggagcgagggtgtcgtagagggcagaatgaacaagaagaattaggagggaggctgcgtgtgcc

SEQ ID NO: 17983 - DNA, 49195 bp, Homo sapiens
  misc_feature (1)...(49195): n = A,T,C or G, or insertion/deletion polymorphism (see Tables 1-2)
tcttttcttttcctttctttttttttgagatggcgtctcgctctgtcgcccaggccggagtgcggtggcgtgatctcagctcactgcaacctctacctcctgggttcaagcaattcttccgcctcagcctcccaagtagctgggactataggtgcgtgccaccatgcccagctaatttttgtatttttagtagagacggggtttcaccgtattggccaggctggtctcgaactcctgaccttgtgagctgcccgcctcggcctcccaaagtgctgggattacagacgtgagccaccatgcccggccatatttttgtttttttttttttaaagagacagggtttaaccatgttgcccaggctgatctcaaattcctgagctcaagtgatcctcccatctcagcctcccaaagtgctggggttacaggcttggaccactatgcccggccaatcctttatctttcctgcttcctttttatttctggactaatcactatccctggaccctgctctggggcagattctcacctttagcctccatgaggaggtcagttctcctactccttctggtctcagggagaccccaggtctcgcccacaccaacccagggacccagaagggcagggcggggcagggctctcaccacaggctttcccagctgagtccagcaacacactctgcacagtggcctttgtgaggacagcgcccccagcccgctgaatcacagggatggtgtggaaggcaatttcactggaaccccctcggggataaaagcctcctttcatgtagtggttgaccagcagggcgtgcatggaaaaggcactgtggttgggggtgacacctgcagaagcaaggaagggtggtgagctggcaagagaaggcaccagcaccattcagaaaggaacgtggaattctgtgagataacacacagcccagtctatccgaggaaccacatgttcctcagggtccaaggcagccagaggagcctttccatctagacatggggtaccttagagatcttggcgccagtaggaataccccccctgcaaactgccatgctgccaagaccaaggaggatagtgttgcttgaattgaaaaatcatccaaggcatggatgaacagaattttgaccaaggagtccagcaggtggccagacttctcatccacaagctccagagggcctggggtttacactgctccatatcagtcagccaggcagggtcgagaagaaagattgagagatgagagggcagccgttcctcctccagaagctgcccagagcccaggcccagtacccaccgtaagtggggaagatgtagctgagtactgcctggagctcagaggaggcccccagctgctgcaggacctcagccaggctctgggtggatgcttgaaggaatggagagaaacgagtcagcagcccacacctgtcgaggagctgaaccacgggcaatgggaggaatttcaacaggatggcatgaggggctccactggataccacctgggggagtgaatgaggacagcaggcctcacctctagaaccgctttgacagaactgctatccccatagcctggaccagcccaagaatccagcaacacttacccctgactgaactttgctgaatttgaatatttttaaaaaatctatactctgtgaatttttcccatcctacactcggatgagtcctttttttgcttttaattttcctgctcaaattccttttcaaaaatcccaatctggtctcggatgcagtaaaaaggagtagtgatctgatgtcatggaagccagcctagtcagggaggagagcagggcatccccagaggccagggtgacagcagcagccgtggagccaaggctccagagagagagagacagagaactggatggacttgggtggaggctgagctaagaacagatgtgactcttcctcccttcctgcctcccgcactgcactctccacccccagtgcctccactaataataaagaaacccagccttatcgagaacaaactctgggtcctcagcatgtccatgttaccttaaccagctttatatacttgtcaatgatagcttcctcctgtggaaacttctccttgaggccctgaatgtaggctttctctccactgtacatggggtactcctttcggccattgggcccttccagtaccatgatgtcaaaaggagaggacaggggagcccagtccagctgcccttcagtgatctggtccaagataaaacggccaatgctgccctcttccatacgcccaatgtaatggattcctgttgggagatggaaaaacaaggtagtaaagggatatggggattgagccctggaaaggtggctgaggaagtgaggtggaagagtttatctggcctggccaagttcacgcccagagtgagctgctcactctgtctgtagggaggtgtcacagcagaaaccgccagatcgctgcccgattcaactcccagtagctatgctgtcacataagaaaactgcccagaggctgggcacggtggctcacacccataatcccaacactttgggaggcagagggaggtggatcacttgaggtcaggagttcgagaccagcctggacaacatggagaaaccccatctctactaaaatacaaaaaaattagcggggtgtggtggcccacttggtgggattactgagtgtaatcccagccactcgggagactgaggcatgagaatcacgaactcaggaggcagaggttacagtaagctgggatcacaccactgcgctccagcctgggtgatgaagtgagactctgtctgaaacaaacaaagaaaaaaagtacccagagagaagatggcacttccaaaacaacagaaatgctcagtatcaccccacaagggctgctccaagcctcttcaacatacagccatgctcccaacccttttccacacaagccttacctgtgtcaaattcaaggccattctttccaaaggtatgacagcagccccctgccttggtatgttgttccagcaccaggactcgcttgccagctttagctagaattgcagctgcagccaggcccccaaagccactgccaattaccaccacatccagcttctccggcacttggttggctgaaaaagctacagcagaagggccaaagggtgggtttctcaggcaggggcagggaaatagcaaagatagggaaaccaaagaagacttctctagcttgtacagtgcaagaaacctctagagtggtttggcacagaactcttgactaacatgtttcaaacattttacctgggaatactcagaaccagccaggcagatttggggttttgcttatttgttttttgagacaaggtctcactatggcccaggatgaagtgcagtgatgtgatcacagctcactgcagccttgaactcctggcctcaagcaatcctcctgcctctggttcccgagtagctgggactacaggtgcatgccaccatgccgggccattttatttttatttttatttttatgtgtttaattattttttaagacggagtctcactctgtcacccaggctggagtgcagtggcgcaatctccgcttactgcaagctccgcctcctgggttcacatcattctcctgcttcagcctcccgagtagctgggactacaggtgcccaccaccacgcccggctaatttttttttttaatattttttagtagagatggggtttcaccatgttagccaggatggtctcgatctcctgacctcgtgatccgcctgcctcggcctcccaaagtgctgggattacatgcatgagccaccgcgccccgcctattttatgttttatagagccaaagtcttgctatgttgcccaggctgatcttgaactcctggcctcaagtgatccacccacctcggcctcccaaattgctgggattacaggcatgagccaacacaccagcccacaagccgggtttctttggaagatgcagggtctgcaagcaatagtggaatagctgggtcttatggtggctcttccaggtcctgatgaaaaggcttgggcaggacagaactgctcagaggctgcagctctgagaaatcacagcaccagcccctcccatagggaaggtctgggggcagtgctgagggaggcagcaccttctcagaagacaaaactggatagcaagtggtgctatatgggtacttccgacacaagatctgttctttaacaatcactggcaaagaactgagatctgggatgtttcaagatacaagagaacttggcaaactgcttatttttttaatgtttttagagagatcaatagtaaaaaaaaatttcacatgtaagtatataagataaatacatgaaacaagtgtcacaatgcaatacttagtggaactatgtataatgcactctgatattttctattctactgcattctaaaatactagttgtggccaggcgtgatggctcacgcctgtaatcccaacactttgggaggccgaggtgggcggatcgcttgaggccaggagttcgagagccttgacaacatggtgaaaccctgtctctactaaaaatacaaaaattagctgggcatgcccactactcgggaggctgaggcaggataatcacttgaacccaggaggcggaagttgcggtgagcggagatcgcgccactgcactctagcatggacaatagagcgagactctgtttcaataaataaataaataatgccagttgcaactcactaaattgatttcatagcccactaatagatcacaatccggtttgaaaagcagttaagctagtcatctcatttttagaccagcccaggtaggtgctaatggttatgcagcaaattagtgacagagtccaagctaaaactcagttctcagaagtccagatgattagtccttccacttagaacagtactgtctccgattgtgtagcaagatatgacacggagaattctaaaatttacaagtgagagggactccgtagatcaaacaggtgatccattattttttaaagcagcagaactctttaaactctagaagcaaccacaaaatatgttttaaagatgagagtggagagcaggctctgagcctgaggcgccttgttgaacctctgccaatgtttcagaactagggttcaatccttacgatttgggaccatgcaaagcctgttaaatcaccggacgggcaaaacgcaatttcctacgcatttctgtgctgctcccccacacccctgagctcgcatgggagggtaggtgaaaaagttaaggtcctggaaccaagtggaggaatgagtcacggggattatcagttccacgagccacggggattacaagtggcagggcgggtgccaacaccttgcaaaccaaggacaatgaccacacccttgggactactattcccggggcctactagggcaaaggctatcgacagtgttgcacactaaagcggggctcctccacgtgcaaggaagccctcctagtactttacatatggggaaactaaggcccacgtctggtagcggctgccttggcaaaatgagaacccaaatctgtgagaaagcctcgagtgcagccccggaccccagggtccctcctgctaccttgtttgagaaccttcttcctggcctccttgtcagttaccaggggcgctgggggccgtttgacatcttcggagaaaggattcggggagctgccagagaatagtcccaagtaaactttgcagaggacggccagcagcagcacagccaggagcagcaccagcggaagccacatcacgccggcgtcgggtcgggtaaatgggacagctccgactgcgctcagcctctaggactgtggctccgcccgggctagttcgctctccagtcaggaggcggaggcagctttgagcactgattaaccagccagccagcgaagagccaactctcaggtgatgattgaccctcccggctctccgtacttcttttgggtttccattgcctactgggaaatgtagttctcggggccaggggagccggcacggaagcggctgtgcgcatgagcagatgaggcctagccgaggcggcgggacccccaagtttggaaagctctkttaacggtgagaacgcgttaacacttgccaaggggagtggttggtgcctgtgcggagctagcagccggcctgaggagggagggagaatgtgatccggtggaaattatcactatggggcgagacaaggccgagagttgtaagactgaaagagartcccgactgggagacaggagtcctgagttctggtcctggctctgccctggactcgctgccttgaggtgttaaattgctttcctcgtcttacgcctccaggctatgcgaaagttctgtccaaaggctgctcacagcccctgtctgactggttgtcatgatgaattgagctctctgttacctgcgcatcacaaccggtgagcgtctgtctctgtgcccctcaaagtggcccatagttttgtcctgggggcccgcctgggacggagtcctctatggcgggtccctaatgacaccccatccgtggggaacctgggggacggggagccgcccatggacaagcatggtgaaaggatcagctaagggcccatctaatttaaattcctatgcagagaatctaacctccagcaagcagttgaagaatcataccccctccttgcctaaagagggtgcataatgaatacttgattggagaaggatccatttttacaggaaggccgtttccttaggtccaactatcaggaatttgcctttgagtacttccttgtttaatggaattgttgctcttttcttctctgctacagatagtaactgtccctactgaaggccccaggagtgctccagccaggtgtggaaagctggtcacgattctatgctacttggttcattttctacacagcaacagaagagccctcctgagattgctattaccatacccgcctgtcaccttgccaaggctggccaatgtgtgttttgtcataggctgtcatggaggccatgatggaggaaaaggaaaggggaggcagatgttgaggccccagaggccacagtgagagcagtttagttcctggggtgccaggactaagggggcattgccctgtcccccggattacagtgagccacatgtcaagcccaagagccaggaggtattcttcctctcagtgttaataatcaaagcatcctgacaccagcagccagtttttatggcatcctggagggctgacctcatagagaggctaccctccttccttagtcacccaaagttgtgaactatgattgtcagttgtgtgtgggccatctgcccacttaggatgcaatttttgatgtgacagacattccggatgtccaattcccctgtgatgaggtatgagccttgtccagcccttttcctgagggaagcaatgtcagatgaaagacttagaattgcccaaactggctagccagctgccacatgcacagtattgctgataactgagaaaggttagaacatcgtgttgcattttgaatttctaccattgttggaaccaggtctagtattataagcccctgacccagcctgtgtgtgaggcctaaacaaagcctgagcacttcagctaagaccacccaccaaggtgacacctttagcctcacgcctttgataagctggcccaggtcccagtaactccattgtcagaaacagaccccatcccttctagtggtgctgctgccttttggacacagaatccagctcacagtcccctgtgtggtccccttttggccatcctgtggcttgggtagtaagaggtaagcatttggctgaggcaagttgttcattcagaataaattcacagctgcttaaattttgtcaacaggccgagcgtgttggctcatgcctgtaatcccagcactttggaaggccgaggcaggcggatcacgaggtcaggagttcaagaccagcctaaccaacatagtgaaaccccatctctactaaaaatacaaaaattagcagggtgtggtggcrcacgcctgtaattccagctactcgggagactgggacaggagaatcgcttgaacccgggaggcggaggttgcagtgagccgagatcgcacggctgcactccagcctgggcaacagggcaagactccaactcaaaaaaaaaaaaaaattgtcaacagaggcataactgaatggtgaaaccagttttctttttcaatttcttttttttcttttgtgcagagctgaggcttcgaagacctcagaggacttctctcagcactcacagaaacctcctacaccctcggatggcacaaagggactgttttcttactcttagtctgagtgactgccaaggaaggcaaaggtagagcaactggatctctggctctccacatagcttctgatctcagaccttactaaaatgctttctgggcccaaggacaaagctcacatgaacaaatgattttgagtcatgaatgaaaaatcttgctctttccatagtaaagaagaattaagagatggacaggtaagcatgcactcttatttgggaaaggtggtgttggtttgagatatatcattaagtatagtaagaatatattaagagaatatttggaaaaatttagaaaccctcattatagttctctttgttctgtaagaaggagcttctattcacctcagggtcaattgcttttcctaatagcttgttttgtaagtgagttatgagatttttgttttctttttgcttgggtagtggggagaatttcattgaggaatcacccaagaaatctgtatttcattgatttggatcattaccttactagcctcttccctgtgaaacgcttgctttggcctgatcatcctcaggactcagttcaatgtgatatgtctttgtatgagccgggcagctaaccctacatgccttacctttcacactactttgcccacccaaaaatggtcttaaatggaggctgtgggattcagtggccagactgggacaaagcctttgctttgggtctccagaaagattttcttcactgtagtaatatgcgaactgttccaaagagggaagtctttggacactggaggggactgaattggagaaggaaaggaaggatgaaatgaatctcaggtacacagatgcctgcaggaagttgttcagcacaatgaatcaccaaatattttagagataaaatttcaacaaaaatttgagaaatatattttgtgcttagtactgtgccaatggttgtgaaacatataaaagaaatataagagcctggaggcagtggctcacgcctgtaatcccaacactttgggaggctgaggtgggcagatcacttgaggtcgggagttggagaccagcctggctaacatgatgaaaccctgtctttactaaaaatacaaaattatctgggcatggtggtgcatgcctgtaatcccagctactcaggaagctgaggcaagagaatcgcttgaacccaggaggcggaggttgcagtgagctgggatcacaccattgcactccagcctgggtgaccaagtgagactctgtctccaaaaaaaaaaaaaaaaaaaatgaaaaaagaaatataagagaaggtccttatgcaggccttttgcagaggaacttttgctgcatacaagggttactggacttagaggtgtgagacagcattgtagccccagctagtaaggtaggttgccttgagtaggtggaactgaccttgatcagagaagagagtggaggtgtattctggaggaaaactacatgaacaaagggatggaagtgaggagagggatctgcagcaggtgtgttgattgcattacagtgggaaataaatgcttagccatcatgagctcctttaccagggagcttggtcagctgtgaggtgttttggcctccatccttgcatctggaacatgaagaaatgaaagttgtgtttaatgagcattagttggaaaggcaaaaaaaaaaagcagaaggattagagtaacaggatgatctgggattccagggccttggcataatacattcacatggttcaaaatgcaaaaagtacagaacgatatatgtattgtgaagaaaccaccttccacccttgtccccccagccactcagtttttctgctggagacaaagctactgcttccttgggtataactgtgaaaatggtctctgcagagacaagcaaatgtgcttatgtacttttaaaaaataaaatggtaaaatagtgtatagactctgtcctttgctttttcacttaatacatcacggaaattgtcccatattgcctgtaaagtaaagcactttctcatttgtctttatggccatatagtatctcactgagtgaatgtgcttttatttatgtaaatcagcccattaatgaacatttaggtttttccagcctttccctattataaacagtatgacaaagaatcacactataaatgtaaacatgtcggttttgcacatggatgaatatatctgttagataaattactagaatgcagtatcaggccccgcatgtacaaaacatgtatgatttcattaggtactatcaagctgtagaggtggtaacagtttactctccagtgtgttatgcactctggccaatgtacatgttatcagactttttgatctttgataatctgactaatgaaacacagtagttttacatgactcttttttttttttttttttttgagatggagtcttgctctgttgcccaggctggagtgcaatgacgcgatctcggctcactgcaccctccgcctcccaggttcaaatgattctcctgcctcagcctttcgagtagctgggatcacaggtgtgcaccaccacgcccggtgtgctaaaaatacaaaaaaaatacttttttgtatttttagtagaaacagggtttcaccatgttggccaggctggtcttgaactccagacctcaggtgatccacccaccacagcctcccaaagtgctgagattacaggtgtgagccacggtgcctggtgacgtttttctgttttgcttttttttgttttgttttgttttaatgagtgaggttgaacatttgttcatatgtttaaaaccaatttgtgattgtgcaggatggctcgtgtctgtaatcccagcactttgggatgtcaaggtggcttgagcccaggaatttgagaccagcctgggcaaccatatgtagaccccatggctacatgggcatggtggtgtgcacctgtggtcccagctgcttggaatgctgaggtgggagaatcccttgagccaagaagtgagtgagccatgatcgtgccactatgccccaagtggggcaacagcgcgagactctatctcaaaaaaacccacatggagaaaccccgtctctactaaaaatactctactaaaaattagcagggcgtggtggcgcatgcctgtaatcccagctactcaggagtctgaggcaggagaatcacttgaacctgggaggcataggttgaggtgagccgagattgcaccattgcactccagcctgggcaacaagagcaaaactccatctcaaaaaaaaaaaaaaaaaaaagccacnnnnnnnnnnnnnnnnnnnntaaattactagaatgcagtttcaggccccgcatgtacaaaacatgtatgatttcatttggtactttcaagctgtagaggtggtaacagtttactcttcagtgtgttttgcactctggccaatgtacatgttatcagattttttgatttttgataatctgactaatgaaacacagaagttttacatgactcttttttttttttttttttttgagatggagtctcactctgttgcccaggctggagtgcggtggcgtaatctcagctcgctgcaacttccacctcccaggttgaagccattctcgtgcctcagccacctgagtagctgagattacaggcatgtgccactacatccggctaatttttgtactttttagtagacattgggtttcaccatgttggccaggctagtcttgaactcctgacctcaagagatcctcctgccttggtctcccaaagtgctgggattacaggcgtgggctaccacacccggctggtttttcttttttgccttaatgattttttttttctctgagattaaactttattaaagttacttttccagaaaattcagtgaatatggtaacataggaacaaacttaggctcataagccctttacatttttacataatctttaatgatgttgatcaggaaattctttcactggtagaattacttctccattctccagaattgtatcatctgggaatattctgggcttcttttcaatggtgccatatggtttttttagatacatgatacttcttggtgctctatatgttcagagaaacttctctagtaacaaactatagaaatgatgattttttattttttaaacagtagagacagggtctccgcatgttgcccaggctgctctcgaactcctgggctcaagcaatcctcctgcctcagcttcccaaagtgctgggattgtagctgtgagccaccacacctggtgatttttaggattttaaaagaacacgttgaaaaattagctctgtatctgtgaaatgagttacaaacaattggccgagtattttggtcggttttttgtttttcatctgtarcaggggataggtttggctgagcagaaaggccataggaaactgcttcactaaacttcgctcactcagaaccctcagactttcaaagagccaggaaatcggtataaaatttttgagataacattaattaagctttttgcagtttttcctaggaccagattaaacagaagttttcctttacagtattcattatggttggtatctccagagttcatcctttttttgtggtactgggaaaagttgcaacatttacctttgcagggacatggatggagctggaggccattatctttagcaaactaacacagagcagaaatccaaataccacatatcctcacttataagtgggagctaagtgatgagaacacatggacacatagaagggaacaacacacactggggcctattggaaagtggagggttggccgggcccggtggctcacgcctgtaatctcagcactttgggaggcygaggcgggtggatcatgaggtcaggagatcgagaccatcctggctaacacggtgaaaccccgtctctactaaaaatacaaaaaaaattagtcgggcctggtggcaggcgcctgtagtcccagctactcggaaggctgaggcaggagaatggcgtgaacctgggaggtggagcttgcagtgagccgagatcgtgccactgtactccagcctgggtgacagagtgagactccgtctcaaaaaaaaaaaagaaaaagtggagggtgggaggagggagaggatcaggaaaaataactagtgggtactaggtcaaatacctggctgatgaaataacatgtacaacaaacccctgtgacccaagtttccctatgtaacaaacctgcacatgtacccctgaacttaaaagttaaaaaaaaaaaaagtatgacatttaaactattatctttgggggattaatatgtgcctaggagattgacccttgtctgttttacagggtgaaagattgtctgctggatattctccatcatatgacaaggacaagagtgttctggctttcagaggaatccctgtatgtatcacccacaacttggtaccttctgccagggcttttgttgtgtgttactgtgtggtgccagaactgtggtagacgctggggacacaagggtggcatagaccttagcttccaagagctcacacttgaggggagtgaggggagggtgtatggaacacaaacatacaaaacaacttctatttaataagataattgccataatgaagcaggctataaaacgcagagagaataccaaaggcacaccacagtctgaaatgagtgtatgaatttttgtttatttacattcaaggtggacatacacttgtccccaacatcacccaagttccacatcatagttaaagttttccaggtacctcaatttaaaatggacttcaaggccagtaagtggctcatgcctgtaatcccagcactttgggaggctgaggcaggcggatcacttgaggtcaggagttcaagaccagcctggccaacacagtgaaactccatctgtactaaaaatacaaaactagctgggtgtggtgatgcacacctgtagtctcagctacttgggaggctgaagtaggaggatcacttgagcccaggaggtggaggttgcagtgagccaagatcaggccactgcactcccgcctgggcaacagagtgagactccgtctcaaaaaataaataaataaaaagtaaaagaaaataaaactgacttcagtcaacccatcagggcacactaggtccttttggcctccagtgtcaaggacattcagtacagtgggtgggaagcgtttgtgtatatgggggtatgtggattctatcctcaagctaaaggtcagctgcctctacagatctcagagttgaagaaccatggcattctccaggctctgaccacagaagcttatgaatgggagccaygtggtaaggttcccttcagggcccttggagtctgggtgggacccaagtcagaccttcccatgcatctgctgttcatcatttgaatttctctcactccttgtctttcagaattttgtagatgtatcagtccttggggaaaaatagaatcaacactgaattaggaatcaaaagaccagagttctgatcttcctctgctagtggtttactgtgtgcctctgggcaagccatatgatctctaatattagtacctcccttatcctcaaagggatgttatgaaaatgagacacaatataggaaaagcctttgaaaagttattctacttcatctgctttgcaaggcgcttccccatactatatttaaagttcactctacttgccaagtgattatggagaaaggtacactccagcctggccaacatggtgaaaccccattgtattagtccgttttcatgctgttgataaaggcatacccaagactgggaagaaaaagaggtttaatggacttacatttccacatacctgggtaggcctcacaaacatggtggaaggcaaggaggagcaagtcacatctcacatggatggtggcaggcaaagagagagcttgtgcagggaaactcctgtttttaaaaccatcagatcttgtgagacttattcactattatgagaacagcacagcagagactggcccccatgattcaattatgtcccactaggtccctcccacagcacatgggaattatgggacttacaagatgagatttaggcggggacacagagccaaaccacatcaccgtctctactaaaaatattttaaaaattagccaggtgtagtggtgtgtgcctgtaattccagctactctggaggctgaggcacaagaattgcatgaacccaggaggtggaggttgcagtgaaccgagattgtgctactgcacccatacctggccactagaaatatgaacttttaaaaaaatactcttttttttttttttttgttagggacagggccttgctttgtcccccaggctggagtgcagtggtgcaatcatagaatttgtgggttcaagcagtcttcccacctcagcctcctgagtaattgtgtaccaccaggcatagctaatttttttttttaagagacaggttcaccgggcacagtggctcacgcctgtaaccccagcactttgggaggctgaagcaggcaaatcacgaggtcaggagttcaagaccagcctgaccaacatagttaaaccccgtctctagtaaaaatacaaaaattagctgggcatggtggtgcacgcctgtaatcccagctactcagcaggctgaggcaggtgaatcacttgaacctgggaggcagaggttgcagtgagccgagatcatgccactgtactgcaccctggcagcaaagcaagactccatctcaaaaaaaaaaaaaagagacaggttcttgctgtgttgctcaggctgatcctcaccttatcctcctgagtatctgggaatataagtgtgagcttctatgtgtagctaaaaaatattctaatataggaacatcatttggacatctgtgaagtttcttttaatggaattttatctttatggtgacaaacccagcattaatacattaataatttttactttaaatacatatatatatatatatatatatatatatatatattttttttttttttttctttccagagacagggtctcactctgttgtccaggctgaagtgtagtaatgtgattgtagctcactccagccttgaactcctgggctccagctgggactacaggtgtgcactaccatgcctagctaatttttaaaaaatttgagatggagacggtctcattatgttgcccaggctggtctcaaactcctggctcaaatgatcctcccactttggcctctcaaagtgctgggattacaggcatggtggcatgtgcctatatctctggctaactttaaaaaaaaaaaaaagtaaaaaataaatgtaggctgggcacggtggcccacgcctgtaatcccagcactttgggaaactgaggcgggcggatcacaaggtcaggagttctctaccaaaaatacaaaaattagccaggagaatcacttgaacccgggaggcagaggttgtagtgaaccgagatcgcaccactgcactccagcctgggcgacagagcgagacttcttctcaaaaaaaaatatatatataataaataaaaataaatgtaaaagagaattaataaataagctgactcaattggcagtgctcttgactatatgagtaagtggaagagagctgaaataaaggagacaattataaaaaggaaaaaagataacctaattaacgtgagctgtgttaattatcctgactatttgtcctttgcccccgtgttcttctgttggtcaggggaaaacagtatttatgtcacacgtaggaggcatctccctcattccaagagaaaaggagaagctcttacgtggtttgggcatttgtgttgaggttttaagcaccagcttgctattgctggtggaaaccttgaacttttgttgactaacctgttttgacagcatattcccacccccttgccactgtggttcctgctcctggctcacagactttgatcaagctgtttgtaggcgagggtgtatggggttggggagggattggttaagttgctggtagatgaggctctgacaggtgaagaatcaataaatcaataaagctgcatgaaggtaagagggtgaaggatcctgttcagcttcataataagcattgcatcctgctgttctactcttcccccagtccctttttttttgaaacagagtctcactcttggcgcccaggctagagtgcaatggcgcaatcttggttcactgcaacctccgcctcccgagttcaagtgattctcctgcctcagcctcccaagtagctgggattacaggcatctgccacatacccagctaattttttttttttttttttgtatttttagtagagacagggtttcaccatgttggccaggctggtctcaaactcctgacctcaggtgatccacccacctcagcgtcccatagtgctgagattataggcgtgagccaccgcacccggcctactcttccctttttgttcagccactttgtccctcctttttagctcctatgctgaaagtaagttttattttcttgatcctccaaggttgaatattctcttaaagctgtcttaggaactccaaggctcagtgtctgctactccggactggagcaggtgagatggaatttcctaaaggtccagatatttaggaccctggacccatctcacccgctgcctctgtccattgccctgctggacctgagcccacacctatgttgataataatagcttacatttgggccacgtgctctcctaggaagtagaattaccccatcctcacaacagccccatgaggggttacagatgataagtaacttgcctgaagacatacagctagtaagaggcagagatgaagcattcacaagtagtttggctctcaagtgtgctttcagtaactatcctctactgcttcccagccgctttctcttccttattatccattagtgtctggtagcatttcatttaatctgcaggtatattctcccaacagtttattgtcatgtgatgtcctcagccaagattgtgaggcagagaggagctgtcccaacctactataccaccgaggctggagagatcatatttttggtattaaactggagtctctccatccttcacattgttgatgtcctctgtagcaaaccggaaaagtcagtgacagaagatgccgctagcrgtttgagccagagaatgacagctctggtttggagaaaagggccggatggtggctctagaaagcccatccttctgctcttctttttttctcccccttatattgtgctttcattcattcattcattcatcaaacatttgttgagcacctattatgtgtcaagctctgtgctagcctctggaaaacctgccctcatgtagctcactgtggagtaggagaaacaatgactacactatgataagcacgggttgtcagggtctcacagagcagtggcccctcatccagaccgatgaggtcaaagaaggcatccaggcgaggatggtgtcagagctaactgaagaatgagagggagctgcaccagcaggggttggaactgaaggtggcagtgcctggagtcttgattccagcagagggagagcagtctgtgaaaaggcaccaagggtgggagagggcagagcacatggaggaacttcaggtagttctggatggccctggggcaaagctagagaggtaagaagaatctacaaatgttcctcgagttacatgaacttccatcccaataaacccattggaaacgaaaaatttaagtcagaagtgcatttaaggctggtccgagtagaatgatttttacaacgaattgatcacaaccagttacagatgtctttgttccttctccactcccactgcttcacctgactagcctttaaaaaaacaaaaaatttaaaaacaaaaagaaaagaaaaatgcatttaataccctgataaatccatcaaaaagtcaaacaattgttaagtggaactgtcatgagttggggaaccatctgtagattgtgaagttatgtggatactgtgctgtagagtatgggttttatcttgaggactgtggagaatccctggagggttttgagcagtgatgtcggatcttacttttcttttcttttttttttttttgaggtggagtctcgctctgttgcccaggctggagtgcagtgacatgatctctgctcactgcaactccgcctcccgcgttcacgcattctcctgcctcaacctccagagtagctgggactacaggcgcctgccaccacgcccagctaattttttgtatttttagtagagacggggtttcactgtgttagccaggatggtctcgatctcctgatctcgtgatccgcctgccttggcctcccaaagtgctgggattacaagcatgagccactgcgcccggccaatcttacttttcaaaagctcactctagcaaacctgtgaggagaggatcagagggtgttaagatccaaggcagccagatgtggtagtgcgtgcctrtagttccaggtactcaggaggctgaggcaggaggattgcttgagtccaggaattctgggctgtagtgtgccatgctgatcatgtggccccactaagttcagcatcaatatggggaccacccgggagtgggggatcaccaggtggcctaaggaagggaaaactggcccaggtcagaaatggagcagttcaaaaatcctgtgctgatcaatagtgggatcatgcctgtgaatagccactgcactccagcctgggcaacacagtgacaccccatctcttaaaaaaaaaaataggcccaaggcaggcagacaaggctggggtctgcagtagaggcccagacatacctagatctcagagggtctccttttctcctactattgcagttgtgagtayagaggtggtcagagcccaagaagaatgggaagctgtggacaccatccagccagagacaggtaactgtacgaatgctgctgtctccccatagcccctctgccascaaaggcaycatccacacatgtggcaaatgtttctgtgagtctgggactaggagatagaattcctgagagtgctcattttaactatataacatagattacagtayctttttcaaatcctaaratgatgacatcctacctctggaggaaaccagagtgaaggccatggagaaagggctgccatccctgtccatctttcacccagccatgagagaagacagggttgaccttggttagggcagcttctacagagtggcaaggctgggtaggaggatggagatgggcccctgtgtaaggctgctcaggttgtttactgcacaaggaagtccctggggatgggagctgaagcaatctgctggaaggctctgaaggctgagtaaaaattgtctcctgtttctttctaagaggttggatgaagagatagaactaggacctatatctagcctgagcctctcttcagctccttgggcccagtgaatagtatcagccattgcctatattgctaactaatcagttaattccctattggctataacagaggtgtatggttgggggttcctatacagggtgtaagaagggaaaagtggaaattaggaaaggcccttaaacaaactggttgcatgctcttatgtgrgtacccaccccaggcagtgacttgccccctcgtagatgagagcatttagggatcacctcgtggggcagatccgccccatacccaccacagaggctgacctagcaagactgaatagcctcgtccaaaaagagagtcctcttcgccgacaatgccagcctcttgaaagaagattggttgtagctgtaagtgtctgatgttcaactggaagccagtgcttggcttggaagtgacaagtaggagggcctcagtaaatgtttgttgacagaatgactcctataaatcctggcatgtcttccgttttgccacagggagccaagctagctcagagcagcctgggcagctaatctccttcagtgaggccctgcagcacttccagactgtggacctttcccccttcaaggtatgagggtagcagggtttggagtctcaagcaaagtgccttttccctaggagccaagcctctatcccaccaggacagggcattgggcaagcaaatctcccctaagatcttggtgcccaggatcatgggtggcctaggacccatgcttcatttggggccttggtagcttttgtgggactatgcccttacagctcctgtagccctgtcattcaggggcctgtatagctgtttatctactcttcccttttagggatggggacatctagagtcaagtactaggtagatccttgcagaggcaaggcaaactgttcagggagctgagtgattcatggccagtggaggaaaaccttccattccctcaaggaaccagaagctatttaggaatttaagaaagatataagctggaaaaagaaggaatatttgggggaataaacgctaggggtgggstgggtgctgggcatagtggctcacacatgtaataccagctctttcggaggaggctgaggtgaggggtcacttgaacccaggagttcaaggctgcagtaagctatgatcacacctgggcaacagagtgaaaccctgtctccgtaaaaaaaaaaaaaaagctggggagctttctgggccatattgagtaacaatacgtttagagaaatgtgatttcaggtcttctacctaaaaccttgctcaggggagagaggctaaaaagataggaaccaagttgttttataggacccagagagccgaaagctaccgaaatcagaatattctaaggcttgcagtagtgaccctgagccatgagaagccaacatgacctcacttgggaagtgctggttgtgaccaaaagattccagctacccctcagagtcatctaactctagtgggtccccacctcctgggaaacctgtcctggcatttgtctgactgcctgggggagctgggcaggtgtaacccctgtgggagtcagtggaatacctagttctggaaaagcccagaggactaaatgcaaataatggctgataatacctacgcttggggatgtctttcaccttgcaaaaaatctgggagctggaagagcctggctctagagactcaacaggtgcctygcagcttctgcctccttcccttggcccaaaggccagccagatagctgggggagttactttctgcaagcactgcctctggtctgagcctgatgggaagttgattaagggaaatgaaccagcattctgcccattgcctgcaacttcttccccagaaaagaatccagccaactattcgaaggactgggctcrccgccctccgacactacctcttcgggcctccaaagctccaccagcgccttcgggaagaaagggacttggtcctgaccattgctcagtgtgagtgcaatgcgagcccacagggcagttgctgcatctgtggttgggcaagaccgtgtgtgctgaccctgtgaggctaagccaggaatattgcatgtaccatggttggcgggtgagagtgggagctgagaactggatgtctcacagtccagatctcacattctctgagaagcacccggttctcccatgaggggcaatctggcagagagtgtgggtgtgttttggggcaggtggcctggatagccaagacccagtgcatggccgagtcctccagaccatctataagaagctgacyggctccaagtttgactgtgcccttcatggaaaccactgggaggacctgggctttcagggtaagagggaggagtagctcatcttctttttcatgcctctgattccaggactagagtgagaggccaggtcgttctcttccagtgctatgagggggaagatcttgggggagtattccgggaagagggtgcagcaaatgcaaaagccctgagggggcgcctgctagttctgcttgaaaaatagcaagagtaggtcgggcgtggtggctcacgcctgtaatcccagcactttgggaggctgaagagggcagattacttgaggtcctgagttcgagaccagcctggccaacatgatgaaatcccatctctactaaaaatacaaatattagggtggggtgcggtggcctgtgcctgtaatcccagcactttgggaggctgaggtaggtggatcacgaggtcaagagttcgagaccaggctggccaacatggtgtaagcccgtctctactaaaaatagaaaatttagccaggcctggtggtatgcgcctgtaatcccagctactcgggaggctgaggcaggagaattgcttgaacctgggaggtggaggttgcagtgagccgagattgcgccacggcactcaagccttggtgacagagtaagactctgtctcggaaaaaaaattaaaaataaaaattagccaggcgtggtggcacgtgcctgtaatctcagctactcaggaggctgaggcaggaaaatcacttgaacccggaggcagaggttgcggtgaacagagatcgcactactgcactccagcctaggtgacaaagggagactgtctcagaaaaaaatagccagagtgtggctgaggtggagatgaaagtgacaggaggaaagatcacttggtggtcttttaggctgttgtaaacatttactgtaagtgatatggaaaacactggagtgatgtgacagaatctggcatttttgggttttttcctctctaaaaaatatttatgaaaattttatcatatattattttactttctgagtgaaacagaatcatttcaccagtttttggattgtactattttttttcaaaaccatatcaaattggctgggcatggtggctcacacctataatcccagcactttgggaggccaaggcaagtggatcacctgaggtcagcagttcaagaccagcctggccaacatggcaaaaccccaattctactaaaaatacaaaaattagtcgggtgtggtggcacgtgcctgtagtcccagctactcgggaggctgaggcaggacaatcgcttgaaaccgggaggatgaggttgcagtgagccaggattgcgccactgcactccagcctgggtgacagagcgagactctatctcaaaaaaaaaaaaaaaaaaaaagacaaaaccatatcaaattatatttgtatagaataggaaaataactttgaaaggaaactttaaggccgggtgctatggctcactcctgtaatcccagcacattgggaggccgaggcaggcagatgacttgaggtcaacagtctgagaccagcctggccaacatggcgaaaccccatctctactaaaaatatataaattagccaggcatgggggtgtgcacctgtaatcccagctactcaggaggctgaggcaggagaatcgcttgaacccaggaggcggaggatgaacccaagattgcaccactgcactccagcctgagtgacacaacaagactctgtctcaaaaaattttaaaaaaaagataaaaggaaactttatgtacccctaattaactggtggtctgttggtatggcaacatggttaagtccctgttccctctctcatctatcatgtaattgtcttaaatgtatcctctctatatattgagaatcgcaccagtaatgttaagatttttgtttcaatcaacaaacataatttttttgaggaggggttctcacgaagaaccagaaaacctgctagacaaattgtagaagagctgtgacactgcaataaacataatttctgaatctctggagaaaaaggaaaatctgggccaggcacggtggctcacacctgtaatcccagcaccttgggaggccacggcgggaggatcacgaggtcaggagttcaagaccagcctggccaaaatagtgaaaccctgtctgtactaaaaatacaaaaattagccaggcatggtggcgcgtgcctgtagtcccagctacgtgggaggctgaggcaggagaattgcttgaacccaggacgtggaggttgcagtgagccgagatctcaccactgcgctccagcttgggcaacagagtaagacttcgtctcagaaaaaaaaaaaaaagataagaaaaaggaaaatctattgtatttactctttccattgtttgttcttccttcctaaccctctttttttttttttttttttctatttcaaggacttcctttagttattctcttaggataggtctgctggctataaattgtctttgttttccttcatctgagaatgtctcaatttccccttcacttctgaattctctggatataaaattccaggttgacagttcttttttttcagcacttgaaaatgtgctacttccttctggcctgcatagtttctgatgagaaatccactgtcatttgaatgatctctcccttataagtaaggagttcatattctctttctgctttcaaaatattttttgtgccaggcatggtggctcacacctgtaatcccagcactttgggaggccaaggcaggaggactgcttgagacaaggagttcaagatcagcctgggcaacattatgagaacctatctctacaaaaaataattttttttttcttgagatggagtctcactctattgcccaggctggagtgcagtggcatgatctcagctcgctgcaacctccacctcctgggttcaagcaattctcctgcctcagccttctaagtagctgggactacaggcctgtgccaccacacccagctattttttgtatttttagcagagatggggttttaccatgttggtcaggctggtcttgaactcctgacctcaaatgatccacctgcatgagcctcccaaagtgctgggattacaggcataagccaccatgcctggccaaaaaaaaaaacttttgtttagtagccaggtgtggtggcgcatgcttatagtcccagctactggggaggctgaggcagaaggactgcttgagcccaagaagtcgaagctgcagtgagctgtgatagcaccgttacacgctagcctgggtgacaaagtgagactctgtctcaaaagaaagatctttgctggccgggcgcggtggctcatcctgtaatcccagcattttgggaggccaaggcgggtggactacgaggtcaggagttcgagtctagcctggccaatatggtgaaaccccatctctactaaaaaaatacaaaaattagccaggcatggtggcatgtgcctatagtcacagctgcttggtgtggaggcagaggttgcagtgagccaagatcgtgccactgcactccagcctgggcgacagagcgagattccatctcaaaaaaaaaaaaaatctttgctttgtctttggttttcaggaatttgactgtgatgtgtcattgtgtggatttatttgggcctctcctgtttgaggttagctcagtgtcttgagtctgtaggtttgtgtcttttgccacatttggtcaattttcagctgtgattcctttgaatactttcttcagctccacactttgtcctctcttgtgggattccaatgatacaaatgctatctttgttcattttttaaaatctttgttatagcctcagatctccaaggctctgttcattttggtttttgtttttctgtccctctgttgttcatattatgttattctattattactgtcccatattcaagttcactgattctgttgtctccgttctcctgttgaccccatccagagagtttttagttctagttcttctatttttcagttctaaagtttccatttggttcttctttatatctgctgtttctttactgaaactttctattttttcattttttcaaagtgtatttgttcataattgcttaccaaaggcattttatggtagatcctatagtcactttctatcattgctgtaacaaattaccacaaacctagtggcttaaaacaacacaaattattgtcttatagttttctagttcagaagtctgactcaggtcttactgagaacctgtggtcaagatcaaggtgttggcagcacagtgttctttttggaggctctggaagagagtccatttccttgccttttgcagcttctagaggccacctccattcttccatcttcaaagccagaaacagcatctctctgagcccgattcctcacatctctttctctggctctgggcttccrcctttcttttccacttttaaggacccttctgatgacattgggcccacccagacagtccaggatcatctccctctctgctgatcagcaaccttaattctacctgcagtcttaatcccctttgccatgttacataacatagtcatagcttctggggacatggtcatcgtggggcggggggattattttgcctaccacggctgctttaaattccttgtcaaataattccaacaactgtgtcatctctgttggtgtctgttgatcatcttttctcattcgaattgagaattacctagttcttggtgtaacaactgattttttattgtatcttagacattttgggtagtctgtatgagactctggatcttacttaaatcttctactttagcaggcctcccctgttactgtgccagcaggggaaggagggacgtcaccatgttactgccaggtgggggtggaagtccgggtatcccacttggcttgcagtaataccaagttcaagaccagcctggccaacatggctggtggggccaggggtgcctcgttactcttcctatgtggcttccacattgcagaggaggcaagggggctccttaccactgggaaagataaagtcccagctccctgcccggccttctctgacgctacccttgtggagctaaggggtgccttgatacagttaggccaggatggaagtctagggtccctgctcagccttttctggagaagagtggggatggggccacatttttctctgtggtgttttgctgcagtagggtgggtattggctaaagccttctgtcttgctacactgcctctttccccaccctttggctagagagagcagctttccttggggctttttggtctgctcccattggcatttctgggttgctgtcttctccatctgggatatattaggcaaaaagaaacccaggaattcaccagagagtcatttctcagctctcaagattcctagtaagtctgtcttccctcctttcagagccttctgtttattttatatagtaatgtccagggctttagctgtacttagtgggaggaataggcagaaagtgcattattcatcttgttccagaactgtaaattcagccttttttgtaaaggattgctttggtggttttgtgtagaagtaactatcaagggtcataggcagcagcaagaaaactgatgtgggaggctgcctccagggcgctggggtccccatttggtgcatagcccctgcttagctcattagaatgagccccacaagtgtggcagaaagtggacgtgtgctgctcatgctccgctagcctgggaagaggccagtgtcagggcagcttcccatggcaagcccttgaagcattgctcgctgccacaccctgtttcctcacggtctctgttacaggagcgaatccagccacagacctgagaggcgcaggcttccttgccctcctgcatctgctctacctggtgatggactcaaagaccttgccgatggcgcaggagattttccgcctgtctcgtcaccacatccaggtgagactttggtgggaagccagaggaaaggaaagggccgtggagctaggacctgagtggccgagagggctcccaggacagctgagataaaccaggaatgggcttccccgtcagtctgacctgcattgaaatatgagctgtaccgctcattagctgtgtagctcaagcaagttcctcgactcctcagagccttgattccctcatctgcagaatggaaatcatagtgttgttagaaatgcttgttctttggtgccgtaaagaaatagcacttgaacataaatttaatttcttcagcaaggattttttttactttctgcagaaagggtacactcactagcagttttgccacgagagtacactgaataaatgagacaggatcatttataacttgacccatatactttactgctgtgtccggtttctattggctggaatgggacttcacattcgtatttgtcttgattggctagcaacttagaactttttaaaagaagcaaaggaagaggagaacaaaggaaggaagaaataacttgtggaatgctgagaaaggtaaaaacaccttcaaataaggaagaagaataggctatgacttaatgcttgcttggacyagtataagcatgccagggcaaatatttaggctaaattgtgggagctaagaacataaagtacagtgacttcttcattatggctagcagatatttaagaatgttagcagaggtctttgaataaattttgcttctaagagaagttactatttatcttaattagatggggaggaaagtctttgaagaggaacgtctactttactttttacagtgtgaccctgaaaatctgaggtctcagttaatttagaaagtttattttgccaaggttgagaacacatgcccgtgacacagcctcaggaggtcctgatgatatgtgcccaagatagtcagagcacagcttggttttatacattttagggagacatgagacatcaattaacatatgtaagaatgaacattcattcagtccagaaaggcgggacaactagaagcaaaagcgggaggactcgaagcagggaggggactttcaggtcataggtagataagagacaaataattacatttgagtttctgcttagggtctccaaaggaggcaatcagatatgcatttatctcagtgagcagaggggcaactttgaatagaatgggaggcaggtttgccctaagcagttcctggcttgacatttccctttagcttagtgattttgggggcccaagatattttcctttcacattttcccccttttcttttttaaaatcttttggagaaagcattttagaagaaaatgaatctctggtcttaggtttcatctgatctcttacggctaggatggtttattcctagacggataggtccccgagttattaggaaagttcatttttagaaggttgtgaagtctcatgtcctatgaagagaaaatacggggaggaagtgaaaacaacaacaacaaacaaaagaacaatcctggatatcaatataggccacattcttctgaagtctatacatcagtaggcaggtatgaaagtggcttatgtatgtaaataggttgctgttattttcttctgaagttgtctggcttcagtttgcagggctgtaagaaagtacggcttaattttcagtgactccaaattaggaaaatggaaaaaaaaaggaggaaaagaaatttaaaacattattttgttttgttttgttttgtttttttggagacggagtctcgctgtgtcctgttgcccaggctggagtgcagtggcgcgatagcacactgcagccttcgcctcccaggttcaagtgattctcctgcctcagcctcctgagtagctgggattataggcacatgccaccacgtccggctaatttttgtatttttagtaaagacggggtttcaccatgttggtcaggctggtctcgagctccagacctcgtgatctgcccgcctcagcctcccagagtgctgggattacaggtgtgagccaccgtgcctggctgaaaacattattttgaagacttgtagccaagaaaaattagaattcagcccaaactgtagaaaattattaaaattgaaaaacattaggcaagactaggatctaatgacaggtgtactatagtttttgaaacataatttttctttctccagtttcctgtttttactaaagacaaatcatggtaggaccgatttgctttataatacttagccagattatttgtataaagtacagcaagaatagttatttttcacataggctttttttaaaaattggctttgatggaactttgttatatagaaggaatctcaggcaagacttttttttaaagccaagccttgccatggatttgtaccatcaaatatctatgagttgggtgaatttcctctcctcttgaggttccaggataaacctggggctcctgggcctgycataaagtaacattctttacttaacacaagtcagaaaccctgttcagggactgtgtacacaaaatatgaggccagtttcccaagggcgttattggcttcataaatcaagtttgagttcttaaaagaaatgacatggttccagtcaaagccttggtaaaataattagtttctccagttgtgtcctattagcagtgaaaacagattcttattgtatttatgcaaataactgtattgccataaattaagaatactcacaaatagtttccaaattctggagaactcaggtagagagaaacaaatatgttccaaattttggtcatagcagtatactaaattgttaaaagctgtcaatagctcaaaagagaagtttgaagactctgaaaaacaaaacaaaggatcagcaacgttttaagcaaaaggycaaaaaaattagttcaatccatgcagttaattcctgttctgctttgatattcatgaacattttagctctccatgagtctgaaagtttttcctctattctgatgtcacaatctccaaagttatcagaaacctkcattcaagagcccctgttagagttttaagatgatgattattatttatttatttatttttagactactcttgctctgtcgcgcagggtgaagtgcaagtggtgcaattttggctcatggcaacctccacctcccaggttcaagcgattctactgcctcagcctccgagtagctgggattacaggcacctgccaccacacccagttaatttttgtattattagtagagacagggttttgccatgttggccaggctggtcttgaactcctgacctcaagtgatgtgctcgcctcagtctcccaaagtgctgagattacaggcatgagccaccatgcctggccttttatagctgattataaaaccaccttctaaagaggaccaaacaacacaacaattgtctgtggatgacaaaaagttttagggaagccattgttgaagacccagttgacaaggaaatttgttatctctgtggcacagaataatttaacataacaattataattattactgataatgtacactaagttatatcagaattttaggagtttcccataattttggaacacataccaataacacatttatacaaatacagcccaaagaaaatcgtacaccatttcatatttgacaatgcttcctgtataatttttataccaaataagccaaattatgtcatttttggactttatggagcctaatatcttaaaggatttatcaggtcagaaaaagacataatttatgatttgattttggaaagtttgtcaaatatcaaaggtttaaaacttgatatcacaaaataggatcacaggtcattataagataagtcattcttttaaccaaagcaataactcaaggatttcaaaaagaaggtgaaaatctccattccttgagagcggagacttgatttttcaatcaataagccctaataaaaacagcatgaagccaattaaatttatttttcaaaattttgtaaacaatctataaaattttaatcttgaccataagatataacttccataagccttttataacctttataacctttattaaggggctggttaatgcttcaagaaaatcttgttaatctgatgcaggggctcatgtgctgcttttgcatcagtgtgcctttgacattcatgattaatttataaagaaacttaacctattttatctttaaaaaatcagctcttgcaatctcatgcacccacctcttccgcaatagtccctgggccttgaagagttgagtagctttaatttctggccccgtgtcttaggaatgcagtttattctgattggcatcttctaccaggcctgaagatgaggctttaattgctgtcaatgtttaagatttgggctgggcgcggtggctcacacctgtaatcccagcactttgggaggccgaggcaggcagatcgtgaggtcaggagatcaagaccatcctggccaacacggtgaaaccccgtctctactaaaaatacaaaaaattagctgggcgtggtggcgggtgcctgtaatcccagctactcgggaggctgaggcaggagaatggcgtgaacccaggaggtggagcttgcagcgagccgagatcttgccactgcactccagcctgggtgacaaagcaagactccttctcaaaaaaaaaaaaaaaaaaaaaaaagatttggcaggacatagggctgggtgcagcggctcatgagtgtaatcccagcactttaggaggccgaggcgggcagatcacgaggtcaggaggtcaagaccatcctgcctaacgtggtgaaaccccgtctctactaaaaatacaaaaaattagctgggtgtgatggtgggtgcctgtagtcccagctactcataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaaaaaaaaaaaaaaacatttggcaggacacggtgttccttttagacccaggagttaaagccctgtaactcaatgtcacaaggactttttttttttgagacagagtctcacttttgtcacacaggctggagtgcagtggcgcaatcttggctcactgcaacctccacctctcgagttcaagtgattcttctgcctcagcctcccgagtagctgggactacaggcgcgtgccactatgtccatctaatttttgtatttttagtagagatagggtttcactatgttgaacaggctggtctcgaactctggacctcaggtgatccacacgccttggcctcccaaagtactgggattacaggcgtgagccaccgcgtctggccagcactttaaaagcacatacagaaagatacacggatgtaataaccttaatttaaaaacaagacaattcagttacttatctagggatgggtctcgggctgtagactctaccatcccagaagcaggaaaaaaaaaaaaaaacaaaaaaaactcatcttccctgttagaagtgagctcaaactccataaagaaattacctgccttccattgtcatggaaacaggaaatcttaccttccttgttaaaagcaagtaaaactccaaaaaaaaaaaaaagaggagttgtacaacaaaataaactttagatcttttttgtttttttgtttgtttgttttgagatggagtttcactctgtcacccaggctggagtgcagtggcgtaatcttggctcactgcaacctccacctcccaggttcaagcaactctcctgcctcagtcttctgagtagctggggttacaggcgcccaccaccacgcctggctaacttttgtatttttagtagagacagggtttcaccatatcatattgcttgatcctgggaggtcgaggttgcagtgagctgtgattgtgtcactgcattccagcctgggtgacagggcgagactctgtttcaaaaaataaaaataaaatggagggattgctacattttgctacttgagaaaaccataaaacccaaccccagagggcaggtccagacagagatagagaagctactggtctcaggctggtcttgaactccttacctcaggtgatccacccgccttggcctcccaaagtgttgggattataggtgtgagccaccacgcccagccaaagatcttgaacaaatttggggagatcagggattctctggagggtgtactcccagacctcagcaaattgttctgttgttttgagccataaagttagctcatgctggtaccaagcatggataggagatttgtcaaaggccaggggtacctccactcagaatccctctgtggttaccaaaatgtgaaccctgaaaatctgagacaggtctcagttaatttagaaagtttgtttttccaaggttgggaatgcgcacctgtgacacagcctcaggaggtgctgatgacatgtgcctaagktcatcagagcacagcttggttttacagttttagggagatatgagacatcaattaacacatgtaagatgagcattggttcctccggaaaggtgggaggactggaagcaaaagcgggatgactgaaagcagggagggggtttccaggtcataggtagataagggacaaatggttgtgttctttgagcatctgattagcctttccaaaggaggcaatcagatatgcgtttatctcagtgagcagaggggtaactttgaatagagtgggaggcaggtttgccctaagcagtttccagcttgacatttccctttagcttagtgatttggggaacccaagatattttgttttcacaatagaaacttcagctggctcattgggaaaattagagacaatgtacaaaagtagcaagcacagctgtgctgttgctgtttcaactctctgccctccctgaggaaatgcyttgcacaggggtagcatctcttggccctgaaagagaagagttagcctccacgggcccaagaggaggagatggacctccatgggttatgtgagccacagacttaccaacaggccagaggtgcttcagtagctcctctgtctctgtctggacctgccctctggggttgggttttatggttttctcaagtagcaaaaggtagcaatccctccattttatttttattttttaaaacagtctcaccctgtcacccaggctggaatgcagtggcacaatcacaactcactgcaacctctacctcccaggctcaagcaatcctcccacctcagcctcggctgggactacaggtgtgccgtaccatgcccagctaattttatttttttaatagtctctccattttagaaaacaaatttgacctgtttcctgccatctgtctatcccatattcatgggacctaggattcattcattcactgaatgaatattttttcagcatcccttggtgctattcttcttggtacttgggatacatcagtaaataaaacaaagattcttccagcagagatgaccataagctcaatatatcaatacattatagagtgctctagaaggtaataagtactaaggaaaaataaataggatagagttgagagaatgtggagagacagttacagtatttttatagggtggtcagggtagctgtcatgagagagtgagacttaaaccaaaccttggaggtgggaatgttagccaagctgatatctgggagaagaacataccaggcagagggattagctagaactaaggtctcaagaaaggagtgtgtctagcataggtaatgagtagtagggaagccaccggagtgaaaagaacacaggaagtttcactcatgtctgtatgaagagaccaccaaacaggctttgtgtgagcaacaaggctgtttatttcacctgggtgcaggcgggctgagtccgaaaagagtcagcgaagggagataggggtggggccattttataggatttggttaggtagtggaaaattacagtcaaagggggttgttctctggctggcaggggtgggggtcacagtgctcagttggggagcttttgagccaggatgagccaggagaaggaattttacaaggtaatgtcatcagctaaggcaggaacaggccattttcacttcttttgtcattcttcagttacttcaggccatctggatttatacgtacaggtttgggcccagaggcctgacaggaagggcagtaggagaggtggtcgtagatgatgggccagagggcgcagggcctagcaggccatggaaaggactctaggttttacgctaggtaaaatgaggaggcactgcagggctttgagcagcagagtaacacagtctaacttactttttttttttaatggatcctaccagctgctaagttaagaataatttccagtgagggcttttgtagtaaattagagatgatgctggtttgtcaatctccccttccagcagaggaatgtgtgggtaagagagtcacaatgtttctgaacaaagccatagctcctaagtggtgaagctgggcctagagcccctgtttcctgacagctggcctggcggtgggctctgtacagcattgattcccagccagcagcacaccctgaaaagtcacatagcagtgggagtgcagatgcttagactctccccatcagaaccactcagttggaatcttcagggttggggccaggtcagcagcagccgcagaagatactctggtcttcctgcttcagcagacaaaggtttctaagcccaaacgtgaggcatgaggataaatgaaattgtaaatggaagcagaaaaatgtccaggtctgagttcctctgctgtgttttagtcagtttcagtgcagtattttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacagcgtttcaccatgttggtcaggctagtcttgaactcctgacctcaagtgatgtgcccacctcggcctccaaaaatgctgggattacaggagtgagccaccatgcctggccaatcagtgggctttttaagaatgttcccgggctgggtgtggtggctcacgcctgtaatcccagcactttggaaggccgagacaagcagatcacctgaggtcgggaggtcgagaccagcctgatcaacagatcaacatggagaaaccttgtctctactaaaaatacaaaattagccaggcatggtggtgcatgcctgtaatcccagctactcgggaggctaaggcaggagaatcgcttgaacctgggaggcagaggttgtgggagccgagatcgtgccattgcactccagcctgagcaacaagagcgaaactccgtctcaaaaaaagaatgttcctgagaatggatgaacactaagttcaggtcctctgttaataatgttgttaccatactgtttttctcatatttatttttagattgaaagaaatcaagggaagggatgatattatgcaagtatatatgatcattaaataggcaatacctgaaggtacagaggtatacatgaaggtcagcatcaatggtgttctcagctacccatgttgaggcaagtataataacgacgaacatttgttaatacctacttgggccaggtgttgtgcctagtactttgcacatgtgatcttaagtaatgctcacagcaactctgtgaggtgggtagtgggataaaatgttaagtgttgacaaaatctgtctcataaggccaggcgcagtggctcatgcctgtaatcccagcgctttgggaggctgaggtgggcagatcacttgaggtcaggacttcaaaaccagcttggccaacatggtgaaaccctgtctctactcaaaatacaaaaattagctgggcgtggtggcacgtgcctatagtcccagctatttgggaggctgaggcaggaaaatcccttgaacccaggagacagaggttgcagtgaaccgagatcacgccactgccctgcactccagcctgggcgacagagcaagactccatctcaaaaaaaaaaaaaaaaaaaaaatctgtctcttggagttgttgtaatgattagtgacttaactctacccagtgtggcactagcgctggatttccaagaccacctgcaggttcaatgattcctgagagactcaagggactctacgtatagttatacttaacagttctgatttagtacaacagaagcaaaatcagcaaagggaagaattacatgggacaaattccayaggaaaccaggtggtgatgtccaagaggcctctcccagtggaatcacacagaacacacttcattcttccactgccaaattgtgcaatacgtataaaatgtcaccaatcagggaagctcattagaggtacccagtactcaaggtttttaccatgacatgctggtcatgtaggcaccctctgcctagcacataccaaaactctggaatcacagagggaaagctggtgttctgcataaagtatcttttttgtgtttgtttttttgaaaaaaaaaaaawwtttttgtagagacaggatctcaccatgttgcccaggctggtcttgaactcctagactcaagtgatccatccgcctgtaatcccaaagtgttggattgtgagccctgggcccagccagcaaaaactatcttgtttgcatgagcagttgaggaacaatgttagggaatgatgggaaccatctcaaaatccaagttctcagctgtcagccatggcctgatctaagaattttctaaggctcaggctctaaggagtctcaggcctgctgtgttaacttttttctgcacagcactcaaagtttatgtcctttttgattttgagagatgggaagactgagtttcacagaggttgggtgaccttctcaaggacacacagctaccaggtagccaggccaagatctggaattcaggtatcatggaagaccctgagaaaaatctctgtggagccagaagaccttctgcagttcagcactgtccagaactttctgcagtgacagaagtggtctagatattggaaatgcaccatccagtacagcagccactaagcacacgtgactactgagcactggaaatgtggctagtaccactaaggagctgaatttatatttgtttttcatctttaactcatttaaatagctacatgcagctggttgccaccatactgggcagtacagttctatactataatgtaatggatttttcttcaactgggaagcaggtgggataaatagaccttggttcttgttctgtactaaggaatgcactggtctatgtgttcctctcactgggtgtccttgtgtatgtgcaacaggggaaaataacatgtcatgtctgcaagttccctgaaaaaaaggccctttccattcagggattttgcaagcttggtttcattgttattaaagaaaggagcttgcctgactaaacatagagcattaaagctgtccctgtaggggattctgaggcccttcctggtgaagctcccctgccagactcaggctgcctcctcttggggtctgacccgcacagctggctctcaggcctctgtgttatcgtgagatggggtgtccccccaagtcaggatgaccttctacccacgtgcgtcttctctgtcttaggatgaggtgctcacgatcagccagacaaccagaagcccaaagaaggggagaggagactttaagaacccgtagggctagttagagcaccgagcctctcacttctgtcttcatcctgacaccaggagatgatgtgggcccaggggttgggtctgctgcaggccaaggagagctgacgggtcaggatgatgaagaggctggagagctagcacgggggttatgcacatcagctctggagcaaataacctcagttggtatcctggttcccatgccttaggaaagttactaaaggtcactgagccttagttcctcatctgtaagatgggaagaagattattaggaaaattaagtggaagcaataataatatcagctgttgcctctggggctgtgcttgcctgcgagccacaccaggctgcagatgacaggaaacacagtgagagctggagttgctgctgactgggtgcccctccattccagcaattccctttctgtttgatgtccgtgaacatcacccacattgccatccaggccttgagagaggagtgtctctccaggtgagtccccaaacaccagctggttagagtgacccagcaaagccttgttcgtccccactctggcttaattttccccagctctactccacctgctggctcctggagggyctggacaaagtccccatgcaccggtctccccaggacatcccttctcccacccctggccttagatgtcaggctcctggggaatggtgggggcatcctgggtttgggctggctcccctsgggaaatggggaaggaaggcgggagggaacctaggtctcagccttcatccaccgctgagcaggtcaccttgcctttttcctgcagagagtgtaatcggcagcagaaggtcatccccgtggtgaacagcttctatrccgccacattcctccayctcgcacatgtctggaggacacagcggaagaccatctcagactcgggctttgtcctcaaaggtgtgctctttcttctggggaggcctaggctgaatgcacagtgtcccaggtccagagagcccaaggtggttgctagactggttttggctgcagttcttccccatccacactttctcaaattccagcttaccaaaatctccatcacccacccsctggagtctgctagttctcctttctctgccctgactgtygcccttttctggtcttatacttatgacaagcatatattctgatcaaaaattgggagccagggtccaatagttggactattcaaagttgcaattgtgcagacaaggtagagtgtgtggtccctgtggctgtagctggctccctagcctacctctctggtgatctctccatctgaggctccttcactttctctccatgggataggggttgggggtactccctagagctgctaggcttgaggccttgactgttgtgtcacccagagccccctcaagccttctgctccccaattctctctgttgcagagttggaagtattggccaagaagagcccacggcggctgctcaagaccctggagctgtacttggccagggtgtcaaagggacaggcctccttgttgggagcacagaagtgctatgggccagaagcccctcccttcaaggatctcaccttcacaggtgagagtgacctgcagtctcactcatccgaaggcgtatggctgatctgacctccgagatgaatggaggcttaaaggctgagctgcaggggctttcagggggtcagtggagccatgtcaggagcctggccaggccgcaccccttgctgtctcagcagatgggatataggaagctcctgggcttagctgtgggaagccaagtaccctcaccggcatgggacatgaggggcagctagacttcacccccttcccgcagacctgcctccagagcaaggagaattctgccttaatctgttgggctccagtctccgggttgaattccagtgtatcccactgggagtgaatggatcatgaggtgggatggccccatctggatgttctgcagatccccacatgggaggagattcccaagtagaggcagccagaattctgactccctggcagcagcagggctttcaggcaccagtgtctgtgttgttagaactcagaggaagaggcaggggcagcagccgacagggggcagcatgacccaagcaaggggcctgaggcctcagtgggggtagggcaaggaggtacctcacaggtgggtgtgaggccccctctggagtttctggccattcacttacccactctcttctccccctgacccccgctccattgtttatgatggaaaaacggacatttggctaggtgtctctcacggctgctccatcctagcccccacaagctggggcttcctcctgtagatgctgtgcatgccccatgatgagtttctggcctaattgagggaaggaggaaattcataccagcagttttcaaataaaagaattgttctaattaagcgtctcaggtgtttttttccaagacaagtcttgcaccatcctgtggtcctgtcattccggaacctggttagagccaggcacacctaagggtgaaggcataggtgggttccagcctggtcatgggctccaggagacagaaggttgcctgtgctgcagccaaaccttgctgaattcataggatgtccatcctctgctatacttacaagcccagagactccttgcaagctctagccagtggacgaggtagcccagctcttgttaagattgactggtataaggcatccacaccacgtttttcctgcatttgcttctggcgaaggccagcactgttggttccttcccaaaagagcctccagactgggcgcagtggctcacgcctgtaatcccagcactttgggaggccgaggcgggtggatcacgaggtcaggagatcgagaccatcctggctaacacagtgaaaccccgtctctactgaaaatgcaaaaaattagccgggcgtggtggcggatgcctgtagtcccagctactcaagaggctgaggcaggaaaatggtgtgaacccgggaggcggagtttgcagtgagtcgagactgtgccattgcactccggcctgggcagcagagcgagactccgtctcaaaaaaaaaaaaaaaaaagagcctccaggccagggtacctgagctggggagtggggggcaggtgagagccccactatgctaccttctgtcctccggaccccctcaagtggaatgctatggaagaccactatctggccctgcaggcctctttaagtctgacccactgcagggggaaacatcacagaggtagggaagagaggtggccacccaggcgtggaggggaactcctgactgctgtcagcaggatgcctcaagggtggggctggtaacaaaccccatagtttgccttgtgttgtctgcctgacctgaactaaccccttcattcacaatacttcctccagtctggtcctcagctaaccaacagagatagcagggagattgctgggcatggcatggcaggagttgaattgcaggggagaaaagctgcagctcggcctccactttggagtatcaggttgggtgattcttccctctgcagggtcctttctgcccaccatccacctgtttagtgccccccagatgacagagtactcacagcttcagaccctggaacattagcaataatgtagtctggcaattttaaatttacagttctgttaatgaactggttgtgaggggtacctgaaccctctgaaagcagatgcaaaaatctttttttttttttgaaatgggatctcactctgtcacccaggctggagtgcagtggcgcgatctcggctcactgcaatctccacctcccgggctcaagccatcctcccacttcagcctcctgagtagctgggactacaggtttgtgccaccatgcccagctaagttttgtatttttggtagagatggggtttcaccatggtccccaggctggtctcaaaccccagagcttaaggagtccgcctgcctctgcctcccaaaatgctgggattataggcatgagccaccgtgcccagccacaaaaatcttaatctgtgtatatttatagggaaaggggctaggcctttcataggagacttaaaatactccccgtctctacaaaggttgtcagaaccactaatgtagtgcaacctttattctctcccctttaaaaaaccatccctggcacctgctctttgtgtaggctgtcaagtagggctaagaagtctatggagaagacatggaggcagatccacagaggagctcatttcttttttatttttattttttgagtcggagtctctgtcacccaggctggagtgcagtggtgcaatctcggctcactgcaacctctacctcccgggtttaagcgattctcctgcctcagcctcccaagtagctgagattacaggcatgcgcaaccatgcccggctaattttttgtatttttagtagagaaagggtttccatgttggccagactggtctcaaactcctgatcacaaatgatccgcccgtcttgccctcccaaagtgctggggttataggcgtgaaccaccgcacccggctggggtatctatggtatggttcttggcacaaatcagcaagttcaacttgccaattgatcagaatttttgttttgggatgaaagaatccaatttctggagctcagaagccacatagtccagaggacctgggggtgaggatgagtcagggtggttgcagccttgccaggcctcacggcctctggtccaagctgacacaggctcactcacaccctgctcttggcccctgggcatgccttctcagatgggacctcttcttggctactgcattctccctgctatttagctctctagcctctgacatcccaccaccacttcattacccaagagaatgaactaaggtctagcaaaggaaagtaacttgcctaggatcacagaggcagggtaagaaccagactgaagactgtccatgctagcctggtgcttttcgcacagccctgcagtggccctgggctcaccagccaaacatgctgggcaatgtgcctacgaagtaataagccaggcttggtacaattgtgaaaggctgtcctctcttgctcagtgggcatatgtcacttgaagctgcctggcagtgctttattagggcatccgaagaaatactgccttaaatggaactgcatcccaagcccattgccacaaccttctccctgttgggaatgtgagactgaactgaacacccggatgcaactgatcctgaggcctggcactgtgccacctccctattgggttcatggcagtccctgcaagcctggctgggactcctctgtcatgcaaagcagctctggcccctccaaggctgtccaattgtcatctgtgtgctactccacccccagcatggggatgaacccaggtgaataggtgggtgacagtgagaatcagcccagggcaggtggtgcaggaaaagagctgggaaagcacttgtctcctttattgaacatctgcagggggcacctctgcactgaccaggcagccagagaagcaagcaggcaggtggtggggggcaggggagcatggggcaggaagacgcccaccctcatttccagtccttgaaaaattgcttgaagatgggactctcacggccctgaggcagaatctccacctgcagggacagcgggggagaagtctggttcacaaagttgccacctctgcctctgcccaggaggacaggagggggccagagccagggaggagggtgtgggcgcctggcctgaatccatgtgcagtccaggctgggaaagctcccctggatgagccatgagatgagaaccaagatttcagggacacagacagaggcaacagactgcttcaagggcgtgggtgcacagtttaataaatgccaccaacggtagctgagccctgtcagctccccacgggatgacttgtggacactgtgctgcggcaggaggggtggcaccagccagggacaacggcccagaggaggagtacccagttctctgggcacccaggagagtgctgcccaacatcctctttgaaaataataagtattttgacattttgaaggattgagatgggctttcccactggatgggtctaagagggaggcctggttgttcctgacagtgcccaaggctctcctgcccttcctggccaatttgaggggtcaggggccacaggaagagccctaggaagagggctgtggttgtgcgcatctcctcacctgagtgttcggggcgtactgcatgcgcgagatgaagccctcggccacctgcagggctgcctgccgctccttctcattcgcttttcgccctagatcataggaaggagatttttaaaaagagcagggaccctctttagctgccatcccatttttcttgaggaaatttaagggagtccacagaagagccagcaatttttacaataaatggaccaggggtcccaagaatgccgaggggctctttggagatgtggagtcagtcccttaagaattttcccaaaccggcagcaccaaggtagatgaaaacccctcgtctgcccgggtctgatcatgcaaaactctgctctgacctgggcccctggaatatttcagggaggggaacaggtgttcaccctagcatcagactgtgaggccgcaggtctccttttcctctaggacccctcacctcttgaattcatcaagccttttctgaaaaactaaataagacaaagggtacaatttattatagaggtgatttactcccataatgccagcagggctacactggcctaacagttatgctaactaagcacttacaaaaatgaagaccccacgtaatccagtcatttctgctagcagtcctgagaactcaaactgctcattccaggcttttttatttttattttttctgagacgcagtctcgttctgtcgcccgggctggagtgcagcggcaccaacacggctcactacagcctcaacctcccaggctcaagcaatctgcccacctcagcctctcgtgtagctgggaccacaggtgcacgccaccacactcagctaattttggggggttttttttttgtagagaagtgatatttcgccatgttgcccaggctgccagacatttttccaaggaaatgataccgaaacgatgccgtgatgtggttggctctctaggcaggctataaaatgccatgaactacaatgtatctgaaattaatatgctggattccttcctctgtcaactgaccagctgcccccctacccatgagatccttctcttcctggcctcccaagtttcctgtttttcctctgatttctctttccatagttgttgggttccttgctccggtttatacatgcttctgtgggcctctgtgaacccccctctgcttggcattggttccatgggatatgtgccctctggcaggagagaaaaggcagccctgcagcacacgcctctcgctttccactcttttgctgctcccagctcctccctttcacttctatccctgctgagtttcagaagcaatactatgaaatgcctggtagcagctatctgtagatacccacctacttgtctgccttcctgaccaggctaggggctggcattttctccaccttggttgaccccacaactgggtgttgagcaaatgctattgctgaaaattctcagaccccaggcagagactgagaacaagtttgtttcattttcagtcaaaccaagcagaacaggctctgcccaacagtgtttctatttccagaagatagaatcttttggaaaaacaagttctacaggttcaccactcactgcataaaatgatgtttaatttgtctaaaattcatttctgtcaaaccttgagacagaatcccaggatcaggggtcccagaagccccaaaggtctagagctgggctagggcagtggttctcaaagtgtgatccctggaaccagcagcacagacataacccataaccttgttagagatgcatgttctgccccactccagacctagtgaatcagaatctatgggggtggagcccagccatctaaacaggccgtggggtgattctgaggcttgctgtagtttcagagccattgtctagaatttaggaggtgggaacagcaaagagaaaatggcgaggcagtggctcacatctgtaatcccagcactttgggaggccgaggccggtgcatcacttgaggtcagaagttcgagaccagcctggtagtgaaaccccatctctactaaaaatacaaaaattagccaggtgtggtggcacgcacctgtactcccagctactcgggaggctaaggcaggagaattgcttgaacccaggaggcagaggttgcagtgagccaagatcgtgccactgcactccagcctgggtaacagagcaagattccttctcaaaaagaaagaaagaaagaaagaaagaaaatagcaaggcctatgccatggct

SEQ ID NO: 17984 - DNA, 65885 bp, Homo sapiens
ttcaagctatccttctacctcagcctctgatatagctgagacacaggccaatgccaccatgatgcctggcttttcttttttttttttttttttttacttttgagacagagtcttgctcagtcacccaggctggagtgcagtggtgcgatttcagctcactataacctccgcctcctgagtttaagcaattctcctgcctcagcctcctgagtagctgggattacagacatgcaccaccacacccagctaatttttgtatttgtagtagagatggggtttcaccatgttgtccaggctggtctcaaatgcctgaccttaagtgatctgctggcctcggcctcccaaagggctgggattaccggcgtaagccaccgcccctcgaccatccagctttttttttttttttttcagtttttggtagaaatgtggtctcatgcctgtatcccagcactttgggaaggccgaggtgggcagatcacttgaggtcaggaattcgagactagcctgaccaacatggagaaaccccgtctctactaaaaatacaaaattagccgggcatggtggctcctgtctgtaatcccagctacttgggaggctgaggcaagagaatcacttgaacctggtaagcggggtttgcggtgagccaagatcgtgccattgcactccagcctgggcaacaagagtgaaattctgtctcaaaaaaataaaataaaataaaaatacaaaattagccaggcatggtggcacgcgcctgtaatcctagctactcaggaggctgaggcaggagaatcgcttgaacctggtaggcggaggttgcagtgagctgagattgtgccactgcaccccagcctaggagacaagagcaaaactctgtctgaaaaaaaaaaaaaaagaaatgtggtctcactatgttgcctaggctggtctcaaactcctggtctcaagggatcctcccacctcagcctcccaaagtgctgggattacaggcatgagccaccgctcccaaacagattagaggatgttttaaggaagactcaggaggttaccaagaaaaaagttcattcaaccaccacacttcctgatgtcccttatagagacatgtgaggagagttttgatgggtacatagaagctcacaagaataaaatgtatttgttcattcaatacaaggtcctctgatacttctcaaagagaatttgaagtggattttgaagaatatatagatgttaggccgggcacagtggctcatgcctgtaatcctagcactttgggaggctgaggtgggtggatcgcctgaggtcaggagtttgagaccagcctggcaaacatggtgaaaccctgtctccactaaaaatacaaagattagccgggtgtggtggcaggtgcctgtaattccagctactcgggaggctgagcgcaggagaattgcttgaatccaggaggcggaggttgcagtgagccgagattgctccactgcacttcagcctggccaacagagctggacttttgtctcaaaaacaaaaaacaaaaaaacacaaatatatatatatatatacttgtgtgtgtgcgtgtgtgtgtgtgtgtgtgtgttaaccacagaaaaactgcattcattcattcagtcagtccagtcagtcactcaataagcactccttcttgcccactgaggggttgttcaggaggcagttcagtgtaggaattctccagatggagcagcggatttgagacctctctggtggctctctccagcatgttcccacatgcccaacccaaccctggttcagggaacctctctttccccaggattccagtcaaagccccagggagggctctgataggctgagcttgggtcacatgtacaccttgaaccaatcacagtggctgaggtggataaacgagtctgagtcacatgtccaccccaggctggactaagggagaactttgaggcagagctgcccagagtcagaacaattggccattgcaggacatgagcttctcatcacttggggtgtgcaagctacagcctgaagttcacttagtgtaggactgccagataaaacacacgacttccccacccccattgacttctgccttctcagggaccttcagcccgaagagtggggagcttccctccatgtggccaagagaccctgatgcccctgaggggtcatctaaagagggtgttgaaggatgcataggagtttgccaggagaaaatctattcattcatttaacaaactcactcgtagtcattattcattaaataacatttaaattaaattcccagttaaattggaatttcagacaaccaacatattggtttgtgttttgttttgtcttgttttgttttgtttgagatggagtctcgctctgtcacccaggctggagtgcactggcactatctcagctcactgcaacctctgcctcccaggttcaagtgattctcctgcctcagccccccgagtagcggggattacaggcgtgccccattacgcccccttaatttttgtagttttagtagagacgcggtttcaccatgttgcccaggctggtctcaaactcctgacctcagatgatccacccacctcagcctcccaaagtgctgggattacagacatgagccagcacacacggccaacacattgttgtttaatgcaactatgtcccaagtactgaagggggcatacttacactgaaaaaacattcattgtttatggaaatttaaatttaactgggtgtttgctttggaaaacagcctggttgtcttttacaaatttaaaacatagagttgctgggcgcagtggctcatgcctgtaatcccagcacgttgggaagccaaggcaggaggatcgcttgagcccaagattttgagatcagcctgggtaacatggcgaaaccttgtctctacaaaaaatacaaaaaattagctgggcatggcggcatgtgcctgtagtctcagctactccgccctccagcctgggcgaaagagcaagaccctgtcccaaaacaaaacaaaacaacccaaaacatagagttacaccatatgaccccggaagtccattcctaggtaagtacccaagagaaccaaaatatatccacaaaggcagggggcggtagctcacacctgcaatcccagcctttcgggaggccaaggtggatggatcacttaaaggtcaggagtttgagaccagcctggccaacatggtgaaacccccgtctctactaaaaatgcaaaaattagctgggagtggtggcgggtgtctgtaatcccagctactcaggaggctgaggcaggagaatcaattgaacctgggaggcagaggttgcagtgagccaagatcccgcgactgcactccagcctgggcatcagagcaacacttcatctcaaaataaataaataaagaaataaatctatgcaaaaagttgtatgccaatgtttatagcagctctattcagaatagctaccaaaacgtgaaaaaatccaagtgaccaccaacaaatgagtggatcaacaaaatgtacatgtacatatatacaatggaatattatttggtcatgaaacggaatgaagtactgatatttgccacaacatgggtgcatcttgaaagcatgatgctgaacgaagccagacacataaggccacatgttatgttttcatttttatgaaatatccagcacaggaaaattcatagaacaggaagcagattggtagttgccaggggctgagagagggggaatgaggactggctgctaataggtacagggtttcttttggggatgatacaaatgtcctggaatcagatcgtggtgatggttacacaactctgtgagtatgcttaaaacactgaatttattgcacactttaaaagcgtgaattttatggtatgtgaattatatgtcaatttttaaaattgtatgagaaaaacaagttttccctggcatcctgtatttttatttgctcaatctggccaccataacttgatgcaattctacagtacctcatggacagtcaggcccagtgacccttcctagggtcccctcgagcctgaaagcatactccagtgtccacactgtacagtggggcagccgaagacaactgcggctgcagagaaagtgcgagtcccagggaaagaaaaaatgcaggtgctaagccaggcacagtggctcatgcctgtagtcccagcgctttgggaggctgatgcaggagcatcacttgaggccaggagttcgagaccagcgcgggaaacatggcggtactccatctctacaaaaaaaacccaaaaaaattagccaggcatggtggcatgtgcctgtggtcccacctactctgggagctggggtatgggggctgaggcaggaagatcgcttgagcccgggaggtagaggctgcaatgagacaagattgcaccactgcactccagcctgggtgacagagagagaccctgtctcaaaaaaaaaatttttttttaaatgtgggtgctattttgggactttgggcttttctcagcctcagtttcccctcctgcaaaatggagtagaacaattatcttcaaatatctgtgagagatggtgtttatgagacacttagggcaaaaaggcaatcatcctcaaaaaagaaactgacaactgcagcggctacctgcttttgtaagtaaagttttattggcaccagggccaggattaaagggaggcaaacaaggctgagtggtgcaaggacaagggtctgatcatgtcttaagagttttagtgttttggccaggcaaaacaccaaaactctttggcctgcaatcccagaactttgggaggctaaggtgggtgaatcacctgaggccaggagttcgagacaagcctggccaacatggtgagacctcatctctaccaaaaatacaaaaaatcagcctggtgtggtggtgggcacctgtagtcccagctactagggaggctgaggcatgagaatagcttgaacccaggaggcaggggttgccgagatcatgccactgcattctagtctgggcaacagagagactcgtctcataaattaaaaaaaaaaaaaaaaagttttggtgttttggccatatgcggtggctgacacctgtaatcccaacactttgggaggcctaggcagaaggatcttttgaggccaggagttcaagaccagcctgggcaacatagtgagatccccgtctctaaaaataaaataaaaaataaaagttttgatgttttgttcatcataaatgttttcattaattttatgtttttaaaatattatttctcttgatggctgagttttgtggggccaccttaaattttgcacaggggtgagatcctcactcgcctcaccctagaacccgttctgctgtgtgtactgggcacattttttgttgttgttttgtttttgtttttgagacagagtctcgctctgtcgcccagtctggagtgcagcggcgctatcccggctcactgtaacctccgcctcttggattcaagcgattctcctgcctcagtcttctgagtagctgggattacaggcgcgcgtcaccacccccaagtaattttttttttgttttgttttggttttttttgtttagtagagacagggtttcaccatgttggccagggtgatctcgaactcctgacctcaagtgatctgcccacctcggcctcccaaagtgctgggatacaggcgtgagccactgcgcccggccaatgcgctgggcatattgattaacctatcttagcctcagtttcttcatctgcaaaatggggctgaacgatgctgccttacttctgagaggattcatgcaaaatatttacttctgcgctctgctggaggggcggggccagctcgcccagtgggggcggggccctgtggtcgggctccccgggaggggcggggccaggccgtgtcagctgaccggcctggccaatggcacctggcggcggggcctggcaggccggggcggggccgggggcgggcctggcggcgcggactcccgggccatggacgagtcgagcctcctgcggcgccgcgggctccaggtgaggcccctgcgcgggcgggcggaaggcagagggcgcggccaagtggacgcggcctgaaaggtgccgggaggggcggggccttcacgggctgtagggaaactgaggcagagggtggggaacgctcagatcgcttctttttgaccacccgcttctcaaagtgctttttctcatggtgggaagggggaaggtgcccccttggacatctagggaaactgaggctccaagcgatggcgtgggaggaagaggctgagggctctgcccctccccaccagctgttctaataataatgctagcaacagcagccagagagctcaccatatgttcatggttgttttagtcctattactagcgatgtattaatatgagttcatatgtattaatacctccttgggtcgtcgctgcaccactgtacaccctcagctcagccctacgacgacctggggaggttggggctgtcaggcgcccatttgtcagaataaggaaactgaggctctagtcccggaaagccactctccagaggtcgcctagctgggattcgatctgcgccctcaaccagctctcttacggcacaaggcgctgccaaccagcagtgtgacctggggggagggcacccttgcttctctgggcctcagttttccaatgagccatagggtcctccttttactgagtttatgtttaggaggctgtgtcatcaggaggtagggacacaggcgtcggggacagcagaagcctaagtttgaagccacacagggactacatgaccccgggcagccaccctttgacttctctgggcctcagtgtccccattataagaaaagaaaaacaggaattaagatttggccattttcctctgggacttagaccacacccttaagaagccaccaagttttcaggtagggaacctgggattcagcacttacccaacgaacatttatggagcgcctgctgtgtgcctggctctggagaggcagcggagtgttctgcaacctctggagctgccctcctagaaaccccaacctgttgggggaggtagacgccagagcagcggtgaccccacggagtgatcagttgtgataagggactcacagcaagtgaaggaggcgcctgacccagtcattgctgggagccctggggtagaggaggcagccaagggtggcgaggcattgcagcggggggcggtatttagggaaatgaaagaggttgacagaagctggaacctagggaggactgagcaggtggggtgggggtcggggactgaggttagctccgggcgggttgagggggtgagaggaatggggccggcgggtctccaacctggagccgcaccggtagctgcgggactgcgaactcagcaggtgatgggaagccaggtcgggagtggtcagggaaggcacgggctgagctgcagatcagagacacccggtctctggccgcgcgggggtggggcagaactggaggcgctgaggccagaggcaagagtgggggacttgggcggaaaggagggggcggggcgggattggcgagcagcgtggtgttggtgggggggcagtcccgcctccagccccagttagatgccaacccgcccgcagcctcttaaaatagagaaaccgcctccgggtaggcgaatgggggtgctgctgacgtcaagaagtggggcctgttccatggtgggggggtcaaacatttcctgatggtaagttctatgttacaaaaggggaaactgaggttcagagaagcatagccactgtccgggtttcacaaagtataggtgacagagtcagacaggatttgaacccacgcagttccggcttcctctccaaaccaacccagcacaggcgtccctccacgaaggtggagggatgagcacggattccccgactgaatgagggcattccgggcagaggccacagcacgtgcaaaggcccagaggcatgtagcctttcttacctgtttatatggggaaacaagaacttgaacctatttcttagcactagaggctgatggccaggacttaatgcttccagggccttcagtgctgattttgaagaggttagactttccccctagggtgatggggagctatggaaggtgctggagcaggagaggacatgcccatattgaggggctgggaagactcctctggagggctaggagcaggagtgggggaatcaaaaagggcaggaagccaggaaggagcatggaatgaaagtctaagtgtaccaggtgtggtggctcatgactgtagtcccagctactcaaggaggctgaggcagaaggatctctctctctctctyttttttttttttttgagaaagaatcatgctctgttacccaggctggagtccagtggcgcaatctcggctcactgcaacctccacctcccgggttcaagtaattctccctgcctcagcctcccgagtagctgggattacaggcacatgtcaccacgcccggctaatttttgtatttttagtagagacggggtttcrccatgttggccaggctggtatcaaactcctgatctcaggtgatccgcccacctcggcctcccaaagtgctagaattacaggcgtgagccaccgcgcccagccaagaaggatctcttgagcccaggagtttgaggctatagtgagccatgatcacgagaccctatctcaaaaataaaaataaaggtccaagtggaagaagattaaaataataataaaataatagtaaagtgggaataaccgttcatattaacaggctaagccctctcatgcattcaattctcccaacagcccgagtggtcagtgctattattagttccacttttcaaaggaagaaactgaggcccaaagagggaagtacccaccaggaagccagagaaattctaaccaatctggcacgtgaaggtgttgtcttcatcagccccagtttggggtctcttttgactggaaaccttgttaatggtccaggagcaccccagccaatcagggggtagatcgctgatgcgagccaatcagatttcctggaggccaaaggccaaagagtccattcacaaacgggtgctgaccggccaatccagacgcatagcccagggcgtcctctccggtggtgacaatgtgaggcgtgctgttggctgtgtgcaggaaaggtctgaaaaaggatccggcctggcccgcgggcggccagtttgcgacagccctgggtccagggaggaggtggagaccttcccaatttgggttaaactcagcctcacgcataacgtgtgcaggcaccgggtaacgtgagctgttattactactactactattatcttattacatttatcatctcctacttggacctttgctttacacatgaccgaatttcaaaacaccaggtcccacaaacagagcatcccccggcagagaagggctagagcctgtatctggacttttgtctctgccgctactggggtggctcctctaggttcagccctccaaggtgatcctgctttctcatggacagcttccacttattttcctcctcctcctcctcctcctccttctccttctcctcctcctcctcctcctcctggaagccctggggctggtgccatgtggtccatgctgacttctctcccatttaattccaggggcatcgaacttccaaccgggcttggtgcccagcaggctgagtctcacctccctttgcacgtgctgtttgctgggcatggactggtgttttccatgtgcctgcaggctttgtttgacaccccctactccaggaagccccttagctctcctctctgtgtgcctccaacccctcttctccctttgagtctctctttttttagacaggatcttgccctgtcgcccaggctggagtgcggtggcccaggctggagtgcagtggcgccatcttggctcactgcaggctccgtcacctggatacaagcgattctcacagcctcagcctcctgagtagctggattacaggcgagcgccaccacacccgactaatataatttttatattttttagtagagatggtgtttcaccatgttggccagaatggcctcaaactctttttttttttttttttttttttgagacggagtcttgctctgtcgcccaggctggagtgcagtggcgtgatctccgctcattccacctcccaggttcatgccattctcctgcctcagcctcccgagtagctgggactacaggctcctgccaccacacccggctaattttttgtatttttagcagagacgggctttcaccgtgttagccaggatggtctccatctgctgacttcgtgatcctcccacctcggcctctcaaagtgctgagattacaggtgttagccactgcgcctggccttttttttttgaaacggagtttcactctttcgctcttcttgcccaggctggagtgcaatggcacgatctcggctcaccgcaacctctgcccccgagttcaagcgattctcctgcctcagcctcccaggtagctgggattacaggcatgcgccaccacatcctgctaattttgtatttttagtagagacggggtttctccatgttggtcaggctggtctcgaactcctgacctcaggtgatctgcctgcctcagcctcccaaagtcctgggattacaggcatgagccactgcgcccggccaccttttttttttttttttttgagacggagtctcattctgtcacccaggctggagtacaatggtgtggtctyggctcactgcaacctccgcctccsgggttcaagggattctcctgcctcggcctaccgagtagctgggactacaggcgcctgccaccacatccagctaatttttgtattttaagtagagacggggtttcactatgttggccaggctgatcttgaactcctgaccttgtgatccgcccaccttggcctcccagcgtgctgggattacaggcgtgagccaccgcacctggctcaaactcttgatcttaagtgatcctcccgcctcagcctcccaaagtgctgggattacaggcatgagccacagcacccagctgcttcgggtctctcttaatccctccagtatgggggtgctcctgctgtgctatgtcttctccaaaatgggatttcctcaaggtggggctaaagcttgttggggaggcagcatcccccagcctgggcaagcgcagacgggtataccataaatattacctttaaagggcagtttcagggggtcggggcctccccaacctccactcctctgggtgggaaccactcccaggggaacagcaggcacagagggagctgtgggtggaaagcagatggtgcggggaccgaagggtccgggagtggtgccaggagagttctgtgtggtccagcttccccgggagcctttgcagggagctgccgattttgcytcacctctctctgccactttaaaaaaacatcttcaggccaggcacagtggctcatgcctgtaatccagcgttttgggaggccgagatgggaggactgcttgaggtcaggaggtcaagaccagccwgaccaacatggtgaaatcctatctctactaaaaatacaaaatcagccaagcgtggtggtgggcgcctgtaatcccagcttacttgggaggctgaggcagaagaatcgcttgaacccaggaggtggaggttgcagtgagacaagatcgcaccattgccctccagcctgggcgacagagcaagtctccatctgaaaacaaacaaacaaacaaaatattcacatctttttgtcttttggaagcaactttcaactggtggttattattcacgtcttgatcattgtcttgactcccatccatccaagtctcccccagcaccaggctctgagcttgctactcattgattcctccagggaccctatgtcactgggccattttccaaatgagaaaactgaggcacagaggggttaagtcacttgtcgggtcacacagtgcaggagtgggggagccagactgggaacctaggactgtcagagttttggaaggaaatgcctggatggggtgcaagtgggaccccccaccagggttcaaatccctccctgtttcacgtggggtagtggaggaagtggtataagatcccacaactggctgggtgcagtggctcatgcctgtaatcccagcactttgggaggccaaggcaggtggatcacttgagaccaggagttcaagaccagcctgggcaacatggtgaaacctcatctctataaaaaatacaaaaattagccgggtgtggtggcacatgcccmcaatcccagctactctggaggcggaggttgcagtgagccaagattgcaccactgcattccagtctgggcgacatagccagacgctgtctcaaaaaaaaaaaaaaaaaaaaaaaaaaaaaaaaaattcccacaactattggaaggggaagaaggagaccctaatggccacggtgatggtggtgatggttccatcaccatgactgcttgaactaaacgccgtgagttgtctgtcctcagacatattcaagcagtcagagagaccttcgaggggtagattattctcctcccatcgtgacagcttggttttctgagcgcagagcagctgaagtcaggcctggggtracgccacacccccgcgacccttccccgcctctcccgggagaccttgccctcccagctgggtcatccggcagcccagcagcttccggccccctccaattggctgtaggggccgatggcgtcactggttgctatggcgaacacccagatcacgacgtgggcagcctggagcccaccaaagtaaaaatagtcgtgtgtccccaacgtggccgccctgatgtgtgtggagggagggtgtcctgagacccagtttcctgcctctcactccactaagagacgtgggcagccggctttcctctgcacctaagtttccctgccagtaaaacagcccctgcccgcggttcgtaggaggtggctcagtaaatgcaaggacatttaccaggtattatgacagcttccatggtcccttgctgagctcaacaatagtacaacagcacacaacagcagcaatagtaatggctgatcatgattaacccagaaccctcctcacgtcatctccagttacagatggggaaactgaggcacggggcatacaaataatttgcatggccaggaagaaacagagaattgaactggacccaggtctgggtgtccccagattctaaacttgtgccacatggcattttgagaatttaataaaccctcgtgattgaccgggtgcgatggcttacactgtaatcccagccctttgggaggctaaggtggatggatcacttgaggtcaggagttcgagaccagcctgggcaacatagtgaaacctcgtctctgctaaatatacaaaaattagccaggcatgctggcacacacctgtaaccccagttacttgggaggctgagtcaggagaatcgcttgaacccgagaggcagaggtttcagtgagccaagactgcaccactgcactccagcctggcgatacagtgagactccatctaaacaaacaaacaaacaaacaaaaaactggttttttggccaggcatggtggcttatgcctgtaatcccagcattttgtaatcccggcattttgggaggccaaagtgggtggatcatctgaggtcaggagttcaagactagcctgggtaacatggcaaaaccctgtctcttctaaaaaaaaaaaaaaaagtcccagctactctggaggttgaggcaggagaatcgcttgaacctgggagacagaggttgcagcgagccgagattgtgtcattgcactccagcctgggcaacaagagcaaaagtctgtctcaaaaaaacaaaaacaacaacaaaaaaaaaccctcttgggcagcccatgtctgaggatggactgtgaggtcacagtggaacacaagctcacggctttctatccttcatgcggtgagggcacccagagttggtgcaggtcagtttgctgagctctaaaagggtcttcaaaagggagtcacccgtcagccgtcctccccacgcccccactggtacccagggcccaaacctgcataggctttgcagcgagtgaggagagaatggcgttcagacctagacccaggaggagagggacatctgagatgggacagggagaggacaactcaggaatctctgttttctcaacagattattagtttttagccactactgacatacttcttcataaatacaactaattggtaattttaaataaaattattattaattttttttagacttagagtcttgctctgtcacccagactagagtgcaatggtattatcatagttcactgcaacctccaactcctggggtcaagcaatcctcccacctcagtctcctgagtagctgggattgcaggcgtgcaacaccacacctggctaatttttttttcttttttgagacggaatctctcattgttgccaggctagagtgcaatggcaccatctcagctcactgcaagctcygcctcccaggttcaagcgatcctcccgagtagctggggctacaggtgtgcaataccacgcccagctaatttttgtatttttagtagagacagggtttcaccatgttggccaggatggtcttgatctcttgaccttgtgatctgcccgccttggcctcccaaagtactgggattacaggcatgagccaccgcacttggcccttcttatttatttatttatttatttatttatttatttatttatttatttttgagatggagtttcgctcttgtttcccaggctggagtgcaatggtgtgacctcggctcactgcaacctccgcctcccgggttcaagcgattctcctgccttagtctcccaagtagctggaattacaggcacccaccaccatgcctggctaattttgtatttttagtagagatggggtttcaccatgttggccaggctggtcttgaactcccgacctcaggtgatctgcccacctcagcctcccaaagctctgggattacaggtatgagccactgcgcctgaccggcccggcctttttttggagacagggctcaagcaatcctcccacctcagccccccaagtagctaggagtacaggcttgagccaccatgcccagcaatttttttttttttttttttttttttttttgtagagacggggtttcactctgttgcccaggctagtttcaaactcctgaactcaagtgatccatccgccttggcctcccaaagtgccagaattacaggtgtgagccaccgcacccggcctactctggctaatttttttaaaaagttttgtagagatgtagtcttgctatgttgcccaatctggcttaaacttctgggctcaaacaaccctcctgctttggtctcccaaagtactgagatcacaggtgtgagccaccgtgcccagcctaaaatattttttaatgcaggtatggtaggagccgggtggggaattagactgtgaatctggagggcctccaggaagaaaggatgttgagttcagatctggagtatgagctgcagttaattagggccagaagggagggaaggctgttctgagagagcgcacagatagcgcaaaggccttgaggcagggctgagccagtgtgtagagtgagcgggaaagatgcattggttggggcatgggattggggattgtgggggtgcatcaacggccaggggttctgagggctagtctctctgagaatgatccccatttctgtctcattgcagaaggagctgagcctgccacgccgaggacgtgggtgagttcacctgggactggcgggctgggtgggccccagtggtcttggaagtggatatttcagcaacagccactgaattgtgaatgtatttaataattacagcaacacatctcatgttcattcttgccctcgtgtttgcaaagtgcttcacaagcacctggcctctcaccacaaacatgggaggccatgccagtttgcaaatgaggaagctgaggtgcaaaggggtttcatcaccagctaaggacactcagctgggaaggagagaaacttgtctggaatccagagtccagatgttgaatttcagctgaagtgtattagaactggcttgaatgcctctcatgacggggagctcacttccttttggggaacaccagcagaaaatcatctctcagctaggcacggtggctcccgcctgtaatcccagcactttggaaggctgaggcaggcagatcacttgaggccagaagttcragatcagcctggccaacatggtgaaaccccgtctctactaaaaatacaaaaaaattaaccaggcgtggtggtgctcgcttgtaatcccaggtactcaggaggctgaggcaggagattcgcttgaagtgaggtgaagattgcagtgaaccaggctcccaccaccagacttcagtctgggcaacagagtgagactctgtctaaaaaaaaagaaaagaaaaaaatcatctctctcgggatcacatcagtgttcctgtaggttgggtttttttttttttgttttgctttgttttctttttgagacggggtccctctctctctgtcacccacatagtacagtgcagtagtgtcatcttggctcactgcaaccactgcctcccaggttcaagagagtctcccgcctcagcctccagagtagctgagactacacatgcgagcctccacacctgacttgtatgtttagtagagacagggtctcactatgttgcccaggctggtctcaaactcctggactcaagcgatctgcctgcctcaacctcccaaagtgctgggattacaggcatgagccaccatgcccagtctaggttaccattttttatccccaaatcttagagaacattattgttcaatgctttcattcatttacagatgaaagaaaccaaaggccggggtggggaggggttttccttgagctagtggtctggaagtgtgtgactgtggacaccccatctttgggagctgcttttgcctgagttgggggtgggaatcactcaatgaacatttttttgagcacctgctgtacactgggccctgctgaagccagaggggatacagacaattcaatctcagagcaatggttgaagttttgtactcaggagagagctcaaccagagaaagagacagaggtgctgggggtggctttatcctgaagatctggggcctcttggaggaagtgacctttgagcttagatctggaagaagaggaggagctggcagcggggaagtctggggagaatggcattccaagcagcaggaacagcttgggcaaagtttctggggtgccagtatgcttggcgttagaagaacagcatgaagacaagggtagctgagtggagtgagtggagatgaggtggcaggacagaaggaggaggtcctgggaatggggtcagagtggcccccaatcccaggccatctgcttctgttccagtggggatgatacagttggtggggaggtgcttgaaggccccagtggttgggggttgctgggggactgggacattgccccgagagccggcactgtttccagccttggcccaagctgtgggcagagtgttggaccgtgaatcaatgaggactgccgagggcaaagtcctggaccttggggcaggacagagccaaagactccacaagggatgwccactccctgccaccttccctgtgccccactgggtccaccggggcctcaagagggccagagtgagacacagacacccccagaccgtggggtttgcgctgagagggaggaaggacagagctggcggcgcctggtgctggtgggggtgcaggtacagcttggcggaggaggggctggtggggttgggatcgtatatgggtgagggggcgaccttcctggcagaggaaacagctggaagccagggactggaggtgtggtcagagcctctagtgtgcgcggggatgcggagacccgagcgggttaggacctcagtgctgagcagctggccgggatgcggggttggggagttggggcggactgcgctcagatcccggctcccagagagccccagggccggggcgagggcagaggccgggccggggcggggagaggcggggtcaggccatggagcaatcgcgcggaccgcggagccagtgaccgcccttcccttccggggcgcagctcgggggctcccaagccggcggcctcggcgtccctgcggcagacagggcggcacccgcggctcccctttcccgctgcgcgaccctcgctgccgggccgggcctgcgcgcaggtgcggagctgcgatccccgccccgaggcggagccagcccggcccccagcggcccagcccccgcgtctagtctgccgcaccagccaggcgtctgtccctgcgtccgtgtgtccgtccgtcggtccgctcgcgccacgatcagggcttccgggggccaacaagggggcgtcggtaccccgccgcacagaggcggcctctgcctcggcatgaagtcccgcagggacaagctgcacatcccggcgctgaccctcgagtgagtgttgggcagggcgggggtatgcggggtgcagggaggacaggatgacaactaccctccccccacgtctctgttcgtgtcgcccagaaacgcaccgccgcctccggggagccctcccgggccatcggtctggccccgccctcacgtcctgagctgaacccagaatccccggtcttgggcccctactccctgagggaaccgcagccgccatccggagatccggattcggccacacgaaggggcggccgccaggttcaccgtccccggcctctttctttgcagtctgtctccgagcagccagagcccgtccctgctgggtcccagcagcccctgcagcccctgtagcccctccttgggcctgcacccctggaggtaagtgacagcgcgtgtgggcggggcgcagacatcgccctggcaccccagagccttggaaaccctccagactcatcggtctcctcaagatactgyaggttggtgacatcacctctctgggcctcagtttacccctccacataatggcactgcgatacgttctaggggcttaatgggaaaattccatttttagccaggccagcatctgacaggtggccaaggaaagggaagaacttaagctgttgcccaaggacttcgccaagacaggtgccggattcccaagcggctcagggcactccctgctgaattggcctggactcctgggtggtgacctcagggagaaagctcctccctctaaaacacacgcacacccaaggctgagaggccaccaacgagagccctgtgaattgagmttaaccraagtggcgccgggagaaaagaaccagggtgactgagcgctccctaaccctttcctgatccctacttcccagttaagaaaactgaggctcagagaggagatgccagttttcctgattcagtccatcccccgggggccaagcatcagggacagctttgctaccaggtctgttgagggttctactggccagttggttgactctgtgactggccaggtttcaggacaggaaggagttttgtgagctcctctcatggtttgggcaaaagtttagggagggacagatgtgaggtcaatggtgtctgttagagttatgtggcccatcaaccatttacactttagtatgaatgagctgcttaactctttccacagacttttttttttttttttttttttgaggcagagtcttgttctgtcccctaggctggagtgcagtggtgcaatctcagcttactgcaacctccacctcctgggttcaagcaattctcctgttgtagcctcccaagtagcagggactataggcacctaccaccacatccagctaatttttgtattttagtagagatggggtttcaccatgttggccaggctggtcgcaaacccctctgcctcagcctccccaagtgctgggattacaggcataagccacacgctgggccatccacagacctttaacggggagaagagagaacaatayagagcccacatttgggtgctgggcaacagggaggtaccttccttcagacgccaagcacttatgaggcacctactgagatccaggtgctaaaggcattgctataaagaaaacatagtccctccatcaatgacttctcagtcagcttagggaattcagtgataaaactaatggataaacaagatgtattcagacagggacctcttggggaggtgatgtttgagccaaggcctgggcacagctaaagaaagattggcaccaggcagtgggtactgcatgtgcaaaggtcctgtggcaggactgaggtggtgggttttttgtttttgttttttgagacagtctcactttgtcgcccaggttggactgcagtggcatgatctcggctcactgcaacctctgcctcccaggttcaagtgattctcctgtttcaggctccgagtagcggagactacaggcgtgccaccacgcccggctaattttttgtttgtttgtttgtttgtttgagaagggatcttgctctgttgcccaggctggagtccagtggtaccatcttggctcactgcaacctccgcctcctaggttcaggtgattctcctgcctcagcctcccaagtagctgggattacaggcacacaccaacactcccggctaatttttgtattttcagtaaagatggggtttcaccatgttrgctaggctggtctcgagctcccgacctcaagtgattctcccgccttggcctctcaaagtgctgggattacaggcatgaaccaccaagcctggcctaatgtttgtatttttagtagaggtggggtttcattatgttggccaggctggtcttgaactcctgacctcaggtgatccacccgccttggcttcccaaagtgctaggattataggcgtgagccactgcaccccgcctgagattttttttaagcctctgtgtctgccttggggggagaaagttctgctggggccaggaatggaggtggccagagagaaggaggtggctaggacaacatccaggaacaagtcgaggcatccactgagaatcagagactgccatcacccccatttagtgaagaaaacaggggcataggacctcagaatgtgttatcaggagcatcctaggaaggtttcgggccagatctgactctgtctaaatccttggcttccaccccaggtgaggacatgatgaagggagggacccgtgtgttggaggccgctgagcagatttgaccagttttaactgggaggggagggaggaagtatctgggactgagaaaggccrtaaggctgcctcactcaccaccggggggcagcagagccacattgccttgggcctggcgggggaatgggtccctgcctgccatgttccaagcatcctaggaataagctcataaacgtcccaacagagtccagcctctgcaactcccctgcctcctttttttttttgagacagtctcgctttgttgcccaggctggggtgcagtggtgtgatctctgcttactgccacctccgcctcctgggtcaagcgagtctcctgcctcagcctcctgagtagctgggattacaggcatgcaccactacactcagctaacatttgggtggttttttttgtttgtttgagacggagttttcctcttgttgcacaggctgcagtgaagtggcacgatcttggctcactgcaacctccgcctcctggattcaaatgattttcctgcctcagcctcgtgagtagctgggattacaggcatctgccaccactcctggctaattttttgtatttttagtagagatggggtttcaccatgttggccaggctggtctcaaactcctgacttcaggtgatccacccgccatggcctcccacaatgctggaattacaagcgtgagccactgcgcctggcctgatctttatatttttagtagagacagggtttcaccatgttgaccaggctggtcttgaactcctgacctcaggtgatccacccgccttggcctcccacggtactggaattactggcatgagccattgtgcctggccttgcaacttccctgcttccatyctatccatctccccgtcgctcacttggctccagccacatggctgatcctccagaatgcaggctggtccagcctcagggcctttgcacttgctgtccccactgcccagagctctgttccctcctttcttcttccgtcacatcctcatcaaggcctcagcctcagataggaagccttccccaaccaccccctccttccaggccccacaaacatggggtataatatgcattatacctgtccatttccacatccagaccccagggattttctttttctttttttttttttttaagacagtcttgctctgttacccaggctggagtacagtggtgcgatatctcggctcactgcaacctttgcctcctgggttcaagtgattctcctgcctcagcctcgagagtagctgggattacagacatgcgccaccacgccctgctagttttgtatttttagtagagacagggtttcaccatgttggccaggctggtctcgaactcctgagttcaagcgatctgcccatctcagcctcccaaaatgttgggattacaggcataagccacggcacccagccaaccccagagatttaatttccacattgtcttgtgtgattatccagttatttttctcacccagaggtttgacagcctctccgagaccagaccttgtctgtcctggtcatatcgtagactcagggcaggcccagggtgtatacagcaggtgctcagttaatgcatgtggcttagatgaatgggcagtatctgggagggctgtccttgtggtagtgatagcattgggggttgggggtgttgttgaagaaggccatgagttgggcgctcataggcaaagtggctgttccaggcagcaacagcatcgtcagagacactttccttctggagcctcaaatcccaagggcaggaagaatgtggattttctacctagggcactaggagccatagagtgtggtgctgggagcggcacagatatatgggcaggtgggaagcgctggggtagtcccactaaaaagggaccgttgaacgggggtgtctgtatatctacctgagactttggcatttacagtcacagcacatgcagggagagtcaaatgccaatgtcacagagtttgtcagggacagggctaggatatgacccctgggagagggattcacccaggaatgcagttttgttttgctgtgagagcaatagggagccatggagggtttgtgagcagggggaagggcatgatctggggagcagtgggccgacaccagagatcagtggctcagccagcctttcatggaaggccttcaccgtggcagcaggccctctggattgtcagctgcagccctgttttgcagagggggaaactgaggacaaatgagcatgggagaaggttctctccctgctacagatgtcagggcagtgggtgtatgtaatagggggtgtgtaggtgttactgggtgtagctgtggctggggacgagggggcagcgcctttaccgagtgtgtgcaaaggtgtgtccccgtgcatatggggtggctcagcacgtagtgacagcaagtggagactgtggccccatccccacttgggtccccagaytcaagagaatctgcaccccgcatgaggcttgggctgcatacctgggggtcataggtgaccactcccatactcatcaccatctctggtggtctcaaaaccaccatctcccctggtctcaaaacaagtcccaaatccacccacttttctccacagcttcaatattcccctcccagacaccgtcccagacccttactggcctcctgctaccttcattcctgtcccccagcagtctgctccccatagcagacacaagggggtttacaaaygtagtccacatcataccctttctctgctcaagcaccctccatggctccccattgctcctacaatacaattgcactcctccctgcagcccacaaggcttatgtggtcagccccgctggcattttgccctcagtgctgcctcagagagttgtgccctttgcctgggacacgctttctgcatagccagctccttcctcctccatttctggctggctgcagcattacctcctctgagaggcctcctggctaaagtcgccccttgcagtgttctctcctttctcttcccttctcagccttggtatttgaaattatcttttttttttttttttttttttttgagacggagtctcgctctgtcacccaggctggagtgcattggtgtgatctcggcccactgcaacctccacctcccgggtacaagtgattctaccacctcagcctccagagcagctgggaatacaggcatgcaccaccatgcccagctatttcttttgtacttttatttcttttattttttatttttttttatttttttgagacagagtttcgctcttgttgcccaggatggagtgcaatggtgctatctcagctcactgcaacctccgcctcctgggttcaagcgattctcctgcctcagcctcccaagtagttgggattatagggacgtgccaccacgcccagctaattttgtattttttttagtagagactgggtttcaccttgttggccaggctggtctcaaactcctgacctcaggtgatccgcccgcttcggcctcccaaagtgctgggattacaggcgtgagccaccacgcccagccgaaattatcttgctcattgaattgtttcctgttggctgggcaaggtggctcacgcctgtaatcccggcactttgggaggccaaggcgggaggatcacctgaggtcaggagtttgagacgagcctggccaacatggtgaaactccgtctctactaaaaatacaaaaaaattagctgggcgtggtggtgcaacacctgtaatcccagcttctcgggaggctgagacaggagaatcgtttgaacccaggaggcggaggctgcagtaagctgagactgcgccattgcattccagcctgggcaacgagagcgaaactctgtctcaaaaaaaaaaaatttgtctctttagctatgaagcctgggccccagcattgggcctggactgggtcccaaagtgtcctgtggcccaggaaggggcatccctcatgatgacactgcccctgacttgcctgggctgtcatgacaggaggaagcattaattcagtccttacggtgggagacacttctgcttccatagtgaacacatattgtaccctcagccctgttccaggctctgtgtctcagattttattctgttttcagtatgggggatgttacgcatggggaaacagaggcctggaagttagcctgatgctatcgtttatagagataaattatatatagatatggaacatataccaggtgcccttggaagcgcccccttacatctgatttgtgtaattctcatgtcagttcagttttcctccaatttcacagttgaggagactgaggctggagttcaatcaggtggctgcttcctaactgaggcagggctgatggcctttcccgccacacacagacagagcatgtcagacgccccgactcaatttgccaaacacaccctctatgccagtccggtgctgggagctgctgggaccctaaggagcccccarcctggggaagacatagccggacagacaggaaagcgggtttttcagaggagaggacgcagttttgccaggctagattccaagcagtggggccagggtgggcgtggtagcatgagccggccaggacgctggggtgggtcttgggtgccgcactgagaaggggtcagtgctctgggagagaggaaaaagatggagggagcgattagatttacattttagcagaaaggagccaaaatgcctgcccctagctcgaggttaaggtgctgccaacgccccgcccccgccgcccgcgrtcgtagcaacgcccggcctcagccgcccgcggccctagcaacgctccgcctctccgcccgcggccatggcagcgccccgcccactcgccggcacgcgggtccgccggcctcgcttccgcgtcgctcgctccgcctcccgacaggccccgcccccaacggccccgcccccgcactcgcctgggcggagttccagtcgcgctcgggggcgcgcgcttccttctcgccgcccccccatccccgcagccccgtgcgcccccctccctgtccggctccgcggggctcctggggccgatcccaccgccgaggcctcccttcccggcctcaggcggctgcggcggcacaaagggaagcagcatgtccgaccccagctactggacggcggtggcggctcccggccatcggagccgcytggcaaaaggcgcgctgctgcagcgctccaagaggtagggggcacggcgccggcgaaggctcggsggccagccgagcaaacaggagttgccagaagtgtgtcctggccgcgtggcgcggaccacggcgagcgtctgtctgtggcagcagtgggaaggggggaggacgcctgtggatcgaggtgtcccctggggtccctggcaccctcctttcgcccctcgttccctggactggggtgtctgtccgccagcgtcgcagctggggtggtgacagacaggagtgagttgagattgagctaggatttgaacccgggtgtccagggctgggcagaaccagggaggaacttcttggaaaaactgaggctgatctgccgctgggggtccattcagcagaaatgttggctcagaagcaaatatttactgcacgaggctggcatttgggtggggtgtcaggagtccagatagttggggttaacccccgccaaagcctcaccgctcttggagtctcagtttccccttttgaaaagcagagaggataagtgagggctgtggattctaccagacctgggttcaaatttcgactcagccactaccaggctgtgtgacctcaagtagctccttaacctctctgtgcttgggtttctcattggtgctggactggggcaaagtctgggcggtgggaccagctaccgaaagaccttgaatgctgagtccagggcttaaacttacctccaagatcgtggggagcattggagggggaatatgggtgccagagggatgaggtgcaggaggctggcttcaggcccctgctttctgccacattctctctgttgtgtcctgggtaccaagagaggatcgttctcaaatggcaacttctcgaggtcctggatctcctccaggaagagttgaacaaacagtcggccctgcatagatgcttgggaagtgaacagatgatgcttagttctcctttgaggcctcacatttggccgtgttttcaagaagacctcgcccaagaacaggagggagggcaacgaagtgtttttcccaaatgcttttggaagcagcaagtgatacagcaggatcggggagggagggtgctggtggtgcagtgtgggggcgaggaaccaggtgaggggctgggagaggatgtggagacagccaggtgagcgtgcattgaggggttggcaggaagttttgcagaaacctgtgggtttcacttttgcttctgcagctcaggctgggagaaaatcactgtgactgttgacatctgtggcttcagtttcccagtctggaaaatgggctcagctggtcattcccaactctggggcttgttggaattggcagatgttggggatgtaattcactcaggaggcactggctgccctcccggcgtgagccaggccctgtgagcattgtctaggcaaagacaacagtgtatgtacccgagtccgacccaaagctgagcactggatgtggtaggtttcatccttcaaggtagagatgaggaaacaggctcaaggggcagccacatgtggagacgtagacaggctgggcctcttctccctgcccaccttgtcacctgtgtcctttgatgatcatacgcttgttctcccatggattgacctgctccgagcattctgcctgggaccccatttctgcacctcggaggccccgagacttcatctctccctccccgcgagattctcccgccgctgagctgcgttggcggcttggggtgtgtgggctgatgctcttgtggagcagagctgttgctgggcaactgctctggtggggcgggggacggtgtcgctcccaacttccttctgtcaaggtgtgggctgaggccagggcccaggtaggagaagaagccaggcagggtgtgagagacctgggccagggatctggtggccagaagggaactgggatggaaagaggaaaacgtgggcaaaagttcagcagaagaggcaggactgtgaaagaggttgcatttagggtttctagttgggtcacattggcattttaggggcatcttgagaagaaggagggttgtcaagagatgggagcaggggcttcaagaggggtatatagaatggggtgtctcagcccatatctgggctccagggtgtgtttggttcacctgatttgctggtgctgctggcagtagccatggtacagggaaaagtgtgggggtgggactgtgacacagaaccctgaaaagctggtccaggggctcctggccatatgtagtgtcctccatcaggctagaagcacttcatgccattgctgttaataacaacactgccaatagtttgtgttkgtttttgttattgtttttcagatgaagtttcactcgtgtcgcccaggctggaatgcaatggcactatctcagcccactgcaacctccgcctcctgggttcaagtgattctctgccccagcctcctgagtagctgggattataagcatgcactaccacacctggctaatttttggtttttttgttttgttttgttttgttttgttttttgagacggagtttcactcttgttgcccaggctggagtgtaacggcacgatctcaccacaacctccacctcctgggttcaagcgattctcctgcctcagcctaccaagtagctgggattacaggcatgcatcaccacgcccagctaattttgtatttttagtacagaaagggttcctccctgttggtcaggctggtctcaaactcctgatctcaggtgatctacccacctcggcctcccaaagtactgggattacaggygtgagtcaccatgcccgacctaatttttgtgtttttagtagagacgggtttcaccatgtttaccaggatggtctcaaactcctgacctcaggtgatccgcatgcctcggcctcccaaagtgctgggattacagggatgagccactgtgcccagccttgtttttgtttttttaagagagagggccttgtgctgtcacctaggctggagtgctgtggcaccatcatggctcacggcagccttgacctcctgaggctcaagcgatcctcttgcctcagccttctgagtagctgggactacaggcgtgcaccaccacacccagctaatttttaaattttgtatagagacggggtcttgctatgttgcccaggctggtcttgaactcctggcttcagaggatcctcccaccttggcctyccaaagcactggggttactggcgtgagccaccatgcctggccagcagtagtgtcaataataaggaatgttagttgaggggtgattccctcctgggccttgaagacctggctaagggccatgggggaacccagctgggggcagagtgggagtggccatgtccaacatcccatccttctccagaacgggctgcgagtgtgatttaggctgggcaggtggcttagcgcggggccctgggcagccacctaccctgtccccttttcccccsacagctgccgcagcgggaaccgcaagagcttggtggtaggaacgccctccccgaccctctcccggcccctgtcgccattgtcggtcccaacgggtgagtgtgggagcagccagcgggtgctgtgtcctgcctctgccccgctgactcagtttccccgcctcctcctcagcaggcagcagccccttggatagtcctcggaatttctcggctgcctctgccctaaatttcccctttgcccggaggtgagtgattgccggctttgggagacagtgcgggcaccacgggcargggttgggcaggggcacgtgctcggtggctagacctggctcctcattcatttcattcaccttttcccctcccctggcccgtctggtggtggtctccccctctggctcccattcccggcaaatgcatgccatcttgcagccacatcccacgcatggacaggtaatttcaaccagcccagggggtggggggtcatggggggatatagccctaagaatcattaactcactaaagaaatcattcattcattcacttaacaagagctgattgagcacctgtcatgtgccagacgcttgcatttcatttatttattcatacaacaacattcattaagcaccyactgtgtgtatgctctgtgctgcgggctgagggcatggtcgcaaatgggcagctggccctgagcccctggggagtcctccgtttggtggggggtggtcaatgtgtgccccagaagctacagctcagaggttgaagctttgacaggrgacacagtggcagctggastcacggggggggcttcctggaagaggtacctaaagagagagagcatgcagtggacttggtcagcctgtgtctctgttcttggttattttcaggagatccttcctacaacagggccagaatatgctggccacagtgtctgttcttagtccccacaaaccacaggggccaggccttccttccatctgttcttgttcccctctccagggcagacggcagaagatggtccctcgcgtctctcccatcttccggctatggaaccaacacacccagctccaccctctcggtacccatagccccaccttggcaggtggacaggcagatgccgggttgkggggggacacatctttgtgtgtttttttcaaggtgttggatagttgtgcrgtcagcaaacatactagttacttcctccatgcacgccccattctgggaaatgcagggtcccctgagaagacccagccttggccccaaaatagtccctggttggggagatacagatatcctcagcctatggggtcagggcctgaccagagggggacttggggctgcccaggggtacaggcagagaggacttcctggaggagagggcatcagagctagggttttgagggatgcataggagctaggcaggagaaaggatgttaccttctgatggccagcaggcagcctgggccttgaggggtggtgctgggttcctggccacagcactgacggtgaactcatggctytgatccccaccactctctaccagtcaagctcatcctcccgggaacgtctccaccagcttcccttccagccgacgccggacgagctgcacttcctgtccaagcacttccgcagctcagagaatgtgcttgatgaggaaggcggccggtcaccccgcctccgaccccgctctcgcagtctcaggtgggccgcgacctctggccccagccccggcccctccctgggctggtgtggaggcccaagttgtggctcctccttcaccccagccctgaccctgcctgagcctagcctctgattcttgtccctcaaccctggctcagatcccccaacatcctcccctggggttggtctcaggtcccatatcacaagccagctgtcttcctttcagcccgggccgtgcaacggggaccttcgacaatgagattgtcatgatgaatcaygtgtaccgggagaggttccccaaggtgggcagcgcctggcggctggaccagcccctgcacttctttccacattgctgtccctccatggaactctgtcttcctggctatgtcccctttgccagtctkttcatttctgtctttccttccccttccgttgaaagatgtcgttcctcctgcrccagccctcccacccgatcrccccattgccccatctcctctctccccaaccatgcctctcctgccccattctgcgtgtgtcactccagccccgccctctgaccaggtcgccccgtctcgccccacccaggccacagcacagatggagggccgtctgcaggagttcctgacggcctacgcgcccggcgcccggctggcgctggctgatggcgtcttgggcttcatccaccaccagatcgtcgagctggcccgagactgcttggccaagtctggcgagaacctcgtcacctcccgctacttcctagagatgcaggagaagctggagcggcttctgcaggatgtgcgtggtttttcgcatgttgaggttttgcatgcagtgggacgtggagtgaggggggtccccaggccagacggtgctgaggacctgtgggtgatgccacgacccacctcccccaggcccatgagcgttcggacagtgaggaggtcagcttcatcgtccagcttgtccggaaactgctgatcatcatctcacggccagctcggctgctggagtgtctggtaagtttctctttctacggccagcttggggtccaggcagaactgagattgggaccacaacagtcctgccaagatacaggtgacagttcccatcgtgtagggctttgagaggaacacagggtgctattgggctagcgtgggcttccctaaggaggcagcgggagtggagacccagkgggtgagctgggaagggtgctccaggcagagggaacagcatgtgcagaggcctgcaggtggaaccaagcccygggtgaccagccctcctgtgcccctaggagtttgaccctgaggaattttaccacctgctggaggcggctgagggccatgcgcgggagggccaaggcattaagactgaccttccacagtacatcattgggcagctgggcctggccaaggaccccctggagggtaagccgggatgggaagaggaaaccaaggctgggaaaggccggatggaggccaggcacggtggctcacacctttaatascagcactttgggaagctaaggcgggcagatcacttgaggccaggagttcgagaccagtctggccaacatggtggaaacccccccccctactaaaaatacaaaaattagctaagtgtggtggcgcatgcctgtaatcccagctactcaggaggctgaggcacaagaattgcttgaactcaggagatggaggttgcagtgagctgagatcgcgccactgcgctccaacctgggcgacagagcgagaccctgtctcaaaaaaacaaaaaaagaaagggcagatgaagccaggattcaarcccaggcccatccgattccagaaccaccgcactgttctttgtctctctgtggccttgctcttaggtcacctgtgggaattatgctgagaccctctgatcttttggggcccaggggcctcagtgtcctcaaatgccacgttaagatggtcaggaagcctggggaccagtgttagcagtggccttccctttgtcctgcaaattcacaaatgactttaccaatttctgtggcctttactgtggcccagaaagtgaacttggagtcaaacaggacaacccgtaggtaagaagacggtcaaaaactcccacagccggccgggtgcggtggctcacgcctgtaatcccagcacttttgggaggccgaggtgggtggatcacaaggtcaggagttcaagaccagccaggacaacatggtgaaaccccatctctactaaagatacaaaaattagccgggtgtggtggcgtgtgcctgtaatcccagctactcgggaggctgaggcaggagaatcatttgaaccctggaggcggaggttgcagtgagccgagatcacaccacttcattccagcctgggcaacagggcaagactctgtctcaaaaaaaaaaacaaacaactcccacagccagccaggtgcagtggctcacgcctgtaatcccataatcccagcactttgtgagactgaggcgggtggatcacttraggtcaggaattcaagactagcctggccaatatgcagaaactccatctctactaaaaacaaatattagccgggtgtggtggcatgtgcctgtagatcccagctacttgggaggctgaggcaggagaatcgcttgaactcaggaggcagaggttgcagtgagccgagatcacgccactgtgctctagcctgggtgaaagagtgagcctacatttcaaaaaaaaaaagatgtagctgggtgtagtagtgtgcgcctgtagtcccagctactcaggaggctaaggtgggaagatcgcttgagcttggcaggttgagactgcagtgagctatgatcacaccactgtcctccagcctgggtgacaaagccagaccctgtctcaaaaagagaaaaaaaaaaaatttccacaaatagccaggataagaggaactgaaagctggagcattgaacttggacctagcctggtccagcagtagccagggggaggctctgggaggaggcagtgttcaaactgaggcctggagggcaggaggtgaccaggttgcagatccaaaggaaagagtgaaacaggcagcataggcatagaccctaaggttggaccatacctggagtgggactgacctgccactgtccccattgaaagctggggaggcccggcatggtagctcacacttgtaatcccagcactgtgggaggccaaggcaggaggatcacttgaagccaggagtttgagaccagcttgggcaacatactgagatctcgtctctattaaaaaaacaattagccaggcatgatsgcacatgcctatagtcctagctacttgcggggctgaagtgggaagactgcttgagcccaggggtttgaggctgcagtgagctatggtcgcacaactgcactccagcctgggygacatagcaagactccatctctacaaaaagtaatttttttttttcttttttgagacagagtctcgctctctcgcccaggctggagtgcagtggcrcgatcttggctcactgcaagctccgcctcctgggttcacgccattctcctgcctcagcctcccgagtagctgggactacaggcgcccgccaccacgcccggctaattttttgtatttttagtagaggcggggtttcactgtgttagccaggatggtctcgatctcctgacctcatgatccgcccgcctctgcctcccaaagtgctgggattacaggcgtgagccaccgcrcctggcctacaaaaagtatttttaaaaattagccaggcgtggcggtgaatgcctgtagtcccacctacttgagaggctgaggtgggaggattgcttgagtttaggagactgaagctgcagtgagccatgatggcaccactgcactccagcctrggtgacagagcaagagcctgtctctgaaataatcatacttggccgggtgcggtggctcacgcctgtaatcccagcactttgggaggccaaggcgggcagatcacctgaggtcaggagtttgagacgagcctggccaacatggtgaaaccctgtctctactaaaaatacaaaaattaggctgggcgtagtggcttatacctgtaatcccagcactttgggaggccgaggcaggcggattacctgaggtcaggagttcaagaccagcctggccaatgtggtgaaaccccatctctactaaaaatacaaaagttagccaggtgtggtggcaggcgcctgtaatcccagccactcgggaggctgaggcaggagaatctcttcaactcaggtggtggaggttgcagtgagccaagatctcgccactgcactccagcctgggcaacagagtgagactgcgtctcaaaaaataaaaatacaaatacaaaaattagctgggcatggtggcacacgcctgtaatcccgtctacttgggaggctgagacaggagaagcacttgaacccaagaggtggaggttgcagtgagctgagatcacaccactgcactccagcctgggtgacagagcgagcgactccatgtcaaataaataaattaaataatcatactaataaaaaataaagctgaggaaactgaggctccaggcagataaggctgagcagggaatcaaacccaggtgtacctaaggccagatcacatgtggtctgtggctggaccatgtttgccaggcattcgctaggggctgcccctctgccaaggcctggggcaagaacatattggaccctccacctgggctgcaccctgagctgaggaagatgttaggagctgacacccagggggcctgtgtctcatcccgtcttcacaggctcaaggctcagagcctaagtttgatcatgactgagcacttcagagccagggcagcccactggcccttctagaaggttcctaagtcattgcttcatccagcctcccggatgtggcttcatgacagtgtcatgagagctggtcaggggaggcactgcatccccagcctggggtgagaactctagaggcctcaggaaattgctgggtgatgcagggtgaggcagggaggctccagctgagcctcctccctcatcttgcagagatggtgccactgagtcacctcgaagaagaacagcccccagcacctgagtccccagaggtgagtagcagaggctgggggacccccgctcatcttgttctttccagagtggaccaggcacccgcagaaagggctgggtttgccgaggtcttgcatgtagcttaattagcatcggtgactttggaggcaaggtgacggcacgtgggactgccctgccttggaagtcgggtgggggcagtgctggaggggcactggacaggtgagttttgcaggacgtgtaagaatttcccaggaggagggcacagctgtgagcaaaaaagtacagaaagtcagaagctgagttggagaagtttggacaggggaggaggtagcatcgggcaccaggaccagtggtttgggcttgggggcaggagaagccttcccagctctgcagcggggcaggaccctaagcccttcccatcccctagagccgcgccctggtcggccagtcacggaggaagccatgcgaaagcgactttgagaccatcaaactcattagcaacggagcctatgggtgagtccctgagtcctgcatagacccatttcacagatgcctgaggggatggttgaggcccaggcagctcctgcatccccctcctaccccagcagggctcacacattcatccttgaatgggcagagaaggcacctgaggactggagggggaagtggagacacgccatagcgaggttacagcctcatgtgtgctctgtccacgagccaggcctttacctgccccaggtgtagggcgttctaggggcttgggggctgatcaaggaaatagatgcccacccagtgggagtagcacgcagtgagctttatttaggtgctgctttgaatggcaggcttgcatacaagggaagtccctcatagcataagccytttggaggctgaggttccaggagtcaccatcaagagggagaggccggcaagggaactccccgggcagagggggatcagagagggggcttacatgtctaggtgatgttgttcaacagcatgggcactcaatctctgggtcagagactccctgcagggtggtagcagcttagggtcttgaaatccacaaagttcatcttatccatggctcagagatggtgcagtttcacgagtctgcaaagcagacaggctctcagtggctaaaattttgcttacttggtctgtgtgtaaaacaaacggatgtgtaaaactttgagtttggygctagcggtcttttaaaagagctagaccaggtgcggaggcactttgggaggccaaggtaggaggatcgcttgaggccaggagttcgagaccagcctgggcaacatggcaaaactccatcaatactaaaaatagaataattaactgggcgtaatggcacatgcctgtaattccagctacttgggaggctgaagttggaggatcacctgaacccaggaggcagaggttgcagtgagccgagatcaccccactgcactccagcctgggtgacacagtgagaccatctcaaaaaaaaaaaaaaaargaaagaaagaaagaaagaaatacacaagcagccaggtgcagtggctctcgcctataatcccagcactttgggagcccgaagtgggagggtcacttgaggccaggagtttgagactagcctccacaacatagcgagaccccatctctacaaaaaatttaaacattagccaggttctgttgtgggaggatcatttgagccgggggggtggtaaagactatagtgagccgtgatctcatgactgtgctccagcctgggcaacagagtgaggcgctatctcaaaaaacataagataaaataaaaataaaagaaacatacaacctagaggccaatatacaagggccatgtgcagcccatttatatggcccccagccatggtggcttaaacccaaaggtggctgctctgggagggggaacaggtaaggagaatgggtggcccaggtggagggcacagcacaggcaaaggccaggcaggttgggatctgggctcaagttgagctgtagtgcctgctggggcctcgatctccggtcccagcaagcctggccctctgtccccagggccgtctacctggtgcggcaccgtgacacacggcagcgctttgccatcaagaagatcaacaaacagaacttgatcctgcgtaaccagatccagcaggtctttgtggagcgtgacattctcacctttgccgagaacccctttgtggtcagcatgttctgctcctttgagacccggcgccacctatgtatggtcatggaatacgtggaaggtacgctcactggggcttgcatgcctccagcgatggggagctcacccctccacgcctgggagaaaatttttagaccaagttgaggtctgttctgtcctccatgaggtctcaccctgctttggggaaccctcaggaaccccagtctggggtagggagcccagccatgggggtttagggctggaggagcccagacaggagtgtgtgaggatgggaccctggaggcaagaggagggtggccatcctaggtggggggaactgatgggcagaggcctggagaccagaagtgaaggcagggagatgtatggttcaggcaggtaaagtactattaccaaagtactgccaggygagagagcgaacatgcacttaggagacaccagctgtatacagcactaattgctgccctgtcggggagaatcagaaggcagggtctcagcttggcgcgctggctcacgcctgtagtcccagcactttgggaggccgaagtgggctgatcgcttgaggtcaggacttcgagaccagcctaagcaacatggcgaaacccccattcacgcctatagtcccagctactcgggaggctgaagcaggagattcgcttgaactctagaggcggagcttgcagtgagccgagactgcgccactgcactctagcctgggcaacagagcgggcaacagagtgagactctgtctcaaaaaaataaataaaaatttaaaaaataggccaggcgcggtggccaacgcctgtaatctcagcactttgggaggccaaggctggtggatcacgaggtcaagagatcgagaccatcctgaccaacatagtgaagccccatctctactaagaatacaaaaattagctgggtgtggtggtgtgcgcctgtaatcccagctactctggaggctggggcaggagactcgcttgaacccgggaggcggaggttgcagtgagccgagatcgcgccactgcactccagcctggcgacagagcgagactctctctcaaaaagaagaaaaaattaaaaaattaaaaataaatgaaggtagggtccgccccttccctctcccccgaccctccccgctgagatagaacaaactggggaccttttgcaggaggtaaagcgaggaggatgcataggcattgggcataacctaaggggcgggcggggggygggggtgccccgggcctcatgactacatccgcccttctcccaggcggcgactgcgccacgctcctgaagaacatgggcccgctgcccgtggacatggcccgcctgtacttcgccgagacggtgttggcgctggagtacctgcataactatggcatcgtgcaccgtgacctcaaaccagacaagtgagctgagctagcatgagcggggcctcgcggagggcggggccagagaggatcaggggcggggccaaagaggatcagggcagagyctctgaggtgcatcccgggacccttcaggagccccatctgtctgagctctgttggtacctcctgacaggaaggcagggaatgagcgcatggtgaacatcttgtgtgtacagaggagaggagagcagacacttaataggcgtctgctgtatgcaggggaaggccggtgcacttatggaggtgctgccaatccaggggagaggatgtgcacttaggatgcacacactgtatacaggagaaggggctgcgcacccagagctgctgctgcacaaggggagagaacatgcacttataagacaccaactacacacacagaacaggattatgcaatttgcgagaccttacatgtaaagacagtgaccgtgcatgtcttgagcacctgctgtatattagtgcaggaaagcaaggaagagaacgtgtttactgagagccttaggatgtttattttattctggtaggtggtaagcacctactgcatgccagaccctctgtgggcaactgggagacacagggccacctgctttgaaacccctgtattattttctcctctgcatttattgagcgcctgctgtgtgcagggaaaaaggaatgcctgtttgtcaggtgtcctcgagatacgaggcaagaactgacatttctcacatacatgtgtggagatgtgaacatgagtgttaagagccttgcatgtaggccaggcttggtggctcacacctgtaatcccagcactttgggaggccaaggcgggcggatcacctgaggtcaggagttcaagcccagcctggccaacatagtgaaaccttgtctctactaaaaatacaaaaatcagctgggagtggtagcgcgcacttgtagtcccagctactcaggaggctgaggcaggagaatctcttgaacccggcggaggttgcaatgagccaagatcgtgccactgcacccaagcctgggcgacagagcgagactccatcttaaaaaaaaaaaaaagcgcctcgcatgttttcagggcattttgcagttggcaagtggcttagaaaacagacatgtatgtggcacctgctgtatacttgggcctgtgctcgatgctctaaggaactcagaagcatgaataactccttacacactaacgttgggtttctatatcacattttcttggttggcatgtacttgttaggcaccaggtgtatacaaaataggcagaagaacagttattaggcaatgactgtgtacctggcccagaacactttatctttatttatttatttattttttgagacagggacagtctttgtckccygggctggagtacagtggcgcagtcttggctcactgcaacctccgcctaccgggttcaagcaatattcctgcctcagcttcccgagtagctgggattacaggcatgcgccaccactacgcccagctaatttttttttttttttttttttttttgagacggggtctcactctgtcgccaggctggagtgcagtggtgcgatctcggctcactgcaacctcagagtccctggttcaagcgattctcctgcctcagccttccaattagctgggattacaggcatgcgccaccacgcccagataatttttgtatttttagtagagacggggtttcaccatgttggtcaggctggttttgaactcccgacctcaggtgatctgccggcttcggcctcccaaagtgctgggattacagttgtgagccactgcgcccggcaaatgaactcatttttaaaactctcacrcaagtacagtatatactgctgtttaggttttcctatggacttaaatatataaatgttttgctacatcatagtgtcttatgcaccagctgtatgaagtcgcatttccgtgcaccttctgggtgcatctgccacttaaaaatacattccagagaattcactgtgtataaccatcatttaatgaactatgtagtcagtacctcctgtttgctccagctctgtaaagaaacaattctgtgccggcactttgggaggccgaggcagrtgaactacctgagatcaggagttcaagaccagcctgaccaacacggcaaaaccccgtctctactaaaagtacactaaaaaaatatatatatatatacacacacacacatatacgcacacacagtagagaccaggcatgctggctcacacctgtcatgccagcactttcaaaggtgggaggattgcttgaggccagcaattcaagaccagcctgggcaacatagcaagaccttatgtctacaaaaaaaaccttagctgggtgtggtggtgtgcacctgtagttccagctacttgggaggctgagcaggaggatcgctagggcccaggagttggaggcagagctctgcccatctcaggcggagccaaggtctagggcagaaggggaggccaggcaccccagccccccagctctgagcacactcctaacctgcccacagtctgctcatcacctcgcttggccacatcaagctcacggacttcggcctgtccaagatcggcctcatgagcatggccaccaacctctatgagggccacatcgagaaggacgcccgagagttcatygacaagcaggtgggcgggcaggtgggtgggcagccccgggatgcctcctcctctctcctgggacctctcttgggctgggggctggcctcagtttccccgttctccctggcccaggtgtgtgggacgccggagtacatagcccccgaggtgatcttccgccagggctatgggaagccagtggactggtgggccatgggcgtcgtcctctatgagtttctggtgggctgcgtgcctttctttggagatacccccgaggaactcttcggtcaggtggtcagcggtgcgtttcctccatgggccygggtttgagctgcagccccaccagagctctgggcagcggtcctccacccgcatgtcagggagagaagcaggaagaggggagggagttggatgccaggtggggaggcggtggggtgctgagtgaggcgggtggctggattaattatagggtcacagaggcttcactgaagtgacttgtgaggctgggcacagtggcaaacacctgtaattccagcactttgggaggctgaggcgggaggatcatataaggtcaggagtttaagaccagcctggacaacatggtgaaaccccatctctactaaaaatacaaaaattagccgagcatggtggcgggcacctgtaatcccagctacttgggaggctgaggcaagagaatcacttgaacccaggaggcagaggttgcagtgagctgagattgtgccactgcactccagcctgrgtgacagagcgagactccatctcaaaaaataaaaaaaagaagtgacatgtgagcagagacctgcaagaacctgagaatgagagaaagccatagagacagaaaagagaaaggtggctctgagcatagggcacagctgtggsaaaggctgtcagtgggtaccaagcctgccacgttgcaggggcagaggaggccagtggcttggagtacagtgaagtgaggggaaatggtggatggtactagaaaggggtaccctgccttctccctccctccctcattttacctccctccctcattttagatgagatcatgtggccagagggagatgaggcccttccagcagacgcccaggacctcatcaccaggttgctccggcagagcccgctggaccgtctgggcactggtatgtagtgtgggggagaacccaggtgggtggctccttcaggccctgggacccagggaatggagggatagcgcccggggtagacaagagttctacttgggaagctgcatggaggagggggtttgcagctagggttttgaaggatgcacaggagttctccaggaactatcacaagaccttggaaagaatagaaagtagctgggtctggtgcccatatggagcactgagcctgaataagtrtgtgaggctgtaaagtcaccaggacctgtgtcaaaggcccagcccagaagatcccactgtcccagttttcccagccacctggttaatcattaagggaccgtttgagactcatgcagccacccatcacgtggccactatggctcctgttcatgactgaggctttgctatgggagacggttgggtccaaggtcggggatcatcacctgctctgtggagcagaagtgggagaagcccgggaaggaggccctcgtaaggctctgggctttctctaggcggtgtggtcccagatggcagcagagagaagggcagaatctttggaacctgggcagcctgggtgcttttttatttttttgagattagatctcactctgtcactcaggctggagtggagttgcacaatcttggctcactgcaacctccgcctcccaggctcaagcgatcctcccacctcagcctcccgagtagccggaaccacaggcatgtgccatcatgcccggctaatttttatacttttggtagagacgaaattgagacgaaatttcaccatgttgcccaggctggtctcaaactcctgacctcaagtgatctgcccgcctcagcctcccaaagtgctggcattacaggcatgagccaccatgcctggctgctggcctgggtttgaatcctggcttcgtccctctccaggctcctaaatgacagcggatttttgttcccatttttctggttctttgttgttgttgttgttgttgttttttgagacagagtcttgctttgttgcccaggttggagtgcagtggtgctatctcagctcactgctgcaatctccacctcccaggttcgagcgattctcttgcctcagcctcccgagtagctgggaatacaggcaccagccaccacacccggctaatttttgtgtttttagaagagatggggttttgccatgctggccagactggtcttgaactcctgacctcaggtgatcctcccttcttggcctcccaaagtgctgggattacaggtgtgagccactgcgcccggcccatttttctggttctgtgttgtccctactatgtgtccagcatgggcagtgggggtaggggggcatcctgtggcgggtgaggtgaggacctgcagggctcagcggggcatatctgcaggtggcacccacgaagtgaagcagcacccctttttcctggccctggactgggcagggcttctccgacacaaagccgagttcgtgccccagctcgaagcygaggatgataccagctactttgacagtaaggagggatccccctggagggggggcggggggtgctctgccatccctcagtccctgggggcagagggctgtgtgccaggcattccacccgagcttggcacctcaccttaggcctggagcttccgacttcctgagccttccaagaatctagggcgtgtgtcggccgccccctggctggatttcctgtgtgtctgggctcaggaggccacagcatccctcaggcttcagaaggagaaaccraggcaccaagtgtggcagacccttgtctggggttccccagcaagttgggcctcctgggtgtccgtccctgaccaggcatggggccccatctgttacccaggagggtagggcgcctagtgcagcttttttggaggcgtccctgcaggggcactgtaggtgagctctgaggaatgactctctctctccccacttggggttcctgcccttcagtgtccagcacctccttcagaacttgcttcatgtcagaggtcttctctgagcttctgtttcctcttctgtaaaatgaggaacatcctttatgttggagatgcacaattttggccaggcgcagtggctcaagcctttaatcccagaactttgggaggctgaggtgggcagatcacctgaggtcaggagttcgagaccaggctgcctgaccaacatggagaaaccccatctctactaaaaatacaaaaaattaggcaggcatggtggtacatgcctgtaatcccagctatttgggaggctgaggcacgagaattgcttgaacccaggaggtggaggttgcagtgagctgagatggcactattgcactccagcttgcgcaacaagagcaaaactgcctgaaaaaaaaaaaaagatgcgcaattttacctaattctgtgtgacccatttcaaggaatcactgaagctcagaaataggaattcccgcccctggtcccacaacctgttttttttttttgagacggagtctcactctgtcgcccaggctggagtgcagtggcgcgatctcggcttactggaacttctacctcccggtttcaagcaattatctgcctcagcctcccgagtagtcgggattacaggtgcctgccaccatgcttggctaattggtcccacaactttttaattatttattttttgagatggagtcttgctctgtcacccaggctggagtgcagtggtgcgatttcgactcaccacaacctctgcctcccgggttcaagcgattctcctgcctcagcctcccaagtagctgggattacaggygcttaccactactgcccagctaatatttgtatttgtagtagagatggggtttcaccatgttggccaggctggtctcaaactcctgacctcaagtgagccacccaccttggcctctcaaagtgctgggattacaggcgtgagccaccgcacccggccccacaactttttagggacacagctggtgttgatccccagatatctgctctrccgcccaagcctcccgtggtccttaaacacaccaggcactgtcccacctcagagcctttgccctggcagtgaccctatcctgagatgccctccccgtattgccacaccgcccttgagatcatctctgggcatcaggcgtgctgcatgtgcctctccctcccacagcacgttcggaacgttaccgccatctgggctccgaggacgacgagaccaatgatgaagaatcgtccacagagatcccccagttctcctcctgctcccaccggttcagcaaggtgggcccgggtcccgaggggagccactgctcagaaaacattgcatgatgtctgtttgctttcgtatctgttttttgattttgctttgttttgttctgtagagatgaggtcttgctatgctgcccaggctggtctccaactcctgaactcaagtgatcctcccacctcagcctcccaaagtgctaggaattgtattggttttttgttttgttttgtttgagatggagtctcactctgttgcccaggctggagtgcaatggcgcagtctcggctcaccgcaacctctgccttccaggttcaagcgattctcctgcctcagcctgccgagtagctgggattacaggcgcatgccgtcacgcccagctaatttttgtatttttaatagagatggggtttcaccatgttggccaggctggtctcaaactcctgacctcaggctatcctcctgcctcagcctcccaaagtgctgggattacaggcatgagccaccacacctggtcaaatttttttgtattttcagtagagatggtgtttcaccatgttggccaggctggtctcaaactcttgacctcatgatctgcccgcctcggcctcctaaagcgctgggattacagrcatgagccatcgcacccggccttgtatttttttattttgttttgttgttttaatttgcttttgttttagccattttgttttttcttttttttttttttgagacagagtctcgctctttcgcccaggctggagtgcagtggcgcgatctctgctcactgcaagctccgcctcccgggttcacgccattctcctgcctcagcctcccaagtagctgggattacaggtgcccgccaccacgcccggctaattttttgtattttcagtagagacggggtttcaccgtgttagccaggatggtctcgatctcctgacctcgtgatccacctgcctcggcctcccaaagtgctgggattacaggcgtgagccaccgcgcccggcctgttttagccattttaaggcaatttccgaggcaggcggatcacttgaggtcaggagttcaagaccagcctgactaacatggtgaagccctgtctctactaaaaatacaaaaattagccaggcggtggtgggtgcctgtaaccccagctactcgggaggctgaggcaagagtattgcctgaaccccagaggtggaggctgcagtaagctgagatcacagcgctgcactccagcctgggcgacagagcgagactctgtctcaaaaaataatgataataataaagtgtacaatttcgtggcattcagcacattcataatgttgtgcaaccatcacctctatctagctctcaaatgtttgattcccccaaaaatttgtacccattagcaaccactccccatttgtcctccttcagcttccatctttatggatttgcctgttctgggcatttcatatcaatgcaattcacactatgtggccttttgggtctggcttctcttactcagcatcacgtactcaaggctcatccctactgcagtgtggaccagtgcttgcttcctttttatggctgagtaatattccatcatatggatggaacacattgtttatccacccatctttgatgcacatttgggtctattccaccttgtgaatacaggtaccattttagtttatttacttatttatttatttattgagatggagtcttgctctgttgcccaggctggagtgcaatagtgcaatctcagctcactgcaacctccaccttctgggttcaagcgattctcctgcctcagcctcccgagtagctgggattacaggtgcgcgccaccacacccggctaatttttgtatttttagtagcgaccaggtttcaccatgttgcccaggctggtctcaaactcctgtcctcaagcgatccgcctgcctcagcctcccaaagtcctgggattaaaggcatgaaccaccgcacctggccctggatgttattttataacctcacgagcttaacttacattccctactttttttatgatctgatcaaaaaatgctccactctgctttaggcctgggccccaggcaggactttctagtcaacagcaaaaacgcagcttggtagcctggcccctgagcctcagtttttccatctgtacaatgggctaaagtctatgctcttttagggatgtggggagtgaggatttagagaagtgactcatactgaagcaactggtacataggaatcactggactaagccagctttcttttttttttttttttttttttgaaacagagtctcgctctgtctcctaggctggagtgcagtggcacaatctcggctcactgcaacctccgccttctgggttcaagccattctcctgcctcagccttccaagtagctgggactacaggcatgtgccaccacacccagctaatttttgtatttttagtagagacgggttttcaccatgttgaccaggctggtcttgaacgcctgacctcaagtgatccgcccacctcagcctcccagagtggtgggattacaggcataagtcaccaggcctggtctaagccagctttcttgccacctttgttactggtttttttgtttgggtttctttttttttctttttttgagacagggttttgctatgttgcccaggctggtctcaaactcctgggctcaagtgatcctcccagctgggcctctgaaagtgctgggattacaggcatgagccaccgcacccggcttaccattcttttgtcttgcctcccaggtctacagcagctctgagttcctggccgtccagcccactcctaccttcgctgaaaggagcttcagtgaagaccgggaggaggggtgggagcgcagcgaagtggactatggccgccggctgagtgctgacatccggtargtggcctggggaagtgtaggcagatccagcttccaagcctgctgggaggtagagacacaaaatctgatgcaaagggagcttcctagtggccaagtagaaaagggtcaaacatattgaccagcctatcaggtccctggcaaccttgctccctttggctctgtgttcctcaccatgcaaacataaaacagctgtgtaccatcatgctgctaggcacacttttccttctgtccagaatgccctttgcttactaactcctgttcatccttcaaagctcagacccaacagaaacagtcaatgtctgctagaggatgggtgttggaagctggccttttttttttttttttttttttgagacagagtctcgctctgtcgcacaggctggagtgcagtggcgcaatctcggctcactgcaagctccgcctcccgggttcacgccattctcctgcctcagcctcccgagtagctgggactacaggcacctgccaccacacccggctaatttttatatttttagtagagacggggttttgccatgttagccaggatggtctcggtctcctgacctcgtgatccgccctcctcaacctcccaaagtgctaggattacaggcgtgagccaatgtgcccggccttttttttttttctttttttaagagactggttctcactctgtctcccagactggagtgcagtggcacgatcatagctcacttcagcctcagactcctgggctcaagagatcctctcaagtagctgggactacaggcgtgcaccacggcacccggctaattttttaagcaattttttgtaggccaggtgcagtgacttacacctgtaatcccaacactttgggaagccgaggcaggtggattacctgaggtcaggagttcaagaccagcctggtcaacatggcaaaaccccatctctactaaaactccaaaaatttagccgggcatagtggtgcacgcctgtaatcccagctacttgggaggcttaggcacgagaattgcttgaccctgggaggtggaggttacagtgagccaagatcgtgccactgcactccggccggggtgacagagcgagactctgtctcaaaaaaaaaaacaaaacaaaaaacaaaaaattgcagagatggggtctccttatgttgcccaccctggtctcgaactcctggcctcaaacaatcctcctgtctcagcctcccaaagtgctggaattataggtgtcagccactgcacccagcctggaagctgggttttaaaagttgaataggaagccgggtgcagtggctcacgcctgtaatcccagcactttgggaccccaaggcaggcaggtcacttgagctcaggaattcaagaccagtctggccaacatggtgtaaccccgtctctactaaaaatacaaaaattagcccagtgtggcggcaggcacccataatcccagctacttgggaggctgaggcaggagactcacttgagccctggaggcagtggttgtagtgagctgagattgcaccactgcacttcagcctgggtgacagagtgagaccctgtctttaaaaaaaaaggtgaataagcggtctccaggtggacagagaggacagtgcagacagaaggaactcgtcctgtctatgcaaattacccttgactgcagactgagagttaagatgtggccatgaaggtggctgagtatcctggggtgcaggtgcctggcaggggtgatgcaggctcttcctccctgcaggctgaggtcctggacatcctctggatcctcctgtcagtcatcttcgtcccagcccgagcggggtcccagcccatctctcctgaatacyatcagcctggacacaatgcccaagtttgccttctcatcagaggatgagggggtaggcccaggccctgcaggccccaagaggcccgtcttcattctaggggagcctgaccccccaccagcggccaccccagtgatgcccaagccctcgagcctttctggtaagtggggccctgagtaagagggatgatgtcatggaagtttcccagaggaggggctrtttgagatgggttttcaaggatgagtaggagttctccagagccaacaaaggctttaagagaggagaagccagggtcccagagagacccccagcccccaaggaaccccagtctagggtaaatgcccccagcttcatagagtcaggatgggacccctagctcccaagatgggggaactaagggtctaaatgggtgtggaggaaggcttcctggaggaggggacttgaagacttttgcatagagaataatttgggaagggagtgcaggaagagggaactgcatgagcaaaggccaggaggctggactgtgtaaatagtgaccagggaggaagggccttaaggtccctttaggaccacatggtgagtttgaggggcacccagctgaccctgctgaccctctagccgacacagctgctctcagccacgcccgcctacggagcaatagcatcggcgcccgacactccacaccaaggcctctggatgccagccggggccgccgccttgggggcccaagagacccagcccctgagaagtccagagcctcctccagcggtggcagtggtggcggcagtgggggccgcgtgcccaagtcagcctctgtctctgccctgtccctcatcatcacggcaggtaatgcccaaggcccctctcacctttgtctgtctgcacccattttcaccaacagggtgggggcccttcctgagttggggaggctggggatgagccccagaagaggggaggaggagtaggacacatggagagctggggagatggtgttcccagtagagggcactgcacgtgcaaaggcctggtggggtgaccatgcttgggacattgaagcaacagcaaagtggccagggtggtcgttgtggtgggaaagagggggccccaggggagacctgtgagggagtgagtgaccccctccctaaccccctgcagatgatggcagcggcggccccctcatgagccccctttccccgcgctctctgtcctcgaacccgtcgtcccgtgaytcttcgccgagccgagacccgtcccccgtgtgtggcagcctgcggccccccatcgttatccacagctctggcaagaagtacggcttcagcctgcgggcgatccgcgtctacatgggtgatagcgacgtctacactgtgcaccacgtcgtctgggtgagtgccgagtgggaatggcagggacccgggttctagtttgactctgcccggtcatgtcccttctcagagctgcattttggagcctggcagggttaggtagatagagctggtgccaccgagttcatctcggtccctgtcatttggcagggaggaggtcagatgagagagacaaggatggatggatggaagctcacagatcccaagtggcattaacctcccagctccatatggggacgcactgggcatgttatcctccctctcccagcccaagggcgtcgaggcatgccctccctattggttgctccctgaacagacacagaaggctttctggagaagggggcgtaggagctggggctttgatgggtgagtaggagttccccaggatcagggaaactgagacagcacaagaggcagcagcttgctggggtcccacagcagacccagcctgggctggggtccccagatgtggggcccaggccattgaccccaccgttctcgtctgcccccagagtgtggaggacggaagccccgcccaggaggcgggcctgcgggctggggacctcatcacccacatcaacggggagtcagtgctggggctggtgcacatggacgtcgtggagctgctgctgaaggtgcggcacccccactgcccaccctcagggctccccagcaccccttggccgcagctcccggttccccgtggttctccgcgtccagacacacaaccccacattcaatgtcaactccaggcctggcacatccacttccttcggcccagaatacatgtccttcttcagcccccaacatcaccccttagagctgctcctccaggaagccctcccttctccctgggcaccctcacatctgttcctccctctggcctgaggcctggaggtaggagatgggctcaagacaggaggaagggccgggcgcggtggcacacgcctgtaatcccagcactttgggaggccgaggcaggatgatcacctgagctcaggactttgagaccagcctgggcaacagagcgagacccccatctctgcaaaaaattaaaaaataaaattagctaggcatggtggcatgcgcctatagtcctaggtacttaggagtctgaggtgagaggatcgcttgggccgaggaggttgaggccatagtgagctgtgatcgtgccatactgcactccagcctgggacacagagtgagaccctccctggttctaaaaaaatagagggctctcatgtgggcagctgcatgggtggttcattgaatagctggacactgggtaggtgtctttggcctaatgactcatgggccattaggtgagtgattgggggatggggagatgttggggtgattaatgggtggataccagataggtgggtgacagaccccgggagggtggagagtgaagagggcaggcctcgatcggcgttgaccgcagagggaaggatcttagcaggaggggtggtgctccctgggctattgtttgaccggatatattgggtaggtcactggttgtgtggatgaatggatgctggggtggtgggtcccagctggtgcccggagtgaaggggacatagcagctgcctggcaagtgctgggccctgtgagaggcacagaggcaacccctcaccatccctcccgcagagcggcaacaagatatccctgcggaccacagccctggagaacacctccatcaaggtgggycccgcccggaagaatgtggccaagggccgcatggcacgcaggagcaagaggagccgtcggcgggagacccaggatcggtgcgcggcagtgaccaccagggagcggtacacagggggcggggccayggggactggggttctttttttcttttctttttcctttttttttttttttttttgaracagagtcttgctctgttgcccaggctggagtgcagtggctcaatctcggctccctgcaacctccacctcccgggttcaagcgactgtcctgcctcagccccctaagtaactgggactacggcgtgcaccatcatgcccagctaatttttatattttcagtagagacagggtttcgccatgttggccaggctggtctcgaactcctgaccttaaatgatccatctgcctcggcctctgaaagtgctgggattacaggtgtgagccaccatgcctggccaggagcaggggttctgaagcctccggttttcttaccccaggcggaagtcacttttcaagaagatctccaagcagacctccgtgctgcacaccagccgcagcttctcctccggactccaccactcactgtcatccagtgagagcctccccggctcgcccacccacagcctctcccccagccccaccactccctgccgaagcccagcccctgatgtcccagcaggtgggtgcaccccgaccccccaccrccccggctaccctgggagcaagggctggtgggccccaggagggaggaaggagytcaggggatggaatgacacgatgtagggaaaaagatgaccgggatcctggtgtctagcagggaacctgggagtacttagagacgaatgcaggtgccagggaaggatgcacccagcagaggaaacatcatggacaaatggggctagacaggagggtgggaaaactgagaagaggccaggcgcggaggctcacgcctgtaatcccaacactttgggagcccgaggcaggaggatcactgagcccaggagtttgagaccagcctgggcaacacagggagaccccatctgtacaaaacataaaaaaattaggtgggtgtgaggccgggcatggaggctcacacctgtaatcccagcactttgggaggccgaggcaggtggatcacctgaggtcgggagttcaagaccagcctggccaacatggagaaaccccgtctgtactaaaaatacaaaatcagccaggtgtggtggcacatgcctgtagtcccagctactagggaggctgaggcaggagaatcgcttgaacccaggaggtggaggttgcggtgagccgagattgagccattgcactccagcctgggcaacaagagcaaaactccatctcaaaaaaaaaaattaggtggttgtggtggtgcacacatgtggtcccagctactctggaggctgagatgggaggctcacttgagcccaggaggtcaaggctgcagtgagccatgattgcaccactgcactccagcctaggcaacagagtgagaccccatctcaaaaaacaaaagggaaaaaaaaaaagaaaacagaagtgatacagagaaggctttctggaggagggggagtaggagctggggctttgatgggtgagtgggagttcaccagagctaggccaaggaaacaaccctgagcaggaggcagaaaagtctggcatgaaccaggcatgatggctcatgcctgtaatcccagcactttgggaggccaaagcaggcggatcacttgaggtcaggagtttgagaccagcctggccaacatggtgaaaccccaactctactaaaaatacaaaaattagccagrtgtggtggcacatgcctgtagtcccagttacttagggggccgaggcacgagaatcatttcaacctgggaggtgaaggttgcagtgagccaagatcatgccactgcactccagcctgggtgacagagcgagactctattgaaaaaaaaaaaaattagccagccatggtgacgtgcacctgttgtcccagctactcaggaggctgagttgtgaggatcacttcagcccaggaggttgaggctatgattgagccagtgcactacagtctgggcaacagagcaagaccctgtctcaaaaacaaaaacaaccaggcatgatgggtggccacatggaaggatgtgggctttagcagtttttgtcagtcccacagctccacttctgggctggggacattgaggccagcagccctgacctacgcttatcacccacagataccactgcatccccacccagcgcatccccgagctccagcagccccgcctccccagctgctgctggccacacccgccccagctccctgcacggcctggctgccaagcttgggccaccccgccccaagactggccgccgcaagtccaccagcagcatcccgccctccccgctggcctgcccgcccatctccgcgcccccaccccgctcgccctcgcccctgcccgggcacccgcccgcacctgcccgatccccgcggctgcgccggggccagtcagctgacaagctgggcacaggggagcggctggatggggaggcggggcggcgcactcgtgggccagaggccgagctcgtggtcatgcggcggctgcacctgtccgagcgccgagactccttcaagaagcaggaggccgtgcaggaggttagcttcgatgagccgcaggaggaggccactgggctgcccacctcagtgccacagatcgccgtggagggcgaggaagccgtgccagtagctctcgggcccaccggaagagactgatcccctgccaggtctctccctggcatcaaagttacgcgttttcttgtgcaatgttttttccgtaaagtcatgcctggatggggactgagccaccagcctgacacccagaaggcgagaagccatctcggtccttgctggaaggtggagacatcgcttgtgttctggtgtcaatcagggggctggatggggcaagaatgggggacaagggtggctttgtaaatagcagcaaatccctgcaactaatttattactttttcttttttttttttttttttgagacagagtctcactctgttgcccgggctggagtgcagcggcgtgatctcagctcactgcaacctccgcctcccaagttcaagcgattgtcctgcctcagcttcccaagtggctgggattacaggcgcccaccactatgcccagctaattttttgtatttttagtacagacggggtttcaccatgttggtcaggctggtctcgaactcctgacctcatgatttgcctgcctttgcctcccaaagtgctgggattacaggcgtgagccactgggcccagcctaatttattactttttataagcgatagccgtactgagccgccccctgaaggcggctgccaggtcttgccccaggcacctgggactctgtttgcaggccctgccctctgggctgagaaggatgcactttggacaagtcatctgtgtttgtgttttccagtttttctgtactttttaagtgttttgtgttacctggtctcattcccctccccacacctacccatttgaggggatggagttgaagtcacctggtcacctgtaccggcccagttcggctacaacctggagtgtccgtaaacaattcctctcacccacaaaacaatgtaatcccagcgatggactggattctgaaggccacttcccaccatcatagctgccatgcccaggcagtgcctgctctatatatagagtctgcctccaatcctgctggcttcagcctggagaagggatatgggagctggagctttgatggatgaataggtgttcaccggatctgggcagaggggtcatccgctccccaggtgggcactgataaaggaaggtacaggcctcacctggaactgccaaggcagcctccagaaatgctcggctgtctcggggcacgctccagtatgccagtcctgcgggattacgtccagctacttccagaaacactcagtgtcccctcccctcaggctctgccttggcctggccttgtccagtctaccctggacaagatgccgtgtgtttgaggcccagcagagtaagcccttggccgtgatgtgtctgaaacacctgttaggggttccctccatatgtcagagcctctctgggatgaagttcaagccagaaaacccagtcgaggctcaagtttgaatttcagcttcactgtgtggctctgggaaaatggctttcccactctgtgcctcagtttccttgtgtttacaagactaatcccattgactgtttattaagcacctactgtgtgccaagcgcttttacgtggcttctccctcagccagccttgagaaggctggaggtggtgtcatcacctccattttacagacaaagcagctgagaccccagcgaggggcggagacctgtcccacgatcacccagcaggagtcgtggcagaacggagcatcagccagaccctgttgtgggcgttgtcatcaagggagcttgaatggagggtctggtgtcagatacagccgactccagccccagctcatcccccatgatgctgtgtgacccactgggcactctggtgagggagctttccagacatcaacagcccactctgcttccctttctgagtcccctgtccagcactgcctagtgttggagggtagaccaaggctgtgcatgattcaccccctccttccatcctggagctggcagtgaataaaagcccgtatttacaaagatgagctccaacgtctggatttgtgaggggctgagaaaggaggaagggaagagtggggaggggagcggagtgaaatagacccatggctcaaagtcattgcaagtgggttttgaggactgcatagcagttcgctgttgagattcttcctgatgccatcgctggtaccagcctcctgctaccctctccctgcgagtactccatcatagccctgcctttaaaagcttcctccagacatctgggccctgagctatgttttttatttttatgtttttgagacaaggtctcgctctgtaacccaggttggagtacagtggcgcaatcacggcacattgcagcctcgacctcctgggcgccctgggctatgttaataaaataaataagcggcggggcgcggtggctcacgcctgtaatcccagcactttggaaggccaaggcgggcggatctcctgaggtcgggagttccaaaccaccctgaccaacatggagaaaccccgtctctactaaaaatacaaaattagccgggcgtggtggcgcatgcctgtaatcccagctgctcgggaggctgaggcaggagaatcgcttgaactcgggaggtggaggttgcggcgagccgagatagcgccattgcactccagcctgggcaacaagagcgaaactccgtctcaaaaaataataataaaataagcaatcgtcgcgtcctttctatcctggtcttagcttgcgctctgccataaaactccctctagccgaacccggcccagccctagagcaatccgttacttccggggcgctcagccggcatgcaaacactcttggctacagccccatctccgagtgcgttcggctatttccggaaaccgtcggcatctaggctcaagtccgctaaattctagtgcccgtaggggtcgagatcgttggctgtttccggacgctctgggttgccatggaaactccttcaaccctggctttctccgacttctgctttttgcggcaggccctttccccactctactgccccctgtttgctgagcttgagaacgcctcatttgtcccctggaaccatctatgcttcagtaattcccataagctggcggtcgcctctgggtctaaactcccaaggcctccattgggcactgagcacattcggttatttccagaaacgctccgcggtcttggggatcagcctcagttgtgccagtgcggcggtagagagtgttcggccatttccgaaagcgctcgggcgtctctaagcccagccgagcccagtctcggatccctcgccgacccgattgcactcggctacctctggaaacgctcggctgtctcgggggcaccctctagtccaccagtcccgcgggattacgttcggctacttccggaaacactcgggtgcccccttacctcaggctccgcctcggcctcggttcatccgcccggctcgaatgcgctcgggcatttccgccgggggcgggccaggccgctcggaaccgtggcggcggcggaggcggggatcccgcggctgcggcgacggtggccgcggtggagccacggggcgggcttggcttggtgtgacggcggctgcggcggcggtggcggccgcgaccaggtgagtcctgactggccctcgtggcgggggcggctgggagtgtgcttaaatgcggggcgcccgggggcagtgccgggccccggtggaagccagaacgcaagcgccaggctgcgtcgggccccgcgggaactgggggggccgcaggcaagggggggcctcgggctcggctccgcagcggtgcagcctccttgggacggtcggggcagaatggggagagactccccgcgtccaagataccggactggagccgaggccccaaatgaagggaggccctgcctggaatggggcttcgaatagtaccgaggggcgcccaggcattgtgcggggcagaatggggtgcgggagggccgggggtcgaacccacttccggtcccctagccgggtggccgggtccacgcagacccaagtgcgcgtctgtgtgagcgctcaggccctgccttcacccgcggagcccccagccctgcctgccccgcccctcccgcctcccggattcggggagcgctgctcccggggcgcgcacaccggggcgtgggggcgggctggcaggcagatccaggcggttttctgggcatcccctctcggggcctcagtttccccacctgtagaatgagggtaacagaggcctaggaatgggtaaattgggcacccgagaatgtggcgcccctccgccctgctcggacacctcttggggttccccgtgactgaaggatgctcagagcctccacctgacactcgggcctcttggtggatagcacctatccttatagccaccctgaatccttgacaagcaacttaacccactgccaaggctttgcatgtgccgttccgtctgcctatcgcgccttcctatccgctgtgatgatccattctctagaacagcacgtccatcccccgaccctagccctgtccatcacagggcgtctgaacccgcagggctaggctgggaatgtgtgcctatctccgcctccccaggctgggactcctggggaataatcaatgccctgctgccggcagcctcccctcctcctcagctgcagtacccccaccttctcctggctccctgtccctgcctggggctaaggttccttctaagcacctccccatctgcattttgtgcctactctgggccccaggctggagctacctgccagcccactcactcctcctctgcagagactggaggtccatttgcttggactcacctcgaggcctttgcttgtgtagaggcctcttcctggactttgttccctacctcttagttcagctggcctgacccctctatggagctcccaaagcacccggagtggcctccattgcgtcctccctgccctaggtatctggccacctggctgctgccccctcatgtccaactgggccaagtcggcagatctaggtgtaagtcctggcttcctcctggcctactgcacggccctagatacctccctgctctgagcctcagtttccccatctgtaacaggggtgatgaaaagcctgtttactggccgggcgcggtggctcacacctgtaatcccaacactttggaaggcagaggcgggaggactgcttcagcccaggagtttgggaccaacctgggcaacatagcaagaccccacctctattggaaaaaaaaaaaaaaaggctgggcaaggtggctcatgcctgtaatcccagcactttgggaggccaaggcgagcagatcacttgaggtcaggagttcaagaccagcctggccaacatggtgaaacctcgtctctactaaaaatacaaaaattagctgggtgtggtggcctgctactcgggaggctgaggcaggagaattgcttgaacctgggagacaggttgcagtgagctgagatcacaccactgcactccagcctgggtgacagagcaagactctatctcaaaaaaaaaaaaaaaaaaaaactgatttactgagcatgtagtatacctggggcaggttcttgggaactctactcccagcagctccaagggaaggctgtcagtatacccattttacagatagagaagctgaggccctgagagggaccggccccaaggtcacccagtgattcagggaattccaaatcaggatttgggcccatctccgtgttgggggtgagaggagttggcctggctaacgctgccctatccctgtctccctaggtcggcgtcctcagctggccgagcatggtggcagcctgcacccttggctcccttgtctggtgcagccagcagagccgccagccttgggcgcccatggccctccgtgtgagggcgtgagcggcctgccccagcctcacctgctgatggaggactcaatggcccagtgacctgacaccacaccaccaactccctcccaccagctgacgaatggtggacccagtgacgagtggcccttgtaagggtcatggaataatttgaagcgaggcatgagcggcccctgtggtcgcctgtgactgctggagatagaggtcccagcaccccaagccaacccagcggaccctcccagccctgcttcaaccaatggggccagtggggctccaagcagccacctaaccatccagaccccaccccactcacgcggccatggcgggccctgagggcttccagtaccgcgctctgtacccgttccgccgggagcggccggaggacctggagctgctgcccggcgacgtgctggtagtgagccgggcggccttgcaggcgctgggcgtggccgagggtggcgagcgctgcccacagagcgtgggctggatgcccggcctcaacgagcgcacacggcagcgaggtgacttccctggcacctatgtggagttcctggggcccgtggccctggcccggcccggccctcgcccacggggcccccgcccactgcccgccaggccccgtgatggggcccctgagccaggtgagcagcaagcaggggccctggaaaggggggtggtcccctcagacccttggtctcctcttctgtccagtgaggcaatgggatctccaaggaaggaggaaaaaggacatttggtcatttgacaagtgtcttcagtgctaggctcagcagtggacacaaggcctgttcctgccctcatgagcttctggttcaagaagggatgagagtgggttcaggaggtgacacatgccatgaggaagggggcttgcgtgggaagatgcgagggtggaagctcaaggcagtgggggcagcgagggcagaggctgtggagtagaactctaatggcgggaacggccagcaggaggaccagagggaggaaggggagggcaatgtgcgctggcatggaggacttagtgggattgattttgaggacaatggagagtgttcagtaggattcagaggctcagcctagcttcatcctgccttttgcagacagggtcccttgaagaacccctttggagaccctgatttccaaaatgaagccacaaggagggtgggatgtgggctgctcagctgaggccacacagcacagtgggatatgaggaccccacatccctcttcaaagacccttggccatcaccacttgccaggggtgtgccaggtgtagagaatcgggggcaccgagcccactcagtgactgctgtttgatgggcagggagtgtgggctctggccggggaaactgtggcccaggttgcaaggaggaggctaagaggtgctgcatgctcggcatggtctgctccgaccctcccagcagcccagcaaaaggccctgtgtgcagaccgggaggcctgagtgcaaggccgtcaaatgccgtacttgaaaccagttggtcacccagggaggccaaagccccgggaggtgccaggcctgctttgtgccagggtgacattgcccaaaggcaaaccagagtcccccagcgcagggcggaatagggggtgctgaggtggtgcgacgctggccccagcctccaggcatctggtatctccagggcccaggcctgcgtcctgcctcggcctgaaggagcaggaggtggccccgtctgggctcccagccagaatctgcctctccccctggtaacagccacctccctcctctgcctggcctctgtccagccaccatacacggccccacgtggggcggctgcccagccccaccctctgaatcttccagggttatgtgacctcggccagaacccgccccctcgaggcctcagtttcctcatctggaaacaacagggttggtccctggggatgctgggacccaacccctcggaaatgtgctgaagtcacctgagccccacctggctgtgcacccacgggggaggttgcagcccctctgacccacaattcctcacctgcaaagtcggggtgatgcagttctgatgggaaccccctccccattctgcagattgatcccaggccactctcagggttgagtttccca

SEQ ID NO: 17985 - DNA, 14399 bp, Homo sapiens
gttttctatctatcctgccccttctatccttcatatcacaatggagcacaaattataattaagagatacaaaagcattcagtcacttccatttttttctttagatacttactatattaagtcttaaatgaacatattggcattccaaattattaagataatgtcatgctggtcattgaaatgctaaattaacatgaagactacatttcaaaaatacaaaagtataaataggagtgttttgtatattcataccacgatttttgcccttagaggaactctgaagtacattgttatatgtctgactaatgtattcaaccctggaatttttggggaagcatttgtttttttctgaaatatactgtcccactaaagtatcaaattgggcatacatgatgacatgaaaagcatttcccaaaccatagttaatttaagtaaaatgaacttaatattatacagccttaactagaaatgagatgtcttgccacactaccagttctgtcaatagaagttgagtgaatagatttatatctattaactagaaaaaagtataggcataaattaacatgtcatctgatgtgagcagattgagaaagccaacaaatttctagttattcaatttaaaggacactgaagtaccacaatgtatacattcaatttgactacataataatagctgctatttacttagcacttcttcatctacatattctgtaatcttcattactatcctgtattagtccattctgacactgctataaagatactatctgagactgggtaatttatacggaaaggaggtttaattgactcacagttctgcatggctggggaggcctcaggaaacttatgatcatggtggaaggggcaggggaagcaagacacgtctcacctggcagcaggagagagaaagagcacaagggaaactgccacatttaaaccatcaactctcctgagaactccctatcacaagaacagcatggaaaaaacccccccatgatccaactgcctcccaccaggtccctcccccaaaacatgcgggttacaattcaagattagatttgggtggggacacagagccaaaccatattattttgcacttgctccctctcaaatcccatgtctttttacattttaaaaccaattatgccttcacaacagtcccccaaagtcttattacagcattaactcaaaagtccaagaccaaagtctcatctgagacatggcaagtcccttccacgtatgagcctataaaatcaaaagcaagttagttacttccaagatacaatgagggaacaggcattgggtaaatgttcctgttccaaatgggagaaactggtcaaaccaagggccacaggccccatgaaatctgaaacccagctgggcagcccttaaatctaaaagctccaaaatctcctttgactccatgtctcacattcagggcacactgaagtaaggggtgggctttcatacccttgggcagctccgcccctgtggctcagcagggtacccctgtggctttcacaggctggcattctgtggcttttccagacgtatactgcaaactgtcggtgaatctacctttctggggcctggaggacagaggccctcttctcacagctccactaggtagtgccccagtggggactctgtatgagggatccaaccccatatttcccttccgcattgccctagcagaggttctccatgaaggctctgcctccatggcagacttctgcctggacatccaggcgtttctatacatcctcttaaatataggcacaggttcccaaacctcaactcttgtcttctgcgcacctgcaggcccaacaccacgtgaaagctgccaaagcttggggcttgcaccctctgaagcaatggtgcgagctgtaacttggccccttacagccacagctggagctggagcatcagggatgcagggcaccatgtcgtgaggctgtacagagcagcaaggccctgagcaggaaaccatttttccctcctagttctcaggcctgtgatgggaggggctgccccgaagatctctgccatgccctggagacattttctccattgtcttggttattaacatttggctccttgttacttattacttattactttttacttattattacttattactccttgttacttattcagatttctgcagctggcttgaattcctccccagaaaatggggttttcttttctactacatggtcaggctgcaaattttccaaacctttatgttctgcttcacttctaaacctaagttccaatttcagaccatatcttcgtgaatgcacatgactgaacgctttcagaatcagccaagtcaccactaggatgctttgctgcttagaaattttcttctgccaaataccctaaatcatctcaaagttcatcagttctctagggcaggggtaaaatgctgccagtctttttgctaaagcatagcaaaaataacctttgctccagttcccaataagttcctcatctctgggaccatttcagcctggacttcattgtccacgtcactatcagcattttggtcaaaagtattcaaaacaagtctctaggacgttccaaactttcctatatcttccagttttcttctgagccctccaaactgttctaaccactgcctgttacccagttccaaagtcacttccgcattttcagattatctttatagcagtacccaaccctgccagtaccaattctctgtattagtcagtttttacactactataaagaatatctgagactgggtaatttataagggaggtttaatttactcatagttctgcatagctggggaggcctcaagaaacatacaatcatggcagaaggcaaagaggaagcaaggaaagtcttacatggtggcaggagagagagaaagcacaggggaaactgccatatttaaaccatcagatgttttgcgatctcccacactatcacgagaacagcatggaggaaatcacttccatgatccaaacacctcacaccaggtccctccctcaatatatggggattacaattcaagataagatttgggtggggacacagagccaaaccatatcacatcctgaaagtaggtatctctaatcccatttgacagatgcagaaactaggactcagaaatgttagagaattggtcccagaacactatattatacatttattaagaggcaaaatctaaatttgcattcaagattccaagtctactgctgctttatttttttgcacatgccaatagtaaaagcttggttttcaaactgtatcacagattaagatagattaaattagaacaatattataataattagaggatgttagaactcctctatttcacagaaataaaggttaaatgatacccaaagtaacaggtatcataggtaagaaattaacacctttttttaaataccaatactcatgtattattcctttaccctgcattctccagatacagataaaagggctgactacattttttttaaatatgtgaattgttctaaaattcaatacttttctacattctggtgagatcctcttggtaaattatataattaaatatcagtcaaaacatactaaaaaatgtattgtggtgctgcatataatgtatatgtactctgattttcacatatttgtctacatatacatttgtcaattcacaataacagagtgatgtgccaagtaaactatcgtgtagtttcacttttgaaaatttaacaatagaatataagttttgtttttcacagtctaagtaagtataggttactgtggttcattttagaacattcattagaaaagtaacgtgtctcttctaaaatgctatttgctaacattttagaaactgtatgttaaataaagaagaaacatttaaagcaagtgatgatgtaatttttgttttaaaattttagggatattctgcacaatgtaaaaatttcaagggcacacttagcactttttttgagaaagaataaatggtagctactgttgtagtgggagatgtgcaatgtggaagctttaaaattgataaacatttataagcaaaataatagtaaataatattttccttttttctaaaataattgtcagatttacaagtgaaatcaatactgtattctctcaaacttgttttaaaagctttgtcagagtttgtatcttcataaaagtattgcaaaaattaattttaacaaaccaaatccctcttgaaaagaatcaaaaggaataagaatgtgaatgtcagccataagaaagcatttttaaaactgtgttttcatataagcagttctgcatgcaggaaacagaaactgctgagtaccactgcagattggacactgctgttaacagctccaaagtctaagagaagtggaatctctgaaaataaaagtcattacttaaaattttaattaccaacataatttttagagttgtcactttcaacaaaatcatccctgaaaaaacttcacaagtaaaaatagttaaatacaacaacaaagaattgcaggggatagaaagaatcgatattgttaaaatcgccatactgcccaaagcaattagcgggttcagtgctattgctctcaaaataccaatgacattcatcacagaattagaaaaaaactattttaaaattcatatagaatcaaaaaagggcacaaatagccaaagcaatcctaagccaaaagaacaaagctggaggcaccgtattacccgacttcaaactactacaaggctaaagtaaccaaaacagcatggtattggtacaaaacagacacatagaccaatgcaacagaatagagcccagaaataagaccacacacttaaaaccatccaatcttcaacaaagtcaacaaaaacaagtaatggggaaaggactccctattcaataaatggtgctgggataccatctcacaccagtcagaacagctattattaaaaagtcagaaaataatagatcctggtgaggttgcagagaaagggaaatgcttatacactcctggtggaagtgtaaattaatccagccattgtggaaagcagtttgatgatttctcaaagaacttaaaacagaactaccattcgacccagcaatcccatcactgggtatatacccagaggaatataaatgattctaccataaagacgcatgcatgtgtatgttcactgcagtactactcacaatagcaaagacatagaatcaacctaaaagcccatcaacagaagactgcataaagaaaatgtggtacatatacaccatggaattctacacagcgataaaaagaatgaaatcatgtcctttgcggcaacatggatggagctggcagccattatcctaagcaaactaacacaggaatagaaaaccaaataccacatgttcttctcagttataactaggaactaaacattgagtacacagggacacaaagaagggaaggacagacactggggcctacttgagggtgggaagagaatgaagactaaaaacctatccatcaagtactgtgtttatttcctgggtgatgaaataatctgtacagcaaacccctgtggcacaaaatttgcctatataacaaacctgcacatgtacctctgaacctaaaataaaagtttaacaaaaaagaattgcagggttttttggggagtgggcaggggagaaaaggaaccaataaaacaatgattatgacaaaacctttatccatagtttaaaattagaacacaaaacatctaaccacctgccaaaacatgaatcacaaaattgatattttaaggacaagtcattaatttgtagcataaatagctgacaaccttagactaaatgtgtcattgctgataaatgattcacatcttcaatactgaaagctgacaagcattcagaacattaaaacaatatatcacaacacagactgttaaatattaggtggacagtcagtgcatgagtttagctgtaccaggattattttaagaaagttcgggcactttgagtgtttttttttttttttaatccataactttctgtaagaaccacactgtggatcataacatctgagctataaggattaagagtgtaactggggcccgttgggtgggggggcgggacagcattaggaaaaatagctaacgcatgccgggcttaatacctgatgagttgataggtacagcaaaccaccatgrccacatgtttacctatgtaacctgcamatcctgcacatgtaccctggaacttaaaataaaaattataattaaaaaaagaattgagtagctgcaccactagaaagatggcagtagcaagacagaagaaaggaaaagggctcaggtttaagcgactggaatcattcctacatgattcctggcggcagaaacgtgacaaggtgcgtctcagacgactagaagtgaaacctcatgccttggaattgccagataaacattccttggcctttgttgtacgcatcgaaaggattgatggcgtgagtttacgggtgcagagaaccactgcaagacttcgcctaaagaaaatttttagtggtatctttgtaaaagttaccccctagaatctaaaaatgctgcatatagtggaaccttatgtgacctggggatttccaaatctgaagtctgtccgagaactcattttgaaacgtggacaagccaaggtcaagaataagaccatccctctgacagacaacacagtgattgaggagcacctggggaagtttggcttcatttgcttggaagacctcattcatgaaattgccttcccagggaagcatttccaggagatctcatggttcttgcgccctttccacctctcagtggcccatcatgctaccaaaaatagagtgggcttcctcaaggagatgggcacacctggctatcggggtgaacgcatcaatcagctcatccgtcagctgaactagacccaggtgaggcagggctgaaaactgcccttgggctgacttttgataggccatgccttgccactttacaagttctttttgcatttactagtatttaagagtaaccttgagattgggaggaaagaggaggctggtacaaatagatggagacctgctgggatcagtgaatgcctgattaggacatggggctatgcatagcctaagagttataggcttaaagatgtcgagtaactaaaaactgtattgctggccgggcgcggtggctcacgcctgtaatcccagcactttgggaggccaaggcgggcagaccatgaggtcaggagattgagaccatcctggccaacatggtgaaaccctgtctctactaaaaatacaaaaatgagctgggtgtggtggcacgtgcctgtagtcccagctactcgagaggctaaggcaggaaaatcgcttgaacccaggaggcagagactgcagtgagccaagattgcgccagtgcactccagctgggcgacagagcgagactccatctcaaaaaacaaacaaacaaacaaacaaacaaacaaaaaactattgctgcagtcattcagatggaaatggggaaagaataatattaataactgatttcaaaaaggacttgaagatgtgaatcatctattttgctgaagaaatcttaactttttgaaattactttttattgctgttgtcatactcttaggtgacaaactgcggtaaattttttatcagtgaagtggaagcatgcgttttgttgttttgggaatttttatcaagtatcttcagagaagattatttcctgctttatcttcaaaaactggaaaggaagggtcaaagaaaagacagtagctggccggtcgtggtggctcatgcctgtaatcccaacactttgggaggctgaggcaggcagatcacctgaggttgggagttcgagaccagcctgaccaacatggagaaatgccatctctactaaaaatacaaaaattagccgggcatggtggcacgtgcctgtaatcccagctactcaggaggctgaggcaggagaatcgcttgaacctgggaggtggaagttgcagtgagctgagatcacgccattgcactccagcctgggcaacaagcgaaactctgtctcaaaaaaaaagaaaagacagtagcttatgttcatgtcaagcacctctcatcacagtctagttccaaggaaaaattccagcgttttctacattgggtgctgtgtcatctgaaatcggcacattccatggaggaaggagtcctgctttgttgcatgtatcctagggtttaatgttggtaaatgagtcactctagcatttgtagaaggctccctgagactcctacagcagtcgaccaagcccaaggacataattgaatctggagagtcctggggccttgttttgataaagacttgaaatacacataggaagaaaggcataaaaataaatgttcacttgtctctgctgtgaaaaaaaaaaaaaagaattaagagtacagagagcaatagaaagagggagatcttttaaattacattggaagcagtaagttttcttagttagcctgaggaggaactctgtccctgtccctgcctcccaaaagggagcaaaagggtataaatagtttataagaagcatccacttgaaagtttaatttttctcacagtgcgaaaaagaataaaataataccagaaaaggttattatgatttctgaaatgtagcataaagccaaaacctgaaaagaagaagaaacactgaattagacaagggtatgcaatagagaacatgaggggttcacaccttcttgacactgcagggagtagctgaaatgactggttgacgctatttgtgggtcttggtttgaataggaggcaatttgattctctccctactagcatcaagaaatcacatcatacacagtacagtggtacatgccgaggcccttccagttgtaggctggccccatttttcattcatgtgggaaaggaaaactgaataaactcaatacagctatgatccccacactgaggaaaactctctgtaaccataaagcccaactcatgtttttacatctaatccgtagtctactctaagattattgttgtaaattcatctgctctaagattactgctgtaaattcatttagaattacatagctagatagaatgaaaaggtaatttgtcaaatgaagctaaattggaagatacttttacattataaaaactataactatttagacaatttagaaaacagcaaaaagtttaaattagaaaataaagtcgccattcttttgacagaaaaccagcaaacacttccatatatagcctgcatcttttaaaaaaactgcatctatttattttggggataacaatataaatggctaatttgcaccttgctttttatgtgtggtactattcatctgtatacttcacattttgataaaactcctatgtcaatagatattttacatgattctttagtagttgtaaagtatttggctgtaacttccattctcccgttattggtcattctttggtttttcactattataaataccactgtacacacctttgcaaatgtctgattatttccctaagttaaattcctagaagggactggaaagccgatggacaactttagggtttatcacatggatccttaaactgcctctccttacctgctccaggaaaagtaggcaaaacatggacacatgtatttccccatattcgcttctaacagaaaacaaatctggtgaactggctattgataaaatttgcctatttctctgttggggtgtttgtcttctcttgattagtaagaatgttttggatgttaagtacttaaacacttagtccattgaggacatagctataaagctctcattttgaatcaaaatttcaaatatttcaagtatgatgatataatctgtgatgttcagagccctggctgttgttcacatgataattcctttagccatatctctgtttgaagtgtatgtgagcttgaaaataaaatgaccagtcaaatgtagttctggttaaagatggtatatttaacacatgcttttatttcagctccctctcaaacccagtatatgtttttaaaagcatacacctctaagaataaagagaagagacaataccagcaacagttcacaagacagaaagcagatggacaaggattgttggcttcctaagatctgttaagtcaccagtggggaaagctaagaagcaacctaattattatgaaaaaaaattctgaaaggctcaaaaactgggggtaaaggtaggggttcaaaatcaggaagactggttcaaagtctgtttaagaacatttacaggtttctttttatagaaatggtaggtcagactatgagtgccaacctgcctgccaaaaaccaaagtgctagataaaaaatatttttaaaaaatatccaggccaggcgcggtagctcatgcctgtaatcccagcactttgggaggctaaagcaggcagatcacttgacgtgaggagttcaagtgaggagttcaagtccagcctgtcaacatggcgaaaccctgtttctattaaatacaaaaattagcgggtatggtggcatacctgtaatcctagctactcgggttgctgagacagggaaaagcttgaacccaggaggtggaggctgcagtgagccaagactgtgccgctgcactccagcctgggtgacagagtgagaccctgtctcaaaaaatacatacatacatatacatatatatatatacacacacgcacatgtgtgcgcacacacacatatatatctccttaaaagcaccatcaagctgacaaaatgataaagaattaggctaaatctaaaggaaagcatcccaagttacttgtgctcagagaataacagatttaggcaaatttggatttcaactaaaaggacagaaaactagaaaaatggacaaaaaaacttatactttacaatacaggaactccaaatggccaataaacatatgaaaagttactcagcttaattagtaatcagggaaatgcaaattaaaacgacaataaaataacttacatacccatcagactgacaaaaattaaacatttgacaataagatgtgtcctgagtttaaggatgtaatcattttggaagacagtttggtattatccagtaaagtcaaagacaagaatgtcctatgatgtagcaactccatcaatagatatgtattcaaaaagaaatttatacttgtaaataaattaatgtgcatatacagtaaaatgtgtaagaatgttggcagcagcatttttttggttaaataaaaactacaaactagtcaaatgttcataatagtggaatgatttataaacatccatatatcttatctctgaggatataattctatacagcaatgaataaacgacagctgtacactacaacatgaatgaatcctacaatgttgaatgaaaaaagcaagatgcaaaatgacatatataatattctattcacataaaattcatatacatatgatattctattaacatggaattcaaaatatacaaactgagttatattgtttaaggatgtttatataggtagtaagaaaaacaagaaaacaacgatcacatttgtcagggcagtggttacctctggggaggaggaacaaaataggatttgtaaacttatatggtcatactggaggcctccaaggtattggcaatattctatttcttgccctggttggtaattacacactgctagctttattattattatttttcattaaattgtatgtatggtcatgcacgacataaatttcagtcaatgatggacagcatttatagtgatggtcccataaaattataatggagctgaaaaagtcctatcacttagctgcagctgtgcattgtaatacaacaccatgcttatgtttgtggtgatgctggtataaacaaacctaccgtgctaccagttatagaaaagtacagcaaatacaactgtgtacagtacataatactcgataatgataataaatgactatgttggtggtttatgtatttactgtattatacttttttcattattttagagtgtacttcttgtccttttttttttttgttaactgtcaaacactctcagccaggtctttcagtaggtatatcagaaaaaggcactgttatcacagaaaacgacagctctgtgtttgttattgcccctgaaggccttccagtgggataacatgtgaaggttgaacactgatgacactgactttgtataggcctaggttaatgtgtgtgtttgtgtattagtttttagtaacagttttaaaaataaaaacatcttaaaaatggaaaaaagcttacagaagaaggacataaaattttctttacagctgtacaatgtgtgtgttttaagctaagtgttactaaaaaggagtcaaaatgttaaaaaaattaaaagtttacaaagtaaaaaagttacagtaggctaaggttaatttattattgaagaaaatttttctataaatttagtgtagcctaagtctacagagtttacactacagtagacttcatataataaatgtcctaggccttcacattcactcactactcaatgactcacagcaacttccaatcctggaagccctattcacagtaagcacctatacaggtgtactatttttttcctcttttatattgtatttttattgtaccttttctatgtttagatacataaatacttaccgatgtattagaggtgcctgcagtgttcagtacagtaacatgctgtaagtttgtggcctggaagcaacagctataccatatggtccaggtgtactgtaggacataccattcagatttgtgtaagttcactctatgatgtctgcacaatgatgacatcgcctaatgatgcatttctcagaacctatctctgttgttaagcaatacatgactgcatatttgttttgttcattctcatgtacatatgcttgtttcacagtaaaaaaaaatgtaactcaaaataaaaaatagaaaaagaaacagatagcatgacctcccctactccagtctttgatgatttcttaccttttgttgtctacattttctctttctagaactcctaagctggttctctaattctcttatcttctcccctattttacattgctgtctttttgctcttatttctgggatattttcttacttttatctttcaatccttcaactgagcttttcatttatgttatcatccttttaactttcaagagtttagttttattctctgaatgttccctttttcaaaatcctttaatttgataaatgcattatttttcttatttctgaggatataagtaataggtttgagggaagtttccttatccaagatgactgctctgttgtttgttctgatctctgtcctgaagctagaagctctccccttcctttcaccctatccttctcctccttccttctaggctgagggttggtggggctccggactaaaggattccagacacagctgagagtagaaatatcttaaaaacaaaaggaagtttaagtgagccattacataccaaattattaatggcattcattcagttgaagaacacagagaaaaagaagaatgaagaaaaattaacagaacttcatggacctgagagacagtatcaaatggccttacatatgaatggagtcccagaaggggaagacaatgaaaattcaagagaaagataatgaagacataatgactagaattagttaatttagcatggtcacaggacacaatatttttaaaacattctatatatgcgacaaacaattggaaaataaaatttatattaatataatttaataactagcaaaacacatatacacaatagatatgggacaaaagatgtgcaagagctttacaggaaaaatgagaaaatattgctgaaaggaactaaagatctgaaaatattgttgaaataaactaaatatctgactaaatggagagatatacagtgttcctggattggaagactcaatatagactcaatccccaaattgaagtctcttatacccaaattgatttaatttcaatgcaataccaatcataatcccagcaggctttttttgtgtgtgtatagaaattgacaggctgactctaaaatttatagggaatacaaaggacctggaagaaccttagactttggccctgccttctggggaagggttagttatctctttaaagatgattttttttttttttttttttttttgagacagagtctcgctctgtcgcccaggctggagtccaatggcacaatcttggctcactgcaacctccgcctcctgggttgaagagattcccctgcctcagcctcccgagtagctgggattacaggtgcgcgccaccacgcccagctattttttgtatttttagtagagacagggtttcaccatgttggccaggctggtcttgaactcctgacctcgtgatccgc

SEQ ID NO: 17986 - DNA, 21852 bp, Homo sapiens
aaaagacttcacattttcatctccatgactatgtgtaaaaatatagaaatcttaaaacaaggatcagacaggttgcaaaaccacaatatctgtcatctgtacattttttctgatactgagcaggggtcagccaaccatagcttctgggacaaataccatgcactgcctttctttgtaaataaagttttattaaaagacagtcaagtccacttgtgtacatattattcataacagcagcgttgagtaggcctgcaaagcctaaaatatttactatctggacctttatagagtttactgactcctgatatagaaagaaaggtacaccagccatataaataaccacaattaacaatgtggtatgtttctgtgttggggaaatcaagaattgcttctatgtctcatggtgtaaaaaaaaaaaaaaaaaaaaagcttaaatccctcagttgtgcaggcatctccatgttctttctctacaaaagggtgagaaatgagtggttccacgcttaggcctaacattgactcgaacagtgggacaggcttctgtttctgtcttttctggattttcaaacaagtatgtgttctctctttgaaaatacagaaagtataaaaacttaaggtaaaaaaaaaattataaatactgtgaaatactctcttgaacatgttatatatgacagatcattgccagggttacaatctcaaatttctaatcagttatttattatactcaacccatccttgctagataccctctccaaaaaataatcctcaaagataaaacaacataggtcacaagtcaggaatgcagaccctcaattcccctctggtatcatattgtgctgatctggttcttttgatcctttaacatttttaaactatggttcacagagtcctaagtcagtttttcttaacctgggatacatatgttagaatcacctgggagcttttaaaaataacgatgccagggccctaccttggaataattacatcagaatcactggaggtgggcctaagtcatataatttagtaaaaactcccctagctaatcctgatgtgtagctgggaaatgaaaatcattcattctgggagaatcgttcttagagaagttatcaaaatcattgggagtgttttgttttgttctgcttttctaaatggaggaatggcatgaggggttgcttcttcaaggactgtttcagtaggtttaggatgaggcccagccactgctattctgaaaatgtttcatggctgcatctgaggtgcatccttaattaaaatgctactcaagaggttctgcagaggtgtggctctggggtaaagtctggggaagattcagaaaaggtagcacattacatacatttatatatacatatacataatatttacataagaaagacaaaacctatatgatcacacttcatagttctgaaagataattcagataccagagatatcaatagtatactatagtaagatcagaagagagagtccattacccagtaacccataccgcaggtgagcaaagaaatcaaccggcagtgtttggttctgtatttccttaacaaacttgcgggctgtgtcgggtgggtctccggtgcccgtggtagaaaccacaacaacaagaggagctgtttcggtttttaggtcatactacaaaacaaggatatcaagtcagggacctaacactacatgcatttttgatttaactcagcagcaaagcaatcagcttagtttcctgtcttgtatttcaatcttcttccttgccagtttttttgagacgaccagtccagtgactaggcgctctcagcttaatcaatttgcctaatgcaggatgtcattcaaggaaaccatgcgtctgttttgttgatgctcatcaagaggttgggggggattaacacgtctttctcttcatgttgtgtacgaaaggcagggacaggcacagacagtacccatcccaggtttccatctagtcccagtctttcatttttagaaaaatcagaggaaataggatatagtcaactctttgccactgagtcatgggccaaacattaacatgagctcaaatctgcaaggcaaatcagcactgctaagagccaagatgaggcacctaggcactgtgatgagctgccaaggaggaacagcagctaactgggtggaaacgtcttttcataagaaagtaaaaaaaagcaaggaaagaggtgttaaaatggggatggggagactcagaaataaagagaactgatacataagcactcaggattagaatgccaagacaaggaagcaacaagtagaatactgtggtaaagaaaaacagcaataaaaacacaacagctctgaaatcttcagcaaaatataaaaccagccatgtgtactgcatgtgacactaaggcagagggataacagggcattttaaaactgggaaattaaaagtgttaccccttctaaatcagggacctggctatcaagaaccgctcattccctcaggtttccagagagctgagaatatcattagctataagcgagctacaaactcttacaaatcaagtttattcttattctcatgtaagtttaaatatttcatatagagcatttcactgtcttaactctgagaatatcattagctataagctgagctataaactcttacaaatcaagtttctttattcttactctcgtgtaaatttaagtatttcaaatagaacacttccttgtcttacttgtaagactccacaagctttactgcccatgaacaccatcgaatttggctccaaataattcaccttatttttcacactgataaaagaggtaacaacttaactttttaccgaagtatttaatgcttccaagactctatgtaagttgtgtgttaaactctacatacagagtttgtataagtaatgtcagtaccttgaaaaggactatgtgaaataggaaggatattagattatgaacagctagacgaaaccatcagccagggaggataaatagcatgactatcttggtgttaaaaaaaaaattcaccattcatctgactgccaaaacacctgctgatcaacttactgaggtcaaccacaaggggccaaatcaggactagttttatgatactgatggctttggttttgtccaaagtaacagattcagatacttcatcatgtggcactgcaatctgaacttaagttactgtagaatgacagagtctgctgactggcagtctcctccaggaagctcccttttctctggtgtccagagttaccgtggcagggctgcataaaggaactaggtgagtctccttccgtgagctgggtttataattcacttgagctgcacacagtctagtgttctgaactggagttttaggaaaggccagagagggttgtgcacttgggtgagagagcactggcaggacagtctctgaaatgttgaagtgaattttaactgcttagcggctggcaaatcatcttgtggtataaagcccctgccaactgttatcgcctgaattgtctgaaatagtataatctggaggcagcaaactaaataaaagaacacaagatggtaaagttgcatataccctaaggtaggaacttctgcagagactgaacataaacaactagtccctgaagaagcagccgagttttttccagatccttacactactactttaaattctatttcacaaaagaatctaggcggtccttcatcaggaggaactctaacacgcacggcaaggcctttcttttggggaaaaaagtgggacactgagattcaagaggtggaaagcacacctgagcaggcaaacacacatctcacttgttctcacagccaccctgtgaaacagacacagcatatgctacttctgtcatttacagttgagttgttacttgtttcaatttttgagaccatttagtctaattcaactacacacttctatattaaaaaaatgctggtgatatcttactataccattgaacaaacacatttctgttaaaaaacaaagactatgtggtggtattagtgtccttttgtttcataaatatcacttcccaaccaaaattcttcaaagcacaaaacggtaaaatccactgtaacggctctaaccttatcggattcactaatacagtgaagatctgcagaaaatccatgtaccacagcttgctcacatatttcttctgcgatggcctttgcctgtccctgctgtgtagcatatagtaacagaaacctcctcatcacttcaaggcatgtaacagtgaaactgaaaaatgggggaaaaaagatcctctttttaatgaagcagtaacaacctaaagatattaattctccctcaatctttaagaaacaatgcaacaatacccacacataatatgaaatggccttttctaaatttgttttcagcactaatctcaaatgagcctaaataagaattcatcaaattaaggagagtgtacgaatgaaactctaattccatggctcagaaatcagatgatcggctcgaaactacttgggcttgaatctgtgtttcctaagtgcaaccctgtagacaagctccccaaatgatccgtaccacagctcctttatcctaaaaatgagagtattaccacctacctgaaaaacgatgtggcacaagccaagaacctgaacaaaacttgagccacagtatcattcacaacagtcttaaatagcttttggtttcctctttttaaaaaaagataaaagtaaaaactatattaaaatgataggattcttggttcttatttgatcctaacgctaaacaaactaatcatagtactaaaggtaactgaagcacatactctccttcattatttaatgcaaatcaaaaatatgtgagtgtatgggcatatatacaaacgggtgcatataacgaaaaaatatttccaatccacttaaacattttactaacacgtttttccgcaagagataagcagtagtaaaacaaacgacactcacagatttttttccatactcatctaacggctaaaattggtgggctgtcaatttgcagagacagatttaaactgaaacccaaaccaaaagcttggctttcggtgaatgaaccgcccagaacggcacctggcatgaaactggtactcgataagttatctgaatgagtgaataaacaatatgaaaacactacacattgacagctcacagaaaacggtggaaacgataatgaaaaccttactacagctaaaatttctatcacttcccatgaaacacacatcctgagggcttcccaggatcaatcaacccctcatccctgctactgccccacaatccggcaccaccttcccacgactctcagcggaggcccgggccccagcagccccggaagcggcgcggaggcggtgggcagagctcacggccgcgggcagaactcacggccgcgtcccgccgggtgggcgctcggaacgtcccgggttccccggagcgcgccgccccaacccggcatgttccccagttccccgcgtccccgagtgcggtttccctaggcctggaaagcgcctagaaccaaaggcagaacatgaggagagaccccacgccgcccaggggcctcccgcggcagaggccgacgccgagcccaaggacacgctcccggggacaccaaagccaaaggccaaaggccaagtccgagccccagcccgcgcccgcggcgacccccggaggccgaagggcgtgggaaccacgggcgcaagccggctgcccacccccgccccgggccgcctctcccaggagattagtgcagggcgagcggccggaatccgggaaccgtagccgacaggcagcttacccacgccgcgccagccgggcacgaacctgcacaacgcgacttccaccaaccttgcgccagcgcgcactgacgcagcgcccatgctcggtacccaggaccaatagaaagctccgaaggggacctgggccaatcacattgcgccgccctgagtcgtgctcccgccccgcgtttgctacggaggcccacgacgcccaggcgcttccgcgaccacccggagtgattgcccggcagagcgcggtaggtgtcaacgcggggtctccgcgcagttggtccggctgggtgtcaaagacctggccggctttctcctcaggctgcgccgcccggcccgtgtctcagcgcaggtccccggggcgccgagtttgggggtgctcgccccgcgggtccctttcattcctaggaaaacgcgccgcggggcctcccgtctgtctgtcttgcacacacgtgttgccaaatccccccgcascgtctttagatctggactggccgccccaccttctcccttcattgatctatgttttgctttttcttttcctaccttgtttccattgacaaagtagaccctttccttcaacactaaccttctcccgacaccgaggggaaaccaacagcttagggcctttccagcgcgtttttacccttgccttgctctaacctcgcctaattttgcccactttacctgttctttgatttctatccaaatgcaatttcttccttcaaccaacatttaagggccacccttaagagctacattgcctgagtttgaaccctagctctgccacttaaccmcctgcataaactgggcaaagtaactttgtgcttcaacttcttcctcgtgtaaaatgatagtaaaagtactgaatctgtgtaagttaatagaatacctacaacagtgtttagcaagtaatagcgattgttattgttcaatgtcagccactcttctaactctaggatgcagagactttgcccctctggtgtttatatgttaaccatccttttttttttttttttttttccagatactcgtttgtagtttcataaacattgatgttgggycaaycatgttctcaatgtatttaaccatgtgtttttaaattttttaatttagttatcaaattgagaatctgatggtatggcattwatcaccttgaggaagaacctttatcgtttatctgattttcagatgcatagagctctggctgctttaaaaaataaacctctaaatcatgttcacaaggtagtcaaggagcgtctgtgcccttggttgtgttcacgacaacctgagcctttcggggtcarattccatcatgcccattgtaaaaagtttcattcgaaaaatggaaatgaccttcatccactcggtggaccagtgttctctcaagtatctgactgcgacaggcttgaacaaaatgttaaaaatgaggagagtcagatgttttacaggagactgagcaacttgacttcatcagaagaagtgctaagttttataagcacgatggaaaccctgcctgacactatggcagcaggagctttacaacgaatttgtgaagtggaaaaaaaggatggtgatcaagggctgccaaaagaaatactggagaatagcatctttcaagctttatgctttcagtttgaaaaggagccctcacagctgtcaaacactagtttagtgactgctttgcaagctctgattctgttgcatgtggatcctcaaagtagcctgttgctgaacctggtggcagaatgccaaaatcgtctcagaaaaggtggcatggaagttcgcaatctttgtattcttggggaaagtctgattacactgcacagttcaggttgtgtgacactagaactcattataaatcaacttcaaggtgaaaaattggaaacatttaccccggaggatattgtggccctttatagaatcttgcaggcatgtactgaaaaagtggatgaacaccaaacatttttaaataagataaacaacttttccctatcaatagtttccaacctgagtcctaaattgattagccaaatgctcactgccctggtggttcttgatcaaagtcaagcatttcctctgattataaaattgggcaaataygtcgtgaggcatgtcccacatttcactaacgaggagcttaggagagtcttggaggcgttcatatattttgggcaccatgacacattttttacaaaagccctagagcatcgtgtagctgcggtgtgcctcacgttggatcctgaagttgtctgcagggtcatggagtactgcagtagagaactgattctttcaaaacccatcctcaatgcagtggcagaaacttttgtttgccaaacagaaaaattttcacctcgtcagatttctgcsttaatggaaccatttgggaaactcaattatttgccaccaaatgcctctgctttatttagamagctggaaaacgtgctattcactcatttcaattattttccacccaaatcattattgaaacttcttcattcatgttcacttaatgratgccatccagtcaactttctggcaaaaatattcaagcctcttttccttcaacggctgcaaggtgagttggttataaattctgacagttggaaaaaagtaacctttgaactggcagtggtttcaagtcacatataaaggcaatatgttgcctttagtttttcttccatagtgatccgaagatgagacctgaagttaacagatgctggcataaacacagttaaagcatgctaggaaatcatgtagagggaagaaagctgtctcagataaactgacttttgccttatctgagaaattgcagcattcttaggagatatggtaatggcagtggaaatagccacattaacatgttagaacttttgatgagtgagcaactgtatctttttttttttttttgagaggatggtattattcatcttaattcaaggccacccaaatatgtcaaatttccggaactccatagttaaaggaaatttccactaattctgtgaacatattttatctcttttaattgtattctgtagctaggagcttgggttcttggaagtcaatttcattggtggcaagaggagggcataattaattctaacaagttcatttcatagtgtcatttaaaaatagaatacttctgtctggagtgtgtaaattgatgttgaatgttcatgatgttctctcatacatacctcaattcagacgtaactatgactgggatgcttwctgtttcaggtaaagaatctcatttggacacattgagtcgggcacaactgacccaacttttcttagcctcagtcctggaatgccctttctataaggtaaaagcatgaactatatgtggctttatttccccatgggtgcagtttccttttaagttcctttacttctgatctgtctcaataacctgaaaaagcagaatttcatttacttggagtcakttgccaccagataggcttttctttgataaatggaccccatttttgtgttcttgttcttgaaggaacaatttcctgctgtttaagatttcttaggaggttttatcaagtgctgcaggcatgtgagttacagtatttctccattctctctgaaggttttacagggttttagtactaggtttactactaggtttcccatagctgtttgttatcaaagtgtgaatgtctggactgaacaaatacctaaattatttgcaagtacagtatatttttaagccaagccagaaatttcacttttatctaatagagtttagtttatctagagttcgctcttcccataaagacctataaagatttatcctattayctatcacattccttatgtagaatcagaaatagcacaccagactatgacattctctctctgcttctctctacttgactctgaatcatagtttagagtatctgatttttgaaataaggtaataagaatggaaaaataccccttttttaaaacagcttagacagtactaagttatataaagataaataatagttaaccccgatctcttaccatttctaaaggaacagtattaaaagcagtttctacgcccaaatgtatacagatacataaacactgtctattttttttctcttttcaaggaatgagactcactaatcaaagtacaatttgcttttatgcgcagtatatcatggccatccctcgaggccagtgcatacagatcacatgcattctttttagaaaggcatgatatttcatggtgtttattctactattgatgcacttggaggtttttgcaacttttgtctctatcgggaatgctataataaacattcttgcaaatcctgtcatactagagcctttttggtttttttcatatataaactagattcccaaaaatgtgattagtggattaatttttgatggatactggcagattttttttccctwatagttacagatgtcacatttccccagcaatgaatgaaggtggccatgtctcctccacttctattgcagtgtgttagtagtctctttaatttgtgttactcaactacatgaaagaggatatcatatcatatatttaagttgcattttaatgagcattaatgaagtttagcatattttcaaatatgtgttggccatttacatttcttttgaattgcctttctacaccttaatttatttctgttggatggtttgtctttaaggactcattgtaaaacagatattaactattatgaatgttgtacatattttcccgatttgtactcttttattactttttaatattacttatgatgtatttttaaatgttctgtagtcgaatctgtcttttatgacttccgaggttcctatctcaagagcatgaatattttacatttttaaaaataatatcttttaaattttatttagatctttgatctaaaagtaaaattgaatttttatttatgtattctaattaacaaaaattgtatatacttattatgttcatgttgttttgaaatatgtatacattgtagaatggctaaatcaaaccaattaacatgtgtattacctccatatctatcattttattttgtggtaagaatatttaaaatgtactcttgccgtgcgcagtggctcatgcctgtaatcgcagcacttttggaggccaaggcgggtggatcacctgaggtcaggagttcgagaccagccttgctaacatggtgaaaccctgtctctactaaaaatacaaaaaattagccgggcatgatggcacacgcctgtagtcccagctactctggactctgagttaggagaatcgctcaacccaggaggcggaggttgcagtgagccgaggtcgcgtcattgtactccagcctgggcaacaagagtgaaactctgtctcagaaacaaaaacaaaaacaaacaaaaaaaaaggtaaaaaagtactctcagccattttcaagcacgcaatcattcttattaactatagtcagcatgttgtacacctggaatttattagcatctgtcatggatgacagaagtttaatttagttattttccaaataaataaccattttctccagcatcgtttattatattgctatccttttcttcctaaactggaatgtcatttatatcacattttccattacagattgagtatcccttatccaaaatgctcaggaccagaagtgtttcagctttcagattttttcatattttaaaatattctcattatatttaccagttcagcatccctaattcaaaaatttgaaatccagaatgcttcatgagcattttctttaagcagcctgtctgtgcttaaaaggtttcggattttggagcattttggattttggattttcagattagagaaattaaacctgtgttgaaaactttagttgtgtgtacttaagacccttgggacaattctcagttctaaaaatgtttcttgaactgttagcattattatgtttcttctcactctctcctcactcctttttaccttccttctttacttttctttctgtttatggtaaccagtgactactgtaaaaacacatataaaagacattttgaactattagacttgcactgtaagaagagaagtttgcattatcattttgagagagatgcctgtcccaattcctggaaaagtatcatgcctataaagtaatgttatatcaaacttttctacctaggtaaccttcaatttattctctgttgttatatcttatttttctttctcacatttgcacttatgattttttagggtccaaaactccttcctaaatatcaagtgaagtcatttcttaccccatgctgttccctggagacccctgtggattctcagctttatagatatgtgaagattgggctgactaaccttttaggagcaagattatattttgctccaaaagtgttgacaccctattgttatacaataggtaagtagtrtaaggagttttgttgttttaaacctaagcatcctgttcgattttggagatatatgggacttagaagcaatagaagttctctggaaatgcaaaatggaatggtcccttccctgaaggcaagttggggttagcagcagagccgttgagtcaagactgtctgggtttaagtctcaaatattagccacgtagtagcagaatatcctgggcagaatatttaacctttttctgcttgcttcttcctctgtaaaatgatagtaataytgacctcaaagacttacttaaggtctaaataaaatagtacctggaacgtaggaaatgctcactaattgttagctactactataacctaggcttgtactgtccaaatatagtagccactagaccatgtggctatttaaatttaaattattaaaagtttaagaaaattcaattcctcagtcacattgtaagtgctcagtagccacatgtggctcatggctgccaaattggacagcaccattataaagatttccacatcacagaaatttctcctggacagcactgacragagactccaagtcctccgtccttacagttcttctaacttgatgagcagaagaaagccttctcgtaaaggacagcagttcataggcttcagatggtcacttctcttctctttacgaagggaactgcagtttaccagaggggaaggacagttcggaagccttccgtgctcgcagaccaggtgtctgggtgtggcatgctttctttacttaccatggaggcactgcaagttggaatgatggaagttatgagttgcacagatgtctaatgtcttaactcaagggttttcttcacagtctggattgaaggatctctgccacctatcataaggggaaagagaaagcatgcatggttcttgtcataccccagataacttcagaacccattctgtggtttagygttattgagctttcttaatttaaggctgacttgattgatcataaagccaattgaattaaaattctcaccattgtttggttgtggtcattactttgcagccttcagtccaattgatcaatgcaaggtggaaggaatcaaagcaaagcaaaggaatgaatacaggaagatagtgtttgtgagggtatcacacgaggaatttttcctttcttctctcaccagatgttgaaattaaattagatgaagaaggatttgtattgccatccacagctaatgaagatatccataaaaggtacaggaaaatgttgtgtttttcacattacaagactcgttgaggctaataagcagcrgtatctttttctcaagaargtgaaaaaaatagatatgattctggaaattaaaatactacatttcagaataccatgttgggaaattccttgtaatattttataaacattaatattaataagatcaaattcatgattcatttgaaaataatattggcacatagtaatagmcaaatcccaaataaactttggcaactaaaatatataataaatattttggattatttaaaaaattaagtatttttctccttttttatttttcaggatagcactgtgtattgatggtccaaaaaggttttgctccaatagcaaacacttactggggaaagaagctattaaacaaagacacctacagttactcggttatcaagttgttcaggtacggtttcacctattttttttgtttcccaaaagcaaatcctatttcaaaattatttttccaggttacttttaaaaagtaatctgaggcacagtaaaattttaaagaatttgatcaggcagcaattattgaactggacagcacaaaactcgaaatggcttgggaacccaagagggaggcttttataggaagaacacaagtacacaaagaatctacttgactggttacagttacatattcttgctgccttgtttgaactattctgtggaaagttcctagttatataattattagtttgtgagatgcttctgattggttgagcttaagttctgtttttctgtagtagaagcttckacaagaaatagcccaagttaaattttgcttaacatttgcactttaagcaaagttaaggttattttcaaggcccaactggcttggtctgctcagggatttttcaggcacaggctccattttaatttgcttttacagtactaactggtttgccagcccagtggaccaccgatcttacgtctagtttaaatcccaacgttgttaattcggcttaaatctcttgacttatattttgaaatacagaattttcagagctttgatttttcaaaagtggggcctacctatattcattataagctatgcttaaccctgcttttagaattactcaattgttggaatatatgttctgttttaatttctccttgatttaataaataaaaatgaacaagataatccattaaaataaggagcttcaccaacacttaatatttaagaccttttaaatatttcactrtagataatgtaagaaggtcttatgtgagggctcagcagtgcgtgagaatgagmgctgccctaattctctaagctgtcagtactaggcagcactgtggtttcatatctgctgacttttttctccatcttgcacatccccagctgaatattcctaaaactaatcatgccagtgtctactcagaagcttcaatgtttctttactgcttacagaataaagtaaaaacttctctacatcttaacattcaagaccctccaatggttggcctgcagccaggctgcaggcacatgattactacctggcccctctgctcccagctgagcagactctctcctttgctgcgcctcctgctctctccctcttcattccctctttgtccctgctgcgtcctccagctctctgaatacctaccttccagcagtttgtcggcatccccaccctcatctaatgaaatgctcactccctcttagcactagatcaccaacctacagcttgttttttatatttattgtgtaatttaacttgccacccaagttgtgaactcctggagaacaagagatcatgtttaattcttatttgcatattctacatattaattcatcaaatatttaccaagccccttctcagtgccaggcactgttctagacattggggatacaggatgaagaagctggttgggatatttgccttccaggagcttacattccgctgtggggaagcgtgtaagaaacaaacaaagtaaccaatagccagaggamcctcagattttgaaggatcttgaccagttttacttttctacctttacagatcccctatcatgagattgggatgctaaaatcaagacgtgaattggtggaatatttacaaagaaaactgttttctcaaaacactgttcattggttgcaagaatgaatactgacttcagaactcaaacaayggaagaacttgcatttttatggaactcagtattaaaagaaaaatataatgtgaattagccactttgcagaatatgttctagactggtgrtctgaaagcatctgtagttttccttatactatgtatacatttattgtggtaaaatttaaaattaattttaatttaatactagtgtcatagatactttttgtacatcaaacaattgatcatgtgctgtaaaggaattcaatgaataaatgttatttttaagtattttgtcatagttatctgctaaatgaaaatattttgctctttagagaccttttgttttctaacagatggaggaaattttttctctttgtgtgctgtgagtggaagtgagatttaccgtaaggaaaaggagcaatgagaaatagagtacagtgctttggatataaatattatagaattatgcagaaacaatcttctggttaatgagatatattagtatggaaacttttttttaataaatatttagagaaatggaaaagcaatttaggtaggttttttggggagctgtttgattggagggaggatcttctaaattataaatcaagaatgaattaaattgtcattagttcattgcagagccttcattgcctcatcacagtcaggttacagtttcaaggagaagaggacaagagagccgactggagtagcagagtgtattttttgaaggagggaggagggatacaattgaacctgtaacaggttgagatgataattacataaagcacttagaaaagtgccttgcacagagtaagcacacagtgcaagttagctggtgttagtctgaacgtctaccccatcatggtttttacttcactttagctttttgggtctatttacttatctttagaacaggaaatggaaactagatgagctaagatcattttttgtctccaattacaaagaaagagagaggcaatggaagcaaattgagattgagcaggagataagcacggtagattctgatgtatccgggtacccagctgaccttgccgctcatttgggacctggcttggaaggattctcacagctctctgaaatctgggtaattagatgatttacactttttcacagctcttagatgacttaaaacaggcattcctgacactgagcctaagatctgttccagatcatatcaggcctcagaaacccctttcacacctccttgcagctaatatccagtcctgtgtctttttctgcctttttagtgaactcaggttccctccctggcctctggtccaccctcactgtgctgtacacctcttcctatgactcagctaatttttggtgcgaaactcaacccagcaatgtggtgtgaggttaaaagcattcagtttaaggagcagaaagggacttaaccaattaaacagccacacgaagaggtaatgacggtctgttataaatgctatgaagaaaaatacagcacgagcgttcttcacctgtgctgttgatgtaagtccatctcatccattgcaagcttttccctgtttgctcatcagaatcagatgctcctccttctgcagttttcacttacagcctctgctgatcctgtctcatttggctctcccctaccctcttcacgtacgcattcagcagacagttctgatcacgctgggcacactcaatgctccagctctagggccaaataggaaagagcccctgcccttgaggggcttgaaacaggtgagattagtgagcaggcgatgggagtggtgaggcctccggcaccctgacacacagtcaaggctctgggaacacagagacctcatgcccacctgggcagtgagagagagcctcagagtgatttgtaagctgagttttagaaggaagagagcagggtctaggggcgcaattgtcaatggctggaacacccagtgtaaagcatacagggttggcccagggagggaggctagacctgcctctggccctgttcaaattttaatcccgaagtacatgaaaataatttaggctaatagagagatataaggttgctggtgtcactaacgagcaaatttgacaagctttgtcaaatcataaagctaagtccttttaaactgaattctcatgctgatgaattcattggtatgtctatacctgtacaaacaaaagtgatctgaatgtgtcagttgcaattacatattcaatatgatggctcttgcaactatatatttgataatatttttaataattgcataacctttctatatttgttttcaaaagtaaagcaaagcaagaaaaatgaatgaaaaaaaattgttttacttgctagcacaacccctgcagcaacagtgatagtctttgggcctatcaatagggggcagcaaagttcaggactttgggctgcagcagttgaaactagaggatctctggaggagagagtggatcctctctgagtgtgtgttgtgagtgtgtgtgtagatggcaggcaggcaggagctgtggaagagtgtggtgacagttctgcctgaacaacacaggcagtcttctttacctttccttgccttcctctatgtgaggaatgtgcgtcgcttgggtacatgtggacacttgaaagatatttgatagaattctgggaaaacggaagcagtcagttcctcctaaaaaaaaaataaataaaattaaaaaaaaaaaaaagtatacctaccagaagatgatgtgcgcaaatccagagaggggtcttggctcagtgaggaaccaggcaaattatccccttagggctgcgatctcccaaattgggaatgtgcccacccccatttggagtctaaatacttagtgtagatagtgaaatgagacacgtcttgtaagctgtttagcccaattcctggaaaatagtaaatactcagtgaacattgggtgcaattattgttattggtacacgtgtgttccttcattctcagttaaactttatcgtacagctcgcggtgaagggtcatgtaaggcatggtctgtaagaaggaacatggctaacttgctggtcaggacttctaggggtgccactgtgagcctttgacaactgcctttgttaattatcatcaaggacatagtgctaagaaactttgttctctaaagcctttgttgtttgaaatcagagcaataaaatggaacatctaactgttgtctatatgagctgagccacatgggccaatctgaccaatggagaagtagcttcaatatccccctcaattgcagagctctagacgtgggaattttgcatacaacgttccacatttcttttccctttgagggacctgaatcggcttcttaggtcagggttactgttaactctttggcacactaacttgctgtgcttgagtctctccagctcagcttcattaaattttacctaaattcacccctccccaaatcctacaacagccctgtctagtcctatgtttgactcgatgtctctaggctcctgtggtgtgcagtctcccctgctgcacgagtcaggaaacctgccttcatgttgatgttctccccctgttgggctccatcaaaagaaattttgccttcatccagtacttgtaatcccatcccagaaaaagcaaacatctccctcccactcccacagtctccgatacagagtgctcacagtgtgtgggtggagttgatattttgggttctaatgtttacaagaaacaatcttaataaccctactgtttttgcttgtattacaggaaattttgaacacacataagaattgaaagaaaagtataagaattgaaagaaaagctggctcagtggctcatgttgtattcccagtgctttgggaggccacggcaggaggattacttgaggccaggagctatgatcacgccactgctctccagcctgagtggcagagcaaaaccccatctctaaaaaaaaaagtataagtttgcaagttcctctattcagcatgaaaattaccataattttccaatcatgtttcatctattctttaactttttctttttttttttttccactggaatgtttctagagaaatccaagctatcatattattttatcctaaatacttcagtattcatctataattgataagctttttttctttttttatctaatcattcagccattgttacaaataacaaaattagttattattccctgtcatcatttaatgtgtagtctatattctaaatttcctgtactatctcaaaaatattttttaactgttgatgtttttgaatcaggatccaaagtccacgtatgacttttagagattctaccactgaagtctcttatgtctctaactgctactctttctcacgtagttttcatgtcattaagttattggagaaattagatcaattgccctgtagaatgtcccacactgttgatttggtgttgtctaacttgtttctatatctatctgctgcatttcctattaaaccaaagggcagatccagagacttgcttcaatttggcttgaatgccttgggaatgatgccagaatataaaagcaggcagaagaaggtgaaagactagactggcttagcctcccagcctacctctttctcccgtgctagatgcttcctgcccttgaacatcaaactccaagttcttcagctctgggactcagactggcctccttgctcctcagcttgcaggtggccgattgtaggactgatatggtttggctctacgtcccgacccaaatctccataattctcatgtgttgtgggagagacccggagggagatagcttgaatcatgggggtggttcccccatattctcgtggtagggaataagtctcatgagatctgatagttttatcaggggtttccacttttgcatcttcctcattttctcttgccgccaccatgtaaggagtgcctttcatctcctgccatgattctgaggcctccctagccatgtggaactctaagtccaattaaacctcttttcatcccagtcttgggtatgtctttatcagcagagtgaaaacgaactaatacagggaacttgtgatcacgtgagttaatactccttaataaactcccatataaaaaaatatatataatatatatctttacatagatatatatatacatcctattagttctgtcccttgagggaaccctcactaatacactatgtttaacccagccccagtgtgtgtccttactctattaatttgcctcctttgagaggagggtttttatgcttctttcatcctccccttctccggcacagaacttttgagtacgagtacagacatgaggagcctaaatgtatgactctgtgaccttgtattccactcatgtacctgggaatatataataagatcatataggaaaatacttttttaaaaagagtatttttaaaaaaggaactaaagcctcttaataatcaaaattgccaaagtctgccttgcccatggtttcatctgtctctggtaacctgccctgcatcctcagggcctcacatctcattccaccctcatctctggtggaccattccgtggggctatgactcacctcatgaaagaagcatctcacctccagtacatgcccctgtcttttgctgtcagccctagggctcctcggacaccaaggaggcaagacactccaggggagactgtgaggccctggggcagtggtcgtacaagttcaggagtcaacaactgaaggagcgagcctccaccgagcagacaggagcaagtgatgaaacatgcctccatgttgatcctctggggcaattcttcaaggcctctccaggcccctcagaaaggttcatgaccattcaccagttgccttcagcagtgacctgggtagtgcatccttggtgtctctcctgcttcttgctcctcttggtccctctctcctgttccctggaattacctcccaaataaactcaggcccttgtctcagactcaaatatttgacttcctactgtatgcctgtatgcctgacttgagccatctgtataagtttgttctcatgctgctataaagaaatacctgagactgggtaattcataaaggaaagagttttaattgtctcacagttcagtatggctggggtggcctcaggaaacttacaatcacggcagaaagcaaaggggaagcaaggcaccttcttcacaaggtggcaggaaggagaagcactgaacaaaaggggaggagccccttataaaaccatcagatcctgtgagaattcactatcacaagaacagcatgggggaaattgcccccaggattcaattatctccacttggtca

SEQ ID NO: 17987 - DNA, 40394 bp, Homo sapiens
gatcagagtttttaaagatagtttggtgctgggtgtggtggctcacgcttgtaatcccggcactttgggaggctgaggcaggcggatcacctgaggtcaggagttcaagaccagcctggccaacatggcgaaaccccatctgtactaaaaatacaaaaaattagctgggcgtggtggcacttgcctgtaaacccaggtactcgggagattgaggctggagactcacttgaacccaggaggcggaggttgcagtgagctgagattgtgccactgcactccagcctgggcaacagagtgagactccatcacaaacaaacaaacaaacataatttggcaggtaggggctcaggaagcagagtgctgattggtcaaggttggagatggaatcctaggggggtcgaactgaggttttcttgctgttttctactcctagatgggatggcagaactgattggcccagattaccggtctggatggtgtcagctgatccatccagtataggatctacaaaatatctcaaacactgatcttaggttttacaatagtgatgctatccccaaaagcaatttggggcggttcagactcttggagccagaggctgcatgacccctaaaccgtaatttctaatcttgtagctaacttgttagtcctgcaaaggcagactggtccccaggcaagaagggagtcttttcgggaaagcgctattattaattttgtttcagagtcaaactatgaactgaattccttcccaaatgcccagcaatgaacaaggacagcttaaaggttagaagcaagatggagtcggttaggtctgatctctttcactgttataatttcttcagttataatttttgcaaaggcagttgaaactgtgtctttgaaaagacacagcagaaacatctgttacataaacaacagaaatgaggaagaaagtatctgactcagtagcaaaggaaatccacagaaagaatgttctgagaacggaagcaatgatcagaccaggtagggatatgatagaaagaaaattctcatctaattcaaattctggccagtccttttggtgatttccatactaatactaggcactttaaaatgtgagttctggtaacacatggaacctcaaagtagaaatgtctgttgttcatttttaaaagactatttgcagagttttgatgtttatcaatgaaaagagttttttttttaaatttatgaagaatagggaatcctatatgggcatggggcaaataatcaaactgttttaatgcagaaaaaaatgtgcaacagaaagagatagctcatggagggataaagactttattctggaccctctagattctgtggggcctgcagtagcttcaagatgccccagcatgtcctgcgcccacacccctgtcaagatcactgtggtcagggcgtcttgcccatggccagtgtattagtctgcttgggttgccacaacaaaataccacagactgaggttgaaaacatttattttctcacagttttggaggctagaagtcctagatcaaggtgccagcagcgttgcttcctctgaggcagctcttcttggcctgtaggtggcgccttcttgctgtgtcttcacatgggcggcccctcagtctgtgtgtctaggtcctaatcttctcttataaacacaccagtcatactggattagggtccatcattttaccttaacggcctatttaaaggccttatctccaaatacagatgcattttgaaatactaagggttagtacctcaacatctgaattctggggggacacacttcaacccataacatgcaggcagacctcaatgctgcttgcagacccaaggcgaactgcacaacaatcaagcctggctcttaggacaaaaacatctgccagagtcaaccaaactgaattctctgggaaggacgagatgcctggtgtcataaaaagaccatagtcttttttaagtgtgatgcatgcgcacacaggcacgcatacacacacgcgcacacacgcgcacacactgcactgctgccctgtccttggcagacattcctgtggggtcatgttcgaaatatgcacttctgtggagtagcttgggttttcttggaagtctctttttctaaacttgtacctaagctgatggcctgtgcctgcttgggcatgaggggtcggagtggggatgggtcaagactgactcctgttcactgtgaagtagaggaaggcagtgatagccagacagggacgtgtgtttagggaagtcctctgtgttttcagttctgtttttgttttgtttttatgatgggagagatgagcaaatataaaggctgcttctaggagcaggagtgaggagaggttgcctatatgagagaaacgggatggtcaatactgtaggtttttttgagaaggtgaaatatggaattcattttttaaattttttaaatttttttttttttgagacagagtctcgctctgtcacccaggctggagtgcagtgatgtgatctctgctcattgcaacttctgcctcctgtttatataaacaggccaaaccctgtatgtatgtatgtatttatttatttttgagatggagtttcgctcttgttccacttgttgcccaggctggagtgcaatggcacgatcttggctcactgcaacctgcaactcccgggttcaagcgattctcctgcctcagcctcccaagtagctgggattaccagcactcaccaccacagccggctaatttttttgtatttttagtagagacggggtttcaccatgttggccaggctggtctcgaactcttgacctcaggtgatccacctgcctcagcttcccaaagtgctaggattacaggcatgagccactgcacccagccgaaagatggaattcaaagaagtgctggtaagtcactgtggtatttgtgaaaaaataaaaataaagagggtttgggctaggcgcggtggctcatgcctgtaatctcagcactttgggaggccaaggggggtggatcacctgaggttgggagttcgagaccagcctgaccaacatggagaaaccctgtctctactgaaaatacaaaattagccgggtgtggtggcgcatgcctgtaatcccagctactcgggaggctgaggcaggagaatcacttgaaccgagaggtagaggttgcagtgagccaagattgtgccactgcactccagcctgggcaacaagaggaacaagagcaaaactccatcaaataaataaataaataaataaataaaaacagggtttggccttgggcaggatggaccgttttctagaaggacagccgtggtgcgctgcacaactggtatgaagcccagtttccatctgaagtcctcgatgttcatggaaataggggcgagacagtctgaggagtgtgaagaaggcctgaaaatatccttgcagagaacaggagagacaatgactgggacagccaggcagggctgagggcccatttgaatttcccgcagtgccctctgtcctgttgtgtgacccctccagcagtaggtactgggaaagcaggtggctgagttcatccaggactgaggctctgccagacaagaacagtgcagcaaggatgttgaaggtaatggcaaaaaataactggaatgcagagaaatgaaatcaaagctgatgaggagggaagggaagagaggagagggcagatagacttgggtagagaggacagaacaatgacagggcaaactggtgatgttgaggaagagtcacagggagcagctaaacaagccagctgcagggatggcactgtgtggctggagagcagggttctggagttatcggtttttccatgtgtgacatgggcctgggtgggtgaggctgagtgtagaagtcttacatttccagtcttgtcactcctctgatgagtttcagaccaatatatccatctgcctagatgtcatttctccttggattcacatgctccaaaccaaactcctgggctcagacatcaaagccactcaaaaatagctctctgagaaatagaactaccatatgatccagtaatccaacttttgggtatagacccaaaagaattaaaaacagaatattgaacagatatttgcatagctttattcacaacagccaaaggtgggaacaacccacatgcccatcaacagacgaatggataaacaaaatgtgctatatacataaaatggaatctttttcggccttaatgaaggaaggaaatcctgacacatgctacatggatgaaccttgaggatattttgctaagcaaaagaagccagacactaatggacaaatactataaaatccacttatatgagatacttagagtagtcaaatttagggacagaatcagatttgcaagataaaaagtttctggaaacgtatttcacaataatgtgaatatgcctgatactactgaacacctcaaaaagggttaacacggggccgggcgcggtggctcatgcctgtaatctcatcactgtgggaggccaaggtgggcagatcacctgaggttaggagttggagaccagcctggccaacatggtgaaacccggtctctgctaaaaatacacacaaaaaaattagctgggcatggtggcaggtgcctgtaatcccagctacttgggaggctgatgcgggagaatcgcttgaacccgggaggtggaggttgcagtgaaccgagacagggccattgcactccagcctgggcaacaagaacgaaattccgtctcaaaataaaataaaataaacaataaaaataaagggttaacatgggggctgagcacggtcagcgagagaatcacttgaggccaggagtctgagaccagcctgggcaacagagaacgctgtctctacaaagcataataataaaaaaatgagccaggtgtggtggcatgcacccgtggtcccagctacttgtgaggctgagatgggaggttgagactgcagtgagccgtgttcgcatcactgctctccagcctgggcacagagacactctgtctctgaaacaaacaaaaaaagaggggctaacatggtaaatttcatgtttcttatcaagtaaaaaggcttgctgacccacaatctatattaggtttccctgttactagcaaggagtgaaggatgtgctatcccaaaatatgtccaaaaattggtatattattttgagctaaaaacaccggagaaattgtagtttcagaaagggctagatgacctgtcgtttcctacagggaataagcagtaaagattcctctgggagtggcaccctctctgtacccgggtcagaaaatagcccttatcaccagagactgggagttggggctgcaatggacctgaataaatgaacttcccaagtaacacttaccttccactaattttacaccctccccaatatttctcctagtgactctcttagaaatgtatcgccccagccagatgccttttgtgctttcttctcaaatgcatcattctttgtctaaaaagtataaaagcatcttgctgtggccacttcttcagacctcactctcttttgaaggtccccatgaaaaactaataaagtgtgtatgcttttcttttgtttatctgcctcttgtcaattcggtttctggctccagcggaagagcccgcagaagcgctgaggggactggagacggtctctggcgcccctacacctgctcagtgagccttcagccccttctccctgacgaagctcccagaggctggaactctggcgcgggaggcacttgggaaatcctcccgaaagcaaggaggagcctttcctagaccgggagcggtcccacgcgggggtacaggttggggcaggggcgaccgagccgggcacaggaactcgcagcagggtagggttggcggctacgccgccctcggtccgcggggaaccacgcgggcttccgggtcacgccgccgcgttccgaccgccctcggggagaggggaggagcctccagcgccgggcggggcgtggttaaggccggtgggccccaccgcagccagacgctgcccgtttaagcgcagagggccgcgggtcacgtggtgggcggggtgggggcgtggcaccaggaagcggcgtccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtccggcgcgcccgcgcttcctcccccgcgcggccctgccggggtcgtgggcgygccaaggccggtcccgcgcgaccaggcccgagcgtcccctcctgtcctgtcccgtcccgtcccagcgcgggaggcggcgcgcgctccttccttgttgggtgggctcagccgcggccaggtgtcctcgcaggtgacctcggggctggacccccgagccagctgcgcggatgcagtggccccgtggccagtgtctcaattgttggcgcgcccgtcttatctaggcttcttttgttgtgtttgtcattagttacactcgtagtcaagggtttagacgtcgagattttcattttccttgaaattttgtaaagggggaaaagactgtacttcaggcgtatcagcggcgccgatgcgcgaaccggygttagaacttggagcctcgggaacccgacccggtgtcacggtggcatccttttcgctctctgctcttggtttttaaaattcacctgagcagccaaacatctgtaccttgatatgtgccgtgttactttagttgaacccagggtggtgtataacagaaataatcgcttgcgggttggcttctgagtttagatcctttcagagttcaggctgttaaccttgctgcttttccctctcaggtttttgctgttcgatctggtggagctactggcgtggtagttaaaggcccagatgataggaatcccatctcatttaggtaatggtatagacactttcagatcattttgtcatgtaaacagaatgatgtttttctaattcaaatggttttttataattttgtcatttggtctgccctaagaggcctgaagtctgtgtgcgcacatggaattcctgtctgtagggagggtcttcgtggcacttactagcacctcttgtcagagtggaatatctggagcagttgatttgggagccaaatacttcaaaagtggggcagccacttcctagcactggaaattaacaagtcagcgtgatgatgtgcccatttctggtttgttcacagaggagggcgttcatttctttagcccaggtctttccagagtggcaggtggaggagattcattgtttctcatgtaataatacaagaaaatcatggcttccactatacttaaggtgactgcatagtcccagttcgcactgttgaacaggtttaatgatcaacagcagggcctttcactttcagaagtgtctcgatttggatgataagctatctggccacygtaacactggtgcttacagaaggtgaaagtataatgtaggccctcaattcagtagtgacttaaaaaattttactgttggtctgtgttaatgagaaactgtccttttttgagagggagcctccctctgttccccagggtggagtgcagtggtgcgatcttggctgactgcaacctccgcctcccaggttcaagtgattctcctgcttcagcttcccaagtagctgggattagaggcgcccaccaccacgcccggctaattttttttgtatttttagtagagatggggtttcaccgtgttggccaggctggtttcgaactcctgacctcaaaacgatccgcccgcctcagactcccacagtgctaggattacaggcatgagccgctgcacccggcctgagcaaggttttaaagtatggatggggtkcgagcatggtgttttggggaactctgggtctgtgtaactgaaggttacatagggtgtctccacagggaaggggaaatggtggtggtgtggccactggcaggggccagcttgaaccttacatattctcctatgaaattagagctttatcttcttattgaaacttatcaggtggggtgtgggatgatcatgtcagtgtttggcaagatcatgctgttcacagcacggaggctggcttagttgggagcctgtcagagttagggatgctatggagagtagcaatcagcgagccatgtgtggtgaagagcagcgctctggtggtgtagagtggcattgcataggcaatcaagggatacttaggaagatgggtctctcgtaagacccgggggtcggttgggtgtggaaaacgagtgagcccgtgataatctagattgggggctctaagaagtttgtgggtggggggaaggtactgaatttaacttaaaaagagtttttagactgggcrcggtggctcatgcctgtaatcccagcactttgggaggccgaggcgggtggatcacttgagatcaggagttcgagaccagcctggccagcatggtgaaaccctgtctctactaaaaatacaaaaattagccaggtgtggtggcacgtgcctgtaatcccagctactcggaacgctgaggcaggagaatcacgtgaacccgagaggcagaggttgcagtgagccgagatcatgccactgcactgtagcctgggcaacagagcaagactcygtctcaaaaaaaaaaaaaaaaagatttttaaaagcagctttattgaggcatagttgacacataataaactgtacacacttaatattatgcmatatgtgagttttgacatgtatacacccatgaaaccatcaccacaatcaaggcaatgaacatgttcagaccccgaaaagtttccttgggcccttctgtaatccatcccttgagttttttttttttaaatgaatttttaatttaaaaaatgtatgtattggaatagagacrgggtctcactgtgttgctgaggctggtctcgaattcctgtgatcctcctgcttcatcctctcacagtgctgggattacaggtgtaggccgctgtgcccagctgagttcactttttaacatctgtctgaggcggtcatgagacactgtagtggagccatctgggttgcataatgaatgtgctgtgagatgcacaagtagatagttctttccagaagctttgctgtgagagagaaacagcagttacggagaaggctcctgagcgggtctatagttatttatgttggaacaattctcaggtgatatgtgtgtgtgatctgaattcttcaatcacttgttacccataatactgtaagtttcccagcaagttctttccagttggatttggtagtttgaaaagaggtcctactgatggcttccgaaacataattttaattttagactagaatttgctgcctcctgaatatagattgtgtcttttgccttttcaataaatggtagtagctagaattcggttatttaactactaacacaatctttcttcttaaagaatggatgacaaaggagaagtgaagtgcattaagttttccttagaaaataagatattggctgttcagaggacctcaaagactgtggtaagacttatctttaaaatacagcattaaagggcattagaaatacatttggaagagaaggaatcgcaaattttcagtgttaaaggaaacttttattatcttactgttgtgaaaggtatagttatgttgcattgtattagagccttcaaaaacgaaaaagacatttgagtgggttaaaaaaatgaccttagtttgatttttaaattaaattaaaaatttttttttgagccagtcttcctttgttgcccaggctggagtgcagtgatgtgatctcggctcactgcagcctcgatctctcaggctcaagtgattctctcgcctcagtctcccttaaaaattgttaaaaaataatttggaacttcatgtgtcttttgtattgcttgatagcagcatagaatatgtgaggtatttttggctactttgtgaattagccttttcatctctcatttctgagtgctagatctgataggagcagatattccaagttgaagcagcctacaggcactttagccygtgtaaatgttcaccattgccgtttgtagagtagagggaaggctgttagaaacaggcagaatcctctgttagtttcttccatcagttttaagtgttaaagtcttggggaagcctcttagtgcagcaacacatttctctgacatcagctgcttgaggaatgaatttttgaaaggagttactaaactgtaactgaatatttgtattaacttaaaaaaaawtgaatcgtaagcctgctgctgttgagacagatgatccgaattggtctttttatctttcctgtgttttggttgtcttcagttattttctggtcaytttttaagttaatatttatttttcttgtcttgtagtatgccaacgtaggttggcagtatgctgcctaatccaaatttgtgtgtgtctgtgtgtttttcctttcaggatttttgtaattttatccctgataattcccagctggaatacacacaggagtgcaaggtatgaccccaggccctttctcagctgctggtgtcagtggtgttgagctgggttatgtagtggagagcggggcatyggggtcgcagggagcacagacttgaagtcagactgtccctcatgttgattcccaaactggagtcaggcggggtgtttgctttgtgacactgaacagttttctaagtttgaaagcttgttcctttggagggggagggttcaatggatgatgcgtggtgaacacccagtagtgctagcccttggggctgtcgtctgtcttgccctttttctcctcactgggctgacagcacatctgggtctgggccctgggatgcctcacagccacctggagtggaggtttctggtgaggagtttctttttctgtttcctgaagtttcctttcctcaatttgttgtctttgtcttgtccttactctttctttcttctcctaggtgttgattctaatccacattaatgagatttgctgggtgtagtaaactaggctagagggagctgagctaaaattggcagtgtggcaccttgggcgctgacagaagctgctagtggttggggtagggctttctgcatttttgtgactgttttgctcaatggagttcagggcggactctttggtgaggagaggtgcatccccaccactgtcctgcctgccctgcagtggccccgtgtgaagagaccctcagcccggcccttctcaaacctgtctgccctcaagcgagtcgggtgtgtgtctcagggtcctcaacccattttagtcaacactcactaaagacccttaggcctttgtacatttttaataaccatttttataacgtgggtgactaagaatgttggcagtatggtgattcctgcaggtagaagctgctgtctgtgagctctggtcagttacttttctacaaaacacagacttctcctgttctgtttagtagaaggaattaggattcaggttcttgaatgaagagttatgggcaaaaatcagggaacattgtatttaaaagaaaatttgttttgttaattagtaaacattccggggaacgttcattaaagaatgacaaacygcagagtttgtgaagcttttgaagagagttatatgtgttttttcttattaattaaaaatatttttaaaaaatttttcttagactaagaatgccaacattctaggattctgctggactagttcaactgaaattgtcttcataacagatcaaggaatcgaattttaccaggtattatgtttatcatttatgtttgttggttaaagttcagtgatagcattctggcagccttttgaattcagtactgaatatatatatatatattttaaacattttctagagatggagtcttgctctgttgcccaggctgcagtgcagtggcaccatcatggctcactgtaatctcaaactcctgggctcaagcaatcctcctgcctcagtctcctgagtaggtgggactacaggcatgtaccaccatgcctggctaatttttctttttattattttattttattttattttatttttgagacggagtttcgctcttgttgcccaggctggtggagtgcaatggcgcgatctcggctcaccgcaacctccgcctcccaggttcaagcgattctcctgtctcagcctcgtgagtagatgggattacaggcatgcatcaccatgcccgggtaattttgtatttttagtagagacgggatttctccatgttgagactggtctcgaactcccgacctcaggtgatccacccgcctcggcctcccaaagtgctgggattacaggcgtgagccactgcgcccggccctggctaatttttaaacttttttgtagagacgaagtcttgctatgttgcccaggctggtgtcaaactcctaacctcaactcctgccttggccactcagctttagtctcttgctggggattttattctttttttttttttttataattgcaagtaataaattaaaaaaaaaaaaaagaaaagaaaaagggcttggtggcccrtgcctgtaattccagctctttggaaggccaaggtgggtggatggcttgagtccaggagtctgagaccagccaggccaacatgatgaaatcccatctctataaaaaatacaaaatgttagtcaggcatggtggtgtgcgcctgtagtcccagctacttgggaggctgaagtgggaggattgcttgagcctgggaggcaggaggttgcagtgagccaagatcacagcactgcactccagcctggatgacagtgagaccccatctcaaaaaaaaaaacaaaaacacaacaacattaaaaagtgggcaaaggccaggtacagtggctcacacctgtaatcccagcactttgggagaccgaggtgggcagatcacctgaggtcaggagttcgagaccagcatggccaacatgacgaaaccctgtctctattaaaaatacaaaaattagccaggttggtggcaggcacctgtaatcccagctactagggaggctgaggccagggaattgcttgaacctggaaggcggagcttgtagtgagctgagatggtgccactgcactccagcctgggcaacagagcgagactccgtctcaaaaaaaaaaaagtgggcaaaggacatgagcagacactttttaaaagaagacacacatgcgaccaacaaacataaaagagctcaacatcactgatcattagagaaatgcaaatcaaaaccacaatgagaaactatctcacactagtcagcatagccattataaaaaagtcaaagaataacagatactggcaaggttgtggagaaaagggaacccttatgcactattgctgggagtgtaaattagttcaacctttgtggaaaacagtatggcgattcctcagagagctaaaagcagaactactgtttgacctagcagccccattactgggtgtaatatgcagaggaatataaattattctaccataaaggcacatgcacgtgaatgttcattgcagcactgttcacaatggcaaagacatggaatcatcctaaatgcccatcagtgacagattggataaagaaaatgtggtacatatataccatggaatactatgcagccataaaaatgaayaagatcatgtcttttgtgggaacatggatggagctggaggccatcatccttagcaaactaacacaggaacagaaaaccaaataccacatgttctcacttctaagtgggagctaaatgtaagttatgaatgcaaagaaggaaacaacagacacggggggctacttgagcaggggagggtgggaggagggagaggagcagaaaagataactattgggtactggacttaatacctgggtgatgaaataatctgtaccacaaaccccgtgacatgagtttacgtatgtaacaaaccttcacatctatccctgaacctaaaagttaaaacaaaaaacattcaaacattgcaagatatgtaatatggaaagcaaatgttccctataatcccgataaataattattatgaacagtttggtgcatattcctctatttttaaaaataaatacaaacttctttttaacaaaaaggggaatgttgtatataaacttttgcagctagctttttttttttttgtccaaagtgtatcttggacatctttctatattttattctgactgggtagtatyccactgtatggatggactgcagtttaaaaattttcttgttatkggacattggctggttttccatttttttgtgattacaaataacccttcagtaacatgcttgtacacacttctttatattagagggagagttgcagtataggtacgaacatctgaaaagctgaaccagtatcgccaaatttcttctagacatgtgtattttcactagcaatataggaacttctgcttttcatacctttaggaggactggatattatcagtctatagacatttgccaacctgagaggtagaaagacttttttttttttttttttttctgagacagagtctcactccgtcgcccaggctggagtgcaatggtgcgatctcggctcacggcaacctccacctcctgggttcaagcaattctcctgcctcagcctcccaagtagctgggtctacaggcgcccagcaccacgcctggctaatttttgtatttttagaagaggtggggtttcaccatgttggccaggctggtcttgaacccctggcctcaaataatccacctatctcggccccctaaagtgctgggattacaggcgtgagccaccatgcctggccgaaagacattttaatttgcattttacattactagggaagtaagcatcttttcatttgtatattgtccatttgtattttgttaacttcctcttaaaatttttttattttgtaataattattttgagacaggatctctgtcacccaggctggagtacagtggcacaatcacggctcactgcagcctcgacctcctagcctcacgtagtcctcccacctcagcttcctgagtagctggaactacaggtgtgtgccagcacgcccaacttaatttttttttcctttttttttttttgtagagatgaggtcttgctgtgttgcctagactggtcttgaactcctaggttcaagccattcttctgccttggcctcccagagtgctgggatttatgggcatgagccactgtgtgtggtcaaaaatattttttttactgtggtaaaaaaacatacaacatttattatcttaactgtttttaagtgttcagttcagtagtgttaagtatattcattcacattgttatgaaatagctccagaacttttttcatcttgtgaaaccaaaactatccagtaaacaactccccttatcccttccctgcagccccagcaatctctattttactttctgtttctatgaatttgactcctttttttttaagatggagtcttgctctgttgcccaggctggagtgcagtggcgtgatctcagctcactgcaacctctgtctcctgggttcaggcgattctcctgtctcagcttcctgaatagctgggattacaggtgtgcgccaccacgcctggctaatttttgtatttttggtagagatggggtttcaccatgttggccaagctggtcttgaactcctgacttcaggtgatccactcacctcagcctcccaaagtgctgggattacaggcgtgagccactgtgtccggccgaatttgattaccttttatacttcatataagtgaaattatacagtatttgtccctttgtgactggcttatttcatctaccataatttcctacaggttcccccatgccatagcatgtgatagggtttcctttttaagactgataataccgcactgagcgtatacaccacattttgcttatccattcatctgttgagggacatttgggttgcttctgcctcttggccattgtgaatagtgctgctgtcaatacaggtatgcagataccgcttcaagatcccgttttcagttcttttagatttatacccagagtgagattgctggagcagatggtagttctgtttctgaatattttagggaaccgctatactgttttccatagcagttacaccattttgcaatccctccaagtgtacaagggtcccagtttctccatatcctcaccaacacttgctgttttgttttgttttgtttttgatactagccatcttaattgtggttttgatttgcgctctttgttgattagtgatgttgagcacttttgtgtgtgtgttttggccactttgtgtatcatctttggagaaatgactaattcgggtcattgtgcctatttttaaaatcaaattactattatttgttgaattgtagttctttatatattctgatattarcaccttcttagagatacaatttgcaagtattttctccgaatccggaggttgcctttccactctgtggattgtgtcctttgatgtacctgcctgtttcttttcatctgttccagcttcctgacctattaagcatgcttctgagatctctaaggggaactaatttagagggtgttaagagttctttcaggttttaattttgttgacctaatgaaagtcatataatttagaatgtatggttagagaaaatacacctgtgtgttaatgccatggtgctttgctgtaaggccatcatcgaaatcttagtaatgactggctgggcayggtggctcatgcctgtaatcctagcactttgggaggccgaggtgggcgatcatctgaggtcaggagttcgagaccagcctggccgccatggcgaaaccccgtctctattaaactccatctttactaagtgccgtctctactgtctcaaaataaaaatacaaaaattagctgggtgtggtggtgggcgcctataatcccagttacttgggaggctgaggcagaagaatcccttgaacgtgggaggtggaggttgcggtgagccgagattgtgccactgcactccagcctgggcaacaagagtgaaactccgtctcaaaaaaaaaaaaaatttgtaatgaccaataggagaactttaaacaaactttagacaaattccatacacacagaaatagaattttgtacatgtgattgcatgggaaggatggcttgctttctgggggagttccctatggtaatcatttaaaagtctgtctttctgttctctgcagtgggaaagtataccttaaggttacctagatggcttcagatcttcaagaaaaaagttaaaaagaaagaagactctagcacatcctaattattatagttcttaagaagcttacggctcctgcccctgacttgcgcagcagttcttcagtgcagtgtaccatgagcattaatgtcttgggggctctgtacagtgttctgtaatatcggaatatttagggtacattgaaaatgtgcctggattataaagtactgcatttgtatggagtcttatgaacacatctgctagaagaagggagctcctcccaggcccagtgtagactggagtcgaggtggaggccaagcagaaggcagatctgccatggtctgggaggtggccgagttaacacatggggtcctggaggtgtcagtttcttttggccgtttcctggatgaggagaaatttgttgtaaattgctcttaggtgtatccatgtgctccacatgcccaggcatgtggaggcacagataaggattttggagggaaacagcctacccaggctataattgctttgttaaggggcaggttccctaatccactcttggagccttgtttctcatctggctaatagggccagtgatgcctgcctctcagtcgtggcaaagagtaaatgagttaggaggctctgtaaagcaccaagcatagggctggttaagtagtagctgtaataagtacaagtgagaatgttcatttcacttagtgggtttcttctgctttttattctcagagcgcactgtaaggatcttctgacagtttgctgttattgatttatttattaattgagactgaatctcgctctgtcactcacgctggagtgtgatggtgcaatcttgactcactgcaacctctgcctcctgggttcattcaagcaattcttgtgcctcagccttctgagtagctggaattacaggcatgtgccaccacgcctggctaatttttgtatttttagtagagatggggttttaccattttgtccaggctggtctcgaactcctgacctcaggtgatccgcccaccttagcctcccaaagtgctgggattagtttgccgttttttaaatgaagatcctgtttcttaaactctgcttcaggtattaccagagaaacggagtctgaaactcttgaagagccacaatctcaatgtgaattggtacatgtactgccccgagagcgccgtgatcttgctgtctaccacggtcctggagaatgtcctgcagccttttcactttagggtaagaggaagcctcccctgaaaaaaacacctttccccagttgtcccctgttcctgtagcatcctaatgtgtcaggcacgttagggacaggttcctctagccgtaacgtcaccgctctgaccactagagggcactctgtatacccgtcagctcctggagccattcattctatgctgggcagacaggctgtgagaggacatgggggacggtggaaaggatccaaagacgaagtctgtgtttatccttgttggttttacacagggaatgatgaaacattgaaggggtttaataagcttttcctaaaacattttccccctaaacaggctggcactatgtcgaagctgcccaaatttgagattgaattaccagctgcgcctaagtcaactaaacccagcctttccgaaagagacatcgcaatggctaccatgtatgtccgtgtcagagagaattccatcctgtgattgctttcagtaatataaataatagaaggagtgtgttacaagcaccacgtgatgccctgacccctagaacacataaggaggactccccttgttctgggtattcagtgtataggtcctgtgaacatagaaaacctgcagtgtttttggcattcctttttgatttttatcagctttgtgatgctaaggaattcctttacctttctagcctgataaaacaagaacattgaaccaatttatttcttagtatctttgttttagaatttcttcttctttttttttttttttcgagacagagtcttgttctgtcccctaggctggagtgcagtggtgcagtgtcggctcactgcagcctccacctcccaggctcaaacgattcttctgcttcagcctcccaagtagctgggattacaagtgtgcgtcacctcgcccggctagtctttgtatttttggtagagacagggcttcaccatgttggccaggctggtctcgaactcctgacctcaagtgatccacctgccttggcttcccaaagtgctgggattacaggcatgagccactgtgcctggccaagtttattttttttaaaagctcagttaaataataattgttctaaataagaaaatagattaagattttatgtaacagacatggaactaaattacgtatatatagaggtatattttcttttactttttttttttgtttgtttttgtgatggagtcttgctctgttgccaggctggagtacagtggcacgatcttggctcactgcaacctccgcctcccaggttcaagcgattctcctgcctcagcctcccgagtagctgggactacaggtgcgtgccaccatgcccaactaatttttgtatttttagtagagacagggtttcaccatgttggccagggtggtctcggtctcttgacctcttgatctgccctcctcagcctcccaaagtgttgggattacaggcgtgagccaccacgcctggcagtacggaggtatattttcatttgaaaaagtggatatctcagtttttaartttgtaatgaaaattttaaacacacaatagagactaataaaaaagaacccctgtatgcctgtatctgattcgacaatagtcaaaattttgcttctaagttacttctgattcttctgtggcctaaaacagtggcccaaactttcaaactttatggtagttagtataatgttctttcatttcttcttcctttttttttaaacrtactcttctgtggcattcctgtttatttttaaattttttttggagagtgtcgctctgttgcccaggctggagtgcagtgttacaatctcagctcaccacaacctccgccttctaggttcaagtgattttcctgccacagtctcccaagtagctgggactacaggcgcatgccaccacatctggataatttttgtattttctgaagagatggagtttcaccatgttgcccaggctggtcttgaactcctgggctcgggtgatcctcccgcctcatcctcccaaagtgctgggtttataggcatgagccgccgtgcccagccagcattcctgtttagacaatagataaagtgagagcagtcctggctgaagtggaggtggggacctgttccctcccaccttggtctcctccttgtccctgggcaggcccagcacagagtttaccactggactagaatatgcattcaggaactgttcacagcaacatttattagatggcacttaaatagaaaaggctgagcatggtggcacacacctgtaataccagtgactggggaggccaaggcagggggatcgccttgaggccaggagttcaagaccagcccgggcaacatagtgagaccctgtttctacaaaaaaatttaaaaattagccaggcacggtggcacgtgcatgtagtcctagctactggggaggctgaggtgagggaagatcgccaaagcctaggaggtggaggttgcagtgagctgtggttgcaccactgcattccagcctgggtgacagagggagaccctgtctctgaaaaatgaaaaaaaaaaatagtgattatattttcctgttattaaggaatatacattcattatacaaaacttggaaaacagagaagaaaatgaacttagcatatcactcaagtataactattacatgtgtttctttccaatcattttagactctatgcttaggtttggggttttcttttaaaatattatgatcaagctgtgtttagtgtgtgttctcttttccacttaactttataataggctttgagtaactgcatgtttctttgtaaacacttgttggcagcaaaatactccattaagtgaatatcttataatttacttaaccgtgatgccatttagaacaaaggaattttgaatggccagatgtgatttatgtctgtttgttccctaattagatacgggcagctgtatgttctcttcttgaggcatcattctcggacctccaacagcacaggagcggaggtggtcctctatcatctaccacggtagatttcatgctttgttttccctctctctctgattttaaaatgtgaactgyagcttgttgatctgttttttgctttctatcctacagagaaggtgcctgtaaaaagatgcacatattgaagttaaataggacgggaaagtttgccctgaacgtggtggacaacctggtagtcgtgcatcatcaggatacagaggtacaagctgtctgcgtttctaccaaagttaaggttgcttaaaagccttgtgaaaattggtggctgggcacggtggatcacgcctgtaatcccagcactttgggaggccaaggcggacagattgcttgagcccaggagttcgagaccagcctgagcagcatggcaaaaccccacctatataaaaaatacaaaaattagccgggcgtggtagtgcacgcctatagtcccagctacttgtggggctaaggctggaggatggcttgagcccaggaggtcggggcttcagtgagtggagatcgcgccactgcactccagcctgggtgatggagcaagatcctgtctccgaaaaaaaaaaaaaattggcaaaatgtctgaataagactagaaagtgcatttttatgctaagagttttggtcttccagatggaaatgggtttggtagtctyaagtagtttagaaaaaagtgattgtgtcagttgattaaagataattcaaaactatttcagaaactaacgcttgagatttgaccttggaagaaggtgggaatccgctccattccacgagtacttgaactctstgttgcaattgtgagcatggatgacagtgctgggggataatggttttgaggccgtgtggaccaggacaactagaatgggtcctgtgggctgggcctctgatataaagaagctgcttmcctcctctaccctcccagagggtggtgacgctaactctgtgacacgtgaggatgtttccagttgaaatgacagagatctgcttaggtcactttgagtgagctcatcaaaggaagcatgtcataaatgcaggaaatacttgtgagaggagataaaaatattaaaagagagttgtgatgttaatsacaaattccttctcaagtaagagctagcctgtagggwggaaatgcaaacacaggcttttaaactgatttaaacagcaagatgggatggaatgaaagcaactgggcaaaccatgattgattttggcctcagtcttgtctttttcccccccagacatcggtaatattcgatatcaagttacggggagagtttgacggctccgttaccttccaccaccccgtgcttccygctcgatcgatccagccctatcagatccccatcacaggtaacacgggttctgtagaggagtctgtgctgccctttcaccatgtggctgtgttctcaccatgatctttgggagtcacgttaaaagtggagtgaggaataaacagagattcccagatctgtctgattttgccaggggccatttgttccagttttgttgttgttttgagacagtctcactgagtcacccaggctggtaggtagtgtcgtgatcttggctcactacartctccacctcctgggttcaagtgattatcctgcctcagcctcccaagtagtggggattacaggtgtgtgccaccgtgcccagctaatttttatatttttttaaatttatttttttgacagagcctcactttgttgcccaggctggagtgcagtggcatgatctcggctcactgcaacctccacctgtctgtcacaaggttcaagcttgtgaggtattcaagcaattgaaccaagtattcaatcgcttaaatacttgtgagaggagataaggttcaagtgattctcctgcctcagcctcccaagtagctgggattacaggcgtgcaccaccacgcccagctaatttttttgtatttttagtagagatggggtttcaccatgttggccaggctggtcttgaacttctggcctcaagtgatctgcccaccttggcctctcaaagtggtgggattacaggcatgagccaccacgcctggcccaaatttttatatttttggtagagatgggatttcaccatgttggccagactggtcttgaactcctgacctcaggtgatccgcctgcctcgctctcccaaagtgctaggattacaagtgtgagccaccatgcccagcctgttctagttttttaaaaaatgcaactactactgatcctataagctaaaattatgttgtgaaaaaagcattttctaagatagatgaatctcccttgggaggaaatagaataatttatcttccctgagctttagaatggatagttttgattagccgttgatggtgaaatatgttttaatattgaatacacccgtaacgttttctgtttgccttagctctgtaaygctgaaattaactttggctgtaggtttgttactgtaacctgggatcacttttctctttctcacattccgtgtgacagtgatgatgaatattgcattctttgggactgacagtcamagtaagtgcttcggctgtggctcttaggcttacccaaatcagtcctccttctgtctggagaggtggggttgggaagtcagaagagtggaggtcaggaattcaggaaaagggaaagaagtcatttatttgcttcgttttgcctttttccagtgtaattgattttaagatagaactgaaagaatattcaacacacactctctctcttttttttttttccttaaacagaactttattttctcacagttctggaggctagaagttcaagatcaagatgtctgcaggtttgctttcttctgaggcctccctcctggcaggcctctttgcagatggccaccttctcactgtgttctcacagggtctttcttctgtgcctgtccctcgcagcagtctctcccggctctcttttgaaggagattggagtgcagaattggctagtctgaggtttcagtgtgcaagacgtagtcagatggctcacatttggaaccctrgtagtaatgttttattctttgtccgatggcattgggcgggttgacccagcctgcagtcaggatttccttgtaccgttcacccgggagttcagaatcgcactctggctgaaagttcagcaagagcaccattgtcagcctgactgccctgtcttgctggaccagccaaaagcttagttactttctggcacagttggaggaaggagctggttcttaacagacgttcaattaggtcttttkgctttctgtgttctttcaagcttcttccttttcctttgtaaataatgttagtattgaaagaatagattttgccaagtgattgtcttgtgtctgctgcccacttggcatgaaggtaactgctggtgaattgggggaaaaaaactaaacatttagaacaagcctgtccaacccacggtctgtgggccacatgtggcccaggacagctttgaatgcagcccaacacaaattcttaaactttcttaaaacattatgagatttttttaatgatattttttaagctcatcagctattgttagtgttagtgtattttatgygtggcccaagaccattcttcttcttcctcttaaggcccagggaagccaaaacattggacacccctggcttagaaccttcagctctgttccggtggtacaggaccagttaggaggcatcaggttctaaccatctggtcataagggaacagatgcgaggcctggtcacagtaacagcccgtgcagagatcaataggaggaaatcaggaatccactgagggtctggggatctaggtagtgtgggctgcaaagcattttcagaggttagtgactctccttttgtttcctgctgggctgtgagccctggcggcttgatgcatccgtgtgtcttgcccactgtgctgccactgggtgggcgtgctcaggaattgaatgggcctgttgagaaagatataaccagcacttttgggaagagtcagccaccctttttctttttgttttgggcctgttagaacagtgggtctcaatctgactacatattaggatcatctggggggccttaaaaatgaaagctctcacctgacagtgtgtaggtcagccacccaaaggtgagggctrtgcactcggcgcagaccttgacacttaggtccaaagcgcgagtgctcttcgccaaagcttgtctgcctgggctctttcctacctttgggtggtctgttcacaatgaccctttctctgaccagctgattgaaacctgccttctgattgtacctgggtaattggaacagaaccaggagtcatggttagcttgtagggctgcctgcatggctcatgagcagtataactggttgttaacggtccctgtcatgtgaggttttgggggtctgcttcccagacgagctcactgtgcttggacctactctatgcaatggataatcgaactaattatttagataattaagtggctgggcacagtggctcatgcctgtaatcgcagcatgttgggaggctgaggtgggcagatcacttaagcccaggagttggagaccagcctaggtaacatagaccttgtcttcacaaaaaaaaaaaaaaaaaaaaaaaaaaagaaaaaaagttagggcatggtcacatgcctgtagtcctagctactctgaaggctgaggcaggaggaccacttgagccaaggagttcgtggttatagtgggctatgatcaactactgcactcaagcctggacagcagagcaacaccctctcttaaagaaaaaaaaagataattaagctacaagccacatttatttgaaacattctccgtggatgatctgggtatttgattttgaatccttcaagtaaatttctcagttccttaacgtgcatatgtaaacgatcatgagtcatctttggttattaaaaataacccaaaccacagtgattgaagccttgacatgctttctttttcttggtgagattttcctggattgtyagctccttcccccttcctccccgtacgtgctttcagtgagacggaacagttcatttcttccktgactacaattgaataaacatttcgtaatgacattaaaaagtattgacttttgtgtcataagtaccagcatttgcagcattttctgactgcatcgttgcacttatgttttctcaatttgtaggtcctgctgccgtgaccagccagtctcctgttccatgtaaactctgtatcctttactraggtgtggcaccgtgcacaacagggcaagtggtcaccctcagagagtggtcctgaagtcctcctccgggcagctgtgaataamactccgagagccaccccgcaggcagcttccctgactgtccaggggcctygcgtttagcgtggactcagtacatggtgggcaggggcgagtgctagcggaaactgggtttgctttttgtttycatcttttcctggtttagaatttcctataacatgtggattcttcatcttggattgtctttcaacctgacatcattatcagcgcaagccaaggtaggtcagcggggacagttgtcgtgttacaacatggtgcttgttgactttggatcccagttgtagccagggacgttttcaaggtgaatctcttagaaatgacccctcctttcaagcgtgggaatgggatttttttttttcactttatamgttttttactatatgtgcattttatcaagaacatatactacttttaataattaaagcaacaactaagaatgccattctcctgcttaagcccattctggaaaagccagactccaccccagggtggatggaaagccggactccaccccagggtgtctccctcatttctcccatcraccttcccaccggtgtccgtgcccttttctgttctgcatgagcccgggaggtgtgctcctctttctggccttgctgaggaagcctcctcagtctgttaattgtctcttcctgggtaatytctttattagagaaatcttttttttttttttttttttttttgagacggagttttgctcgttgcccaggctggagtgcaatggcgtgatcttggctcactgcaacctccgcctcccgggttcaagcgattctcctgcctcagcctcctgaatagctgggattacaggcatgtgccaccacgcccagctaattttgtatttttagtagagacgaggtttttccatgttggtcaggctggtctcaaactcccaacctcaggtgatccgcctgcctcggcctcccaaagtgctgggattacaggcatgagccactgtgcccggcctaaagaaatcttatttttttaaggcagggtcttgctccgtcacccagcctggagtgcagtagtgctatctcagcttactgcagccttgagctcctgggctcaggcgatcctcctgcttcagcctcccaagtagctgggcctacaggcgcacatcaccacgcccagttaatttattataataataataataattattttgagacggaatctcgctttgtcaccaggctggagtgcartggtgccatctcggctcactgcaacctccaactcctgggtttaagcgattctcctgcctcagcctccccagtagctgggattacaggcatgcgccaccacacccagctaatttttgtatttttagtagatacggggtttcaccatgttggccaggatggtctcgatctcctgacctcgtgatctgcccacctcagcctcccaaagtgctgggattacaggtgtgagccaccacagccggcctataattttttttttgtagagacagggtcttgccatgttgcccctgtgtctctaatacctcgccaggctggttattagagaatctcctatgttactctttaatcctctgtgtattttcctgcctttcctctggaattcctaagaactcttgaggagagaattagccctgatgctgtaggcatccactgtatgtaatgcattgttgtgccttgtctgtaacccatagcctcatgtgacatccactgtatgtatgtaatgaagtcatttctctcctgtgcatctcgctggtgttttcctgtacagctgctctgtacctgccttgggccaactgaaaagggggtcacccagatgattttttatgtggcacttcattctcctgtggcatcccaattgggaaaggccacaccagatgctggcagtgtgggtgatcagtacatttatgggtcgatgaatggatgagttatgatgttccattgagagcctctggagttaccttttaaactaatgagctgttgtaggagaaaccaaagcacaggactgaagttgatgccacgtgttgacatctttttctattttaaacgttaaaagaggggctaggtctagggaagtccccgtttggaatgaaggactaggagctacacctttgatgtgcccctgaatgcagaggttacttggaaaagagtcagccaggtgtgcggtggttgggctgtcatcctcctgtggtagacacgctcctgaattgctcctgaatggctcagctctgctttggttaggaaggaaaagctacactgactgtactttgcggctttttatcaccacctgccacccgccccgcagatgtttaggggaaccacttttgggcttttgttacggtttgcatcatactgttttatttgctgcctcttaaaatccaggttacctctggaacctccaagtgaaacttgagcccatagtaaatctcttaccagacaaaggaagactcatggactttctcctccagagaaaggaatgcaagatggtcatcctgtctgtctgttcacagagtaagttgaatccttcccccttgctctgattccagtgtgaggcctgtgctgcccaacactttttatcgggatgtgggctacattgttgtgtcttgtctgtgacccacagcctcattctttatgtgaggggtggctatgtgaccccctaggaaaggctgctaaatggaaagatgatttgtagagatactggtagaaaagaacaataaatgggatggttctgaatgaaagtgggcacacaggaggggagtgggccaccacccctggccttcacacacacctctttcaaaatccaagccactcactgcatatgtgtcttctttaagaatcccctactgaggccaggcatggtggctcatgcttataatcccagcactctgggaggctgaagcaggaggattgcctgagcctaggagttcgagaccagcctggacgacaacatggcaaaaccctgtctctmcaaaaaaaaaaaaaaaaaaaaaaaaaattagctgagtttggtggtatacacctgtggccccagctactccagaggctgccgagggaggattccttgagcccgggaggacgaggctgcagcgagccgtttgtgtcagtgtacctccagcctgggcgacagagcaagaccctgtatccaaaaaaaaataataataataatcccctaccaatatgtgctgttggtgtttgtttttgttttggtatagatggggtcttgccttgttgcccaggctggtctcaaactcccagcgttaagtgatccttctgcctcggcctacccaaagtgctgggattataggcatgtgccactgagcctggcctgctatagcttttttttttttttttttttttaaccgtaaccagaaaggggttgcgaatgacatctagctgtcaggtctttaaagtattgtatttcttaragtgtcctttaaaggtacttttgcattggtaaccttttgagattagtttttatcatagcaacgtgtggaaattctgaagctgacatgaagttggtttgatccgtgtgtgaacattgtgcctttccagtgttaagtgagtcagacagagcatcgctgcccgtgatagccactgtttttgataaactcaaccatgagtataaaaagtacctggatgccgascagagttatgcgatggtgagttacatggagtatgacaaagggtcctcctcccccaccccctcccgggtattttctaagtaattatgatgcaaaattgtttcctatatattagaataaggtcgctgagatttgccgcctgccatagggcaaggtggcagtagtggkggatagtggaggagtagtaaattcagggtccctgcatcccackagctggcggctgcatctcacttcataccttcactgtttttgtttttcccatctgtgtttgatcttgcctgtagatccttggtctactgttatagatgagaaaaatcagtctctgctttgcaatattttgtatatttttctgttatgccagagtgaggacttagaaaattaaattagaaatatttatatttgccacacctttcttcccttttgggaaagaatcctgttgagatagtgacgattcagtgttagcacttagcaggcgtgtttgtagtcaaggtaataaccatggcttatcgccaccaattcccgctgtattacttgtacatcatatcttctgaagccagaagaaaagtttaggacaaggagaatgaattatttcaattccaggatctgattagtcctaggctgaaaatggttttaaaccaacaaaagccccagaactccactcccctttagctgttcatggaagggtaagaggtctgagacaggcactgaagagggccagttgctgggacagtgtccattcctacgctgccagacgtgagggatggcyragtccttttggactctattgctgtgggtgttctgggctgtgggaatcagtaggtctgatcccaaatggcagtttctgtgccgtcccacacggtctgctgggctccataaaccgtcatgactcagcagtgtgggccactgaccagccacatgagcagcatctggagtttcttggaaatgcaagttctcaggctacaccccacagctattgcataatctgcacggatctgaactgcttttttttttttgagacggagttttgttcttattgcccaggctggagtgcaatggtgagatcttggctcaccgcaacctctgcctcctgggttcaagggattctcctgcctcagcctcctgagtagctgggattacaggcatgcgcacaggaaaaagttgtatctaagtagagaaagtgttttccgctcatatcctgggtccacatcgaagaattcagtccttgtggatgaactgtaaacagcacccttcctctaagatgcygaagatcatagtttgtggtttttttctttcaggcrgtggaagcagggcagarccgaagcagcccgctcctcaagaggccggtgcggacccaggcggtgctggaccagtcagatgtgtacacccatgtcctgtcagccttygtggaaaagaaggtgggcygcagctttccgcctcttctggactgagaatgctcaaaacaaggaagttgctgaaaacgaggagacttcatgtgattagagtcacttgaagtgattagaatcactggagtttccttgggtgaggccctagagctggtagtttggcttctaatgctgaggcctaaagcataattgttgacgggtggttctggagcgatktgtgcaaaaccagtgaaagatgaacactgggccattttaagatggaaacaaggtgggggttggatagrgagttatatgcagcctcttttgcacctcgttggtatttgtaagaccacatttttttctccctaggagatgcctcataaatttgtgatagccgtgctgatggaatacattcgttctcttaaccagtttcagattgcagtacaggtaccttcaaatcatctgggcccaagttaaaacagaaggaatttaaaaaaaaaacacagtcactgtcttagaagatgactcatatgctaagacaggtctgcctccctgactcagaatgctgagtgactcctgacattattagttggaatgggaagtgtaaggtcaagttggggtctttacctgcatgacgaaaccacttcttgtaatgacagacttttactgtgttggttagaatagccagtccttggggagcctctagtctgttgtagctgaatgatttggaagtgttctttcactttttacttttgtcctcagcattayctacatgaacttgttatcaaaacccttgtccagcacaacctcttttatatgctgcatcagttcctgcagtaccacgtcctcagcgactccaaacctttggtatgcattgccagatttttacttccattgtggttaaaaatggaaaattttaaccgttatctttccaactgaagtgggtctaaaaatgtctttcaggcttgtctgctgttatccctagagagtttctatcctcctgctcatcagctatctctggacatgctgaaggtaactctgatgtgtgaggttttagactatggaaactaactctgttcctgttgtttgcactgacctggacttctctcccttactgctagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggtgagaatgcaatgaaaagacttggggtaaccatagcctcaaagagtagcagagggcactggcagctggtgggcgaggaccctgggttagcatttttgtaaacaacacaatttgataacagcccacctagcccttggcccattatttgtagtagagtgaattcagtatactgacagaatctgaattatgctctggaactcaccgaggaggtgtgttttgagtcaagacacatttaggacccagatcaggcacagcccatctcttatagcagatcttggaatatctcttaaagccaggaataagacggcaaatggtggctaagggttttaaagggtctggggcttattaaggtttcagttttatgaagtatacattggttgatcattctcattttttttttgagacagagtctcgctccgttgcccaggctggagtgcagtggtgtgatctcggttcactgcaacctccgctgggttcaagcgattcttctgcctcagcctcctgagtagttgggactacaggtgcgtgccaccacacccggctgatttttgtatttttagtagagatggggttttactatattgtccaggctggtctcaaactcctgacctcatgatccgcctgcctcagcctcccaaagtgctgggattacaggtttgagccaccgcacctggccctggttgatcattctcatctccaaatagttatacaacctaagacatcatctttaggatagggaaggatcagggctgtctaatgaaacttctaggtctatttctagctcaatgtaagacggcatttagttaccataaggacaggttagatagaatctcttccatttagcttttgtatttgtctctcaaagcagatagggtaaccccaaaacttaggaaaacaatgtattttattaaagaaaaataagttaaaacccagtagacacacctacgagatgctttctttgtccctcatttcatgccacatctaactggcaattaaatctcttcctttctaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactataaaatgttataaagtgtatctacaacctcaactgtcactaaaaatatggtatagaacttgtgggatggcttactcctaaaaggagagacagacagtgcattgattggcctttacagagtgtcagtgagcggatcacattcacagccatctagtgtcacctcctgcttgccaaagaatgaggtttctttcctgaagaggctgggagaagtttagtgtcctgtggttgcctccagatctagtaatactgcttcccaagtcaactgtgcattcctgagttcacaggcgctacgttcaaagctgctgccaaacaaccgatggttggcaccatccggtgttcaacttggccttgccgatgcagcacccgtccagtggtaaaccgaccgacccttagacacagttcagtcaggatgccctgcgagagggctagaaatttagaagccgttcgcgctctgttcctttgtatcgctcttcagtggcacaacttttggctttatttactgatggccctatgagagagagagactttttcttatttctgcaggagaaagggagctagttggctgggcatagtggctcacgcctgtaatcccactttggaagactgaggcaggagaattgcttgagaccagcctggacaacagagtgagaccacatctctctccctctcttttggagatgggctctttgctttcttcctcaggctgcagtgcagtggtatgaacacgactcactgcatcctaagcccacccttctgggctcaagcaagcttcctgcctcagcctaacaagtaggtgggactgcagacgcacaccacttcacctggctaattttatttttgtagagatggaggcctcactatgttgcctaggctggtctcaaacgattctcctgtctcagccttccaaagtgctcatctcttttttttttttttttttcttaaaaggaactagtatattagattgtaatagaactactttctatcccccggagatgataaaaagcccctcattttcttaatcttctacttcagtgcttcaatttagtgacaaagctataaatgaagcaaatcagtattgttctttcaaccgtgggtcatttttgtgcaaggtgaagtggccatagaagtaaaaggatcaaggacagtctcgagatgaagaaaggcagcaagcactttgctaagaaacgggaaatccatgagggacataaaaagctgttctgcagcactgctggtgtgagagctggctgccagatggactccttcatctcagtggcagggaggagctgccctgcctgctgacactcagatccattcaaggactggctccaggcctttgtgaagcagacagatcaggcctccagaaaaaacatcgacaacttcctaataaagtagtctgcaccatcatgaatcccctggatgggttttttcttttagaagaaatttttttactcagtatcatttatcattatcaaatgaccattagtatgagttcaaatacttgaaaagaatgcctcaggatagaattccctttcagtaatgtccttctattgtgccacccttttaagatgagaactcttacctatgtaactgagtaagacagggagaaatattaatccgtgagtggctcccagtaagaccatggccaaatacatcctgaagtagaatatctggaaaatttgagatttggcaaaagccaacaccacaatccctccaaattttgtaagtgtgattccactgaacacctaaaagaagagatactgtgttagaaaccacttttaccaacctgtaattgaacaaaaacacttccttacaaggatttctcccaggttcaagtgattctcctgccccagcctcctgagtagctgggattaaacaggtgcacgccaccatgcctggctaatttttgtgtttttagtagagatggggtttcaccatgttggccatggtctcgaacccctggccgcaagtggtccgccagccttggcctcccaaagtgctggggttataggcatgagccaccgtggccagcccttatggggatttcttaatattcaaggttcaaagcaatgggaactgaacccaggtagcatcatctactacctaacactatttgctgccttatgatcctgggggagaggtatgaccaagttaaaagctgtgtattctgcacagacactgcatcgtgtctcccaattgattatctttctttatattctcaggtgaaaacttaaatatttaaaagtgttacgaaacaaagttttagtttttactctttaccaggtattttctacagtggtaaagagataggctaagccagggtgtagagttgaaccaagacgactctccaggcaccaaccgcacatcacacgctgggttctggcccgggctcccctgcattttaaatgggaaagactgccagctgtctcatgtttaacttgtctgttattttcctgcttcagcacactgccacctaaaaaggagccgtaccaacaggtacagttccacagaacgtccgttctgtccacgatgtggcagctaattcatgaattgcctgaaagcttgcaatccttagaagctgctttgtaagtacaggatccagactcttcagtcactgaggaggattactttgtggtgcgactctgccggcgtggccctgctcagggtactcacggagctgcccatgtgggcaagtgcctcttccgcgcgctccacgcggctgcctttcatgctcaccgtgaacgctctggttatgtggctgcagaactccacggagatgccacagctctgaaataaagcacttcctttaggatggctctcttcctgttgaagaccctaggcagccaccccgttctgaggatgggtgctaattacccagggcaccctgggtgctagaggaggccaagcatcccattggacttacaaggcctccatcacaccaatcttactgtaccaggaactttttggggccctctctacacacagccaaaagcctggttttctgtggcacgtttgtgttgaccaggagaaattgctggaacccgttaaggtcaccccacccgcaccgagctggcgcattgtcacaacttcttttcttggacctcagtgctcccctatctgaagcagggctcatatctgagagtacggatacactgttctattttccatgaataccttctcgagtgctctcatctttaatgattaaaagtacctgataaccacataggaggcaaaaggcactggtcggagagctcctggggcggggtgcaattttctaagtaaaaagtgaacatcctgctgtcatcaggctacaggcttgtgcaatctctaaagaataacaaattacaggcagactagcccagaactaggccaggaaatcacatttccatggtcagaggcaccatcaggtatactagtatagccgcaaggaatgggacaagagaaaaaattgaacagaaattgcctgtaatgtgcctatgctcccagatgtccaactcaatgctcgctccctctatgccctgtcccaccaccatccagcactcctccagcactcatcctgcctctccatgtgtgccaagagcaagcgccagacttggtatcttactccatctttagggtttacatggaatctaagacagccaattcccccaagtgaaacaggagctagggacaaactgagactgtatgaggactcaccatcaccaggttgaccaaggatacagcgttcagactgatgccccagagccacataactccaaacatgttgaccaagaccatggcgatggtggcacacatgatgactgcagaccagagctcacagcccaggaggaccatggtcaccagaaatatcgcgcccagggacacaccgaggttgaagatagtgtcgtcaatgatggtcaggtactgttcgtagaagacataaaacacactggaggggagaggggaggcctcattaaagctcgctctcactcccgaacactgcgtgttcatcctgtcaccactgccaagtggtcagactcctttgggaaacatcccttgcagaaaaccttgctggctgtctacaagactcaccgaaagcaactcacttgacctctcatggccactgaccacccagagaagggcccagcagtgatgcaaaatgtatatttttgataaagtttctgtttataagcccaatctatgctattttatagacatttacagagagcattccacagcattctgaaaaaacacaaaaaaacaaagaatcctgatctatcctgagacactacctcaggctcagcggggtccgtgcaaggcctgaggaaaacatgctttcatttattttctgccagagctaaccggctcttaacttcttccaaacaaatccaggccttcctgctttaagcgagatcatggggaggcaggaaaaataaatcacttgtttctcctacctttctacagtttctaaattcagtagttcatacataatacttttcttcctgggaaaaaaaacccctaacaatataaaaagtctacatacaggcagcatcccaaataaccagcagttagggattctggttcattgttggccaagaatgtgggccgggccctgctctgagccgcctgctctccaagcgccccctgccttaagccattttccagtgtgtgtctcttgcagctgtgcagtggcgcagagatcaagttttgcgtctctagccctcaggccttcacagagactttagattctgaactcctttgcccagcacccatttcctttgatatactgccctgtgctcagaatggagcaggggccagaacccaacctgaaaatcagcatcttgccaagggaaccctccccactcccacccagtgtaggccctttgctgggtaaaccccattgaaaaagggcaggctttacctgtaaggaaatactcggtaggcactgccgttaatgcccatggtttcggtgacattactggctataagtcgggctttcttcagagcgtcaataaagtcagcagaggtctgcagcacggtgtggtaggtcatgaagtacgtggctccgaccctggtgccatggccaaggaggatgttaactgcagaactataggcagcatgtcccctgaggaaagaatcctgggtgtcaagagagtccaggtcttgcaaaatatcagcagaatctgagcacttgaggctaagcaaaatcacctgaccctggactcagaggtcagacccagctgtacatttcagggatgaagaaggcccccagataagggaacaccaaaggtttagcttgttctctcccagactggcttctttttttttttattttgagacagagtcttgctctgtagcccaggctggagtgcagtggcgtgatctcggctcactgcaacctccacctcccgggttcaagcaattctccctgcctcagcctcccgaatagctgggattacaggcacctgccaccacgctcaactaacttttgtatttttttagtagagacagggttttgccatgttggcctggctagtcttgaactcctgaggtgatctcaggtgatccgcccacctcggcctccaaaagtactgggattacaggtgtgagccacttcgcctggccagatgggcttttctcgattgctctgggttctttggtacatagctgctgtttctccacctggtttcatgtataatcaaaggtacagggtttactcagtcctgttgtgtaataggaagcaggaaagggcaagggccctgggaacaacctcagccctgccacttactggtcatgtaaccccgagcaaaatgaccacctctgagccccagtctcctcttctgtaaatgggtataccaccacctactcataggctgcgtgatgagaaatggaataatgtcagggagtgcctggcatgacgctggcaccctggaggctccccaggaacggtggctactgccttcagaaaaactgaatctacttcaacttattttacgtaggccaaagcatccagtcagtgagtaaatcaagctgcaagattca

SEQ ID NO: 17988 - DNA, 26069 bp, Homo sapiens
gtgaggcggaggttgtggtgagccgagatcgcaccattgcactccagcctgggcaacaaaagcaaaactctgtctcaaaaaaaaaaaaaaaaagagtttcctcagagcctggatcctcgctgctcttttccactcacacacccttctctccggcttcctccctcctcctgcttggatttggagtaacatagatctgggttgcagtcctgagtctacctgttcctgtgtgactttggacaaatcacttaacctctctgaacctctttcctcaactgacaaatgggtacatgacctagatcatctctaagggccttcctgctttctcagtctcctctctcaagcaccaggctcttgccccacagtctcttctcaaaaacaacttttttctttgtttgttttgagacagagtcttgctctgttacccaggctgttgtgcagtggcacaatctcggctcattgcaatctccgcctcctgggttcaagcaattctcgtgcctcagcctcccgagtagctgggactacagacgtcgccaccatgcccagctaatttcttgtattttttggtagagatggggtttcgccatgttggtcaggctggtcttgaactcctggcctcaagtgatccacctgcctcagcctcccaaaatgcttggattacaggcgtgagctaccgcacccagccaaaaacaacttgactgggtgaaaagaacactgggtaagagtcagagagacctggccttggaatctagtttccactggaactagctgtgtgaacttgagcaagttacttaacctctctgagtttccacttccttgtctatagaatggggatcctgaaacccaacccgtgaaactggaatgaggcttacctgaagtcatgtccctaagacatttagtgtctggcatctggtatgtgctacagaaatgttgactgttattgttattagctattattattcattatttattgactgtttgctctgtgccaggcattgtgtcaagtgtcttaagatgtactaactcatttaatcctcacagccatgctatgagatagctgcatcttatagatgaggaaactgaggcacagaagggttaagtaaattgctgatggtcacacagctaaaaagccatggaattgatccatgaacccaggctatctggatgcagagcctgctctatcacccaccaagctgcactgtctcaaatactactactttctggaagaatgttctctttgcttgtccaagcccagagagaattccagtaggggtgaggatggagcagtagctgaattcagttggtcaaatccaagggtgagaaagacgttcttaccctaacgcgagataaatgtccagggcattaacttgagctggcccaagtgcagtggcctacacaggtaatcccagaacttcgggaggccaaggtaagaggattgcttgagcttaggagttccagaccagcctagtcaacatagtgagaccttgtctccactaaacattttaaaaatcagccgcatggtagcacgtgcctatagtcccagctgcttggggaagctgaggcgacaggatcatttgaacctgggagatcgaggctgcactcagtcataatcgtgccactgcaccccagcctggccaacagagcaagaccctgtctcaaaactaaaataaaaatacaaataggccaggcgcagtggctcacacctgtaattccaacactttgggagggagtttgagaccagcctggccaacatggtgaaaccccatctctactaaaaatacaaaaattagccaggccacggttgtgggtgcctgtaatcccagctacttgggagctgaggaaggagaattgcttgaacctgggaggcagaagtttcagtgagatgagattgtgccacggcactccagcctaggcaacaagagtgaaactctatctcaaaataaaataaaataaaaataaataaataaaaataatttgggtcacccctgattatttcctgaccccacccctaatattttacccattgaaaacctgccaaaatgcaactgggaccagctttcttcaatgggggcagcagagagggtctgactgggatgtggctgtgtgtttgctacgagagtgaatttctgtgtttctgtggatgcatgagtgtgtggagtaggcgatggtggtcttgtctgtgtggctggactgtggggtcttcctcgttgtctgtctctcaacactgtggagaggcagtatgggggtgcctgtcccacctctcccacccacaggatgtgtgacccggggcaaatgactcacctctttgtgccttagtttcttcatgtatataaaaatgtggatgatgataataatagggttattctgaagattaaatgagattgcccatgtaatgtgcttaaaacagtgctggccacttatgagaaagtagctaataccatcagcttatatgtagtagacatgcttaagtgtgtaacctgtgggtttctgtatatttatacaggacacctgtggtgtacaatggagaggatatgagggcctggcggggacgagctctctgtgatttgtgggaggggatgtgcttatatgagtgtgtgcacaaacgtgtgtgtgtgtgtgcacatacatgtgttgtgtgtacagcagatgcctgcgccttctgcacatgtgcaaggacgttcactgccaggacccaggttaccacacaaacagtctccatccctaggacaagtcactgaggctcacgtgtgcctcggttccttcatctatacaatgggtggagtcactaccccaaagggagctgtgaggcccaagtgaattgaggatgtgaagttctgagccagtgcaaagtgccagttacataggagtggcttgtgctatgcgttctgagagagccgggcttacttgttgacactcctgggttcctaagtgccatggctgtttgtgtctgccttccctgggctgcagaatttgccctggtgtatcgaagatcccacctgttgttgtccgaagagccagaattgggaacctatcaaagagaaactgggaacagccttcttcagtgggggcagcaatttcagttcagtttcttcagtggggcatccaaggcccaaagaaggataagaacttgccttaagacacccagcacactggaggcagagacggggctagatcgaacgagtctctcttgtccttctggcatagtgggagagcccccataggggtcaggggtcgcagccctcacccctcactgctctgccctccccaccttccccagcatccagcaggaaggtcactgctccagcaggaaggtgtgtgctttggcagccgcactgtctgggctgcctgtggtgggaattccacatgtctggagaggacccgtctggagtagcccagtcccagcccccagccctgcttcgccagctggcccagggtttggcctgctgccccgagactaggttcagcctgggaatcctcagagcttgctagaagagtagtctgaggattgcaaattcttcacctgtgttttttatataacacctttctgttgtaagtctatccccttctattacaaaagtaatgcattttatttttggggaatacaagtaatgaaagaggagaaaattgaactctttcttaacctaggacttcagcaactcagagactgagactttaaacacacacacacacacacacacacacgcacacacgtccattatctacatactcatacattcacctggggacacatttgactcaagaacactcaaacacacacacatgtaagtatacttgcacacacatacacaagtgcatacatactctcacaagtacacacgtacacacaaacacattcacacacacattcctagagtgcacacagtgtgccagccactgtactaaggctccacaaatgttcactcatttcatcttcgcagtaatgctacaaggtaggcaccgctatttctcccattttacagatgaggcacacaatggttgagtaacgtgcccaacacctagttagtgagggggtgggataagggaaatttgaacccagatttgtgggcttaattcatttgctaatgaataggctgtgtttgagtggcatcataacgaacatcaccctaggcttttttccttatgcatctatatttggtttggttagaaaatggcatctttggctgatacaaaaaaattagccaagtatggtggtgcgtgcccgtggccccagctattcaggaggctgagatgggaggatcacctgagcctgggaggtggaggttgcagtgagccgagattgtgccactgcactccagcctggacgacagagcgagactctgtctcaaaagaaaaaaaaagaaagacagcctgtccaatatggtgaaaccccatccctactaaaaaatacaaaaattagccaggtgtggtggtgtgcacctgtagccccagctacttaggaggctgaggcaggagaatcgaggttgcagtgagccgagattgcgccactgcactccagcctgggcgacaaagtgagacaaaaaacagaaagaaaaaaaaaaggaaaggaaaaggaaaaggcatccttttagatactaaccaggcctggggtcagatctggacttaaatcctggcgtgattgcagactggctggcttgactttgggcttgttctttctcctctctggggctcagtttcctcatctatgaaatggggagctatagtacctgcttctgaaggttggctgggcttttgtgtaaagcactcagccctgggcctggcacatagcaggggctcactagatgggccatattaactgtctgctccaaggctggagggtgttatagggaaaacagtcagaaaatactctccagatgcaaggtggccttaatatgtcaggatgtggaaggcagagagaagcctcggggtctgggatctcccataggggatgagtattttttcctggaatccctgccctgttgccacatcactaccctgaccatttgcccagcccagccctacatgcttcaggtgaaagcagagagagaggggcgggagagaaaagcccatcaagcagcaggcggagcctccctgcaggagtctggcctggctggaaggggagggggctgtggggccagggacgtcagatgccaacagcaccaggggaccgttaaagttgctgcgccgccaggtgggccagggtgtctgcagaggtccccggcctcctgggctgccgcctgccaccgcttgggctgcccgtcctgggtacgcaccgttggagcctcctgcctggtctctcgtgcttctctgtctcttctctaagtcgatttttcgctctttcttctgtttgtgcccctctctctgtctatttctgtcctcccccagccacattgttgcctctctctcattctctcttatctctttacctttctatttctcattcttttttctctgtaactctttttttctgtcccctttttggtctctcttttttctctgcctctttcattctctgccattgggttttctctgtgtctcattctcaattcctaaattgcagcaaagcagggacaaaaggaccttgcaatatgacttggggtaaggtgggccctgccctccgagggcattgactgagcccgctccagcaggattggtgaagaggatgtctagactggagagggctgctgtctgtctcctgggctggagggacagagcactggctttgaagtggtggcaccatctcaccccagggccatgtctggattagccactgtctgggcatttcttccccttgcccaacccactcagtcccctggggtggaaaggaaggggtgctgggcatctggaccagagctgcatctggaggtctttgccaagttcccaggaggcagcatcctctgggtcggcactgttggagaacgctcagggtctggtgctctcgtgcctgccccttccaggcagccggctctgattgcacaaggcagacctgtgactcctccatccagctatgcccctgctgcccagcaccgtgggcctggcaggcctgctctkctgggctggccaggcagtgaaygccttgataatgcctaatgctaccccagccccggcccagcccgagagcacggctatgcggctcctgagtggcctggaggtgcccaggtaccgccggaagcgccacatctctgtgagagacatgaatgccttactgrattatcacaaccacatccgggccagygtgtacccacctgccgccaacatggaatacatggtgagtccccgtacctgccccccaccccccgcagtgtcccttccggcaaacgcagccggactcatcttggcctagaatgactggctttgaagagctggaccacttgcctgcctggccccactagccagtatctgggtgtcgacctgtggaaagggcaggagttaatctgcccattttacagatgaggaaaccaagaaggttgcacagctgttccagtgagtcaggcatgtgactactatgtaaggagcaccactgtgcgccaggcactgcacgtgagtatcatctccattttccagaggaagaaactgagactcagagaattaatttgcccagccaggatttcaatccaggtctgcctgctgccacctggcaccatcacaactgtaaccatcacaatcccctacccaagaattttggctccccacactggggacctgcatggggtgcgtggctggtgctttctatgctattgtctctttaccctaaggtcttgactgacacacccacagcatcctccacaagcccctggaggcaggcttggagcagtggggacaggtactggggaatctcaggctgaggaaaaccaacagctgaccagcagaggaagctgggatgtctcccctcaaagaggcagggctggtggctctcactccagcccccaagaagtcaaaggagggcaccaaccttttgcttacagctcctcccccagggccactgtccaaaaccagcctagagggatgggtttccagcccacccagagatgtctttagggaaagagtttgccagtctgccccctgaaagaccaacacatgccactcgatagcctgaaaacttaactttttcatcgtatccattgacttatacttggagtacacttgcagccaggcaccgtgctaagccttgtggatactgctggtaacagaatagacaaggccccttccttcacgaaggtgacattttagtgggaataagagaaaacaagcatgaacaacaagatattaatgtacataagataacgtgaggaggcaatacrgtgttgggaggggcgggaataagagccgggatggcaggcagctagagtgcaggggagtcattgacttgttcattcattcgttagcacctagaatgccctccatttttcaaacaaatggcacatttattgagcacccgttgtgcgtgtgtggcacctgccccaacaggtgtttaatgattgcaggcggcatggagcagagagggttcaatatctcaccagggactccagggagggcctgaacatgtaggtttgatgtttagcctgctccttccctcactttacccctttgtagcatgagggaagcactcctctgctctccctaaaagactgagccagagagccgggcgcagtggctcacgccagtaatcccagcactttgggaggccgaggtgggtgaatcacctgaggtcaggagttccagaccagcctggccaacatggtgaaacccagtctgtactaaaaatacaaaaattagctgggtgtggtgatgagcgcctgtaatcccaagctacttgagaggtggaggcaggagaatcgcttgaacctgggaggccgaggttgcagtgagccgagatccagccagcctggatgacaagagtgaaactctatctaaaaaaaaaaaaaaaaaaaaaatattgggccagacaaccctggtagatacctggacccctctttggatgccccatttctccctccctagctgacttctactcacagaacaggctgtccaactcgacagcctttgccctagcagcccttctctcactgccgcaagaaagtttggctcccatttctcactctcacaccgaccaggactgtaataatcaatgacttgttgaaggccttgttgccttgctaccctgagtcctcagtgcctagagatgttgtttgatatttgatgaatgaacaaatcctatttcagagaatcccaggaagtcagagatggaagggaactagtattttaatgacatattttctggttataaaacttggagaattcatacattggaaaattacaaaactgttaaggaggatgaggagggcattcaccatgtagtgatggggaataatcactaagacaaaagagcaaggtgcagaatagaatatgctgccatttgcctatatatatgtgtgtgtgtgtgtgtgtgtgtgtctgtgtgtgtgtgtatatatagagagctgcttgtacaggtatagaatatatacctgtatacagaggacacaagaagcagtggtgactgcctcttgggacggtgtgcagggtggtggggttgggggagaagtataggagagagatgagactttctactgttcctccttggttatctatttttgttgttgttgacacggaatctccctctgttgcccaagctggagtgcagtggcacgatctcggctcactacaacctctgcctcctgagttcaagcaattctcgtgcctcagcctcccaagtagctgggaccacaggtacacaccaccatgcctgactaatttttgtattatcattattatttttgaagacagagtttcactgttgttgcccaggatggagtacaatgatatggactcagctcactgcaacctcggtctcccaggttcaagcgattctcctgcctcagcctcccgaatagctgggattataggtgcccgccaccacacccggctaatttttatatttttagtagagacagggtttcaccatgttggccaggttagtctcgacctcctgacctcaggtgatccgcccacctcggcctcccaaagtgctgggattacagatgtgagccaccatgcctggcctaatttttgtatttttagtagagagggggtttctccatgttggccaggatggtctcgaactcctgacctcaagtgatctgcctgcctcagcctcccaaaagtgctgagattacaggcgtgarccactgtgcccaagcggatatcttacatattaaaattatgcatattttcacgatttaaaaaagcttttgacttaaccattttcaatgttaaaataaacacatttagaaaatactacaaggccgggtgcgatccacctgcttcagcctcccgaagtgccctgtaatcccagcactttgggatgctgaggcaggtgaattgtttgaggccaggagttggagactagcctgggcaacatggcaaaaccctgtctctacaaaaattagccaggtgtggtggcatgcgcctgcagtcccagctactcaggaggctgaggtgggaggatcgcctctcacctcaccacctcccactgtaccaggaggcagaggttgcagtgagctgcgatcgcaccactgcactccagcttgggtgacagagtgagatcctgtctcaaaaaagaaaagaaaagaaaaaaagaaagaaagaaaaagaaaatactataagtacaatttaagaattagttattttctcatccttctgggttcagtcacttctagggactgctgagaactcctgtacgaacaccctgggacctgctcagagcagagcccaagctcagagtcaagagatctgggtgtggaccccagctctggtatggactcatggttgcccttcaagtcatcagcgagctgagcctcagtcttctactttgtcacgtgggtttgttgcagggttccagggagatggggtagaaacggcaccaggtaaatgtgcatctctggacacagttstgacgatrgtggcrattcccctggggaatttcattgcctttctttccccaggtctgggacaagcggctggccagggctgccgaagcctgggccacccagtgcatctgggcacatgggccttcacagctgatgagatacgtgggccagaacctctccatccattmtggccagtgagtgaccctctgcccttccttcactcagtcattcaacaaatactcattgaacacttactctgtaccaggtgctgcacttgacactgggatacagtggcgagcaaggcagacaagctctccacctgcagggagcctgcattctagttagaaggggcaggcaaaaccctaacaaagttgtgtatacattgaattgaggcaagtcttgtttggtttgagaacaaacaagtgcacagattgtggtggaaagtgaggagggattggaagactaagaaaataggataagggggccgggcayggtggcttacacctgtaatcccagcactttgggaggctgaggtgggcagatcacttcaggtcagtagttcaagaccagtctggacagcatggtgaaaccccgtctctaccaaaaatacaaaaattagcccagtgtggtggcgcatgcctgtaatcccaagtactcgggaggctgaggcaggagaatcacttgaacctgggaggtggaggttgtggtgagctgaggttgcgccactgcactctagcctgagtgacagagtgagactgtgtctcaaaaataataatgtcaataaaataaaataaagataaggggataaaataaaataaagataagtctgagaatggcaaacccacccttctggcctgaccttctcaccgccattctgactgtcaagtcagattccggggaccttctgatctgggtagccttgggaagttatttccactttctaaaccttggtgtccctgtttgtaaaacaaagttgttagcctagctcagttctttccagacttgtggatttcacaggcctataaaattgcaaaaagaaatctgtgagactgccacacaattgtcagatttttattttgccaaataaggatgtyagaaaaacaactaccttcccatcctcgccattctgccatcaccccggggagagtgggaaagaattaaggccagtcccttcaagtgagctcagtggaaattcagggccctgtctgtgttttttcatgtccttcactggtcacaaccagcaccagcctctgagagccgtgaatggtcactcagagccctacagagcagacatcgggtgattcagtcctgcctccatttcactttccctctcccccgcygctgaactcttcctgccagactccacccctacccatggccaccatttgagaggctcacagagagaaagaaagcagtgttagacacgaagctgtgctgtcgtaaattatgaatgtgcattcttccagattttctccctctttagtcatttatgtatatttttatatatttgtgcccctgtcaaatatgtgtaatagaaaaagccctcagaggccgggtgcggtggctcatgcttgtaatcccagcactttgggaggcagaagcgagcggatcacctaasgtcaggagttcgagaccagcctggccaacatagtgaaacctcatctgtactaaaaatacaaaaattagccaggcgtatgcaggtgcatacctgcagtcccagctacttgggaggctgaggcacaagaattgcttgaacccagaaggcagaagctgtagtgagctgagatcacactgctgcactccagcctgggcaacagagcgagactccatctcaaaaaaaagaaaaagccctcaggtcctcccagatggcttttcagactacagaggttatctctgggtgacacaccagtatctgccttctcctcacatctcagaggcctaggagatcatccgaggagcccttcctttcctaaaaatgcaagctcccccgtctgagatgcacctcctgcccggccctctgtataacagtaacacgtatccttttttgaggacttaccacttgccaggtacagggaggcacttcacatgggttcagaacatgcctgtgaggcagggccactgccctcatgctcacagataggaaactgagatgggggaaaggaagcaaagtgatcacccaaggtcaccagcaagttggyggcygagccacttttccatcytctcacccagcttcttccgtgtcccccgcctccccaggtaccggtccgtagtggatctcatgaagtcctggtctgaggagaagtggcattacttgtttccggccccaagggactgtaacccacactgcccctggcgctgcgatggccccayctgctcccattatacccaggtactcctccgtcagggctgagggcccctgggataacacatcctggcgccttagaagaaaaggaatgtgtggagcagaaataagaatgcaaacaaagaccgttatgagcttcttttcaccaaagargcatattcctggaaagttgtgtgcacaatgaattgaggtgaatcttttttgtttttgttttttgtttgtttgttttttgagacagagtctcactctgttgccgaggctggagtgtagtggtgagatctcggctcactgtaacctctacctcccaggttcaagtgaaactctgtcccccccgcaaaaaattaaaagttatatatatataaagaaagaaaatgactgggtgcagtggctcacgcttgtaatctcagtaacttgagaggctgagatggcaggatttcctgaacacaggagtttgagagcagcctaggcaacagagaaagacctcatttctaaaaacctttttaaaaatagtgaggtgtggccatgcaaggtggctcacgcctgtaatcccagcactttgggaggccaagggggtggatcacgagatcaggagatcaagaccatcctggctaacacggtgagaccccgtctctactgaaaatacaaaaaattagccaggcttggtggcatgtgcctataatctcagctactcgggaggctgaggcaggacaatcacttgaacccaggaggcagatgttgcagtgagccgagattgcactactgcactccagcctgggcaacagaacgagactccgtctcaaaaaaaaaaaaaaagtgaagcttggtggtgcacacctttagtcccagctacgtgggaggctgaggcaggaggattgcttgagcccaggaggttgaggttgtggtgagctatgatcccaccactgcactccagcctgggtgacagtgagacccacctctctaaaaataataataatttaaaaaggaaatgaatagaaaagtatagaaaatatattggctggccaggtgcagtggctcatgcctgtaatcgtagcactttgggaagccaaggtgggcagatcacctgaggtcaggagttcaagaccagcctggccaacatgatgaaaccccatctctactaaaaatccaaaaaattagctaggtatgctggtggttgcctgtaatcccagctactcgggaggctgaggcaggagaatcacttgaacctgggaggcagaggttgcagtgagccaagataccaccactgcactctagcctgggagaccgcgagactctgtctccaaataaataaataaataaaaacattagtgactgtcaaaaaaaaaaagaaaatatattggctagtctgaaggtagtgagttctctcaattgattgtttacagtcagttacagatccaacttccttctcgcgactgcacttgactgagtgcagtatgaaatgaaagaaagaaaatatatcacacatgataacatgataaggctagtgatttgtaaaactcttgttcaaattgtgtgtatgtgtgtgtctgtttgtacacctgtaacaatataaaaattattccttactgttggttgtaataaaaagaaaacattgagaaacatcatgttacaatataaatgcctccgtttcctcccccaacaccttggaacaggcagactgtctctcccaggaagacctcacctaatgcaactgtacaaccccagggagcctgggtcccactgagcccttctcatagccccctctgtctctgtccttcaccagatggtgtgggcatcctccaatcggctgggctgygccatccacacctgtagtagcatcagtgtctggggcaacacctggcatcgggcggcatacctggtctgcaactatgccattaagtaagtgcctgcaccaaggcaaagagggccctggggccggcgggtgggtcctgagaattcaaagaaagatacgctccatatcccttcttcattctaagtgccctcaataccatataatttgggtagttttaagagtttactaaggccgagcatggtggctcacgcctgaaatcccagcactttgggaagccaaggtgggcagatcccttgagcccaggagttcaagatcagcctggggaacaaagcaagaccccaactcttaaaaaaaaaaattagctgagtgtcatggtgatcatctgtagtcctagatactgggggaggggtgaggcgggagggtcacttgagcccaggaggttgaggctgcagtgagccattatcatgctcactcatgagtgagaaactgtctcaaaaaaaaagtcaattaataatccattttttctttctttctttcttttttttgagaagaggccttgctctctcagccaggctggaatgcagtggcatgatctcagctcgctgcagcctccacttcccaggttcaagcaattttcctgcctcagcctcccgagtagctgggattacaggcgtctgccaccacgcccagctaattgttgtatttttactagagacaaggtttcgccatgttggccagactggtctcaaacccctaacctcaggtgatctgcccgcatcggcctcccaaagtgctgggattacaggagtgagccactgcgcctggcctattttctcttctttttttgagacaaggtctccctctgttgcccaggctggagtacagtggcacaatcacagctcactacagcctcgactggctgggctcaagtaaccctcctcacttcagcctctcaagtagctgggactacaggtgaatgccaccatgcctcgctaattttttgtagagacggtgtctcactatgttgcccaggctggtcttgaactcctaggctcaagcagtcctccttccaaggtctcccaaagtgctgsgattacaggcgtgagccaccctacccagcccaataatccttttcctttacccaagtttgagaatcactgggaaatagacaggattgacacaggtggaaagacagtgttgctgaagtcagtagtggagaatgtggcttacatctgccaatacaccagccaactaggcttacaaatatctcactactgaattagacctacacatccagtggcaggtaacactggatagccaaaggccccttcttagaagtacagtgccagccctctaagcttacgacaagaaaaatacagccaagaacacatgctccctgcaggcaggcagatcccaaagaaaaggaaggaggaatgagtgtgcttagcttctccagtttgctgggtgggagagtttaggagatgcctgcatacaagcctcttggaaacagggagcaagcgtaatgaaacttgcagacgttccagattctcatagaaaaacaagaacaggccaggagcagtgtcttacacctgcaatcccagcactttggggggctgaggcgagtgaatcacctgargttaggagtttgagaccagcctggccaacatggcaaaacctcgtgtctaccaaaaataccaaaattagctgggcatggtggcgcgtgcctgtaatcccagctacttgggaggctgaggcaggagaatcgcttgagcctcagaagtggaggttgcagcgagctgagatcacaccactgcattccagcctgggcaacagagcaagactccgtctcaaacaacaacaacaacaaaaacaaaacaagaacaaattctaagtaaacatgatatttagaatttctttttttcttttttcttttttttttggsgggggacgaggtcttgctctgtcgcccaggctggagtgcaatagccagatcatagctcactgcagcctccaactcctgggttcaagcaatcctcccgcctcaccctcctgagtagctgggagtacaggcatgcaccattacacctggctaatttttaacatttttgtagagatggggggctcattatgttgcctaggctggtcttgaactcctggcctcaagcaatctccctacttggactcccaaagtgctgggattataggtgtgagccacccaccgtgcctgccctagaattccaaaattatataataaccacattttactgtcacatagcctttaatcatttacaaactactttcacactatctcattgaagagatgaaagaaagaaggaaaaaggggggaaccctaggaggacattctttttacaaattaagaaattgaggctcaggcaggttgagtaatttaccaaatgtcacaaagccaacaagtagtagagctggttcagaagaatcagtcttttgattccaaattccaaattctttctattgtattattctgatgttcttgaagtcattagtagcctgaaacaaattctcaaaacaggatacttgttatttgttagaaatggcatctattgacaatgtgtcacgttacagcccagctttatcagagacagaaaaatacaagaaaccaaatttcattacaaatagcgtctaatttttttttttttttttttttttttggaggcagggtcttgctgtgttacctaggctcggaagtacagtggcatggtcacagctcacggcagcctcaacctcccaggctcaagttttctagtttgtttgttgacatatcaaatgtttgaagcattgagtgttatcagtatagttgttaagatttttagcctctggggccaagactaccagggttcaaatgtgtgatcttacttaacttctctactcctgtttcttcatctgcaaaatgggaataaaataatacccaatcttggaattgagtgagataacacaggtaatgcccccaggctcataagtgggaaatacagattggttactattgttattaccaggcctaggtttgattcccctctgcaatgcatctactaagcatttgaatacatcattttatcttgacaggcttcggccttccccttccccttcctttctttccttcccctttccttttccctttttcctttcccttttcccctttctccttttccctttctcctttcctttcctttcctttcttttcttctgtccagctctgtcacccaggctggagtgcagtggcagaatctcagctctgcaacctccacgttcctggttcgagcaatcctcacacctcagcctccccagtagctgggactacaggcgttcaccaccacacctggcttatgttttgttttttgtttttgttttttgtagagacgggggtctcgccatgttgcccaggctagtctggaactcctgggctcaagcaatctgcccacctcagtctcccaaagtgctgggactacaggcacgagccaccaagcccagcccctttaaggtaaatgctacctgctcacagaatttaaggattaaaatataaygtgaggccaggtgtggtggctcacgcctgtaatcccagcactctgrgaggccgaggcaagtggatcacctgaggtcaggaggtcgagaccagcctggccaacatagtgaaatcccatctctactaaaagcacaaaaattagtcgggcatggaggtgcgtccctgaggcaggagaatcgcttgaacccgggaggcggagtctgcagtgacctgagatcatgccactgcactctagcctgggcgacaatgcgagactctatctcaaagtaaaataaaataaaataaataaaataaaataaaataaaataaaataaaataaaataaaaatagcctctgtggtgccttgcccatagtacatgctaaataaatggtggccatgactagaaccaagttataaactcttgggcatgggaaatcgaccgttttcatttctatatccttctactatagtgattgcaatcctttgtttttttaagcagaacttttttctaagtggttaaattaaacaaaaaaagaactccatgtcatcccaggtatcaccaccacccactctccccgcccccaaacttctgagagcaccttttgagaactgtggactgacagcagccggcacaaatcctgatgttcaataggtgctccagaagtgtttgttgaatgactaaatgattgaatgagtcctgttaggaaaccagaagtgagtatttttctgagcacttcagctgatttcactcatggtcactcaacaatcacgtttggagaaaaaagattatatttctgctcaaaggtgtgttcatttaaggtgagaaaacaaggcactggggcttggcaaagaatgccacaggccagtggtgagattattaggcagccatgagcaagagctggaggaacaattttaggctttgaaaggagaaagagggagaaaaaggctgggcgcggtggctcacgtctgtaattccagcactttgggaggccaaggtgggcagatcacttgaggtcaggagttcgagaccagcctggccaacatggtgaaaccctgtctgtactaaaaatacaaaaattagccaggtgtggtggcacatgcctataatcccagctactcaggaggctgaggcacgagaattgcttgaacccaggaggcggaggctgcagtgagccaagatcgcaccattgcattccagactgggtgacagagcgagactccctctcagaacaaaacaaacaaaaagaataagaaaatcaacccttacaagggagccactaattaactaggcacagtgctaggtgcatacatacatgtgatctttgctgaattccttagagagagaggaggctcttctcttggttttacaggagaaaccaaggcttacaggttgggcacagtggctcatgactgtaatctcagcactttgggaggctgaggcaggaggactgcttgagtccagaagtttgagaccagcctgagcagtatagggagaccccccatctctgcaaataaataaaaaattagctgggcatggtagcatgtgcctgtagtcttagctactcagaagactgagctgagttgggaggattgcttgagcccaggacgtcaaggctgcagtgagctatgggtgacagagcaaaacaaaataaataaataaataaataaaggaaagaaaaaaaagaaaccaaggcttgcagatgtgacttgccccaggtccccagggctggtcagtggcagcgctgagatctggacatctgtgtgaaggttactcacctaatgctcctctgtctccctgggtccttttctcttccaggggcaactggattggcgagtccccgtacaagatgggaaagccgtgctcctcctgtccccccagttatcaaggcagctgcaatagcaacatgtgcttcaaggggctgaaatccaacaagttcacgtggttctgaattttctctggrctttggtgcgcctccagctgggcctgaccctccatgtcctgccctcaaaaaactgggtggagaaataattgtttctttaaaggatatgagttagaatcaccccctgttraattttccctcctagatccccttcttaaatgtccaacatgggtcaaaagaaaatgacctccttgccttccttctttcctagttgcatctttcttttcttgggcctctgggaaagagccctgcatctttcattaattcggttctcagagaaccaaggctggaaggcatagaactggcaccttgggaccaggcataatggctcacacctataatcccagtattttgggaggctgaggtgggagaatcacttgagtcctggagttggagaacagcctggaaagcctggcgataccccatctctatttagaaacaaacaaacaaacaaayaaaaaacctggcacctcggttttgtaactctcaggctttgtcaaacccaaatgactttgtccatccaatgaaaggaattccactgggtgcggcggctcacaccggtaatcccagcactttgggaggctgaggcaggtggatcacctgaggtcaacagttcgagaccagcctggccaacatggtgaaactctgtctctactaaaaatacaaaaattagccaggagtggtggctcgcgcctataatcgcagctactcgggaggctgaggcaggagaatcgcttgaacctaggaggcggaggttgcagtgaacagagatccagcgactgcattccagcctgaggacagagtgagactctgtctctaaaaaaaaaaaaaaaaagaaagaaagaaaggaaacccgctttcattcgtctcataacagtcaaccagtttctgggcagcctttgaggactcgtgattcgctccctgagttgggcacatttcaggcccatgattttgaaaaacattgaaattggcttgtggacatccgcccccccacccccactgcatggtactggagccacgacagagtccaggcccccctttttacagatgggtacactgaggctcagagcagggtgtaacttacccagagctgcatagcttgtctttgatggccaaggttagagctcagtctctcacagctccttcctgcttcctcggctctcagaactgagaagtgaaaaccaaagttggcctgaggggactctctctgggcctttttttctctatctctgcctcggtctctctctcttttgtctactgtccgttctatctctgcctgtttttgttttggtctctgcatctctgattctttttctcccatataatcttactctcattccaataaaccatttcccctctccccccaccatcccacccagggatcatagcacacaaaagtccttttgtctccagagatagtaaaatctcctccctcagaccttgccctgcagctggggcccactccctgcctggctggagagcttttcctttgaagacccgggatggaaaacaggcccttttccatggagtccctacgttgtcctggatggaatgaattttctcatcctgtgcatgtcaccccctcccattccacccccaataaagtcttttgagatccagtgtagtggctctttctggtccctccctctcttggctcccaagagggtcaaaacacaaggaatgggaactgggtgggggaagatgggtgagaggaaaaccagctcaactggaagaccaggggaaggaactaacagcgctttgggccccgctctgcagaaggctagatcaatgcacaagtgcatgcacgtatactattgctccactttacagatgagataaatgaggcatggggtgagtactagcttccaaatgctggaaatgagtgaaataagagaattaagaggttgggcgtggtggctcatgcctgtaatcccagcactttgggaggccaaggcggcagatagcttgaggccaggagttcaagaccagtctgggcaacacagtgaaaccctgtctctactaaaattacaaaaattagccaagcatggtggggcacgcctgtaatcccagctactcaggaggctgagacaccagaattgcttgaacccaggaagtgaaggttgcggtgagccaagactgcaccactgcactccagcctgggtgacacagcaagtctgtgtctcaaaaaaaaaaaaaaaaaagagagagagaattaaggacactgttgtgagttcattgttcttagactatatctttcctactttattttttggaatgggctctcgaaggcagtatcagaaatggaaaaccgaagagatcacgtggaattcccaccttacagtggcacttttggcttgtctcttccctggcacagtggctcatacctgtaatcccagcactttgggaggccaaggaaggtggatcacctgagttcaggagttccagaccagcctgaccaacatggtgaaaccccgtctctactaaaaatacaaaattagccaggcgtggtgctgtgtgcctgtaatcccagctacttgggaggctgaggaaggagaatcgcttgaacccaggaggcggaggttaaagtgagccgagatggcgccattgcactccagcctggacaacaagagcaaaactctgtctcagaaaaaaaaaaaaaaaaaaaagaacagatttaatgaaacttcttgaatcccagtttttacatctgtaaaatgggaatattgacagtgacaattcaatgacgttaagaatatacaatgctgacaaactaaagagttcataaatgccagtggttgtcatcctcattatcctggtgctcaggaaggcaatgtgagacctgttgaaatagcacgggctttggggtcagatgatgctgaattccagttctgtgttggctccttcgtagttatgtgacctcatgacgccacttcatgcagggggttacgtaccacttaaatctccagaacattttgggaaattgacatagggttagcaaacctcccccacccccatataaaaatattaatacttttttttttttctgagatggagtctggctctgtcgccgaggctgcagtgcagtagtgcaatctcggctcactgcaacatttgcctcctaggttgaaacgattctcctccttcagcctcccgagtagctgagattacaggtgctcgctgccacacccagctaatttttgtatttttagtagagatgggattacaccgtgttggccagcctggtctcaaactcctgacctcaagtgatccacctgcctcagcctcccaaactgctgggattacaggcatgagccactacacccgaccaagaatattaatacttttttttaaaaaatatcgaagttatttatttatttatttatttatttatttatttatttattttgagatggagtctctctctgttgcccaggctggagtgcagtggcacgatcttggctcactgcaacctctgtccccctggttcaaacgattctcttgcctcagcctcccgtttgccaccatgcccggctaatttttttatttttggtagagacggggtttcaccatgttggtcaggctggcctcaaactcctgacctcgtgatcggcgcgcctcggcctcccaaaatgctggggttacaggcgtgagccactgcacccggccccaaaatctaacgtttgttatcactgttgttttagaaaagaaaggacattttaatgcaacccatgcccatctgtaggggctgaaggtccctctgaggtgattgataaagctgaaaaaagagactatgggaagagaagaggaatattatcaattagctattttagaagcagggcaaactatgagctaggtattcctataaggaaatgaaataatttactaaaaaacatacagcaagaaaataatagagctggagttttctgatttttctgagtccagaatttgtttcactgttctcatttcagctctctctaacaggatgaatgaccttgatttcagaatccccaagcaggtggtgagatccaaaactgagacaaaagaaacggggctgttccaaaaaaaaagctaggtggcaggtgtctaacatgccagggagctaaaacagagtgtgtgagtttcagcagcaggttgaatttagaatggggaaggagaccagaggagacgccagacaggatgactttgtcccattggcctggaggcagccccatgtttctccacccctcatatcactcaccagtttgtaatagtatctttgaatgacgatctgattaaggtccgtctcctccattagtccacaagtttcgggggtacatctactttgctcatttccatatccccagagtctagcacaaggcctggtacatagtaggtgctcaataaatatgttagatgaaaggaagataacacctctatgtactagcagtgagactccaggcatgcaatttctctctgtccttcagtcccttcatctcaaggtttaatttaaatatggtaacgcctgtatgcaactcccagcatccagtaggcactcactaaacacagttctccaccctccttttttcctctgcccctccctcggttttcccactacttcctgcatggtgacacacccatagtttggagccataaaacccaacccaggttggactctcacctctccagccccttctgctccggccctgtcctcaaattggggggctgatgtccccatacacctggctctgggttcccctaaccccagagtgcaggactaggacccgagtggacctcaggtctggccaggtcgccattgccatggagacagcaacagtccccagccgcgggttccctaagtgactggttactctttaacgtatccacccaccttgggtgattagaagaatcaataagataaccgggcggtggcagctggccgcactcaccgccttcctggtggacgggctcctggtggctgtgctgctgctgtgagcgggcccctgctcctccatgcccccagctctccggctgggtgggcttggccatggtcagcgtgaacgcgcccctcggggctccagtggagagttcttacggtaagtggggctgggggaagactggacagggcgggactgcggtcagctttgggaggccatgggacacctccccgtgtgtttcttacgggcccaaagctcctcctggagctcctctggaagggcaggaagccccacggaggcaatgtgaccgcttccctaagctctcaagccggggcatggcctgcttggtgcgagaagtgctgggaggggccgagaagccctggggcagaggcttggctcattttgtctgtccagaggccttcctgggaatgcatctcaggggtctttccaaaaccccacagagggtggggcttggaagcaccgtcctgtttcgatgcggggcaaattgaggtccaccaggagaggcttgctgggcctaggtcacgttgctggtgcattatcaagctgggcgtgggaccgggcagctcggtcgctccgcacctccgttggctctggataatggggaggaggtagaaagcgccgcgcagggtggagcgttggaaaatgagaatatcttgtgcggacgtgtgaaactcagatgcagggctagaaagcatgtgttactgagagtgaaaggctcaggctcactccttagggtgacccccacattggaagcaacccaatgtccctcagcagagggaagacgggtaaataaagcgtgagacgtctttacagtggaatgctatcccattgttcaaggaaacaacgcacatctgtgtgtgacagggaagaacctctcagttaaattaagtgaaaacggtacactgaagaactgtgtagttgctgatagcgaaacggatatagatgtatatatgtacacacgcgtatacgtgtacattccacgcatagaaaattcgtggaatgacacaataaaattggtgacaggtttgtttctgaggagggaaattcaagagaatgttttatcttttggggacacattttggattttttaaaagttgggtgccttttataaacctgttcaaatcacacacccgcacagaacttggtctctggaatccagcagacctcggggtctagttgtgactctgtcacacggctcaacattcacgtgcctcttgctttctttctgaagtggagacaggactaggatgtgtcttaagatcatggtggatgccgtggggaacaaggatgtaaagcccttgataccacgtgcattgcaaagacacaatcaacatttatgtcatcaattgctgaggacagagagccagggaatgacagaatcagggcctgatctcctgactctagtcaggaagaatcttctttgctttgacccccatcaaacaggaatatgtgatgcactggaaatggcagaggctgaagaaaccaacagcctgggaacccatcccacacaccagctgtgtgacct

SEQ ID NO: 17989 - DNA, 13633 bp, Homo sapiens
attttcaggatcttgcaatgtgatgctactgacctgaaagaatgaatgcgcctttaaagaagggggagattatttgcttcccatcagcaggctcaagctcagtattttcatagcgtgtttaataaagctttggaaagaacacagttaaagtgatgaccattagctggagtaggaaaagattcaactcaaacatatttcagttatcttaaacaaattcttccctgaggtgtacacacatgcaattagttgcctttcccagtgaatgttgtacagccatatgccccagaagaatttggctccattcagttacaattcacaaaaggcatttttcaaacatcttgagtgacataaatagctggcaagagtgttaattgcagaagtactctgatttatcaagcgaataactatgtgaatgtgctttgtaaactacaagatactctgaaaatatctgttgtcattctgttttttttttttctgagacagagtcttgttctgtcgcccaggcagcagtgcagtgggtcaatctcggctcactgcaacctctgcctcttgggttcaagtgattctcacgctcggcttcttgaatagctgggcctataggcatgtgccaatatacccacctaatttttgtggtttttggtagaaacggggttttgccatgttggccaggctggtctcgaactcccaacttcgagtgacccacctgccttggcctcccaaagcgctgggattacaggcatgagccaccgcgcccaactgtcattctgttttttaactcgtgtacataatacatacagattaataggttacaccttcttcacaatgactttgcaatttgttggactgaaaaatgaaataattttggtaacactctcccaagatcagtgagtttttctgttgttttctttcttcttaccattagactataggcacaatgtctcaacggtatttataattccttgaaagaattatttctaattatctatgtaatatacacctattttagaaaagtttaaaaatggagaaaagcatgaaaagtaaataataagtaattattccatcacccagaggtagtagtcattaatatttagtccattttcttctcatcctttttctacacatataagtatatatggaaatatgaaaatgacatgtatttttgatgtgattgtataagaggcaatatagaatacaattgaatattggagagatgtgccatgatttacttaaccagctccattactgagtattgtttacaaattattactattacaaatattattataatgaatatcttaatgcataaagttttatctgcatttcagattatttggttaaattagattcctacaaagagattctgttgaccagcctctaacaatatggtccccttttctgttattactgctgttgtgtaagtaccaccacctgagcccacccctattcccacttcccactgaacggagcttttttgtaataccagtatgatattgcaaaaatgatgaagtgtgatttctgcggccagccattgtggctttctccttgatctctctgtgctggttcacttgttctggcagaagacttcagcattcctctggagaggtccatgtggtgaggacctgaggcctccgccaactactatgtgaatgagctgacttgggagtagatcttccagccctggctaagccttcagaccgccgaagccctggccaccaggtggaatgaaacctcatgaaaaaccctgagccagaactgtctaggccaagatgctcccagattcctgtctagtagaaactatgtgagataataaatgttatggttctttaaaatatttaaattgctaaatattagggttctttattatgtagcaatatattagtaatacatagataaactgggttaaaaggtagagtatttaaacatgcttgatagtgttaaaaggctttccagaaatgttatactaattaactcttatagaagtatgtctattatagtcatgcctgtaatcccagcactttgcgaagccaagggaagaggattgctagagcccaggagttcaagaccagcctgggcaacatagtgaggccacatctatacaaaaaataaaaaaattagccaggcgtagtggcacacatctacagtcctagctacttgggaggctgaggtgggaggtcaaggctgcagttagctgtgattgtgcctgggtgacacagcaagaccctgtctcaaaaaaagaaagaaagaaagaaaaaaaagtagtatgtgagaatgtttatagtattgtaccttcattaccattgagtatttatatttgtaacctttataatttcatagaaaaagtagggcattttgccatttaaaagttttgcttttatttgtttcctattgaggttaatttttttttcatgtttctttttatatttcctcttctgggaaacctctttacatataatttgctcaactttctattggggtcttagtgtttttcttagtgatttgcataagctgtttatatataaaaggcattaatcatttgtcatgtttgttataaatattgttttccaattggttgttgctttttggtgtcatgattatatgtaggtgttttaaatttttatgcagttcagtggattatggtatcttcttttgtgtttaagcttggaacgtgctttcatttgaagagaagataaatgctcatgatatagtttttggttttattttatatttggatctctaattcatctgggatttatttatttatctttagagacagagtcttactatattgtctaggctggactgcagcgactattcacaggtgtgatcatggtgcactacagccttgaattcctaggctcaagcgatcctcctgcctcagctaccgagtagctgggaatacaagcgtgcaccaccgtacttgacttattatttattttatcaccaaatagcaagccaatttctacaatgctatttatgcaataaatagaacaatttccttctttcctgttgattggtaattattatatgttgagttgttttaaaatcttgtgactttctgtgctctctattctatttcactgaaagctattcttgtcaatatgactccattttaattattgcagatttataatttgtaataactggaaggactagttagtagaatgactttaagaaatatgatctttcagcctgggcaacattgcaaaaccccatctctaaaaaaaatacaaaaaaaattagcagggtgtggtgcatgcctgtagtcccagctactcaggaggctgaggagggaggattgtttcagcccaggaggttgagactgcagtgagctgtgattgggccactgcactccagcctgggcaataggatgagactctgtcaggaaagaaaaagaaagaaagaaagaaagaaagagagagagagagagagaaagaaagaaagaaagaaagaaagaaagaaagaagcaaggaaggaaggaaggaaagaaagaaagaaggaaagaaagagaagaaagaaaggagagagagagaaagaaagaaggaaggaaggaaagaagggagggagggaagaaggaaaggagggagggaggaagtaaggaaggagatctcatggtctctcagagccacagagctttccagaatgcaatcaaatgtttaagagttgggtggcctgtcactaaaaaatatgagagaaggcaaaatttcatcaaaatcagagttttgtggagctggccagaaaaaaacattttaatattctaagaggcaaagaaatgaaaaatccaatcaagtgttctatcagaggcaggttagaggcagacttctaagaataaatggaagaaagagggaattatgtgatgtagatgagttctgctgcataaacaatatttggcccataaattagtcttcatatttttgtgtatttttgtctagctatggaaagtttaaaataattaaacagtaaaactatctgagcctgggaaatgtctaacaaatatttctttgataacttaaatattttcttctttcaccataagttttaggttttcaacttgttgagtcaattttggccattatatctttatgttaatcatctagtttactgagatttctgttttatctgcatatacgaataattgttattttatcattaaaaatttccagactgttgtatggttttttttttcgtgtgtgtgtgtgtgtgtgtgtgtgtgtgtgtgtgtattgtagaatgaatttgacagaaagatgcttatttcatttgtattcccccccaaaacatctgctattgggtttatcatttttactgtttttattttctttaaatttattttccttttctcttttcttagattcgttttagctattctaattttttgagttgaagagttagattttttctaagaagaaaaacatttaaggttatgagttacgctgtagcttgtacaacccctaaactaagttttctatgcattgttctcattttcattattattgtgatgtttttgagacatggctggactgcagtggcatactcattgctcactgcagcctcaacttcccaggctcaagtggtctttccacctcagcctctttagtagctgggactacaggtgtgtaccaccatgtcccatgaattttttgtattttttgtagagatgaggtcctactatgttgcctaggccggtcttgaactcttgtctcaggtgattcacctgcctcagcctcccaaagtaagccactgcccccagccaattttcattattttgcaaatagtttgatgttatatttgttttcctctttgacttaatattattttatttttttaaaaagaagctctgaccaagcaaattactagtctgtctctttattttttttagtagaacttttttttggttcttttttgtcctaaaatagtttctgaaaattaggccatagaagaattttagattcttctatgcaacaacagaatgcaacaacagaagtcattgcatttgaatcatttacttcacttatttgatcctagtcttatgtgtctcagattaaatcaactggctttgaaaatccgagttttatgccatttaactctgaatgaagagtgcaaagtgaaagacttgggaaaagggacgaacttacccctagaagcccggggctccttgcctggcagatggtcagaaagaactgcactaccttccattttcaagtccctaacagagaggctcagtggcagaatgggaattcttccatgaggactcgacagtcaaccaaagttgaacaattacatgtagaagagagtgagcaaatagagggcttgctgaatgaaaaatgattctgaattctacaaaaatgtaaggtctttaatctggaccctactctctgaattgtgcaggctgcactgaaacgccctggtgatctgacgtttaggaagaaagttaaagagttggtcagatggatagttcataatgggtgattccagtccaagagcccattgcccagctttggttttggttgtatcataatctccaaccattaatcccattgacagagtggaatatttcagttaacaagacaatataattaatagagctatcattgaacccaaaaagggattaccaattttaacataattattacaaaacgtatgctaacccccaaataatactatgcatgatgtgacctctctttgatttggaagagcctgtagaacctcagagggtgtcaaggcatcactttgagtatcagttaggattatttggaagtatagatgtatcagatgatagaaatgacaagcagtactgcccagaagggagtttcaaagaggatgacccccaaacggaacttcctgcagctgcatttaaagaattgtgttcatgtgtggtacatgcattttaaattcccaacattattgacatctggtcacctcatctttgcatattgtccattttattccaaaagcccttggcattttatctgggatagcatgggtaaactgaaacatttgacctcgactttccccttttgtctttcatctgtttctggttcattggctgggagttgcacctgcgggaggacgtctcatgcagacttgcacatatacagggagtgttgcattgaaggtctttgctggaccttctgttcagaaggtgattttcaaaagcgagcaatgctgccaatgcagcttgcttctcttgacagattgagaagtccagcttcaaaagttacctgccatttaagcaaggagtttgtcaagagatcatggttcattttattgaaaagactttaaggagttgtaggatttattcatagattgctgagaacaatggcaatatttttatttttacagagtttgcacttctgatttcaggttaaacgctaacttgtttttagtctgcttaggggattgtgacttgaaaatttttatattctgatgagcttttttgtagtgtccacaatgtataaaatatttcctaggtgagatctatgttctccatttattgatgcattgcagaccaatttgagtgatgtgtttaaggaaaattcttcctagtttaataagtaagctaaaaggttttttttttatatttaatgtttaatctctgtctcgtgttatttaaaattagcctgcagatactttccctcacttctgtaggctcctggaagataaacattcaaacagcggaacaaacaataaattaaataaaaaataagaattatattttcttaatttctgcctcagaatttgcgttttgtctttctgcctttttttttttggatgtcaaaatagatgagatcgtatactctatggagtataaattgttactgaagtctttatttttggtaatgaatgagtaagaataagactatctctgtgattattaaaatacatggaattatccaggaaattttccttacaaggaattaaaatattcctgtattaaagagaagaaaagcctttcccaagcggctggcgaagacggcagaggtgcaggtcctggtgcttgatggtcgaggccatctcctgggccgcctggcggccatcgtggtaaacaggtactgctgggccggaaggtggtggtcgtacgctgygaaggcatcaacatttctggcaatttctacagaaacaagttgaagtacctcgctttcctccgcaagcggatgaacaccaactcttaccgaggctcctaccacttccgggcccccagccgcatcttctggcggaccgtgcgaggtatgctgmcccacaagaccaagcgaggccaggccgctctggaccgcctcaaggtgtttgayggcatcccaccgccctacgacaagaaaaagcggatggtggttcctgytgccctcaaggttgtgcgtctgaagcctacaagaaagtttgcctatctggggcgcctggctcacgagtttggctggaagtaccaggcagggacagccaccctggaggagaagaggaaagagaaagccaagatccactacgggaagaagaaacagctcatgaggctacggaaacaggccgagaagaacgtggagaagaaaattgacaaatacacagaggtcctcaagacccacggcctcctgatctgagcccaataaagactgttaattcctcaaaaaataaaaaataaataaaaataaaaaattaaaaataaagaagaaaaatattaaaaaagtatttatttgtaactagctccatctagtgagaattgcttaaaattacatgattcatttatgaatctcctttgaactagtaacattttttgagagcacttttccattttaaagaactataaatcctgtaattttatgttttatagaacccccaattatagactagaagagttttggtaattatagagcctattttagaaattaatttatggtgaaaaataaagatatacctaatgaattagtcacttctcaacatcatcactgcaactttttggagaagcagtaaagtggacagtaaagctaaatcctggtagaaaagtaaaatactgacttcttgagacgagaagtgggtgtggggcataatagaaagatggtgatgagattgctccagactttaggatgagaagaataaccttgttaacagttcacaaattgcttgcatttgtttttgcatttgcttttttggacatctttgaggtagctatttcagtcgactcttgaacaacatgagtttgaactgtgtgggtctacttttacacggagtttttctcttttctttttttgagacaggatctccctttgtcaccttcgctggtgtgcagtggcgtgatcatggcttactgaagccttgaccttccgggttgaagtgatcctcctgcctcaacctctccagtagctgggactacaggtgcacaccaccacacccagctaatttttctatcgtttatagagaggttttgcattgttgcctaggctgtgcggattttttccaacaaatgttaccccgagtgtgcctgcctcgcctgcctccccttccacctcctccacctcttccacctctactacctcgagacagcaagaccaactcctcgtcttcctcttcctcctcctcagcctactcaatgtgaagatgatgaagatgaagacctttatgatgatctacttccatgtaatgaatagtaaatatatattttctatttttttcttttttcttttttttttttttttgagacagagtctctgttgcccaggctggagtgcagtgccgtgatctcaactcattgcaacttctgcttcccgggttcaagcgattctcctgcctcagcctcacgagtagctgggattacaggcgcttaccacacctggctaatttttgcacgtttagtagagatggggtttcaccatgttggccaggctggtctcgaactcctgacctcaggcgatccacccgccttggcctcccaaagtgctgggattacagacgtgagccaccgtgcccagcgtaaatgtatattttcttctttataatttccttttctctagcttactttattgtaaagatacaggatataatacccaccacatacaaaatatgtgttaatcgactgtttctgtgggaaggcttctggtcaacaataggttcttaggttttttgggagtgccccctagccgccacactgctcaagaaccaactgtgttcccttattttgcaggtcaagaaacagtctcagaaaggtgagggctgctcccagtgctgcagggcattgtggatgctgtgggtgctgcccggattcccctccaggactgaggcactgctcattctccagccgctgggggagccgctgcctggcacctctcacctgtgctgctttcccagtgttgcttttagccaaagaaagacactgcccaagattaagctccctccctagggaccgtgcacatccaatgactggttcctgtgaggtaccaagacttgtccaccatgcctcagtttgcaatatctcagaagggccatcccagatccagagctctccatggacccactgaggctcagctcgacttttctatctgccaaattctttgtctttcaacacttacaggtgctatttctgcgattactctccaataacttctgtatagaaatctcggtgtctcagagtgtgtttcccagtgaactccacctgtgacagctggtactggatgtggtcctaggaactgactctaaaataggatgttgttgctgcacctggctggctgtaataaggcccccatcactggtagagcgctagcccccatcataggtgaagcgctagttgccccaggcatccatgccagtgccagtgttcacatgtttacaggtggcaaactgggacacgaaactggtagaaggggataggctggcaagtgacacatataggaggttgagagtttcaggggaaattaagtaaatacaagaattttggaattagatgactgttgttggaggctatgcatgcattggagaaagacaatgactgcctcggttggttacttaaccatgtgaggggaagtatgaagccagaacttggctgtatataaatagaatctcatctccggttgcctaagggccgtacagctaaggacttatatgaatagcaaagttccagaaattgttgaattcttaattctcaactccagccagttctgctatatgtaggtcagggtgctgatttggaagcagtaagattctgagactttggatggggacacttggtccaagcactaaaaaatcttgaatcatcaggtcccgctggacctgtgggcctgcagaagtgacccactcctctctggtaaaggctagagcctctggcttatttgaaggtcatatggaggatcctgtcttgcaagaaaaccctagtttgtttgggatggactgtagaattgcgtaggcgaataaagagtaccactctggtttgatgtggggtggagtgctgagggggtttgctggggtgtagttgtgagggtctcctaggaggtcagcagaattgataagagcaagagaagtagaattaatatctttaattgtgtaataagaataatatatttaattgtgtaataaagaatatctttaattgtgtaataaattgtgtaatatatttaattgtgtaataaagaatatctttaattgtgtaataagggtgaaaagggattttgtcagaatctgatgaaattcctgaggggttaatagatcccttttcatgtaggaataacaggtgaatggctactagggctgtaataatgaaaggcaagattaaatgaaaagtgaagaattatgtgaaagtggctttatccaatgagaatccacctcagattcactgtacaaggtcagttccaatatatgggatggctaacagtagatttgtaattactgttgcatctcagaatgatatttggcttcatgaaagtacggagcctattaatactgttgctataactgcaaatagaagaatactgccaatattccaagtttctaggaaagtaaatgacccgtagtataagcctcggcctacatgtaaaaacaggcagatgcagactatcgaagcctcattagcatgtagcataattataattcagcaataatttacatctcagcagaagtgagtgactgaagagaaggcggtcagagtatctgacatgtagtgtatagctaagaaaaccctgtgatgatttgaaggaccaggcagatacctagaagcaagctgagattttaccatgccgagatgtttgattgtgcaggtggctcaataaacagtggttaataatagagaatgtgtttttcggatgttagtcattagagttcttagagttgaagcacaacaatgatttttgatgtcattagttatggttatatcccatgtaagaattatgacatacactgtattcttattaagtattattcttattataggctttatgggattttcttcaaagccttctcctatttatggaggcttgggattaattactagtggaggtgtgggttgcagtactatgttaaattgtggtggggcttttgtaggtttaatagtttttttgttttgttttgtttgtgatggagtcttgctctgttgcccaggctggagtgcagtggcacgatctcagctcactgcaacctccaccctctgggttcaagcaattttcctgcctcagtctcccgagtaactgggattacaggcacgtgccatcatgcctggctaatttttgtatttttagtagagacagggtttcaccatgttggtcaggctggtctcgaactcctgacctcatgatccgcccgcctcagcctccctaagtgctgggattacaggcatgggccacgtgcctggcctggtttaatagttttaaaattttatttagggggaatgatggtggtttttggttatacaatggcaatggctactgaggagtatcctgagacctgagggtcagtgttgttatttgggatgcctcactattagggttgctgttagagttggtgataattatgtggttaattgattatgatgaggtgggaattgtaactgattttaaaaatatggaaaactgggtgacttttgaggttggggaaatagaattactttgtgaggattctatggatgtagctgccttgtgcagttatgggtgttggtgggtggtggttgctggttgatctctgttagtatctttattgtgattgagattatgtgagggaatagggttaaataattaagaatagagttaggagagatgggataaggaaggagaaaaagtagagcataattagatctttctggttagatacaatggtggaggctatcatttgaacctgggcagtattttttggtgttgatttttctaatcaaatcagttctagtagaagagaggttaggttttgtcttgcatggaaatttgagtgtggtgttgtgtggtgtattgtgattgggtaaaatcctaatatattggagaaattaaatatttgtgatgggtgcttgagtttgaggttgttagttacaaggttaagttctattgctagtgagaagcctaaaatagttacgctgagggttgtgagttttaggtgaaggagcatagtcatttggggaactgatattggaataatattgttggagattaaaaatccagcaaaaatactaccaattgttaggcatttgattgaattgattaggaaggggttgtttttgttgatgacaattacagccgtgaagtgaggttgtcctaacagtgcaaagaaaataattcgggtgctgtagacagctgtcagggaggaggcaatgacagtaattaaaagggctcagacgttggtatgcgacatatttgcggtttcgataataagatctttggaatggaagcctgtgaagaaaggcattcctgtgagtgcaaggctgccggtaataagtggggaagagggcctgcagaagtgatccactcctctctgttagaggctagagcctccggcttatttgaagatcatgtggaggatcgtgtcttgcaagaaaactcgtgctctgctcaggattcagctctgcctcctctcttggccatcagacccgaagctaagggcaagttagaacataacccagccacagaagtgctgggcccgctaagaaaacaaacctgctaagaaaaaaaagtagttgtaggcctggtcaatgtgaaccatcaggaactgggggaatatgtacgggactggatcttgagggtgctgaaccaaaggaaacaaaatacaaattggaaaagggagaactttcttttacggtacggaatttacaccctgacgaggaccccgggagatggcgccaacatactactacatcacaacctctaagaggttgcctcttagaggcctggaaaagtattgacccacgttaagtgaggtagaattggaagaactgccacagcaaatggtgaaggaaggaatcaggatgtccagagcagtgggcatgccaaactggttagactatagaggccagaaaatccaccccccacagtgttccctaggagggcccagagcatactccgtttaccggcgtgctaagtcatggcctggtgaggagggcaccagcatcacagagaagccctggagttgccgcccagcattccaaagggcaggctgatggcaggagatgctgttacagcgctgggcttgctgccag

SEQ ID NO: 17990 - DNA, 19542 bp, Homo sapiens
aaaaaaaattacttacaggatccaaaccttccttctctagtttggctttctccaagtagtaactcctctcggccacgctgagaagcctccaactctcactaatcttcttattgatctcagactgagggaggtgggggagctcctgctgcactttcaggtagatgtcgtaatagtacagaaggtaagcagacctgaggaagcaatgacttcttcaggctttcccagtaatggcaatgctggcagaaatccctccacttcccactccccatccctcgacccaggacttcattcaaccagtaagtactactatgctaagatatgggtagtcaagaggttgataaaacctagcttctcatttctaagcatttatctaaatagggactgaaagtcaagcaaacaaacatttaaataacatcctcagatggtgttataataagttataatcttattcctgattataactgatagctgtcagtacaacacaaattatattacattcaatttgtaatataaaaactcatggtataggagaaatgcttatataagctaccatattaaagttactacattagagccactatattacagtcaggagtaactacccaggaagataaggggctccaagggaggaggggaaaatgaatggtaaagatagcaagtggctgtttccccttcagaaacctggaagcaaaggctcatttgactggctttcctaaagatcgctttttgtgcaggaatgattttaaagcaaagatagatacaggtgtcctgtcctgtcattccactctcagggaaagcttcctcaaggggctggttatcactcacactccgtgctcctctacgcagcctttggtcaccaacctggtcaatggcacctccccaaggatgagagagggaagcaagcagaccaatcaaaatgaccaatgctggtagtttcacaagtttgaggtattcacagtcaagagtgaagttagagctacaatttggatattctgtacagatataattggtattatttctttttgtgtggtttttttctttttcttttcttttttttttttttttgagaggagtttcgttcttgttggccaagctgtagtgcaatggcacaatcttggctcaccgcaacctccgcctcccagattcaagtgattctcttgcctcagcctcccaagcagctgggattacaggtgtgcgccaccacgcccggctaattttgtatttttagtagagacggggtttctccacgttggtcaggctggtctcgaactcctgacctcaggtgatccacccgtctcagccttccaaactgctgggattacaggcatgagccatcacgcccagccttatttctaattttgtaattttattaatgctttgttttaaatgtttaaataacaacaatggcataataataaataatgtagctcttttgtacctagcttctaccatcagtatggtacaatttcctgtgacaacttgaaaacaaaagcaaagtctggccagtaatggcaatgctggcagaaatccctccacttcccactccccatccctcgacacaggacttcaatcataacactctttttcaaagagtcttaaaagttttcctcaatgcagctctccaagcaacttctgtttataaatgctagcagcaaccaaaatgtgttggctaacctgggtttctttgtcttttctccatgtattttatactttttcttcttcttgggtggcccaggagaggtgtaacaataggcttcctcaatttcctccatcacgacagttacctcagtaccatcatatgatgcgtccatggctaaaggaaaggaaagtcaaaataaagtttccagaatctcccctaagaggggcagcagcttcctgatcaaataaccccttacctctgccagtgccttaaggcttagacatttcccaaacccaatatatcctaagaagcacctggcttggttgtttaacacacaagattccagagctccacttcagccctcctggagcagaatctcccgagggtatggaaatccacatgcttaacaaatgcctcaggtgattcctcagaccgggcaagtttgtgaccactgccttagaaatacttttcacttatattcatgggatacagtacccacccacccctttaacacaaagatttattagccccaaattataacaattctatatggaaacaggttaaaaaaaaatgcttggccaggaatcagaagttctggcccattcctcctatgtttcatcaacttaagcaaatcccttcattgattcactcaaacatgtagtaagggcctgtatgtaaaagatttctttatactctgccagcttgtgcaattttggtcaggtcttttagctgctttttgttcagctttctctctcatgtataaaaaaagacatgtctcaactaccttcccacagatttatagtgataagactcaaaggatacaatagacacaactctatttaaaaataattggatgggcgcagtgactcacgcctataatctcagcactttgggaggctgagatgggagggttgcttgaggccaggagtttgaggccagccagcttggtcaacatagtgagaccccatctctattaaaaaaataaaaatcttttttaattaaaaaaaaaaaaagaaaatagtcaagtgctatgcaaatgaaaagggtttgtttttgggttttttgtttttgttttttgagacagggtctcactctgtcactagagaacagtggcacactctgggctcactacagtcttgacctcctgggctcagcaatccttccacctcagcctcctgagtagctgggactacaggtgatgtcatcacgcctggctaattttttggagagatagggttttgccatgttggccaggctggtctcaaaatcctggactcgggcgatctgcccaccttggcctctcaaactgttggtattacaggcatgagtgggattacactgtgcccagctgggttcattcctaaagtcaggtaattggcagaaaaaaaaaatggaagagttcattaagttttttttttaattttatataatttaaaaaataataatagagatgaaatctcgctatgttgtccaggctggtcttgaactcctgggctcaagcgatcctcttacctcagcctcccaaagtgctgtaattacaagcgtgagccaccacatctagcctctgttaaagactattatctgtgtctgagatgcttaacaaccttcccaaggccaccaagcccaagcagggacttgagagatagatttttaactcaaaaatccaactccctgggccttctttcattatgctacactgctatccatctctactggcaaccctccaaaccagcactgttcaataaactctgatgatggaaatgttctacatctgtgctgtcaaatatagtagccaccagccacatatggctatcgagcacttgaaatatggctagtgtgactgaagaattgaattagttttatttttaaatttatttatttttaagacaaggtctcactctgtcccctgggctgcagtgcagtgatgagatcctgtctcactgcagtctccacctcccaggctcaagtgatcttcccaccttggcctcccaagtagctgggactacacatgtgcaccaccaagtctggcaaatttttaaattgtttgtagagatgagatctcattatattatccaagctggtctcaaactcctaggctcaagcaatcctcctgccttggcctcccaaagtgctgggattacaggcatgagccaccaccacacctggccaattgtaattaactgaaatagcaacatatgctaggagctagagacagcacagatctaaacagtcatctgaccaaccaacatcagctctctggtgctgggctaaaaaacagagaatctactaacagcttttatgtctaggaaaagaggcataaaaaacttaataaccagttcaagaagagttagttttttttgtagccaagttctaaattggacttttaccacaagtctcaatccttggagggagaaaggctcacagaaaccacttgaattttacaagaggaaataacatagttgcccctgaaaatctgtcaggaggaaatttagaattctgggaagaggcagttgtggtggtaaatatgggactgatacgtgcagtacaaagcccacacacctctcatttagacctcactccacaaataaggtataatgagcactgcatgtggagtcaagagacctaaactctaacctgatgatctcagagaagtctattccacatcctaaatttcaactgtttctactgtgagaaaaggatgaacccagtggctcctagtcttttggaggcaagaattcttttgacaatgttgcgaaagcttaaaaaaacaaacaactacaacaacaaaaaacctctcctagaaattgcagacacactgtatttcacctataattttcaggatataccccaggtaaagcacacattattccttaggttcttcctagttctctgtcatctctaaatgattcctcttcctattaaaaacaaaaactaaactaacaaagaaaaacaaaacaaaaacctacattctaactgccatagtgcaacccaggaagagaacacagtctacaacttggctgggtaagcaataggccagtaaaggataagggaagcagtagttcaaatcaaggctacgtggggactgcgcttttttgccctgaattgacttctgggcggctgaaagccttgtggagaagggcagtaactgcaggagagcatctgtaatgaatggcatatagggtactaagcaccctgcgcaaaacgggttaggaaacactcattacagccaccttgggctgagggcaggaagacaacaccctacggttttgtttgttttattaccctgttctaagcctgagtacaagtttgttatcagactcgaggcagcagtatagcaatgcaaaaaaaggcaggacaatttaaggttaaaaacgaagggctctagaggacagaaaatccgggttctagtacagactacaccagtcgcaccagcacggggacctctgaccttaagcaatctacttaccctaagtctccgttatttcatctgtaaaacagagttaaggtcaatacctgaaatatgcgagacactttctctgtcccatcagatcctccttggaatctcacgagattgcctttgagggctcagccatgggccacagtttgactctgggctagctcctttccctcattctgggtcatgaatgaagcaagagccaaaccagacaaagtcttggtcaagctaagacgtctgggacatccgaatgtcccatacggattgcggaaggaggacactaaggctcagtggccctactttgtggaagactcagtagaggctcagagagccgcagcatccaactcgaggtcgcccagcggctcggcgcggccctcgaaggcgggacttacccggaggagcgtgcaagctgcgccgctcacattcccggaggcgcttggcccggcggctggacgagggggatggctggcgcactcgcgctccccgctgtcggcgagaggcggctccagtcgtgacagcagcaacaaggaagtggaggcgagggctcgcgcgcgcatcccgggggctgaaggagccccggccccgcggccccgcccggcgacacacggcgcggagtcgcgacagcccctctcgcttcccctcctcggagtcgcgatatggggtcctgaagggcaagaataggagcacaggttcgctccgcaggctcctcaccgatgcctgccgagggccccgggggtcaagccccggggagctcgaggaagacggcagggacacggtcgtcaccgaggcaccggtttggcggctgcaccggcagtagcggcacaccacggatcgccagggagacccgtcccggcggccctcgcggcgcaccggaagcggtcggcagcgcgtgactgcatgcgacccctggcgcaagcgcaacagcccagccctagcttgggagcggacccacacgaactgctcaaaggcttggagsrggtctagtaaggcgaacggactgcttccggccagaggtcccgggcggaggaggaagctgtggctgccggcggtgggacgccccggccgctcagcccccgggcactgctgtggggcgttcaggtaacaggggcggggctgtgctgagcgtgagggatctaggccccgcctcacctttcagagccacgtcgggcgctgggaagcctacaataccaccctctcctcagcacgacgttcaaggcctgacctcagcctgtctcagyctttccctctcattcaggatcgggttcatacgtagtgccgcatcaagtagcgccttcatcactccagtgatctgccctcaatccgtctctcccactggcccacgaatagtgatggtagtgagttcctggagtgactcaagctgagctgaatgaccgtatggagagcttccgtaaatcaaatagggattggattggattgtcctttctctccagtgtcacaagttgtccacatttgtacaagttcccgcacaaccctcactgtattccagtctgcctacttctctgcatctaccgccatcaccaaccttctagccaccatcatctcctgcctggactgatgtagttctccccacatcccctctacaatccattctccacgaagcagtcagattgatcattttgcactgtaagtctgatcaagtcactccctgcttaaaaccctccagtgtctcattcacttaaaataaaattcagacgtcttagcttgaccaagacttgtctgatttggctcttgcttcattctctttctatgtctcctctcaatattagtagttcccagaaccagctatatagcactctgtagtgtttggagtgctagctttgttgtgagcctcctgggtttgaatcccagccctgccacaagtaagcaatattaagcaagtraagtgcttaacaaatgaggtttacgcagtagatcctcccacctcagtaaatggcaccatcatctgctggattcctcagtgctcaaaccagaaacctgggcgttatccttgactcctccttcacctcacatccggtccagcacagggcttgcaaaaacatagccccagactgactactactcaccatctctctattactactctaatccaagccaccattatctcatgtggactcctgcttttttctctgatacccttccattctttacacagcagtcatctctccttccttaaaatccttcaatagcttcctattgcactcaaattaacatccaaactgtatatggcctactggtttagcctgcttttatcttcagatttaaggccatctcttaggaaaatcaactttacccattaggttctctaccctgcaaccaaaagactatattgtaaatctgatcatgtcattccagaaaaacaaaaccaaaaaaccgtcaaaagcctcttaatgcccccaaagcaagctagaaacctgactaggacttcctgtgatttggtccttgctttcttctccaaagaattttttgttcctgaccaggacattctatttcctatatagtatttcattgcctttcatgttaaatatttcctttcatctcatgagttcctatttgtttattctttaaggcccaccatattattccctctttgaagtgcactgcccatccatgctccattccagttgattatctgcacatttatgttccagtagtactccgtaacctctgatttagttttcacatgctctartgtttgtcttccctggtaggctcctcaaaggtgggcactatgctccattcatctctgtatggctggcatcaagcatactgcttaatacatagtacatgtcatgaatggatggatacatgtatggaggtgatagtaaaaatctacccttgagaagggacagtcatagcataaagtcacagcaggttctcttgtcctttaaggattctcatgataaaatgcctacgaaggcaattacccaaaactgctactgctggatcatgttttgttggaccagcgtagggcagggggactgtttgttttaaattctgaatacttctagacaggatacaccacaccattctccaaatacttcaatccctgtttcactcacttacgccaccatcctggcccctaaaggcatttgagtttgaagcayctatctagggtccaagacttaaatctggaaggaccttaggcatcatctgggcttgtggtttgcaaccatgggacttttcaaaaatatgtattaaaaaaaaaaggaaaaaaagaaaataggcccagagagggactgtactacaacctgcccatcacttctgccataatctgtcacctaattggtctctttgcctctttgatccattttccacagaacagccaaagtgatccttttaaaatgcctgaaaacatccgtggatttctgttgcactcaaaataccaattctttaccatggcatctttgtttgtttgtttgtttgagatggaggctcgctctgtcgccaggctggagtgcagtggtgtgatcttggcccactgcaacctccgcctcctgggttcaagcgattcttgtgcctctgcctcccgagtagctgggattacaggcatgcgccaccacacccagttatttatttatttatttatttttgagacggagtcttgctctgtcactcagactggagtgcagtggcgcgatctcagctcactgcaagctccgcctcccgggttcacaccattctcctgcctcagcctcccgagtagctgggactacaggcgcccgccaccacgcccggctaattttttttgtatttttagtrgagacagggtttcaccatgttggccaggatggtctcgatatcctgacctcgtgatccacacgcgtcggcctcccaaagtgctgggattacaggcgtaagccaccccatccagcctaccatggcatctttgaatggtctggccacccacctttgtcatatacttggattcatgcaaatatttcagttccctgaatacctcaagctattttcggtgtgtgtgttttttttgttttttkttgttgttgttgtttttgagacagagtcttgctcttgttgcccaggctagaacgcaaatgtacgatctcagctcactgcaacctccgcctcctgggttcaagtgattctcctgccttagcatcccaagtagctgggattacaggcacccgccaccacgcccggctaatttttgtatttttagtagaatcggagtttcgccatgttggccaggctggtctggccgccttggcctcccaaagtgctgggattacagtcatgagccacagcgcccggcctatttttgcttttgaggttttgctgatgctatgtcttttgctggacagccctttccccatattcttggagatctcagcttcagtgccatcttagtgaggacatccctgaccaccctttgtataataagtagatcttcctcttttattctttgtcatagtctttatttcctttatagcacatatcaccctctgtaattatctgtttactttttatatttcccaccacattttatatttcataagaacagggaccttgactcttttgttcattactctacccttaaagcttggcacctgtaaatataaaatgaatgtatggctaccagaaacatcttcccacagtaaaaatctttccaggccagatggtggtagagctttgaagatctcactttggtggaatttcaagcaggaccatggcctggcagaaatagtaatctgagttaagaaatctaagctgcatgaacccgggtaggccccttcccagggccccagtttctgtgtccatcaaagaagctggagaataactcggaatgtatacagtgcartgctatttgcyaagctctttcactgcctgttatttcaatctgttctcatggtaggcagagcaaacattgttattcccatttttatggaggttcagaatgtttaagtaagctagataagatcacttctgtttcaaacattctgagtctttacaagtagcctctacaaaaagtcagtagcatgaatcctatcttttctttactttgactgtaaattgtcctttcctaatacaatttgtaaaaatcctgaaccatcttttaggggaaatccattgtttcctgataggtactccattttgtcttctcagctttccacacttggggcaaagcaagccgcgaggaggaaccagacagtcctgttagttgtggccagccctcattccctggaaatggcaaacaaggggaacaagaagcgtcggcagttctctctggaggagaaaatgaaagttgtgggagctgtagactcaggcaagaggaaaggtgatgtggcaaaagaatttggtatcactccctctactttatctacattcttaaaggatcgcaccaaatttgaagaaaaggtgcgggaggcatccgtgggaccccagcggaaaaggatgaggagcgctytttatgatgacattgataaggctgtttttgcttggtttcaagaaatccatgccaaaaacattcttgtgactggttctgtcattcggaaaaaagcactaaacttggccaacatgcttggctatgacaattttcaagcaagtgtgggctggctgaacagatttagagatcgccacggaattgctttgaaagcagtctgtagagaagatagtgacaggttaatgaatggtctaggaatagataagattaatgagtggcatgcaggggaaattataaaactgattgctgactacagcccagatgatatctttaatgctgatgagacaggagtgtttttccagttgcttccccagcacacacttgctgctaaaggagaccactgtagagggggcaagaaagcaaagcagcggttgacagcactcttttgttgcaatgcctcggggactgaaaaaatgagaccattgattgttggtaggtcagccagcccacactgcctcaagaacattcattccctcccttgtgattaccgagccaaccagtgggcttggatgacaagggatctgtttaatgagtggctgatgcaagtggatgccaggatgaagagggcggaacgccggatcctcttgctcatagacaactgctctgctcataacatgcttccacacttggaaaggattcaggttgggtatctgccctccaactgtactgctgtcctgcagccactgaatcttggcataattcacaccatgaaagtactgtaccrgagccaccttctaaaacagatcctcctcaagctcamcagcagtgaggatcagaagaggtggacatcaagcaggccatcgacatgattgctgcagcgtggtggtcagtcaagccatccacagtggtgaaatgttggcagaaggcaggcatcgtccctatggaatttgcagaatgtgacacagaatcagcagccagtgaaccagacattgccattgaaaagttgtggcacacagtggctattgccacctgtgtcccaaatgaagtaaatttccaggactttgttactgcagatgatgatctcattatctctcaggacacagacatcatccaggacatggtggctggcgaaaataccagtgaagcaggaagtgaagatgaaggggaggtatctttaccagagcaaccaaaagtcaccatcacagaagccatatcaagtgtacagaaacttagacagttcctttccacttgtgtagacattcctgatgccatttttggacaattaaatggcatagatgaatatttaatgaaaagagtgacacaaacccttattgattccaaaattacagatttcctccaaacaaaataatgcaggaatttatttcagaaaatgtagtttacaagaataaagatttctttagataggttgttgagccaatttaagtaaagcaatgttattgtgacaacattccagtactctgaaatagccaggaaacttctttgaatggaatttgactaatatgtgtgttttcttttcttttgtttttggctgtctctggtccttgattcaagatgtattttgattcatccaagggtttccaaacttgtctgcaaattaggatcacttgagaatcctttaaaaattccaaagctcaggccatatcccaggcctattaaatcacaatctttggtgacgggtcacaggcattggtagttttgaagctctccaggtgattccaatgtgcagacaaatttgaaaactgaaccaaccacaggaacatcaagtacactgtgggcctgggtccagcttctttccagtaagtgtatctcaggggcttccaaatttagcttacatcagaatcacttggaaggcttgttaaaacccaaggctgctaggcccacccccagagtttgatacagtagacctcaggtgggacccaaaaatttgcatttctaacacattctcagctgatgcagtccaggctccatgctttgaaaaccactggtctagctttagataggatattgagccaatttaaataaagcaatatactggtctagctgagttctagaacttctctctttagctggccatctgaatactcccccatcactaattgttaaaaaaagaatcaactgttcttactctagagctcttttttcctttctgctgatttgctggaagcactacaagacttctgtttgttcgttygtttgtttgtttgtttgtttttaaagatggggtcttgttatattgcctaggctggaatgcagtggttattcacaggcatgattataacacactactctctctaactcctggcctcaagccatcctcccaaatagatgggactactgatgcacactgccatgctggccttacgaaatgttttaataggcatttcactaatagggatctggagtacaaggaaatacagtgcatttaagacataggctgggcatggtggctcatgcctgtaatcccagcacattgggaagatcacttgaggcaaggagtttgagaccagactggccaacacagcgagacccccatctctaaaaaaaaaaaaattartaagacatggatacaaccagggagggaggttataataatagagcatcctgttaatcagaatcatgggggagaacatacagcccagcgtgcctctcactttccagaaagggtgagaggatcattagagagttcattagagagtatttattcctaataagtcagataaatgtcagtttcatttttagaagtttcacacaatacctgctaatggtgtgatgtcatttttccccctgcttcaggttaattttttggatatttcagaaacccatagcaattcagtgatttttctttttgtagtagctcagtcaaaacaggtaacagcagattaatcatagaaaatgttgcttccacattaacaaaacaatcactgaaaaacagcagatgtttaaatagattattttatagcttattttggatattttttcttttaataaactaatatgatcatttgaattaaaagtactgtacatattttaaattcttaacatgtgggagaggcaaactcttctggctaagtcctgtggttgtatttctttgtcagctccttaattgctgtcatcatcctctcgtgtcaggattactgccacagtatctaattccttccctcacctttctcctgcagtccattctgcacatattgtttgatctattggcatcacaccatttcccctgcccaagtgtctgtagtggctttcaaatgcctacaaaaaaaactattcagctgagttttagtatcctctatagttgactacaacctgcatttccaacttgttagctcgatacaattctgtgtacataatgctccctgaagaggccattgttttcttttactgcataccgacttctgcctgtgtgccttgcccaaatgcctcatcctgttttctactaagctaggccctacacattcaggaactaactggaatcctctttcttccaggctttcttggagactccagcaactactccacctgttttcccctcatcttctccaaacttcttgtctgtaccactcaaatacttagatgttttctagatgttctctggctctttagactgtaagttccatgacagcagggatcagtcaacctttataatcttaatggtgcctaggactgtgctggacacatcgtaggcacttcaaaaaacatttgtgtataaattgatagacacgtacaatgtgttgaagccaccttatttttaaagctgtattaagcattgattctactagaaatggcttggagataaggtagggttttattccatttaaaagggtttgcaaaatttttccatgaatatagttgcctcaaatataattccaatccaggttataatctctgttctttgataatgaattatatataatgtaatttgataagtatatagaatatatactatttatagttgaacccatgtccctccaccaaaaagtcattgcaggacttctgttggcttccatttatacacacaagactttagtatgaaagggcttgtctaagtgctttgcatatagtagatgttcagtaaatatgtgcttaaacttgcttttttaaaaaaacaaatttaacatccctggccgggcatggtggctcacacatcccagcactttgggaagccaaggcaggcagtttgcctgaggtcaggagttagagaccagcctggccaacatggtgaaaccctgtctctactaaaaatacaaaaattagctgggcatgatggtgggcacctgtaataccagctacttgggagagtgaggcaggagaaccacttgaaccctagaggtggaggttgccactgcactccagcctgggtgacagagtgaaacaccatctaaaataataataataataataataataacaaatttaacattcttgatttacttaatatatcatgatttagatcctggacttccatcggaagatggaaatcatccgaaaaagaaaattttttagttcagtttacactggctaacacttcgattctattggatatcaggggtttttggtactttgttaagctaaaagaggttgatattatccctcgtcaggctttctgtggcttctccgtgcctctttggtcactccaacctcacttgagtggcaaccccacttctgctccagttgactaatcctctctgtaggccaacatactatacctaggcacctacctcaattgtgttgtcatgaggataaaaaggtgtacctgagactaagtgttctataaatgcactctattgtcattccatccctatttggaacataatgagtatcatctagagtcaaggacctgccttatcagcccttttttccactgacaggtcttggggttcagtgtttgagagccaccagcctaatcaatagatgataattcaagttttctgtgccattactcataagggccctgattcaaaagcaagtaagctaagatttattgtctattatatttcaagcactgtttacttattatttaatatttttagtaaatcataatacaaaaccacagtagactcagataatttaattccaaggttgtggacctattaaactgctgttcatgctacctgaagccagacttatctttaaagtggaatgtggtagcatactgtggccaccagagggcacaggtggactacatagggagacagcgtcaactgaagaaacctttggagctgccacttgtaatttctctgatgtggtacagattgagagggaaggcaacaaggaaagaaggaagagacataggatgttggacttgttcaaacaatttacctagaagtaactgcctgggaccacctaatcccctccattacataccatctcttctctagagacttttcccaacctattaataaccataggccaggctgagcatggtggctcatgtctgtaatcccagcactttgggtggctgaggcaggaggaatgcttgagcccaggagtttgagagcagcctgagcaacatagcaagaccccgttcctacaaaaatgaaattagtcagatgtggtggctcatgcctgtaatcccagctactcggaaggctgaggcggaagaattacttgagcctaggagtttgagactgcagtgagccatgattgcgccactgcactccagcctgggtgaaagagcaagaccctgtctcaaaaaaaggcaaaaacccaaaaccaaaaaaccataggctatgtaactgatcgtggatagacactcaagctctggaaatgaggcagtattagggaaataattacccaacaaacatatccatgtttgcagtaataacttatttaaccttataaacccactgcaggtcataggagctctaaggatggagcacatggccctactctcaagaagcttagtagaagagatagacgggacgtgggggagtgagtggtaaatgtcatttttgagaatatgcaaataatatattttactctttatgagtggtaaatgtcattttagaggatatgcaaagatatacaggagtatagaggtggaccctaaaggagcccctgaatgagagaagaggaattcagtaggaaatgttgctaaggaaaagggacatttgataagtatctggaaggaaaagtagggagttagggagatggggctgggaggcaactcctggcagaacagcatatataaaggcctggggtatttttttttaatggcccatttgggagcacctaaggttggtgggtggtaagccaagcaaaggatgtgtggtagaacgaaaggctggagatgtaagggcagagttttttaagtcttgtgggttagaccatttattttgaacttatcctaaaggcactagagaccccttctacttgccctaagtagcaatggtcaacttctttttaattaaaataattgataactagtatggaggttggattgtagaaaagcagataaactagttaggctgtggtatagtactgaagagaaataattaacactgaggggtaggaaaaacatgttggatttgagaggcatttacaaggtaagatggatttagtgtgggagttgtaaagggagatttcatgaaatttcaggtttctgcttaagtggctgggtcgtgccaggatcaaagtatgttaccaggagaaaggaagacaagtttgagggtcatgttacatgtgagatgtctctgggcatccaggcagttgtctgttaacaaccagccctggagatttatatacagacagatagactgtttggcgttctagaatggttaggctagaaatattttttggctgccacagatagcacggtgattgaggacatacatgtggatgaagttatgtagagtgggcttataatgcaaggtgttcaacatatgggagtccatgagccaacctttttagagctatacgtgtatacctgcacatgtggctatttccctgagtcatactttcatcagcctcaactggatctgaaaacaaaatacttaagcagtggtattaagtgaagagagaagaggccaaggacacaagccctgaaaggacagatggggaagtgaggccctccaagatggctgacagagatgctccagaatgactgagtgtacctcacagggctctggatcctaggtgctgctcacaggcaggagtgcacactacggtaagactggaaggacccttagactattcaactccttcactctgtgaggtgggaatgaggttgggagaatgctcagggttactgcaaaaggaggactaaaaactgtccttaaccctgtaccctcatgaactgagcgaggcataaagaggaggacattctgggagaggcttcatggcatgtatagggtgagagtagtgctctatttccttacaaaatggtgtgctccaatcaggaatctactcctagttctctcagtcatcagaaggtgttagcctctatttactgatggaaaaaaaatgtggctcaaaggtcacttgcccaaattcagagttaagatagtagtaaaacatgatccaaaattgggctttctgatcccagtactgtatggaataggagtcacgcacgcctataatcccagcattttggaaggccaaggcgggaggaatgcttgagcccaggagttcaagatcaacctgggcaacatggtaaaaccccgtctctacaaaaaatagaaaagactagccggagtgtagtggcacacacctataaccccagctgctcaggaggctgaagcaggaggattgcttaagcccaggtcaagactgcagtgagccatgattgcgccactgcacttctagcctcagcgacagggcaagaccctgtctcaaaacaaacaaacaaaaaacagaaagggtcctcaagcaatctagtcctcctcccctcttcaccaaaggtttaagtgactcattcaagaccataaaggaaaaagaattggatttctttatgtccttctccgaggacagatccttttgttatgactgggaaacattaatgactgaattactctccaaatgtaacagatgattttttttttctttagatggagtttcgctctgtcgtccaggctggagtgcaatggcctgatcttggctcactgcaacccctgcctcctgggttcaagcaatgctctgccgcaagcctcccgagtagctgggattacaggtgcctgccaccacgcccggctaatttttgtatttttagtagagacggggtttcaccatcttggccaggctggtcttgaactcctgacctcgtgatccacctgcctcagcctcccaaagtgctgggattacaggcgtgagccaccgtgcccagcctaacacatgatattttattttatttatgtatttttttgagacagagtctcgctctgtcacccagcctggagtgcagtggtgtgatctcggctcactgcaacctctgcctcccatgttcaagcaattctcatgccccagcctcctgagtagctgggactacaggtgtgcaccaccaaacccagctaatttttgcatttttagtagagacggggtttcaccacgttggccaggctggtcttgaactcctgacttcaggtgatccacccgcctgagcctcccaaaatgctgggattataggtgtgggccactgagcctggccaacagatggtattttaaaactcactggggcctaaatgtgttttagtcagaaccctccttgcacttaaataatttaaatacagagtaatgtattattagagtaacaatttattagcagacaaaacaaatgaaacctctaaatctcaacacacatacaggatcttacataataaacagcataaaacataagcttctagaagaaaagtatctgctattaaccaactccccctcctttccagtaggctgcaatacattaataactcatcctcatcccataagagggttaagcaatgatttacatggaattacatcaaggcacttgctttaattaaaaaatacagtataaaacatgttcctaaaagtcat

SEQ ID NO: 17991 - DNA, 195071 bp, Homo sapiens
ttattgaatgtttctttctgagaaactggacttgtcagcttctttcattggcctctcagcttccttggcctttgggggtaggtttgcatagacctgcttacctcaaccaagtacacagatcaggagatccaatttaaaacaacaaactaacaaacccctatgggatcagagagaccaagctcaatactgaagttaggttttggactcagagacaagcttacctgtaggttgaaagcatgaagcatgaaacccaatgcatgggcaatgttcagaatctgttggtttcagcccaggattgatagttgcagtgcaatttcagccattatgcgcaagcagtgtcacatccattcagctgacaggggcgagacactaatctcagtgggcatccagcaactgaaactgcagctggccttgggaagtttctgccaactctttaaatctttacaggtacagagttgctgcgggtgaccaaactttgtagccagtaagatcatgagaaagttaagcagtctgttactttgagggaatttccttagaaaagaagagaaaccgatttttttctcctttctggtgagaatgactcacttggcagagctgattgctttagggcccacttgacatgacaccttccccctgcaaatgactctggatattataacataccttcgttttcattgatttactttactatctttaaaaacaaccctctaggccagaaacatgtagctgcactgctatgtgtgtgtgtgtgtgtgtatgtgtgcactgatttttacacaatttcacaatgtcctggaagtttgtggccccctaggttgacattcggatcgctcgagccagttgaatagttatatgacaatacatgatctaacttctttaactgaaaacaaacctaaagtcatcactgtttttggaccaataggcattgagaagttgtaagcttgatcttttaaaaaatggagacatccactgaccagcagctaattctgtgcagcactccacagcagacagggagaggagggaaagagttctacagggagagcatttttcagtctctagcctgctgtttacaaaggaagtgctggatgtcactgttcacagcctccgtgtagaacagctgcagggggctccatggtgcctccaggagcaatgtcctcaccactatttaccctctaaaacattaacttgaagtcagtggttcatctgtaccacaagcaccaagggacttgttaaaaatgcagattcctggtctgcattccagacccactgaatcatgtaatagggactagaatcaatattttaaataacacctgaactgatccttctcaacaacaaaatctgacaacccatttgaatcgggtttatttcacagcttttaagttctaaaaaatgtactaaaataaggtactaagcacatatgaaacatatacttaacatgtattttactttcaataataatagcattaagcctgggcaacatagggagacctcacctctacaaaaaaaaaaaaaaaaattcaaccgggcatggtgttgcatgcctgtagtcccagctactcatgaggctgaggtgggaggttgcttgaacctgggaagttgaggctgcagtgagccatgatcattgtgctactgcactccagcctgggtgaaagagcatgactttatctcaaaaaaaaaaaaaaaaaagaaaaagaaaaaagtgttacctgttccagaatctgattgttgtttttttcaggctttatttacttccctgttcatgacccttgctggcatggatggcattgtggccaagcaggattgggagatgctggagggagtacagttggtataaaaggggtacatggaataaaacatgtatttcttcttaagtctactgatttaatgtaaatacagatgtatgagaattttcagagtctcaaagtcaccatggttttttgatattatttataggtactaacattttaaaaaatgcagtttttttgagatcaaattttcacttttcctatttgggtggctatttaaagatgcatccaggcacaattcagacatacaagatacttcagttcagtggtttcttgaattacacctaaaatccaaaggaacgtgtttctgaaagtggctgccaatttttttttttaagaggacaatcagcaccatctagtggacacaaatatctcctcttctagaattcggacccctgaggagatggagggcaggctttggaacctaggttggaatcccggtgccagttagttccccaacgaccttgggacaattacttaccctttaggtgctctgcttctcaactctaaatccaggtaatactagtgccgactcatagaatgttatgaatgaagtgaaatgatgcttggaaggcaagtctgaaacactttgtaaatgcagtttttcaataacactaagcatagattcacaggacatgggaactatccagtggtaaacactattatctgctctccagtaggaatggctattatacacaaaatccagtgtgtagaatctacgatatgaggcttaatgagatccctctcctaccatattgttacattcggttgaagtttatggtgaggaaagggcaaccggggcaacaaggctgaaatggtagttggtgcccagatggcaaacaatgctcttgctcgctttcattcattcaaatctgactccactcggaaggaggatgtcaagagtagggagagactgcaaacaaaaacaaaagctaactccgaaactaacactgccactgccatatgtcaccaacctggaatgagaccagggaaattttagcttcaaatatcttgactctagaagaaatttttatgaatgactttgaagggcacaacactttccaggatgtgtttgcgatttttgaaaatggaactgcagaaaacacagtatagacatttggtgctctcggacttatatccccgtgctgttttgagggtgtcacctgcaatagctgacacagaagtatctggggaaattaaaaacaaatacacaacaaatgcaatttattaaagctggcccttaaggcacacacagcctctcggcagtttacaaaatggaagcagcaggaggtaaataaacacgtgagagtgacacagagacaaaacaattcaaaatgagataaatagttttatgcaaatatagtcaatagggacttagtctggaaaggttacaaacagtgaagagacacaaagtttacgtggaacccgaattttattttcacttgctttatatgcatcttatgttgcattttaaaaacaacagttaaaaaaatgaaaacagcagtaatcataggtccgctttttcttagttcagccccttccccccccgagaaattgggaaggtattgttttcttagtggacactattagtcaccaaattaaaaactggaaagaatggccttcgtttatggtgtatgagaaccgtgcaggcacttggcaatgatctcgtcttgccgctaggtaaacagcggtcggtggacggggagcattggcatcatctaggagcctgttagtctcaggtctcacctgatactgaatcaacatttttttttttgaatcagcatttttaacaagattcctcggtgatttgtctgcacattaaagttgagaaggcctagattcatttgatctcaggtacacccctggttgtgtagtttatgaagtctccccaggtgattctaatgctctgtgcagttaagcactgcaaaactagtccaacttcatttttcaaatgaagaaactgtggcccacaaaagcttatgtatttacctaagataacctagctgtttaatatcaaaatccaaataatgtcatctctcttcttcataaaaaaataaagcagggttgaggggacagagggtagggagtgtggagatggggataattattttatacagggtggttgggaaaggccctcctgaggaagcggacgcctgaggaaagagaggagcaaaccaggtggatagctgggaaactgtatttcaggctggtgtgtgtgtgtgtgtatttggactggaggaacaacaagtgtttccaaattcctgacagatactgatctttgggatgcagaaacaggaaatcagaattaccagctgttctcaaaatcttattcttaaaatattctctaccttcttcatattctttactcattattacaagtatctgaagcctttgtttaaaaaatgagaactattaaatttagaagtgtttacaagaagtggggtttatagcaaatattcaaatgctggaaaacacagagaacattattgaggagtattcaaataatagatctcctagcagggttaactgtactacccagaatcatgggttggaaactgtcaatttaaggatttactttgaatccaaaacccgttacttttttgaacactgctcatagaatttgtataaagtatacaatgagtatcaacctatttatattttatttgcaagaatgactcactgccagcggcacacagggccaggaacataggctttcatggcaccaactacaaacaagactgactgatgagattgtggccatgtctctcccaagtgctcctgacctggttcctgaaaatgttcacctcaacctcgaactcagcatttcctgtgctggttttcaacttgacattggtgaatttcttcagtaacatctctaggtcggctgctaagttttaattctcataggaggattaggatactttctcccattttcttcagtttgcaactttttttcttttgagatttggaaagccacataaattccctgagaaatgctgggaagaaatccctgcacagaaacactaacaatgaggacagtgaggctggaaccaggtttaccaggggaaagcagtaggtaggagtggaggtcagagagccaacagaaagccttatcatttagagatgatgtcagtatgaacctgaatggaagcactgaagttgtgacgaatgtttggattctgaatatattttgaatgttgagctgataggacaaatagattgtagagtgagagaggaagaagaattgaggatgactccaaggtttttggtctaggcatggcaggctgaaattaccatttgctgagatggatagaaagtgggtgggggactctggagaagttgttttttcccgtgttaagtttgagatgcttacacatctaagtggatatgccaaataggcagttaggtaaaggagtctggagttcagggaagtctgggctggtgataagatgcaggattcaggagcatagggatggcatttatagccaggtttttatacccagcactcgcctagactgcagctgtgttctttcggcaactcagcctacgactatttgcttcgctgaaaaaaaaccacatcgtacctagttaaaacaatgaggacaaaggggccatgaatgtgaaaatgccctgtaaacggtaatgtgctgttcagactggaaagcaggagaaatgatggcaatggaggtgaggaaaatcagtttgtggacgtagggaaataattttcgtgcactgagaattagagaaactacgaaatgaaagaaggtgcaaaaagcaattataactctttttggactgtagccgaatctgtgcaaaactcatatttttaaaatttccatagcaccccaaatttactagagcttcacatacatggtctttttgagctgcacaagtcttgtaagaagggaattattattgttcccattttacggaggaggaaactgtgctcggagaggataactgacctgtaaggcatcacagcaatatgagggacagagatacacaagcatccagacgtccgcgttccgaatccaacctaaagacgaaaaatcgctcccaacccccaccgtcggcagcgaagacggaaggacacacgccggccgtcccagctcgcagggctccaacagccgccggccccggtcccatttccggatggtacagccctttccgctatcgcgagaccggaagcatcgcgcatctggttgccagggaaacagcggtcccacaggcaggagggatctggaccggcggcttcttccactaccagagaggctgaggtggcgggagagacccctctcctctgggggtaagtggctggcgcggcgagtgtctgcggcgcgcttctgcggccatctgcgccctgactgacggcggccagttcctcgaggaggcccggcgggaaggtgaggggccgcgcagatgagggcggagctcggtcgcggggcggtgcgccgaggagtgggcggggcggagctgcgtcgggccgcttggcatgtagatggactgtcagggagagcggacagggccaatgagagggcgggggcgggctcattgggggcggggccccagcggcttctgcctccgcggaggctatttctccaggaatcacctaacattaggacctgtaaccaaggcttctactttcccgagatttggatcttcccaccaagatctagaactgatcaccagccatttaaactagaccgtaaacggcaaaggatgcaaataggcatttcacaggaaaaataaaaagatgcaaacagcaaacaattgattagagactcaacttttctcgtgaagaaatgtaaaccaaattcacagataccttttacacctatgagactggagaagatgaaacagctttgacataaccagatgggccccagcccagtgtaggggaagtagtgtaatttggtgcagcctttttggagtacaatttggcgaactaccaaaatttgaaacataagtgttctttgactcagcaattctaatatattttatggatgtatgagcataactaaagaaagattggcacaaatatattaacttaaaattgaggtataacttacttatggtaagcctcacccatttaatctacagttctgtgagttttgacaaatgtatacagttatgtaattaccaaccaccacaatcagcatacggaagtttcatcatgaaccccaaattccctagtgctctttgtatttaatccctcccctaacgccatccctggcaacaacttcctagttttttgttcctgtaattttgcctattccagaatgtcatattgatggaagcaaacaccctgtggccttttgaatcaggcttctttcagcttagcatcatgcagttgctattcattcatgttctgtgtatcagttgttcctttatgttgctgagtaatagtccattgtatggatctacggtagtatatttatccatttcctacttgaggcatatttggatgagttctttccagttgttggctattattgatgaagctggtataaatattcatgtacaggtttttttttgtgtgtgtgaatatgttttcatttcttgggtaaatatgaatgagattgtggagtcatatggtaaatatatgtttaactttataagaaactgctaagcagttttgaaaagtgatgattttgcattgtcattggcaatatgagtgttacagttgctctccaactttgtcagcacttggtattgtcagttttctaaaaaattaatttttgtcatttgaataggtgtgtagtggtatctcattgtgatttttattttatttttttgaggggtaatgatgttgaacatcttttcatgtgctcttttgccatccgtacatcatctggggtgatgtgtgtgtccaaatcctttgttttcttgttattgagtcttgatacttgtttatatattctggatatgagtcctttgtcagatatgtgttttgcaaatatttgctcctagtctttgggttttgttttccttgtcttaacatcttttgaagactacaagttttaaattttgatgccttccaatttatccatattttcttttatgaatcatgcctttgatgttgtatctaagaaatttttgcctaacccacagtcacatgtattttttagaaattttatagttttggccaggcacggtggctcacccctgtaatcccagcactttgacaggctgaggcaggcagatcacttgaggtcaggggttcgagaccagcctggccaacatagtgaaacctgtctttactacaaatacaataacaataacaacgacaaaaagaaaattttatagtgtgaagttttactttaggtctgtgatacattttgagcaagttttagaattgcttttaatagcaaatattctatataccacctaagtgaactgatgaaaaaagtgctgcatctatgggatattatgctgttgtttgaaagcatgacgtatatctataaatggtgatatagaaaaatagataaaataaatttttttttctttttttgagacggagtctcgctctgttgcccaggccggagtggtgcaatctcggctcactgcaagctccgcctcccgggttcaggccattctcctgccttagcctcccgagtagctgggactacaggcgcccatcaccactcccggctaatttttttgtatttttagtagagacggggtttcaccgtgttagccagggtgttcttgatcctcctgacctcgtgatctgcccgccttggcctcccaaagtgctgggattacaggcgtgagccaccgcgcctggccaaaattgattgttaattgtgaaaaagcaagttgcaaagcaccatgccatttgtatgtgtgtctgckttggggaggagtcgatgggtataaaagatagaaggtttgcatatgcctaaaaaaatgagacctgcragtctctattaacactaattcttgggataagccgaattttgacttaaaacattttgatattcacctgtattatttgatgttttttctgcatgggcaagtattccttacagatacacaaatatataaagtaaaaaaactgaccatacataaataatttttagacataaaaataatgaaactaaatcagtcccactttttaaagtcttgctactcataatgactaaacagaggaggattcattttcttttgattcttttattcacctcaaaataccaaattatagcagccatatgtccccattttggctttaaatcatctatgttgattgcatttctcagaagcctctatgaaraactttaatcttgtttgaaatgaatgttatataagttggcacttgttacagtttagaatctggtcatatatctaatctatttaatcaagtatcatgaagtaaatatgattctattttgaagtgttttaatgtcataagaaaatgctcattatgtactggtgaaaaacacattagtccaattttgttgaaaaagacagagcaaaaatgggaaagatgtaccaatagcgtwtagctcagggtggtgggatgttgggtgatttttatttcttttcaaataccttttagtacattctagagatctttctataataaatgaattctttagttataaatacaagatatagttaatagaaaaacagaaaatacagataagcaaggggacaagaacatccagaaacccaccaatccagaacccactactcttacttccttgatgtgtcatcatytttcaggtccctttgtgtatattcctttaataagagaagttggactttttaaagcaggattattggcaacttgtatgtctttctctattttttttgatatgtgcatttctgtttaaaatctttacccagttttctattagaattttcttttcttactgattggtaagagctctataaatatgtgaatatattaaccttttgtatatcatctttgttgcatttatttccccagtttctcaggttccttttaatttcacttagagttctttttcatgtttgagattcaagagcattaactattacgtagccacatctgttagtcttttcctttttgatttatattcttagtatcacgcttactaagtcattaattccataattatgaaatttatctttacatttatgtttataaatttatctttatgttccttccagtctgttagagatttcatattttttattacttataaaattagtttttacttttattaaagtattatgtttaactgttgtttggctttatcaatttctggacagtctctttgatttcctgtggtaacagattacatttctgatactactcgcttccttttgtgcactcctcacgaacaytcaatataattaaggcataatatttggttaaatcaacattcaatgcttacgtaattataactatttacatattgattgcttttttcttgtacaatgctttatttttcttgtggaatttctttgtggcagwtgcaatttcttctcaaatgcttaaatacatctataagatccaattttaataccctttaccaatacctttttctagatggccaaattcataagatagtctgttattgagtccccacctacctcaggaactgcattttatttaatttattattttcaggagtgaacctaatagaacagacctatttctagagcaaaatgaaagatttgtggagctctttagctgatccaggtcattgttggttgcctgtgcctgtgcytttattgacatgtattatgcggytctgcgcatgcttccatctcattgctccctctgcaagctgtaataagtctcccttgacaggctgcttagggcgtttacaagacatttggccttttggtgacttatgctttttggttttgatgtgaggggccagggtgatccatcatcccacaataataatgtcagtgctttcctgagtgagcccaaactcttttrcagagtttgaataatgttgagatcaatgcttttttcatytgctgagatgggaagagctgacctcctgatctcttaaacataagctttggcaccttgaatggttggaagccaagccrtaacatcrctctgtgtacctaggtgaagcctcaggttgtttatatttgtgctttctcctgtgtccacagcttctctggaccctgcctctgctgttcaaaaaagcaaaagaaagatgagtcattttgtagggtaagaaaaggacattgttgggtagaggcaattkcctttttcattctgttatggttgaatgtataattgataggaatttaggaaaggatttgttggaagacacccattcacatgtaaatccgagtatgagagggcaaaagctggaattaccctctttcttccatttgactcagcatgcgtgttgccccagtgtcacaggacagatctggaatggtcttagtcagccacacagtttggaaggatcaatgtgcctgcatcgctcactgtgtctctgtagcttatgccaccctgcctagtatttcttgcttccggaaatagcactagttatagagcagccagggtggtgagaagcctgtggatatatcacatgaagaatagttaaatagattggtaatgtgtagccagataatgaaaatctgtcctttaataaaggaagtaggttttgttctcttgcttcagagggcagaaatagaattatgggttttagaaggggagggttgataaaatgagagcagtgcctggagataggtactccatgaaaatgcarccccacgggggagaggagaaatcagagctgagagggaagaaggctgaactagagtggacaaggctagaaaaaagaaggcaaaaccgaaagaaagtagcagggggactttgggagaccgaggtgggcggatcacctgaggtcaggagtttgacaccaacctggccaacatggcgaaaccccgtctctactaaaaaaaaaaaatactataattagctgggcgtggtggcgggctcctgtaatcccagctacttgggaggctgaggcagggagaattgcttgaacctgggaggcagaggttgcagggagccaagatcgcgacactgcactccagcctgggtgacagagtgagactcattttcaaaaaaaaagagaaagtagcaggagggccttagcaaatcattaagatgaagtggatcttgcttgagagacgggtgcccctgagtgttccctcggggaagaccagggacatgtaaatgttttttcctggaggcccaggaagcaaccaagatggcattcacttctgtgttctcttytagccatattcagtatctaacatcctgggcagtatattttatgcatactgtggcataagattgaacaatccatgtacacaagatgtcttttggtgaagctggggaacccttaagtgtgacttcagtagcaacataatctttaaaacaaagcctctgagtaattggatattaatactaactaatgaaagatttaaatatccgagtcgcttggtattaaatattttatttgttgtttcaggatttcaatggatattataaagggaaacctagatggaatttcaaaaccagcttcaaattcaagaatacgccctgggagcagaagttcaaatgcttctttggaggtgctctcaacagaaccaggatccttcaaggtaatttacgtttagaaaagatttaaactcctttccccaacctctcagcagttgatgaaactaaggttgttgttaacatcccattttaaattttctccttagacggtgtgtttggggagcacttgcagatttcttggattttaatctagattaatatgaaaaaactctactccattccttccctccctccctccctccctctctctcctccctccgcccctcccctccctctgctcctcccctccctctgctcctcccctccctccctccctcccaccttcctttttttcctttctttttttggagtgtggtttatttctctgcactgtactttgttaaaacttgtgtatcgactctttttttctttataaggaagttttgtattccaacatctaatataccaccactgacttttactaaaaacacttactcaaaaagattcagtattttaaaaaaaccgtttggtaaaggccatgtgatgtatattgggtaggtatattgtattagtcctttctcacattgctataaaagaactacctgagactgggtaatttataaagaaaagaggtttgcatggttccacaggctgtacaggaagcatggctggggaggcatcaggaaacttagaatcatggcggaaggtgaaggggaagctggcacatcctacatggttggagcaggagagagagagagtgaaggaggaggtgctacacactttcaaacaaccaaatttcatgagaacactgtcagaagaacagcaatgattcagtcacctaccaccaggcccctcctccgacactgggaattacaattcracatgagatttgggtggggacacagagtcaaaacatatcagatattatctggctgtgaccttattttttttttcttcagcagtcccttttttttccttaaaatatctagacttctagacttgatttttttacttaaagcattagttttctcatttatttcttttaaggttttaggaaatgaataattgaacattataatgaaaaattttggcaagttaatgaattcatactcattttttttttgtttgtagactagattctgcattatggaactctwagaattctgtctgtcatgatgtggttcaggaatagcattctatgtatttcaagcagaaggggattgaatacaagagttaaagcctgggcaacattgtgagaccctgagtctacaaaaaattaaaaaaattagcaggacatggtggcacatgcctgtagtcccagctacttgggaggctgaggcaagaggatagcttgatttcaggagttcaaggctgcaatgagttgtgattgtgccactgcactgcagcttgggtgacagagtgaaactstgttccccctccacctcccccactgcaaaaaagagtttagttcctcaaaatcaacagaagacctcaaaatcaacaggtgaccagcaagaaagggagttcagggaggggctatacctggattatgggttctcaggtcacgccaccagagctgtaatccagagatcagaaagttgctgctgctgcttccgccactgccacaagtccctcagaaccacaaagctggtgactagacatgcagagatggctgcctttgatatttttctgccagcttcctatcaggaacttaggacgatgcttctacctcacatctgctttctaaatcttgtgcaggttcatctaattggattatcctaacgtacgtccagaaccctagctataagtgactttgtacaaaatatagttttgtttcatctagtcctgcatcattactatatggtgtgttaactcttacagctttgtaataattactgatatctgatagtggctcttccatattgtttgttttcaggactgtcttaactatccttggctttttgctcytctgtatgtatttttttttttttttgagtcttgctcttttgcccaggctggaatgcaatggtgtgatcttggctcactacaacctctgcctcctgggttcaagtgattctcctgtcagcctcccgaatagccggggcyacaggcacacaccaataggcacacctaatttttctatttttagtagatatggggtttcaccatattggccaggctagtcttgaactcctgacctcaggcgatccacatgccttggcctcccaaagtgctgggattacaggcatgagccactgcgtctggcctatatgtgctttagatcagttttttaagttctgaaaaatccggttgrggttttgattgaaattgctttgactttacagattaatttggggagaatttctaactttgtgatattaaatcttgtcatgtattaatattgtatctcagttgatctattaacttttaatttttagttaaaaaaaktcacatacaataaaattcacttttttggtgtatagttctatgagttttggaagatagattgagtgatataactaccattacaatcaagatatggagcagtttgttccatcatccctgaaaacattttttcattctattcctttgcagataatcccatgtcacccttaatcccttacaattactgatctattccctgtctctcttctttttccttttccagaagtttrtataaatggaatcatacagtatgtagcttttcacgctggcttttatctcctagcatacttaatacatttgagattcatccatgttaatacatgtggctgatttcctttttaaaaaattttaagtagagacaggggtctcactatgttgtccaggctgcaaattttagagtagcatagaattagtattcctgcttatttatttctgggtgacaatttttttaagcagcaacttcatgatattgataacttacacataytttaatacacagattaatattacttcattcaagacttattaaaaggagaatatcagtgatcacgtaaactcagattttatttgaacctactaagctacaggttaaactctagaatatttattagccaatctggactttggcacttatattgaaagcaaagttttcaaagttgtgatttgtgttaatcaagttcatagaaagtcagtaaggttcaccttagattggggaagaaagctacaaatatattgtatgctgactgctgattgcaaatcattcagcatctagaaaaccttacatattgtttgactaataaatcttggtgtgctagttagttttattgctcagatttgtcttttattaaattcttaccaaagatttttttcacagcagaaaatgagcttaaaatattagtgttttagtgacatgtatttagtgataatatatttctcattctaaaaattttggcttgttgttgcttattaattttttttttaaagagccagtagttgtattttgtgtaaaaatcccatgggtttcaagtaggaatctaaatactagtaaggggtttcatgaggtatttgcgtttcctgtgattaagataaaggtatggaatgggggaagtggagccatgaaaaatggaggtggggctgggcacggtggctcacgcctgtaaccccagcactgtgggaggccgaagtgggcagatcacttgaacccaggagttcgagaccagcctggccaacatggtgaaaccccgtctctactaaaaatacaaaaattagctgggtgtggtggtgggtgcctgtaatcccagctactcgggaggctgaggcagaagaattgcttgaacccgggagatggaggctgcagtgagccgatatcgcaccactgcactccagcctgagcgacagagtgagacaccacctcaaaaaataaaaataggctgggcacggtggctcacatctgtaatctcagcactttgggaggccaaggagggtgggttgcttgagcccaggagtttgagaccagcctaggcaatatggtgaaatcccatttctattaaaaaatacaaaaattagctgggtgtggtggcatgcgcctgtggttccagctagtcagggaggctgaggtgggaggatcgcttgagcccaggaggtcgaggctgcagtgagccatgatcatgccactgcactccagccttggtgacagagtgagaccctgtccaaatgtatatatatatttatacagagatgggatgtgatgttaagaatgaggaagagagaaaaatcatgcatataggccacagagcagaagagcagggggttaggaatagagaggccagtgggcaatgggttggggaagacagttggtagctagtggggtgggaaactatgggaaaatttgtgaaatttgcctagttctccagcttcacctttgtacctcattaccttctgctctttctgagttaggatcatatgagatgatggatgtgaaaggtcttggggtaygctgaagtgtgctatccatctagttatgttttgtatattctttattcccccatgtgaaacccagccgcagaggaaggtctgctaagttsctttataccaatataaatgacaggcagaacttgtgtgacttctcccagaaatgttagcattttcacaggacggaaggccttaaggattaactggatattgtggaattacagactttttctggcatttggcagaaatatgtttttgaacagggaaccctgtttaaccacctccyggattacataaagtagacactattttgcttatttataaattgggccttcactagtttcgttttctgctaggtctgttttcttctctgttaattcatggtagagaaacttacaccatagggtcattgtgggaagcgaatgaggcaggccatgactgatagtaattcttcaataaatgatggctatgattattaccactgagtcagctcagttccgctgggtttatgtcctggctcaggcagggacatactcacgcaggcctgcattcctggcagtttcattctcagcactgtccatcttccaccctggggattcacgaggggactgcagattgtggtggagagttgaacatgtggtgcagagaaaacacaaaacctacagagggctgagagcagatgggctggaggagacagtctctctgtkgggaggggaaaggtgcttctttgagaaagggctgactctctctctttaaggtctttcctgtctcccttgggctgtgttaacttctgaagtgattttcatcacagtttacaaaccccagggcctatgatccctgcttttccctcacccggccatggaggtccttttctgttctctcttaggaaaacacagctgtgtcaattggtgttttcaaaatgaactttgctaaaatataaagggaaactaaaatgaaatagaaaaactgtgaataacatagaaataaataaatgaccaaagcacagggttctgattaggagactctccctagaaagcacatctcaactcagactatccacttttcawccattctgtagccacatgtggcaagtggctgtcgtattagacctttgactgcccatcccagtgtgagctcaaggagcaggcccgtctgccttatcccagagcccggcagatagcagttcccttcaggactgaygtagactcttctccattattgctagggattgctggagaatggtgcaaatgttattacatggaattgtgtagttaaattacatttaattagagtgttatatttctagaatactttaatgctagtgtatgcatttatgtacattctccatctgcttccattagtgtcaaartattctagaaatgtaaagtttaaaaaaaracagtattttcggaaaytgttttttttttdaaattatttttaggtcgatactgcaagcaacttgaactctggtaaagaggaccactccgaaagcagtaatacagagracagaagaactagtaatgatgataagcaggaaagctgctctgagaaaataaaattggctgaagagggatcagatgaagatctggatttggttcaacatcagataatctctgagtgttcaggtaggataatcactaggtgattggctaatgataattacaaatgttaatgattattacaaatgttatatttaaggtgttagtattacctgtgtttttatcaactaaatataaataataaaccaaaaaaaagacatagactatttgtgagcaagcaatcactttttatttataacaatattaagagcccttaaatatattagaaatataacaaaatatgtcatttaataaaattgtggtcattgtgcattaatcaagtagggagtatttctgcattttttgatgcaatttattgattttttgatgactaaaattgtacaatataatatatgctctaatttatagggatagtcccacccaataacatttggattttcaaagatgacattttttatgctggtaaattaattctagtcagattgaattagaatagtgtttctcaaaaagtggtctgcagagccctgggggtatggtgggagatggtgkccctgagacccttgcaggggctctgcaaggtaaaagctgttttcatagtaatgctgagrtgctatttgcctttgtgtccaccatactgacatttgcactgatggtataaaaggaatggtgggcaaaattgctggtgctttatcatgaatcaggacaatggcaccaaaatgtactagtagtcattgtattctttgcaaccaggcactggcaggaaaaagamatagccagtgtcactggctatgaatcagtaaaaactatcaattttatgaaattttgacccttaaatatgcatcttcttaacatcctgtggggmaaaatgggaagtatacataaagcaattatgctgtgtaccgaagtttgaggttgtgttgaagaaaagtacttttgtgatggttggagttgagagctgaactggccacttttataatggaacaccgtttttacttgaaagaatgactgacaaacaattctcattcagatgggtatctggtagacttctttttaagaaaataaacatgttacttcgaggataactactgacagtatttgttgccaatggtaaaatttgagctttgaagtgaaaattacagttttggaaaactgcatatgtcactgtgaggttgatagctttccagtacttagacttttcttttttttttttttttgagacggagtctcgctctgtcgcccaggctggagtgcagtggcgcgatctcggctcactgcaagctctgcctcccgggttcacgccattctcctgcctcagcctcccgagtagctgggactacaggcgcccgctaccacgcccggctaattttttgtatttttagtagagacggggtttcaccgtgttagccaggatggtctcgatctcctgacctcgtgatctgcccgcctcggcctcccaaagtgctgggattacaggcgtgagccaccgcgcccggcccttagacttttcttataaaaattggtggcaatattaactgatgccgttgtgtaatgaaatgtgttaagaggttgaaggtctgcataatttagttaaccacttttttccaaatgattaatgtaggataaaagatccattcaatgtaaaatatagatccatggattttaatggaacaaatacataaagctcactgatttgattacaggtttcacttaacagttaacctgtaggaaaccacccctgttaagttttggtgtagtatcaaagaagactgtccaattatctgaataggctattaagtttcttcttcctgttttaaccacttgtctgtgtgaggccaaattttctgcatatactttagccaaaacaacagattacaataggatgactgtcttcctatgagaatatgagaatccacctgtcttcccttcatccagatattacaaatttaaacaataccactcttctcactaatttktttgagaatatagttatttgttataaaatgtgatacttatgttaacataattagtaatagcatgttttttatttttgaaagtgaattaataagtaaatatttacttttcagtgttgatttctaatatgttcattatcaatagctataactcacataagaaaagttaaactatttttaaggccgtaaaggggagctgagaaaaagtttgagagctgtgatttagagtatgtttgggatgagatcaactctcactgttaggtcaggtgactcaggattatggttttcaggaaacaaagtggaatgggagatttcccttatcgcccttgaaggacgtgtgacaagggtacggctcacttcttcagtgcttccctgctcaaacccctagagggggcaggcagatgagcaggtgcagaggccatggggagtgcttttgggctctgatcccatggcagtgtctaagggtgagtgtttacaactcccaaatcccaagtgggagtgttccagtgtgctctttcagctttgccgtctgctggcggcttgtgttaatcagctcaatgagaccctctgccttatgacaagggcagagggctttctgtatcctgggttcttgccctggtataccagaagaatcgaatcacatgttggcttggaggatgagtgcaaggttttattgagtggtagaggtagctctcagtgagatggatggggagctggaacggggatggagtgggaaggtggtcttcccctggagtcrggctgcccagtggctgaactgtcctctgactgcctctggctgaactcaccttcgcatctgcatcgttccgtagtcactggtttgccagtgtctgctggtgtgttcctctgctcctctcaacgtccagccacttgtgtcttgtacgcttaaggtctcgggtttatatgggcacaggatgggggcatggcaggccagactgggcttggaaaatgcaacatttgggcatgaaaataggagtgcctgttctcacttaggtccatgggcacaggcccaagggtggagccctcgccagggactctacctttctctacccagcacttccctgtccccttcctgtctcaaagatattataattgaaattagctgctgacacagtttacattggatttgtttatattgttttagtactgcatgagttacttcaaaatgccygctatatagactacctatgttcacggagcctgagaatgctaggattggcagttgggaatgagaactagaaggtgttgcttttgaagtacataagcaataagattcaaggaacctccttattaataatatcctttttggataagttgctttcctctttctttttttcctctaagaggaaatgatggaattgagagcagtagctcacacctgtaatcccagcatttgggaggcccaggcaggagtatcacttaagcccaggagtttaaaaccagcctgggcaccatagtgagacccccatctctacaaaaatttttttaaaaaattatccaggtatggtgacatgcacctgtagtmctggctctggctgttcagaagctgatgtgggaggattgcttgagcccaggcgttcgaggttgcagtgagctatgatcatgccaccacacttcagcctgagtgacagaatgagatcctgtctcttaaaaaaagaagaagaagaagaagtgatgcacattatagagaaacatcacttaaccctttgggttttcaaaagttgataaatttggccttacttagcacaatatgccacttctaatgatctaatctggggtggctgagacttactgtttgagcattcatgctcattcattgctggattatcagctttcatcagatttaaatggagagaatattatctgtggctaagaggctaagaactttggctctgcagtcagacagatttgggtggaacctgactggcatttaccagttatatgaccttggacatacgtgtaactcagttaaaaattagcttcagtttactaatttgtaaaatgagaacagtgattataccacctcagagggttaatatgagcattaaatgatataaagtttaaaaataaagcacttaaaactgtgcctatcaggtaactctataaatgttagttattattatcgttaatcataagttaatgacagaagttctaaagagtccttaatttcaaataagtgactatcaattgtactttaagaaattagaacaaargaagcagcatagaaaaaagatacaagctacatagagtacttgttttgagtttttttctttctatatgttgcaaccacttygtgtcactgaagacttacggctttctactgtagccatttgtgtacacgccttctctttcagttagtctgaagcagctttaggacaggattcttgtcttattccttatttcctattttttagtcatgaacatagaaagtataacagaatgaaggagaaagaatttgggatttaaaatcacgaggatcacttctgagtccagtgctataatttgttacatatttgaaaggacccagttatctcaactgtaaaatagagataaatgtctgtttcatagggttgttagataattatatagacaaacacatgtgaaagcaccttgtaaaytgagatacatggtaccaatgtagtagttattactatcagctataaatatttgttgaatgaaagaacaaattgtaagaacaaaacaaaactttatagttttactatacttcaaacctatttttactttcaacacaatatagatgaacccaaattaaaagaattagattctcaacttcaagatgctattcagaagatgaaaaaacttgataaaatattggcaaagaaacaacgcagagaaaaagaaattaagaagcaaggtctagaaatgagaataaagctgtgggaagaaattaaggtaagaattatctaaccttatgctgacatgtaagaaataaattctcctggctgggcatggtggctcacacctgtaatcccagcacttagggaggctgaggcaggaggattgcttgaggccaggagtttgagaccagcctggacaacataaagagaccccatctgtacaaaaaaaacctaaaaaattagccaggcatggtagtacgtgcttgttgccctagctacttgggaggctgaggtgggaggatcccttgagcccaggagttcaatgctatgcagtagctatgatcatgtcactgcactccagcctggctgacagagcaagacactcaaaaaaaaaaaaaaaaaaaagaaagaatttcctctaagatgagtaagaaaatcatggaccatggtgttactgtggcctgccttgattgctttattttgtggaggtagtggcagtggtatgtatatgtgtgtatatgaaggagtcatggggtgatatttttctggaacctgagaagaaaacttggtctgcaacattcagatttcaagcactgcgctggcrtgttcatctccccagggacaggcccagggtaccatgtctcttaccagcagcaggctggtaaagtgctgggcccctccatctctggaataggaaggggtgtaatagctgctttcatcaagtatgtatatctgctttttcttcagcagccttatagtttggagataaatagacacagtttaaccctctggttagctttattatttgggtaaacctttgtgacaaacaagttttggggagttgactgtttcctgtgctggtcaagatctttgggargctgtgaagtgcttgaggtctgggaccatacttcatttgcttctgtctcaacaaattcctggtgctcaatgaactttccttggccttcttggacctcttattctctataatattgagggcttgaagttgactagatgttggcattgacttggtatatagccattggctcatatttcaattttgaccctcaaaggaaagcacctttaaggtaaggaaccttgtcataagagattggttatttttgataaagtcctccttgaacagttgactgacttctgggaaagtttcctaggcaataatgtgaattaaaaatgtagtaattaaaaatacatttttatgaggttcccaggaagtccactgggatggaaagaaagaaacatccaaaatgcaatgctttaaactggagaaatcgtttctggaaattttagcagaaaaagttagcctatcactttttcctactgaatctcaagcaagtttttatttcctttgaagcaagaattataaatggaaacataataaaacatagtaacaatgttgaaatgtctgaaatttttaaattttatggtgtatctttaggttactcacagattataaaaatatcaagcagaaacttatgatactttaagcaaagtaattatcatataatgataggcatatactctgactctatctgggaatacccattgacagaattttgtgagaacagaggagatttacagatttcctcaaaaaaaaaaatagcctgagacttctcgtttgtacgtatgtgattgggagccgtgttggagtttaaaaaatcaatgattatagttgccttcttttcccatgtttaaattttaattttcctttcattagtctgcaaaatatagtgaagcttggcaaagtaaagaggagatggaaaatacaaaaaaatttttatctttgactgctgtttctgaagaaactgttggtgagtagatggagatgtcattcaactttgtttttatctgagtcatggaatatttggattaaagtaaaattcccaatccagtttttctgtcctgttctttgtgagtttgactgttctttagggaaataattgatcacattaggtaggattatatgaaactactccgagcttaggtatgttttggtgtctttaagtgtttgtgtctgcttgatggtaagggggacagggcagggacaaactgggaaatagacaaaagtatgtcattgcctttacttccttgtctcttttaggtgtctttagaccccactttctgcatacaattccctaactgcttatgagcctgtggaactccttttgttaaaatctatgaccgatttgtcctatttcctggtctctcacagtcctatatttttgagatgagccaattctgcatatttatttctgcctttctcctttgtttgtatgtatatttgtgaatcttcctttttgaaaacagaaatattatggagtcatgtaacctttaacccatttatatgatggtgaaaattttagggattagaaacattttgtatttttgtatattctagttgaaacatcaaaaaatactagtctggcctatattaaattcatagatcatttactttttgcatcttctgtttygttacggaggtaacacatgtataatctatataagaaaatattgrttaaacaaaaaaaattactatcagctaaattctcaacttgtagagataaccactattaatattttagtttactctttatcttttgagatgtgtttaatgcaaatatccatgtatatattttgagaataaaaatatgatcaaattatatatgtatatggtattttgtaacctttcccccactaatttgtatttcacgagcacctttacctgtcaataatagatgtgtgtggtagtttgtttccaaacggctgccattagttccttccctttatttgtgttcattctcctcctcatttagagatggagtccatgtttccctcccatttcagtcttggctatcctggaacaactttgattgatatattacagcaaaaatgatactatgccatttccaggccttgtctttaagaaaacaggcagtttctgcttcccttagaatgctcactcagaggaaagccagccattatgtaagaggtcaggttacccaaggctgccatgctgtgagaaacccaagcaagccatatgaaggggctatgcagagagaagatgatggtggccagttcctggctacagtgattttggtaatgtctctctcaaattcatgtccacttggaacattggaatgtgtctttatttggaaacagggtctttgcagagacttagttaagatgaagtctattggattagggtgggcctttaaaaaagaggagaggacacaaagagacatagagccacagggaagaaggctgtgtgaagatagagggatgtagctacaagccaaggaatgcaaggattgctgtaagccaaaagaagctaggaagacccaaggaatcattcggaaggaatgctctgctgacaccttgatttcagatatctcttgatttcagatatcttgtagaactgtagagaataaatttccgttgttttcagccacccagcctgtgataaattgttatagcagccctaggaaaccgatacactgactgttcaacagtttcaatgcagacactgaataaaagagcaagcttggacatttcagctccactaaacacaatgcagagaataaccaagactagacatacggccccctgacctgctccaggcatctccagccaaagggagctacccagccatctgaggccccattcatagtggagcagagataaattgttcctgctgtgtccctcaaattcctggcccacagaagcatgagcataataaagtgttcactgttttatgccattaacttaaaaatttttattgtaaattgacaatttrtatttatggggtacaaaatgatattatgatttatgaatacaatrtagaataattaaatcaagctaattcgcctatccatcacctcaaatacttaacatcttttatggtgagaccatttgaaatttagcctcttagcaattttgaaatgtacaatacatccttattgatgatattcaccacaccgtgcaatagatctcaaagaaaaacccttattcttcctgtctaactgagactttgtaccctttggccattattttctcattttcccatcctccagcttctggtaaccaccattccactctgcttctatgagtacaattgttttggattccacatataaatgggaacatgtagtatttgtctttttgtgtctggtttattttgcttggcataatgtcctctaattctattcatgttgttgcaaatgatagaatttccttctttttaaagactgaaaagtactccatggtgtctatacaacacattttctttatccattcatctgttggtggatacttaggttattccataacttggctattgtgagtagtgctgcagtgagcatgggagagcagacatctcgttgacaaacgaattccaaagcttttgggtaaatgcccagaggtgggatttctggatcatatggtaattctatttttagttttttgaggatcctccatacacttttccataatggctgtagtaatttacattcccaccaacagattgcaagggtttcctttaatccacatcctcaccaacaatttatcttttgtgtttttggtgagagccattctgacaggagtgagatgatagttcattgtggttaatttgtatttcctgaatgattagtgaggttgaacattttctgcatatttgttgtatgccattaagttttattttttactttttattttgaaataattttaaatttatggaaaacttgcataagtagtacagaattccatatacccttcccccctgcttctcctaatcttacataaccatagtgatcaaaactcagaaatcaacattggtataataccattaattaaagtatagactttcttaaaaatttaccagttttcccactaatgtcctttttatttactagtatccaatccaagatcccatgttacatttcgttgtcatgtctccttaatctcctccaatctgtgatagttcctcagtctttccttgtctgtcgtgatgttgaccctttgggagagtattggtcagctattttgtaaaatgtccttcagttttggtttatgtgatgttttctcatgattagatgaaagttatgaattttggcaagcatactctggaagttatgtgcccttctcagtcaatcacacttggtatacctaatgctgttatatattattattggtaatgtttcaccttgatcactttgttaagatggtgtctgctggttttctgcactgtaaaattactatttttttcttttacaattaatacatatcttgggggagatgctttaagactatgcaaatatcctgtttcttctccagctttcacctactaatttcagcatcaatcagtagatcttgcctgcaataatttttaccatatgccactagatttgggtgattttgtaatccaacaatagataactggaacaatgtgcatcagcattatttttaatgattatatattaattcattagatggatgtgccatcatttgtttaactaatacccttctattgaacatttagattattcccttagtttttcaattttttaaattacacatgttgcagtgacatccttagtcaattattgcaatgattaccttctgtggttggctgaaaaaaatccaccccaatcccccaagagatatctatgtcaaatccctagagcctgtgaatgttaccttatttggaaaaagggtctttgcagatgtgattaagtcctggaatattgagatgggccctaaattccatcataggtagccttatcagaaagagatggagggagaagaggtagataaggaagaggaaaaggtgctgcaaagacggaggcagagattggagtgatgcagcctcaagcctgctggcaaccatcagaagctggaagagggaggaacagaaattcctctagaacctctggagggaacgtggccctgctgacatcttgattctggatttctggcctccagaactgtgagagaataacttctgttgtttgaagccaccaagtttgtggtaatttgttagggccgctatagaaaatgggtatactttcaaatacattcctagaagagaaatacttagtccagggttggactttcacaagatttttattcacattgacttattgaaatcaatttagactcttacccacattgtatctgaatattatttttctatgccaacgatggattttgtagttatttttaagctttgtttatttaaagtggaatcacaataatttgtatttctctgattatcagggaggttatagatttattctttggtttagctaagttgtgagttacctactcatgtcttagtctcttttataaagtgaggtattctttattgatttgaaagacttttttaatattaaggatattaattatttgtcacaaacaccataagcatttttctaactttttttttaattttgtgacatttcttgctctagttagtcatttcttttatgttatcattcattggtactctgctttaaaaggccttttatgtctcaagattgtataaaaaatatatattttcctttcatcagttataatttaatgaaaaaatttaaatattaacccacttgagatttattttggtattagatatgagttagagagttgattttgtttttttcccccaatttgctaaccagctattccaagaccctttattggataatctgtcatttccccacttatttgaaatgctagctttatcgtgtaggaactgggtttattttcagattttctattttattccattaaaatttctgtctgtgctgatgttaataccactctattttgattattgtgtctttgtaatatattttattggggcagtattttggaataacatggttttctcaaacctattttttttctgagtttagcaatgactacattattttttaaaaaagagattgtaaaagcacctctaaagctatagcttatgaactgcttttttatttatttaaatgtctaaagaccagtatatgaacgtagtctgcttggaaaagtacaacttactaatatatttcattcaatgtttatcagtaattctataccttcatagaaatgagactataccccttattcccccccctcaaaaaaatccatggacagtgtcaggaatgagattctggatattatagtatctcaatgtctatagtttggaaaccaggagtcaaatactgatttttctagtgggtagggcttttctgaaagaccaaacctgcttgtggttgactctggagcaagcaatgtaagacaggccactctgtaagtggatctatggtggccttttaacattaagcttttcggtcacagagttcactacccagtgaacttttggtcctggaaggcaagacatttgttttcagttgcccttttttcaaaaccaaatcaaaactgtcaaatatgtttaatttttaaagctcctggcccgtatatttgacttaaatctatgctcacattgtatttctggagttatgtgactgctgtaggccctgtagacacttcccataaygttagattagtcctgatgttctaacatggaaattaagtggacttaatgatatgaaagctggagctgcaaggggcttgaaagctatgttaagagagaatcattgttttaaacatgatgacattattaaagcttcaatttttagattcagacttcttagttattatgtattggcagtgtgtgcaaagcaggtaagatgcaaaagtagggtcaacgtaaaaggaaaagggaatacaagatactgttaggtgaaccagatgtctgttgcacttcactcttgctactgactgtcttaattagttcacacttgaccagttcaccaaaatgaagaggtaacattattgtattactggcttcttcagatttaattagaatctttttttgatgattgttcttttacagaaaagccaaattccttaatgaaatttcctgcttgctgtttacttcatagacatatgttttggagtcatttattgccacacatatctgttttttttwaattcttaaaaacaaaaaagtagttagcatttactttaggctgcattattaacctaattatattaatttgttttttggactacataactattaccttattctaaaagaggaaacttttggaataatcagcttaaacttggtattattagcagaatattttcactgcaagtatgaaagaaataattagaaacacaacagtccagtttgacctcatgccacggattttttgaaagtctcatattcctggtatttcaacataagcactatcataaggtggtacgaagctactttcatctgttctacaatgaaatgaatttcccattactcattagatctcagctactgttttaattagaaatgtataaaaatttaaaaattattttaatcaatcatatatagccatacatttctaaataagatatttttataagtattattaggaaaacaggaaaattttgcctttttttcctgtataattttttgttgccagcacagtttcaggcacttgtaaattgtccagtaggtggcagcatctagttacaataagtactttaaaaagccttaaagcatttaaaaaaattttaaagctcctggcatacatttttggcttaaacctatagagttcacattgtatttctggagtcatgtgactgctctacaccctgcagacacttcttgtaatgttagattagtcctgatgttctaacatggaaattcagtggacttaatgatgtgaaagctggagctgcaagggacttgaaagctatattcagagagaatcattttaagcatgatcacgttattaaagccagacctatttcagcatacctatcaatatacccaaacctactttctttcttttcattttttgtctttaaacaaagggagaaattcttaggatggatatttttcttttctagtcagtttttcttatcctcttatttaagagttagcttcaggttgggtgggtggttcatgcatgtaatcccagcgctttgggaagtggagtcaggaggattgcstgaagccaggagttcgagaccaacctgggctacttagcaagaccttrtctatacaaaatatttaaaaattagccaagcatcaggaggctgaggtgggaggattgcttgagtccacgagtttgagactgcagtcatgccattgctctgcagcatttgtgactgtgtgaaaccctatctccaaaacacaaacaaacaaacaaaaaattaaccttaaggactttgggctgatggctgaatggcaatttccaacctgttttcagcttccaaaacacagaacccatcccagttggcttataacatcacaaataagcaacagcaaataaatgaagaaaataactgtggttggatagtgcatttacttttatttataggtgctaaacacaaaagatgccttgactccaagagaaagttgaaaacaacattaaattgatttatatcacatttgaaccttataatccagacatattaacctcaagtttactgggattttgaagtaaacaatattgtacttgctagagatctctgaagtattttaaaagtctgtcccatcccattactgaggggtcacttttgggtttttttagaggcatgttgcaaaaatcaaaactcttttacatcgccaggagttttcccttagtttctatcatttatctaatgaatacaggtagaattcaatattctttgagacaaatacatctagtgacagggttgctttttgatagaggttattctttttgtctttgtcacgtttctctcttgtgtttctagctccaaatatagaaatgcatataaacacaaaacatcaacatcataaccaattaggctttttcaaatttgagaatacttttttctaggtgccttttctgtgagactcagatatatgatacttctgctcttggatgcttgggttaaatactcaaagaaaatctggtagtctctttctactctgatatgcagagggtagagggaggaaatcacataactgtgctgactgacacaggcaaggattttggtttttaatttctgttggagtctcagcattgtttagcaatctcttgcattctccwaaatggtgattccaaactattactatgtgcttcatctcccatcttctgcaagaccttcactgtcttggttggtcttcctttccagagaaaatgaatctacagggtaggaattccttttacattcatttcttctgtttctaagcttcatcctgactgtgttcattcatcctctgcctcttgcctctaactttagatggagggaaggtactcttattctctgaggccaaaatcagtaacatcccatccctttcactgtgttcctggctgttggtttgttcgtcattccattttttcatctagagcttcaatctctctggctctttccctttaacttaccatgtttaactcttctagtcctaaaacagaatcaaaaagccattgaaccaatgaataaccaacagaacatacaaataagcctttttcctcatttttttttttaatcttactctaaaacagacaccactcagtttccctcttctccttaaaggtcagacttcttgaaagaatagtccacatctcttggtgctacctggtcaacttccatttacttcttaacttttcagtgtctgtattttctactgtcacgctgtggaagctgcttcataagtggtcctcctaaatttgaaatctaatggcatacctccagttttgattgtacttgacatcactgtagaatctgacacagtgacctctcatagcatagtgcaatttttactggatttgttattccctgctggttttcttctttttctttccttcttcctcctattgttgaaacttattccttcttttatatgttttctctgctttagttaatggtttcatcacccacctagtctcctaaactagaaattgaagagccagcctcagttcctctgttattgttcttttacacttcttccttgagttccccaaatgagtatttgttctgccctatctgtatctgacctgttttttttttatccccattattaaatggtttggtctcagcatttctctatcagattattcaaacagttttcagtctcgcctccatggtgtcattattttcctgcaagatcattgtactggttatctagtgctgtgtaacaaattacccctaaaacatggcaacctaagccaacaaacatttataatctcacagtttctgtgggccaggaatctgggagtatcttagctgggtggttccgactcaagatccctcctgtcaaatggttgccggggctacagtcatttgaaagctttattggagttggagaatcggcttccaagctcactcacatggttgtttgcagacctcagtttcttgctgcctttgggttggagaccttaatttcttactacgcaaacccctccataggatgcgtgtatgtcctcacaacatggtagctgacttctagagcacttagtaagtgctcaacaaattgagttattattagtaatcctgtgattactagacgttactgcatcaacaggaacatggtttgtgtctcttatattatcatttatatgtcaaagaatttcttcaggtttcatacatctgttagctatgcataggtcttatatatctttttattgttattaccctgattggtgtttagcccatcatatttataaagggttattaatgacatagacgaaagttagtgactttttagacatttataatttgttttctatttgtacatttaactaaattatcttattaattttaattatttttacttgtttaccttttttttagtttatgaacacataaccaggaaataatgttaatttttgtgtcctttttaacaattattcctatgctgagagctgtaagaacttagtgttgaaatttattgaatgcatttcaatatatatttaaattatcataaatttttatttcatgtccaacatatttaatgttttaaaattaatggatttaaataccaaatgagtcttttattcctgggccaacccttcttggttatggaagattattcttttaatttagtaccagatttaaatgaatgaatttattcagattttttgcatctatatttataagcaaggttagttgtgtttgtgtgtgcacacacaggtgtgtgaaatgtttgttatggtatagggggtgaagttgagggtggagagtcgatgtatgtgtgtttgctttgtcaggctgtgtgaacttcataaaatgaatggggatggctgctcacttatttctatgatttgaaacagtttatataacacagggattatctgttcccttcaaatttgaaagatttcactggaaaaaccatctggttcaaataatttcttggaggcacttctctgactcttttctcagctgccttcatatttgctattctatttcaggttactagctattctggagtcaattttggcaatgcatccatgtcactaagattttaaagtatccacttcatgaagatttaaaaatttactaacatgcaatctcagatagtcttttaaataataattctttttcatattgtttgtacatcctctttatctctaattttgttaatgttttctcaatctttttaacctggaagttttttctaaactttttatttgggcacagttttacattcatagaaaaattatgaatatggtacagagatttcccctatacccacccccagtttcccttattatgaatatcttgcatttgtatggttcatttgtttcaactagtgaaccaatattgatatattcaggtttccttaacttttacttaatgtccgttttttgttccagaatcccatccaggatgccacattccatttaaccctcatgcctcctcagtctactcttggctatgacactttctcagactttttttatttttaatgaccttgacagttttgaggagtactggtcaggtattttgtagaatgtccaagagttggaatttatctcatgcttttctcatgattagactgaragtatgtgtttttgggaggaaaaccatggagttacagggtcattttcattacattacatcatattattaacataacattgctattaatgttaactctgttcacctggctgaggaaatatttgtaagatttttccactgtaagttaccatatttcmccatcctttgccacactctactctttggaaagagattgctatttgcagcccctgcttaaggagtggtgctgggaaaacttgctaaccataggaagagagataaaactggatctctaacttaccatgtacagaaatcaactcaagatggactaaggatttaaatatataaaaattctagaagaaaacctaggaaatactcttctggttattggcctaggcaaagattttatgactaaattctcaaaaacaatagcaacaaaaacaaaaattgacaatgggaacctcattaaactaaatatactaatcgttatttagaaaatgatgatgactttcttttcttctccagaattttgtacaagtcctatattttaaaaatgaatattgagtctcataatattgtggtcatggttttgatattcttaaaaataaattttattgtgtatatttaaggtattacaacatgatatgagatacatatatctataaatatatatggtaaaatggttactatagtgaaacaaattaacatatcagtcacctcacatagttacccatttcctctccccaaacccccatcatgggaagagcagctataatctcatttagcaaaaatcctgaatgtaatacactattatcaattatagtccttgagttgtacattagatctttaaacttgttagtcctacatatctgctattttttatcctttgacctacattttcccatttcctcccagtgttctctccccaggtaatcattgttttattccctttctctgtaaatttgacttttttttttggattccacatataagtgagatcatgatcatgcggtatttttctttctgtgtctggcttatttcacatagtattatgtcctccaagtctacccatgytgtggcaaaaggcaggttctccttttttaaggctgagtaatattcctgtgtgtgtgtgtgtgtgtgtgtgtgtgtgtgtgtttatgtattacagttgctttatccattcatctgccaatggacacttggtttgtttccatatcttggctattatgaataatggagcaataaacatgggagtgcagatgtctttatgaggtggtgatttcattttctttgcgtttatacccagaagaggaattgctgagtcatatggtaattcttcctatttttaatttctttagaaaccttcatattggtttccataatggctccaccaatctgtattccctcaaacagtatacaagggttcccttttctccacaccctcaccaatagttgttatctcctgtctttttgataatagctttcctaacragttgttatctcacagtagggttgatttacatttccctgatgattagtgatgttgagcaccttttcatattgttggtcatttttatgttttctttgaaaaaatatctatttactttgcccatttttaatcaggctatgttttcttgctattgagttgtatgagttctttataaattttgaatattaacaccttatcagatatatgatttgcaaatgtttttcccaatctgtaggtttttttcttttattgattgtttcctttgctaggcagaaccttcttagtttgttgtagtctcatttatttatttttgcttttgtattctgaacttttggtgtgatacccaagaaataattgcccagggtgatattaaggcactttccctctatgatttcttctaggagttttgtagtttcagattttatgttttggtcttttattcactttgagttgatttttgtgtatgaggtaagataagagtgtaatttcattcctttggatgtggaattccagttttcccagcaccatttattgaagagactaccttttccccattgtgtcttcttgggcccttgttaaaacttagttgactgtatatgtttggatttatttttgggatttgtattttgttctgctggtctgtgtgtctgtttttatgccagtattatactgttttgattacattagtaatactaatttgatcacctttctgtgtgatgccttcaactttagtttttctttttcagaattgctttggccatttggggtcttttgtggttccatatgaagtttaggacttctattgctgtgaaaaatattattgggattttgatagtggttgctttgggtagtgtggacattatcacaatattgaatcctttgatccatgagcacggagtatctttccatttatttgtgtcctcttgaatctctttcaccaatgttttatagtttttagtgtccaggtcttttacctccttggtttaatttattcctgagtactttatttgatttttttgatgctatcataaatgagattgttttcttgatttttttaggctaggttgtttgtgtatagaaatgccacagattttcatatgttgattttgtactctacarcttttctgaatttatttattacttctaatagtttttttctggtggaatctgtgaggttttctacatacaaaatcatgtcatctgcaagtagagataattttacttcttcctttctgatttggatgcctattatttcttttccttgtcagattgctcttgctggtccttccagtactgtgttgaatagaagtgatgagagtgggcatccctaccttgtactagatctcagaggaaaagctttcygtttttcccccttggttatgatgttaactgtgaactttttataaatggccttcaggaaattttcttctatacctaaactcttgagagtttttatcaagaaaggatgttgaactttgtcaaatgctttttctgcatcaattgaaatgatcatgtggtttttgtctttcaatctgttaatgttatttatatatcacactgattgatttacataagttaaaccacccttacctgccagggataaatcccacttgatcatgatgtgtagtctttttgatatattgttgaatttggtttggkaatattttattaaggatttttacatcaatgttcatcagagattcctggtgtgtaattttcttttttgtgttgggtctttgtgtggctcaggtatcaaggtgatactggcttcataaaatatgttagaaagtatcccctcyagcctggtttttttttttttggaagagtttaagaagtattggtattaattcttcttggagagtttggtggaattcagccatgaaaccatctggtcgtggggttttctttgcggggaagtttttaattactacttcaatctctgtgtttattgtagatctgttcaggctttctgtttcttcctgatttaatagtggtagtttatatttttctaggaatttatccatttcctctaggttatcaaattttttgacacataattattcataatagtcccttttgatactttttatttcttaggtgtctgttgtaatttctttgttttcatttctgattctagatatttgagtcttctgtttttttcttagtctaacttttgttgattttgatttttcagaaaaacaactcttagctttattgatttctccttccctgtggcttttctatcctctatttgatttatttctgttctgatctttattattttcttccttctgctaactaggtttagtttgttatttttgcagttccttgaagcataatgtcaggctacttatttgagatctttcttcttttataatgtaggcatttattgctataaacttccctcttagaactgtttttgatattttgaattggttgaaattttctttatagcttattagagaggttctcaattgtaggagacatttggatgtgtgcatttttggttgtcataaggatgtgctgcaggggagaatgagggaactactggaatttatgccactatgccaggggccaagtttgctaaaggtcaggaattgcataaggaagctccacacggagaattgttttgcctgtaatatgattaatacccccagggaaaattcacctaatatatgattaacttttataagtactccgtggacacttgaaaagaaggactgtttctctctgtggagaacaaactttgaaatgtgcaaaatgtccttattacttgtctatttgatttgcattcatcttagagagttctgttaaggtctttcagtataattgtgcttttattagtttctgaaaactgattggaatccttcaatatagtagaaaatgcgtattatttgtgaaaccaaaaaagaagaactggaagaaagagtatattaacatgaaatgacaagaggatgatttaaaaaagaagctgattaagatgagaaaggattacaaggaaaaataggaaaaatgcacttattggagtaatgagcataattaagactgcaggagaatcaaggcagtgaaggatgctccacaacatgaagggataaatagatgaggaaatgatgaagtaaatgataagtgtggagatagggaataggaattccagttaaaaattatagaaatttctgagaaagtaaactagtataactattatagaaacaatgatcacaggaaatttttctgatttaaaaaatattatatatgcactattaatgataaaaggccaatacccatatatacacaggtaagattctgaaccatgggaaggccctaagaaatcttacaagcatccaggcccaaattagaataatcttattttacctataaaaatggaagctgarttcagatatctttcttgcaataaaggaaaaatatagtaactagggattacatattgcttctgttattgttttgtgaagacaacagaaagacattcttagatatggtagagtggataattcactgctcatattgtttttggaataaatgtacttgaaaccatactctaggcaaccagcagatgagtcacaatgtacaatccaggattagagaagttgctatataaaggaatgatctgtgagcattataaccagccaaacacagaggtgaacagaaagaaatgtatgtttataaatccaagaattactctatgctagaagataagaataaccataggtaggcctaaaagtccagattatattaacagaggctgaaaagtgggagaaaagtgagggtaagtaaaacaattctaaattccttgtattactttagaggagaggcagaaaaccattttttgttcttgactttcttaatatagaaaaaatatgtttatataacttagacttcaaattaaagtgcaaactttccaaattgttgtatagttaggattatggtttataaaggagaaaggaaaagaagacaagaaaatgagcattaaaagaaaggaagaaagggagagagggaggaaagaggaaggaagaaaggaagaatggaaggagggaaggagggaaggagggaaggagggaaggagggaaggagggaagcccaaacaggaaaaccattagggtctaacaggaaaatcactaatrtgtctagtgatgtacatgttaggtgaggcaatgagtgtactcttttgaactagcctgttaaaagatacactctcacgttggttttcttatcatctctccttatttcactcagttcccccttcttccccctttatttttataatcccatcctcttgtctttttatattcatcagttctttcctgtgacttactcctctagtttcacaaatgtcatatattttgatatattgaggatgccaacaagtttttagaaattttatgatttttttatarttattttcaaaatgtctgctgtcccattgattaccaggatgctgtttcatttgtttttcattttttttccttctgtgtcttcttatcctccaatgaggtaaaatccatccacacctgccatttaccaacagagcaaaaaggtacatctgccttgagtctgctcattgtccatctgcatgcttttaaaattgtgatcttcattgctgatttctgcttcctttctgtccagttgttttctaagagttgcagcctctgaagagatgtagaaagaagtatgacagcggttgagtaacagcatttgaactgcctcaagaaacagtgttgttgctcaaggagatggggactctggtttctggttgtttttttccttttatctctgagtcaagggggtgctttccatctagatctaagtctgcccctgcgctgtttcagtaggcaaagcttacatgaccactgattgcttttctctttccctttctatcatttgtgttggtggcaattttttccagattctggaaatagagaacattaggtcgttgaatgaaattgtttcattcaacatcgtgtttttttatttttaattttttaaatttttattttttagagatgtgatctcattttgttgcccaggctgtagtgcagtggcatgatcactgctcgctgccacctcgaattcctgggctcaagggatcctcccacctcagcctcctgagtaactgagattacaggtacatgccaccatgcccggctaatgtttaaatttctgtagagatggggtcttgccatcttgcccagtctggccttaaactcctgagctcaagagattcctcttggcctcccaagtgccaggattacaggtgtgagccaygccaggctctgtcattttattataacattgatgaaaaaaaaatggattcccagctagggccactgtctgtatggagtttgtcttccccctgtctgcatgtgttttctccagacactccagtttcctctccatctcaaagatatgcatgttaggttatctacgtggttccactgtgagtgagtgtgggtktgtctgagggcaccctgccatggcatcctgtccagggtgtgttcccacctgggactctgagctgcacagatagactctggccacttgagactctgaattagaataagctgataaataattaccttgcttatttttattaatttttctgaaatgtacttatagcccacatttatgtgagttttaatattacaagtgttttggtctttatttagaagtttaataatgtttttgtttccggaaatgtgccacagaaacttaattcttatttatattaattagactatggtaaaattggtttccttatatgtcattttgcttaaagtcgcagtttccaagaatctatagatgacattaagagaggatttactatactcgtgtagggcatctaaaaattgtatggcataattcagtattcagaaatgaggctctttttccctttctgtttcttcctgccttttctcaggatggtgtctgggttcgggaggacgcttgtgtagcatcatggcctggggatggcggggtggggggcggggtggcgcgtgaatctggtccttgctgttctstcagaggcgtatcttgtcctgcttggtctgtggatatgggaagccagctggggcatctgctgacttgtagctggtcccatttagcctttgtcatctgccagcagatgctgatgttgtatgtggtccctgccacatcctctctggtggaaggctctatgccaccccctcatcacgaccccagtcttcttcacaggggcatgtgagagcttctgttctccttcaagccacaggctggccagctrtggggaactgtgtgtgtgtgtgtgtgtgtgtgtgtgtgtgtkactgagggggagagagagagagagmgmgacagacagacagacagacagactacttcagcctctgtctccctgtaagcatgccacactgcctttgcttgtctgcagctgtcatgggtggttggagagcaccatgttcctttgtgcggggtctcccctcagttccaggtgtacagtgaggcagagctcactctgctgtgggtttctccagcctcttcaggttctctatgcacctccaggatttcacctccaggggctgtgccggggagcagcttaatacctgtatcacttgtgtctactctaaactcatcccctctgctggtcttccaggtcctctaggtccttatttgggatgggctttaatttcttccatgggtggcaggaagcaatttaaatcacatcctgcaatcttcctctttcaggactcatattaaaaacttgctcaatcatcaatgttttggctcatgatctctaaagggagatttttttttccttctcacatgaatgtttgtagtgaagagaggaatttttaaaattttcttattaactttgaattttgatcagatttaaagtcataggaaaagtacaaaggattctcaaatactctctatccagagtctccaaatgttaacattttaccacattctcttttctctttccctctccacacaaggacacacatatacacacatacatgcacgattatacatataaatcaggaaatgattattttgcaattatctataggctttattgagattttgccaattgtccctctaatatcctttatagcaaaagaaaaatctcaggctatgcattacattattgtcataccttttagtcttggtgttttatgacacaggcatttttgaagatagtaggcctattattttgtagcatgtcctctagtttgggttggtttgtttctgctcggttaggttcaggttatgagtttttggcaggaatcccacagaagtgatagtgtccttctcaatgaatcagatcaggaagtgcatgacggtgattgtcctgatgctcacaatgttaactctggccactttaaatgaaaatggtgtctaccaggtttcttcatggtaaagttactatttttcctttggtaattaataaattatcttgtggggagatagatactttgaggctattatcctattattcctcaaactgtcacccactagttttatcgttcattggtgatacttacctgagtcagttatgatggttactaaatggttaattccataatttcttctacgttaattgtttttgaaaaagaaggaagaattttctaaagggagatgtggaattcagaaaatgttttttttttcctccaagggttaagctcttgcaattgaatgcccaacttttaaaactgttgtcttttaaactcaaagccgattgatggcacctttgttgtatgtagtacacacctctctctgaggcaatgaataccactgggaagatgggcaaagagccacagggtcacaagagtaatttcaaattcttcttacccacctgcatgacactggtctcagatagtcgctgatcacctgtgagggttttccatattgtaaattttcatatttttgtgtctttacaggtgttttaatataaaattgagtaaactgttatcataaaggaattatgggatagaaaaatatattaccacttcaggactatgatgtaaatgtaacttaaactgataataaaatgttgccaaattgctgacttgctgagcctacttttaatgaatattgaagaccccctaataatagtggttgcaacaaaaaactgaaagttcagaaacagttttaaatctttttgttttctaagtagtttacccctctctccccaggcttacaccacaaatttgcttgattaactcatcaaagattgtacaaagactaacagtgtaatgttaaccacagttcataattcattattatgaattccaaattagggaattggaattgatgaattagtgtttgtagcagaagttttgtgttttgaattaggtgaatgtgtgttgagggtgaatgtatcttctgcctgcttcctttgtctgtatcagctcatagagggtgtctgaacttggtttgctttctgggagaggtggtggatcctgtaatatcctcaagacttcccatattttctgaggcaaaaccatttctgtgctgcaacctggcagattccctcacattagggtacagagacacacttttaataaaacgtttatgttaacggcgtcttgcaaatatacagtgtccgaattagctaataggagaacataaaaataaactacactgaaacaaagttaagttgaaaaacacaatgtcctatctatcttctttatggaggtgccaagaaaatacatcagaaaagaagaaagttaactgctaagagtctcccaagttctctctcacattcctttatcttaatgactgatcgcatatttgaagtctccaccttggggacctaaaataaaaagagaaaaccataattatagttactcagtatgcatattctctgtattatgaacatcaagatttggrtgcattatctctggagagttaatgtgttattttagcacactcttacacatcctttttgtgcttaagttctagggaaatgctgtttaactatcttagcttctgtagtttgtttcatttggctcctgtatacaaaggtgattgtcatttctacttggaggtgacattaacattgtcttaagaaatttatgtgtgtggaggggactgaggaacactggagagaatattaaatgttatctttttaaaacaattttgtagacaactacttaatttattttgtgagcattgaacaagtgattttttaaatcaacaggtccttctcatgaggaggaagacaccttttcctcagtgtttcatactcaaatccctccagaagaatatgaaatgcagatgcagaaactcaataaaggtatatttaaatttgtgtgattatacacattttcacaagggaatactggctgtatacagaaatattcataaatgaaataagttcatgtaatttaatccaaaggtaagtggaagcaagtagagttcaagatgacacaagattggttattgttgcagctagttgttgagagtttgttataccattctactttggatgtttgaaattttgtataataataaagagtttttaaaaaaagctggctgcaagtaatgaaaacctggcttaagcaaaaacaagtctgtgaaaatgattttggtgggaggcagctttctttggttcccaagagcatatgctgtggttagtcattcagaggttggctcagttctgcaatcctagagaagagcctgagtgatccagctgggtcaggggcctacccctggctcaaccaacttgtccaacccagcaaggtttggggtsactgtaggaacatggcagctatgtcaataccagactggagaggagaagaggacatttccagtgaagacagttctggccagataacccaatgtgttttccctactgtttattagaaatatgttttaaaggagctctgtgataaatgtaaacatggctgcattcagtttgtattttttaaatgttgtattggttaagagtatatgaaacttcaactgaatgaataaacaaacctcatatttcaactaaaaagactgtatacaacttgaattatggaaagaagtgttatattttgtatctattaggccactcaccaaaaaagtaactcatacgttaactatgggtagttgatttaaaagataattacgtgattgttaaaaaataaaaccccaggtataaagcataggtttatttgcctatataagctataagcttatataacttaataacttaagttataagcttatataacttaaatttgagtaaaatttttttttactcaaagctacttctgtttgaaaagaattttaatcaagagatcttactctttctctcgttctttccagctattttcatcaaaaaaattttaaatggttatatctgtattgactctttgataactagctataaacacaccagttgactagctcctttaatcctttatgttcaggtaacctcccttataaaacaaaattaaattttatataaactttgtctggattgagcttgtgactggtgtttttttcctttgtggacttgattgtggaaatgcatcctgttttgtagggtgaactgcatgtgttrtataaggagacattccttcttcgtgcatattttcagagctttaatgaagggttcacatgatcttgttttagaatattttaatgcgacacatagaaaacaagatattttataaagggaatacgagtccacaagtatttttcttattcttattttgagcactcggtgtctgaatatctcagacattgactcaagcctcttccaaaaggttgaggaaaattggccaactgagatgggctctaggggtttgtgcagatgggagctaggacatgggacgctaactcccagaccttgctcaaaagacaggcaaaacaaaatgcactgttcagaaagggtaatggcaaattaatagaatagcagggatgacctagcctttagggaaatttttgttttgtgtcaagactgaaataaaaaatatattttaaagtctccctaacatcagcgatttcttcttctcatgtctgtcttgaagttctattgatatttcccatcattctcatggaatcaacaggaagaagtttgatacatgataatgaattacacaagaagttttatgagaacttcatttgaagttacagtagcacatttatctttttaagactagatctccattatatattaggtttctggatctggaatgtagaagttagttcttctgtgtgtgttttagttcttatatattttaatatatgcttaaagtgaacttttagcataattgacacttttaattatgaaaaaattttgaacttttttaatattagattttacctgtgatgtggaaagaaatgagtcattgatcaaatcaggaaagaaacctttctcgaatacagaaaagattgagctcaggggtaaacacaaccaggattttattaagagaaacattgaggtatgtacttagaaattcagaagccagaatttggggctaaatgagttgaaaaaaatggcaatagttttgttcagtgtctttaaatatttttcaaccatcataaatgtataaatgattgaattagtagatataatgaaagaaaacttttataaaccagtacttcattatttctatgttcaacccactacatcctatcctatcctatctctttttaaaaatggtaggtgcatctatcatttatttcactatccagaaatagtctgtttcctgcaatttgcaaaacatttattcagataatagctttggacaatgtttctcagattttaaattgcatattagtaaaattgtttttttttaagtaatgagactgattttgtagccagtacatttagaactttgaatggaaaatgctcctggcagagcagcagggctgggctggagaagccaactggttgtccgcctcttctctggacgtcccagcagctggtcactggccttcattagcttctgcttcaagcacctatctttggtcttacaggccttgcagcctgtctttaaggcagattcaaactaaacaagggcgcaggggttcctgggttagaccagaatgtgaattaattaatttacaacaagaaatgtagtgaggaggacagaagctctgcacacccttgagcagagtcactagaaaactgcatgggcgagtgtggagtattgacaagagagagttaagtaattttttacccttcaagcctgatgctttccccataattggcacatcatttccaggcaaactggattcgtggggcagcctgccactgccaggactggcctctgggactctcgatttttgtgctccacattcatatgatcttcttcaggaaacctccatcttgttctstctctgtctttgcagtggcctgttgtatgtttattttctgttcaattttcctagaggagtagagttccccccttatccaggttcttgctaacacagatagcaggtctaccgtagatttctctttcccctttttaatagtaactgaatatttaaattcctcatatgatagtcttgaaatttaaaagcactttcatttagtggataagtaccccaaagaaagtggcaagaagatttcttccaaatgtctcagcaagtatgtttttgcatttatattttttatctatagtagagaggtttgaaaactgctcatattattttttaataaaatgtctgttggagtggttaacagcagggcctgcttatagggataatatctttggatattagagaatggccctatataaaaattttggtataaaataaaattacctagaaaatgtaaaatgcctaatcttgcaacttttctttgtgtatctgtagtgtagaagtctcagattccattttttttttcctgaactgtgaatttcyttgagtatatgatattttccattaataaattctgtagttggccaaggaatcaagaaacccagtggttatggttgacagagagaagaaaaggctggttgagcttttgaaggacttggatgagaaagattccgggctctccagttctgaggtacgtaaactctgatagggaacactacacttcttaatttagattttaaaaaataatattattggcccagtatcataaatttacaataatttttcggattctgagacattattctttgattttaaaaaaaccctgttttactaacacaggaacagataacaaaataccgcgggtgttctcacttttaagtgggaactaaatgatgagaacacatggactcatagargggagcgacacacactggggcctgctggagagtagaggctgggaggagggagaggatcaggaaaaataactaatgagtactaggcttaatacctgggtgaaaaaataatctgtacaacaaagccccatgacacaaatttacctgtataacaaacctgcacatgtacctctgaacttaaaatacaagttaaaatttttttttaaaaatcctgttttatacaattatttttattgaggttttcaaatttattcttggtcaattcattattgactttcaaaggattatttaatgtcattctaagcagtgtttacacattggttatcacagtaacttcttcctgtgatgtgatgtgcttattactgatgacatatgaatgtgtttttctgtctccttttcttattgtccctaaactggttttgtggtatttcagtgtagtcttcttcagtaatcctaaagaattccgtcctgttcctgcccagttaactttgagcacacagttccctggagagtcctggggttaacaggagggcctgcttatggtgataagtccgggtgggtacagactaaagtgaaagaggggaacagcatgtaatgggggtgaggtggggcaaacgcaggtatttatagggcccgggaaggtcacctaaagagtgctgtggcccaatgtttgcacttgtttacatactaaacttgagaaatatcctttgcttctgtgaagaaatacactgtcctatgttccttgaagcacttagctctattgtatatcttttattcccctgcatttaataaggacatgatggagtgaatgctgctggccccctgcccatatcccctttccctgaaactggtctgtgcatccacgccccagccctgtgctaagggtgcacagctgtccccttcccctgagaatttccctgagccaaacagcccaggatatcactccctccccaccctaggccccttacctaaatgtgagattagctctctggtgcagtgtgtcctccatagcttccccagggatcagactgaagctgagcttcagctgagaccacatcctygcttggccctgtgcccttgccctcggctgttttcctcatgtccctggtcccaaaggcactctcccagtgaattacttgaacaagaatccttgtcttagtttccacatctagggacacagagattcagagcgtagttttttttgctataagtctaaaagcagtgcatgtgcagtgatccctgtggcccacgggggaggagggtgtgccygtccagtgggaggtaacactcaatgtctgctgcatggaaatcccaggccaggcctgcctggatcctccagtttttcaagggaagctagaaattcagatttttttgtgagaaacattaaacttgtaaaatgttcacaactgctcctatttaaaaaagttctgtgtgggcaaacaaaatatccctcccttccaccaaaaarcaaaaacatatctacagaatatcacacataataatcctctaaataatccttcctgagatggtgaggtcccagcgggggctgtgtctaggagcaggtgaaggtgttgctatgcctggggctgatgaagtaggggaaaggggtgggtgagggaaactgctaaatgcccacataattctgagatatttyagcttcgctggttcatggtatagtcatgtgccacataatgatgttttggtcaacatgcatacatgacagtggtcccataagataataatggagctgaaaaattcctgtcacctagtgacaccgtagctctatattttagagtgtgctccttgtacttacatataaaaaagtgaattgtaagacagcttcaggcaggtccatcaggaagaatttcagaagcaggcattgttatcataggagatgacagctccatgcgtgttactgcccttgaagaccttccagtgggacaagatatggagtggaagacagtgatattgatgatcctgaccctgtgtagacctaggctaataggtgcatttgtgtcttagtttttcataaaatcttaaaaataaaaaaagaaaattttaaaataggaaaaagcttacaaagaaagaaaatatttttgtacagttctatactgtgtttatgttttaagctaagtgttattataagagagcgaaaaagttaaacaaattyaaaagttttaaaagtaaaaaagttacagtaaaaattcctttattattaaataaagaaaaatattttaaaataaatttagtgtagcctaagtttacagtgtttataaagtctacagtagcagccagtaatgtccttggtgttcacagtcgctcaccactcactcactgactcaccagagcagcttccactcctgcaagctccactcatggttaagtgccctttacaggtatgccattaaaaagatttttataccatattttattgtaccttttctatgttktaatatgtttagattcacaaatacttcctattgtgttaacaatcacctacaacacagtaactacaaaacatactgtacaggtttatagcctaggagcaataggctttacaatgtggcctgggtgtgtagtacactctaccatctaggtttgtgtaagtacacccaatgatttttgcacaatgacagaattgcctaatggtacatttcttagaacacatatycctgtcgttaagcgacacataactgtaatttgtctactttattaacaaaagcttagataccagtaagaattaagggatctgggtttcattctggttttgttattaattgtaaaattgggtaaactgctacccatggtctcactgcgtatcaaactatggcgatagattttcttgatacattctaggaatgctttcataatgactttttgttaataatactgccttttgcatattatttttgttagtatttatgtctcatctttctagtttaaggtcatctctatcattttagtttttgatcttttacaagtactatgtagctgggcttttgctgttgcttttgtgtctttatctttaattgtttcttcatcctttatcttttgttattatcaatatgagcatatttaatttgctcatattcattacgaccgcatactttttgaatcttttcctgacatcaaactttatattttatttatcatatttgtttttgtttatctccctatcctcttgtggtttggaaacttaatatcctatttctgatctggtactgttaaccttcaagttttaaaaatacattaaaatgcgtattttcttttcaacttcaataattagtttctaaaatttcatattttaacaagattggatctttggtgtactttcatttcccttgtgtttcattttctttcctccaggatatattgaaatcatctggaattttagttctagaatactacacattttagtttttacctttaaaaacagtatgcttcttgtatgttaggaatctctctaaacaaaatttagccaaaatttttagccacatcattaactgtgtatttggactcaacgaattatttatttgtataaatcattccttgaattatttttctggaacttttttgaaaaattttgccccaagaaatggtgaagtgtggataatttttgagtgtttgtgtattcaaatatttattttttcctcatttgaatgttagcttagcagatgactaaattctacttgcaaaatcctttttttcttgaagcatgtaggattttctccttattttggagttcacaattttatcagattatatttgtgtgtgtctttaaaaacatttcagttcctgcttggtaccttgtaggctcttttcacctgaaggttcaaatcttccttcagctcagaaaattatcttatattatttcttcctttccatcatctcttttttctccttttgggaggtatcagttgagaatgtgattggctgccagtaayagtggcttaaacagtaaagagtttacttttttctagtaacaagaaatccaggagtgagcagctcatgtctttctgtcctcctgttctacattcctatgcggattttgtctttaggtttgcaagattgctgctacatctgtaggcagtgtgtccattttccaagcagacagaaagagggaagggtaaaaagcaaagagactgtcctctgaggctttgctttttcactggggatggaatggtgtccccaggacttctacctgcatctcagcggccaagctgtatcgcgtagccatttgttcagtatgttgctgcaagtgagaagggggattcaggtatatgacttactctttttttgtagtagaggtagaaatggggatcatgtcagtcagtagacagtgtctgccacaggtggctataggacctcttggatttctcttccaggtcttataacatctttctcataatgttaatcgtttttgtcattttgtacatacgagctccttctacagttttctaagttgggtttcaaccatgttgttctgctgcttagccatgtagctctcttttgagatttttaaagrcaattgtttttaggcccagcgtggtggctcacgcatgtaatctctgcactttgggaggccaaggcgggaggatcacttggggctaggagtttgagataaccctggccaatatggcgaaaccccatctctactaaaaatacaacaattagccaggtttggtggtgcatgcctgtaatcccagctacttggcaggctgaggcaggagaatcgcttgaacatgggaggtggaagttgcagtgagccaactgcactccagcctgggcaacagagagagactcgtctcaaaaaaaaatatttacactaatatttactgagagttctttctgcaagtcctcttatctgatgtgggaggtaaacatacagaaattctagagtccgatggatggtgacaaatgttagaatagaaattcagaggaagaagcagtgccgcaggaaaagtttaggaaaactttgaagaaggaacctatttactatattctcaaatcataccgaacttcttgctgttcctcaaattctctgtgttcttttaaatctctgtgttttcaaatgtgccctttcctttatgaagtgccccacaacctcatctttgacaaataaatgcacagcttaaagaagactaaatgatatgactaaaatgataattatgttttaattcccctgaactcttgttctctagttgttttttttagtagcatgcataattttttttttttttttttttttgagatggagtttcactcttgtcacccacactggagtgcaatggcacgatcttggctcactgcaagccctgcctcccgggctcaagtgattctcctgcctcagccttccaagtaggtgggattacagatgcctgccaccacccctggctaattttgtatttttagtagagatgggatttcaccatgttggccaggctggtctcgaactcctgacctcaggtgatctgcccacctcagcctcccagagtgctgggattacaggcgtgaggcaccatgcccaaccgtcatgcataattttatggatgtaatmttctcttgaatctctctaggacggggactggtaccagttgggcccatggcctgttaggaactgggctgcacagccggaggggatgagcggtgggctagcgagcattaccacctgagctgtgcctcctgtcacattagctgcagcattagattctcacagaagcacgaaccctgttgtgaactgtgcatgggagggatctaggttgtctgctctttttgagaatctaatgcctgatggtctgaggtggaacagtttcatcctgaaaccatcctttctaaccccattccccccagtccatggaataattttcttccaggaaacctgtccctggggccaaaaatgttggggacttctgctctaggatacttacttagaatttaagaaatattttcatctatgttgggaactcacacttgcagtgaatggcacccgctaagctagatgtctctactaccaccctcaccagtgaaatgggtttgcatccgatctcaggtcactcacatctagtagtattgagtcggggagtctggtggtggacccttagttacctayctgaaccctggctataaaggttgctggtgaaaagcattttctgttctgtcttgggaaggtaagtttcctaaaagctagaagttccccacacatagcaagggtgtatagaggtgctagacagatagaaaaaaatgatgatgccatttactaccttttacatatatcttatttctgtaacggcatagtgcataaaacatatacatttctggtgaatttcgtctgacatactcttttaacttcagtgtcatatgaaaataatcccattcagacagaacttaaaatttattagccactatttcatcatcgatttcatagttttacttttttgtgattctttattttttatcatttaggctatatggtattgacatcacttttatttaggaaaaattaccagagtttgtgagtaattaggtaatatagtatattttaaaaattatgcataactttctttttttttaagctgtccatgtttattttcaagggagagcaatagaatttaaatcagaacctggaattctgtcagtttatcagagttgtgtgcctttagctaactgaacctcactgaggatcaatttctttataccaacttacaagtgtgtttaaaaacatttatgactatatcataatccttatattgatatactacaatctacccactttccccctatttttagacgttttattataaatagtgtgacaataaattttttatcagtcacygttctgggttgcaagtaacaaagatggactttggctaaagcaacagaaaatgaatttattgggagtcttgagtagtccatagactcagtgggaagtttggggaaccaggtttgtacaccgrgcagatgtccaggcagccataaacatggctttaggaacagcctggttaggggctggctgctgtggctccgcagccaccagaygtttgctttccacgagatgctcattgctgccaccatcactgtccctgttaatcatttccctgcacctttgcttctgtccctcaaggtttggggtgtttgctttcaaatagctgaatctaggtcatttgtttgtcttcctgatatcagagggtggggaggagtgtcttgtcgtgatcctcccctgccaagactcacacactgtttggtttcactgaaatggactgtgaatgccagggtcaagaggataaaaatataaaagtytttgtgcataaagtttttacctataatgcctctgattatcacctagggcttagttcctggtattaacatcgtgaaatcaaaatgtatgaaataagtttctttgccctctacttgacacgttattccaaatattcttcatgattcttctgtcctctttttgcagtaatgcttccctttatgaccttatccattctcatagcccccagggtttgaaccactgtagatatgtgggtaagtcaagtgtgtttatttaatcccaagcctctatcttgaatttcacataaacatatttaactgcctaacataatctgtggatatcctagggggatgtctgccagtttcaaaaggtcccaaacaattcattatctttctctccaaacctacttcatctatagaatccctagtttagataatgtgaccaccataacctacttcacaaaatcaggaacttgttcttttttttttttctggtaaggccacaacaaagtttattattttttaagttgtttattttaaatcaataaatacttttattttaggttcaggggtacacatgcaggtttgttctgtagataaattggatgtcacagggctttggtgtacagattatttcatcatcctggtaataagaatagtacccaataggtagtttttccatcctctccctcctaccaccctctgccctcaagtaggccccagtatctgttgttcccttcttgtgtccatgtgtactcaatgtttagctcccacttataagtgagaacatgcagtatttgagttttcattcctgtgttattttgtttaggattatggccttcagttgcatccatgttgctgcaaaggatgtgatctcattcttttttatggctgcatagtattccatggtgtgtatgtcccaaattttctttatccagtctattgaaaggcatttaggttgatttttgtgactagtgctgcgatgaacatacgcatgcatgtgtctttttttttctctccttaagacagggtcttactctgtcacccaggttggagtgcagtgatgtcgtcatggctcactgcagcttcgacctctcaggctcaagtgatcctcccacctcagcctccttcgtatctgggactacaggtgcatatcaccacatttggctaatttttaaaatttttttgtaaaggtgaggttttgtcatgttgctcaggctkatattgaactcctgggctcaggccatacacctgccttggcctcctgaagtgctagaattataggcatgagccactgcacctggcctgcatgcatatgtctttatggtagaatgatttatattcctttgggtatatacccattaatgagattgctgggttgaatggtgcttgtgttttaagttccttgagaaattgccacactgctttccacaatggctgaactaatttacattcctaccagcagtgtataggtgtttttctctgcagctttgccagtatctgtgattttttgactttttagtaatggcctttctgactggtgtgagatggtatctcattgtggttttggtttgcatttttcaaatgattagtgatgtcgagcgtttttttcatatgcttgttggctatgtgtatgtcttctttagaaaattgtctgtttgtgtcttttgcctactttgctctttgcttattaatttgtttaagttccttatagattctggatattagacctttgttgaatgcatggtttacaaatattttctcccattctgtaattgtgtttaccctattgatagtttctcttgctgtgcagaagctctttaattaggtcccatttgtcaatttttgtttttgttgcgattgcttttggcatcttcattatgaaatccttgacagggactatgtccacaatggtatttcctaggttatcttctaagggttttatagatttaggttttacttgatttttgtatatggtgtaaggaagaattctggtttcagtcttctgcacatggctagccagttatgccagcaccatttattgaacaggagtccttttccccattgtttgtttttgtcaactttgttgaagatcagatggttgtaggtgtgtggctttatttctgggctttctcttctgttccattggtctatgtgtctgtttttgtactagtaccatgatgttttggtgactgtagccttgtaatatagtttgaagtcaggtaacatgatttctccagctttgttctttttgcttaggattgccttggctatccaggctcttttctggtttcatatgaattttttaaatagttttttctaattttgttaaaaatgtcattggtagtttgataggaatagcattgaatctgtaaattgctttgggcagtatggccattttagcaatactgattcttcctatccatgagcatggaatgtttttccatttgtttgtgtcatctctggtttctttgagcagtgctttttaattctcattgtagaggtctttcacctccctggttagctgtattcctaggtattttgctctttttatggctattgtgaatggaattgcgttcttgatttggctctcagcttgggtgttgctggtatatagaaatgttattgatttttgtacattgattttacatcctgaaactttgctgaagttgtttgtcaaatataggaggttttgatcagagactatggggtttttaggtatagaatcatgttgtctgcaaacagagatagttgaacttcttctcttcctatttgaatgccttttattttttttctctttcttggttactctgattaggacttccagtactgtgttgaataggagtggtgagagtgggcatccttgtcttgaggaacttattctttatccttgatctttatgtctgcctttactcttccataaaattatctccaggttctgtaaattctacttcctgtgtatctctggattctgttctgtgttcccagaaaacattccttagttcagccattcagcacttgtgttctagattatagctattgcttcttaactggtctttctgcttccactcttgctgtcagtagttccagttttaaaatacagacctgatcatgrtgtttctttgattaargtcttgttttctccagccccttcctgctcacagaggttagttgatcctctctggttcccatggtgcccagagcttaccagcactcttcacaccttgttaaaattgttgctgccaagaaattgagaactcctcgagggcagaaccttgtgatattcatattgaatcaccagtgcctagcataatacatatgttcagtaggcattatttttgaatgaatgtaatgaatgggtttgatgagataatatggaacaaacattagttgaatgaaagatgatcaattaagtttgtgaaacccaagcaactgattttatagatgctatgttacttttaagggacagagtttgaaaataccatgtcccattacagggtaaacctgatttcttcctacttaacatgtcacaaaacattttttgaatgtagataaatgagaatgtcatgagaaccagactgtgaaactaaaagatttgttccacaggggaaaccccccttaaaatattagaggatactttatacaggctggcagataacaaaaccagaaactatttcatattattcttttactaacccaatgttaattctgtttgtgtgtgttgtgtgtgtgtgtgtgtgtgtttgtgtgtgtatgtgaagacctgggcactgttatagccacttgaaaggtatattttggcaaaaatatagcctgagaatgacctggtgacccttgtttcctcttagggtgatcagtctggctgggtggtcccagtaaaaggatatgaacttgcagtcacccagcatcagcagcttgctgaaattgatataaaactccaagaactctctgcagcctcccctacaatttccagtttttctccaagacttgaaaatcggaataatcaggtatttgaagaacccatagactgttcaagttaatgtgtgctaaagctgttcacataattttacaatctggttgttaaccagttgctttttccagtgatcatagtttcataacagtgtgtatattcctttggttacttccactttctactcacttttctttcatttggtaattttctgggatgcggtcactgaggaaatatttcttttaatattattatatctctatgatttaagctaaatctcgatcatgatcaagagagaggggagggaagaaagcggatatggcactcacgagtcctttgagagccttatttttctttattcctgtggcactaggtattagcaatgacagccattgtcccttactccaccacattcttttatctcctttaatttaacatcaagcagtgaagctcattatgttgacttctctcctatgagagttttgaaatgaatgtgtttcttctctcagtagttccctcaaatactcttttacaaagcaggtgcggtggctcatgcctataatcccagcactttgggaggccaaggtgggtggatcacttgaggtcaggagttcaagaccagcctggccaacatgcaacatgatgaaaccctgtctctactaaaaatacaaaaattagctgggtgtggtggtgcatgcttgtaatcccagctactcgagaggctgagacaggagaatcgtttgaacccaggaggtggaggttgcagtgagctgatatagtgccgctgcactccagcctgggcaacacaacgagattctctgtcaaaaaaaaaaaaaaaatctggtagaaggtatggcatatcagaaaattaaatttctccctcaaccctatattttagtacttcatggaatctggtttggtttgggtggtagactgaggagaaaatgtctgattgcataagagagtaataaccctgtagcagctttgtaaaacttttcaccaaatcattttctctacaattgtagatgaccatgatctttgtggaccatccaaagatttaaatatcagtagcctataggtaatccttctgattcatagtaagcactttctctaagctgtcacttgaaggctggggatctagcttcatgccagttgaagcaacctcaggggaaaggagcagtgtgaaggtgttccaaggaaacagttttgtgactggttgtatttctggcggacaggaacagctgcttctgaccctttaaacagcagtagtggtgctgttgttctcactattgatttgaaattctgcagtgggattagaattcttggaaaacagagataattggaatctttgtcttcactcaaatgtgtcccaggactttgtattttattttattttgagacggaatctcgctctgtcaccaggctggagttcagtggcgcgatctcggctcactgcaagctccgcctcctgggttcaagtgattctcctgcctcagcctcctgagtagctgggactataggcatgtgccaccatgcccagctaatttttgtatttttagtagagatggggtttcaccatgttggtcaggatgggttctatctcctgacctcgtgatccgcctgcctttgcctcccaaagtgctgggattacaggcatgagccactgcatccggccgtatcccaggactttgacatgagttaggctagtttatttatgttactgaattctatttttcaaaaaggaggaaccctagatgggataataaaatgtttcacagatactctattcttttcatgtttcagttgatttttgttgttcttgttagatttcaagggtagctgaaatctcagagctgaactgtggtcttaaatatagaaaatgtttcatggctgtcaaatgaagtgaagtctgtgaagtccgaggcactgatatagccatccaaaagatgtatttttggcaaaaatataacatgggaatgacctggtgacctttatttccttctcttcttaaaagagacagagaattcagagatttgtttggctattaggacttcaaataaaaagtatgaatatgggccaggcgcagtggcttatgcctgtaatcccagcactttgggaggctgaggcgtgtagatcacgaggtcaggagatcgagaccatcttggctaacacggtgcaaccctgtctctactaaaaaatacaaaaaattagctgggcgtggtggcgggtgcctgtagtcccagctacttgggaggctgaggcaggagaatggcgtgaactcgggaggcagagcttgcagtgagccaagatcgtgccatgcactgcagcctgggcgacagagtgagactccgtctcaaaaaaaaaaaaaaaagtatgaatatggtcccattttcttatcatcagcaaaatcacattttcagagttcacatttatggttcagataagatattttaaaaataatgaaagggaaaaccagtaccttacatttttgttacatactgagattacgtgtttttatgtgaaataacatatatttggaaagaaaagggaaaacaacattttgggactcacattggatgtaaaaacaaaaatgtaatgtagttgttaaaaagaaataatttatgcttcttgcatgcaaaaataaagaatatcttttgagcttttgttcaatttccctttggcatttcttcatttctaactaaaaccagcattacacattgaattttcaaagcaggaatgctaacatggcaaagtattttagggatattatttttggattggactactttttgtataaatacactgtatcttgaataaaccctgtgtatctatgtagttgatgaatgagttccaatcagttgctaatccacaaacattcatagttcatattcactttaactcttctgcaaaccattaactcaccagtaatttttctccatactccttaagaaagaatttcttttgagtggaatataaatttctgtttttgaacaattgattcaacacatattgagtgctcctggatgtaaggaattttacagaacttaaagatgaatcaggcaaataaaatactttggaataaaaaagtctcacttcaggctgggcatggtggctcacgcctgtaatcccagcactttgggaggccaaggcagacagatcacaaggtcaggagatccagaccatcctggctaacatggtgaaatcccatctctactaaaaataccaaaaaattagccaggtgtggtggcaggcgcctgtagtcccagctactcgggaggmtgaggcaggagaatggcgtgaacccgggaggcagagcttgcagtgagccaagatcgcgccactgtactccagcctggaggacagagcgggactctgtttcaaaaaaaacagtctcacttcaaatttgacttttgcatttactagttctgtggacttgggcactaattagaagctctccaaacctcgttttccttatttataaaataatagtaatattctttaaggttctttaggtaatgggtagctgagttaatatacataaagtgtttagcacagtgacacagatctcagccaattatgttattataagtgatataaagaacttatttccttatgggaggtattgagtatacgtagaaaactgtggacaagacagcacaggcaggtgccatagaaagcttttttttttttcttcaagagacaaggtctcgcttgtcacccaggctggaagtacagtggtgcaatcatggcttgctgcagcctttacctcctgggcccaagtgatcctccaacctcaccgtccccagaagctgggactacaggtgcatgccatcacaccagctaattttttaattttttttagaggtgtggtctcactgtgttgcctaggctggtcttgaactcctggcctcaagagatccacctgcctcaacctcccaaagtgcccagattcatagaaggctctaagtaaagtgctgtggtggtttagagcagagagagagagagcatatccaaggagtatccagaaagtctatttccataagtgaggggcaggagaaggaagaggaactagggaaggaggcagagggatcagagacacagaagaaaaccaccattatgtatcacgaggctgaaaactggtggcctacagcagtggtccccaagtattttggcgtcagggactgggtttgtggaagacaattcttccacgggcccagagagggggatggttttgggatgattcaaacatgttacatttattgtgtactttatttctattattattatattgtaacaaaataattatacaactcaccataatgtagactcagtgggagctctgagcttgttttcctgcaactagatggttccatccgggggtaatgggagacagtgacagatcaccaggtattagattctcataaggaatatgcaacctagatcccttgcatgtgcagttcatgatagggttcacactactgtgagaatgtaatgccgctgctgatctaacaggaggagggagagctcaggcggtaacatgagtgatggggagcagctgcaaatacagttgaacttgggcctgccgctcacctcctgctctggggcccggttcctaacaagccatctaccagaaccgtccatggcctggggggtcaggagcccctgacctacaggacaaattaagctcccagatgggtctgcttttgcttacaaagggtttaaygattttttttagccaacatttaaaaattaggtaaattcctataaaaatccaaatttctagttctctcttgaaaaattcaaattagaaaatatgtcagcattagacctaacttcttgcttgacaattaccgaattgagatgaatagcaactgctctttctatggggcacagattctccggtttgctgcagtatccaccactctatattgtatggcaggccctaaggcccacttcatgcatttatgttacttgttcagcctttgcagagatcgtcaatacatttttgaatgcctgcttatttcataggagacactgtagtggttgatgtagtgtccagactagtatgaagcttgatctctgacctcaaggtagcttgtaggataccagaggatatgatgtaaacaatagaacaagttgtggagtaactgtgcaatgaaacaagaaccaccaccagatgggcactgatcagatgaaaagtacggaaagtgtatgctgcgggagcacagagaaaggaaaggttatttgatgaaggcatgatattttaaaaattcctttgaagatttatctttgttggtcaagaaaacagttttctgaacaagttgaaacatagactttctgacttatctctgtatggtaactataaggtagtaagttggtatgcatatagatttaagatgataaatgtggttgagtcaatgtggttaagtcagaatagtttgaggaactctaggaatgtggctcagagatgaaggaggtgttggtctttgtgaaaagggcrgataagaagtcttcttttccttatgggctcactgattgtgatgttctcatatagatgctctggcccagcacttaactttatggcaatgttttaaaagcagcatttggcttttacgtatctgatttccttagcataaaacaaagcttgtggtcacagtcaaaagaaagaatggcatattactgctctttctgtagtgtgaataatatgtggttgcagtttttacatctgctttttattttcattttgtcttagcwagagaactaattgaagcaattttttcttaagatctgtggtttaactgtgcatacttttctttatccatctcctaaccctcaacaaatcagttcgttctttccacgtattgtaaatcccaccataaaactgagtgatgttctataatttagttaccatacttcttattcgtagaagtatcagattccakttctctccagaaatatctaagatataggagttatgtaagcattcagtttcttaaatccttagcaaccggattcaatagtaaattctattccatttggctgttatatacaagtatattttattcatctctcatgaagtcagctttactaaatctagaattccagttcaccgttagattttttttctggttggggagggcctcagaaatggctctccttgacaggaggcattgctgtgttcttaaactaactagtttaattgaatataaaggtcctccttaatttgatttattttcttattcttgaaatattgattcaattgtacacaatttgataagcttgagaaaaaattagcaaacatttgattgaggaaaattgtagtttgtattgatctcctttcttgccaagatcatgctattattgctgacagcaacaattaatttttttttgatgtcttcctgtctcaatattagctaaaattgaggaaatacagaccattgtttgacatgtaattctgaaagatgttttattattgggtccagggatttgtatagttccagtaagggccatggactctacttgaccccaaatgtacttaggtgtgtgttggttgagggcaggaatttaggattttttaaatgtatgctagtcacaggcacagaaatcttattgaccatctgctcatttccaaaacccatagaagccacaggagcatgcatttckgggtttgaggaacaaacaagaagttacttcagagctctttacctccagtgccaatctgttagatctccagttaaatctgggaaactgcccttgccacctccattttacagattactgtgaagtttatatttctttgctttcctctgttaagcttctgatgtagtcaaggtttccttcattttatggcattattccaaggtgataaaaacaatctgcctgaagtatctttttccctgcttttggtactgccagacacacgatccatctaatgacaagaaatagcaggaacctacagaaatgtatagcattgtctcgaaaacataggacaagctgtctttatttaggcaggtttgtattttcccaatcctaacgcatgccttatttgcatatcagataacttacgaagctgcgggtaatttgctgtttttgatttttgaaaatgagtttattttgcttcaaagatcccttttggcctagtcaacaccacagataatttttctaaggataaactcagaatctcttggcaaccaattagtcaaatcaacaagtatctattgatcttggcctcagggacagttctcttcttgtggcatatggaggagagcttttattgaattctccatgaaggcattcctgtatgacccagaaacacagaaatgatatgttggtcagataatctgattaaatatttctactatgagaaatcaagatatttcctgatgatcacgaggacagatagtactggttggcactttgttgtgaaaaaagaatctttcctggcaccacagagctttttgcagctgggcaattttcatcagcatcagtggcaaccttttcttgccccctcttggcctctgctttcatcatacagtatttttcgaatatttgaactatatggttatgccatcggaggccatgactgaagaaagctgttatatatcctttgggtctaactgtagagaattatagactcataagctattagaaggggaaataactttctcagaagtaactgagacccagaaagaggaggtgacttcctcaaaagtgcacagctgattggattggaagctagaatccaaccttcgggtgtatacctcttaggtatggagagtcacattgtcagagcaggacaaaaatggctttggcagaaaagtttattaaaaataaaaaatcagtggctcacatctgtaatcccagcactttgagaggctgaggcgggaggatcccttgagcccaggagttcaaaatcagcccgggcaacatagtgaaacccatttcttcttcatacaaaaaaaatcagccaggcgaggtggtgtgcacctgtagtcccagccacttgaacttgagaggctgaggtgggaggatcgcttgagcctgggaggtcgagtctgcagtgagatgtggttgtgccactgcactccagcctgggtggcagaataagaccgtgtctcaaaaaaaaaaaaaaaaggtttgtctgcttatgaaattgataacatgtttattgtaggaaattcaggaactacaaaaaaataagaaaaataagattaaatcatcaggatttttgccaagttaattattgttaaatttccttccagtctatttctctatacgcacacagactatatatatatacacacatatatatgtacacacacatatatatgtatataattatatttgtgtgtgtgtatatatatgtgtgtgtgtgtatatctatatctgtatctatatctatctatctatctatgtatatatctatgttagagtttttgacaagaaacagaaggaatacctagcttggatttcgaagataattatatgaagggactatttatatagatttaaaggagctaacagtggatgttgggacaccgagagactagccaccgtggatgggggaagaaaaagtgtgtgggagctcagcaagagctggaattgtgggagaagaactggccatctgaagttgtaataatagaggacatgggcaaagggttagccaaccccagccccctcagcgtgagcgcttgagcggtaattagtttcctaactctgtttccttggcaatctgagaaaagttggcatgctgaatatgttaggaggcgactttgcttatgcttaaaatgatccctggattgggagaattataaagacctgatggagaagctgtattttggccatctctgactgcagtgattcttgtggctgggcacgtttcttgctgggtccttggactcggtgtgcctatggggccatttcaagagataatggctcctgtaggatatgaggattttaagacagtcagcttatagctgttttgctctttatacctatattgttttggcatggactgtagcaaacactcccattgaaaagggatacctgatactggcctgctgtgtttcctgtcttataaccttctgagtagagtggctctaagtgtgtcctctgttagtctttgagcatgaatatgcagttgaatctaagaaaactcagcacatctcagggatacatcactgcccaaactgtgatgcaaaagcattaggggaaggggaaaaaataccctaagctctctctccttctgtcctgtactctcccctcactttgactaaacctaaccagaagatggagctcaaggagaaacactctgattgtcccagctgtggcaggtgctcaccatagtttatcatacttctattgatggacatctgggctgttttcagtttttagctgccatgaacatttgtgtacaaggctttagttatatattttaatttctttttgataaattcataggagttgaatttttggatcacatgatcgacaaacatttaactttttaagaaatggcctgttttggcgtggtggctcacacctgtaatcccagcactttggaggccaaggtgggtggatcacaaggtcaagagattgagaccatcctggccaacatggtgaaacccygtctctactaaaaatacaaaaattagccaggcatggtggtgcatgcctgtaatctcagctactcaggaggctgaggcaggagaatcgcttgaacccgggaggcagaggttgccgggagccaggattgcgccactgcactccagcctggcarcagagcgagactccgtctcaaaaaaaaaaaaaaaaaaaaaaaagacatggcctgtttttcaaagtggttgtacctttgtatagtcctgcaaacaatgtaagagagtccctgttgtttcacacatttccaacatttggtgttcacagtttttttcatctgggccatgctagtggctgtgtagtagtgtctcattgtggtttaattgcatttccccagtgactaatgatgttgaggaggttttcatgttcttatttgtcatgcacatagcttttatgaagtatctgtgcaagtctttatagaatttgattgtcatttgattaattattattgtctatttgattatttttattatcgagttgtaggagttccttacatattctggatacaagtcctctgtcagatttgtgtgttatgatcattttctctcagttggtggtttgttcattttcacagtggtggttttgattaagcaacatttaaaaatgttgttaagtgcaacttataatttttttctttctgkgccttctctttgcttgccccaagatttagaaaaaatcatagttgtagattattaaaataatttcaatttaaaaatgaaatccggggtgttttgcagattaccatgtgtcctacttcatagctggtgtatcttcatgaaagtttataaaatgctgactgcttagcattgcaaagagaccttgataccattttttccaaacttccccctaacattagatttcctttaaaaaatatttctgataataattcagcctctagatgtgtattagtctgttctttcactgctataaagaaatacctgagaatgggtaatttataaagaaaagaggtttaattggctcgcggttctgcaggctgtacaggaggcacagcagcttctgcttttggggaggcctcaggaaacttacaatcatggcagaaggtgaaggggaagcaggcacttcttacatggccagagcaagaggaagagagagagaagagggaggtgctacacacttgtaaacaaccagacctcatggtaactcattcactcacaatcatgagagcagyactgagggatggtgctaacccattcatgagaactccacccccatgacccaatcacctcccaccaggcgccacctccaacactgggggttacaattcgacatgagatttggtagggacagagatccaaacgatatcaggatgcttctagagattgaaagctaccagaagtgagaaatgaagccaaatataaaataatcacttcttgaaattgacgcactcttaataatttgcttggtagaactgtatacaataagaattttactgaaattcattgctagtttgatgaaagtttcgaaaacccaaattacagtctattggccagtgcttacacagcttcaggattatagtttgcattgggatgcagagaatagggtcagccatgtcactgtctaggtggtgacagtgtggtaagtgcaataaaggagcatgtggcgtggctgagagaataatttgtcctttgtgggtatgtcagggaatattatggaaatatgcttgaactgggcccaaaatgggtaggagtctcaggagttggagggttggaattgggggaactggtagtagtgaatattgctgcacatttgagtctgagtctcaagcagtgggaaatgagatgaagagattggcagggcctaaagcatgaatactttgcaccttgttctgtgtcttccctgcaaagaatggaatcaacagggtgactggtagcatcaagaccagccaggaggctctggcagcaacctaagtcagtagttcttgaattctcaagtaggtgtgcttcagtttattagtccttagtccttttttttttttttttttttgagacagagtctcattctgttgcccagtctgcagtgcagtggtgcgatcacagctcactgcagcctcgacctcccaggttcaagtgatcctcccacctcagcctcccaagtggctgagactgtaggtgttaccgtgtctggctaattttttttttattttttattttgtagatatggggtctcactgtgttgcccaggctggtctctaacttctgggctcaagggatcctcctgacttgacctcctggagtgttggggttacaggtatgagccaccaggcctgtcctgtccttcccttttgaatcagaacctcctgggtagaggctggtccttcggattttttcctgggctctggaggtgattctgaagctcactggagtttaaaaactgctggtgaatgatgaggatatcttaactaagacggtgagaaagaaacaagtgccttgattagagaggtattagggattggcaactagatagtattcctggtgaccatctctatgtaaggaatgagggagtagcaggattatggcttgagtgatttcaaaaatgtcattactgcccatcacttatatggcaacacagagcagatgtatgtgagaaaggaagtttaatcttagatacaggaccaaattcctatcaagaaatgcccatttttatcacccagaaataacattaactttgggaaaatatggttctgtcaatataaatattgcagacaataatgaagtactttcattatgtaatacttagtcttttcaaaggacatattcagctcgcatttgtttggcattaagatttgttgcttgcctactacatactgtgatgacttttagcctagatctattattactgttactgttttacagatgatgaaactgaagctcagagaggttaattcatttccctcaggtcagtctagtcaggaaccaggcagggcaaagattcaaaactcctgaccttgccaaatccagttttcttcccattattacacagctgcttctaataatatggatgggcagggttttttccttcttatttatacatgataaacttgaagtccaaagaaaagtccaaggtctcaagctggtaagtatcagagcagggaccagaacccaggttcctgtttcctggctccagctgttttcactgtctccttctgcttcccaaatgattacagaagttgggttcctttcctacttgttatatgtacagttggacatttacctcctaaaatgggaagactttaaagcrttatacatattgttttgaagggaagaaataattgtttgagaagcaaagctaaccctcaaggctcagttgctttgaggtggtatgtgacagcacatttccagcctgtgaatgatgttttttttttttctttaaattagaaacctgaccrtgatggtgaaagaaatatggaagtaactccaggagaaaagatacttaggaacaccaaagagcaacgcgatctgcataatcggctgagagagattgatgaaaagctgaaaatgatgaaggaaaatgtggtaagtctttttgttttaattaattttttttaagaaaaaaatagaggcaggttctcactatgttgcccaggctggtctcgaacttctgggctcaagtgacctgcccacctcagcctgccaaagtgctaggattacaggtgtgggccaccgcacccgtccatctctcttatttaaagtttaattgtaaccaacacttgtaccaaaaaaggtttcagtctcttttgactgttttatgactgttctcatgtgttaaatcagccatgtgaatttgtcagtaacaatgtgaataaaagctaaaaatataattcgtaggactttgatattattcttaatttaagcaatttatataatataaaacattaaataacatataaaacatattctgacttcagatagtgtgtaagatactatgtgaagtcagaataataatccataatcctaatattctgacagtgacacaaatatttgtttttcgtggaaaaatttggtagttctccctaaaatcttccctatgttttgaacttatagcttaaattcthtttttgtttgyaattactaatatattattagtaactagttaattttaatgcattccaaatctttcttggcctacttcatgtttttcttgctcaacataaagacatgtcattcctgatgagtgaaaactcttaaagcaactaagttgtgagctggttgatgctctgaacctcttagaattgctctgtcatactatgattttcccactacccatagaatgttttcagctggatacctggattttacctaaaattaaacatgtcaaggctgagcttgtgattgtggtcttgcggtaattacctgcagtaaccccttttggtctcctactaaattctgtcatcttgggtgatcttcaagcttctttgagttttaaccaatgtgactagtttgttgccatattcttcctgagtttcttaagactcaaaatctttttttttggtccctacttttatcacccttctctcagtgttgtcacctcatgccttagccacttataacctggtttttgtaggatttcttgtttccagtcactcccttctctcattattccacttaatatgctgcaccatggagtaaacatcaggtgagtgattttaaaatgtgatgcccttcagagcccctgagagtgtgccacaatcccatcttcacaccttgtaatcaagcccagctgaactgccctcactgcctgcaggcccactgcagcagcactgacacagagcctacaggagctcaggccccctaatgagagttaggcagcagatctaaagggaatgaatacatcgtgctttttttatagctcatttttatttgctttgcatgagaaatctcatgggcattatatttcagggagacctctatttccattttcagagagatttctctgattctgttgatgggatgaagtagaagaagtaggaatggkctgggtgcggtggctcacgcctgtaatcctagcactttgggaggccgaggcgggcagattgcctgagctcaggagttcgtgactagcctgggtaacaaggtgaaaccccgtatccactaaaatacaaaaaaaattagccgggcttggcagtgtgcgcccgtagtcccagctacttgggaggctgaggcaggagaactgcttgaacccaggaggcagagattgcagtgagccgagattgcrccactgcacactccagcctgggtgacagaatgagactccgtctcaaaaaaaaaaaaaaaaaaaaaaaaagaagtaggaatggtagggaagtgtaaggaggctcttggccagtcattgtagtggtaacgatrgtacattgtgaattcgatgtgataaatgaaatgttttggtttgattggttttgaaaactgttggtacttcctctcactccatatctgccaatccaaggcgggctaagcctgtcactccccatgatccattctcctgatttctgactgctgtggtttggatgtttgtgacccctcagaatccctgttgaaaccctagtccccaaggtgatgggattaggaggtggggaatttgggcaagtgattaggtcatgtcagtgaagccctcgtgagtgaaattagtgactttataaaagaggccccaggggactcatttgccccttttaccatgtgaggacgtagtgagaagtcatccctatcaagaaggaaatgggcccttactaggcaccaaacctgccagctcttcgatcttggacttcccagcttctagaactgtgagaaataaatttgtgttgtttataaaccacccaaaataccattattttgttgcccagacagactaacacattggccatttatcacataccttgaacatgtagctgttactttctaccacatctctaccattatttaatttttggctcaaaaccagggtcctttaagaaatcgtatgtcattccagtgccttatggaatttggctacacttaaagggatatgacaaatgtcaagagttggttgttatccaagtggaaaagaataatacatgagtagataagagcaattattgaataccaactatgagccaggcactgtcccaagtattttacagatactaaagtatttaatcattgcaactgctccatgagataaataccacagtcctcattttatagatgaagaaatggagygaaagagaggttgactaattccttgaggttatacagctagtaagtggaggaggtaggattcaaatggttaacatttaataactatgctattactgcctttctgagacttgatttccttttcatgattaatgtctttttttgtgaattaaagtgtgataaacttgttataatcagtaatcatgagcaaaatgtttgggttcccctatacaaatttaattttcatagttttgtgttttatagtcaacactttcagaggctgttgtctgcatgataaaggcccatgaatgttgatctgtactgttttatgttttttttttttttttttttctgagacagagtatcacttctgtcgcccaagttggagtgcaggtagtcctcccacctcagcctcctgagtagttaggactacaggtgtgtgccaccatgaccagctaatttttttatatttaggagagacgggggtttgccttgtttcccaggcttgtctctaactcctgggctcaagcaatctgtccaccttggcctcctggagtgctgggattacaggcttgagccaccatgcctggccctgttgtatgttttcattgcttagtgtttcataactgtagattcataactgatttcataattgtggattcatgttgtgtaccacgtgacctgttgaggggaagatactgtgtgtttcaaactctgaaaacgcactgtacctcatagatgactagatattatttcagccgggaatctggagacctgagtccttgtttcagttttgttaatagcctgctctgtgaccttgaataaattacatagtttcttagagcaggggtcccccacgcctgggccaaggaccaggtactgggccgctcagcaggtggtgagcagcaggtgagggtggcttcgtttgtatttacagctactccccatctcttgctttacctgagctctgcctcctgtcagatcagtggcattagattctcataggagcgcgagtcctgttgtgaactgcacatgccagaggtctagtttgcatgctccttgtgaaaatctaatgcctgatgacctaaggtgggacagtttcatccaaaaaccatacccctcccccacccctccccctattgcctaaagggttggggaccactgtctgagagacttcatttcattgctttaaaatcaagagagtagtgcaagatgacctctgttcttttgccagmgattcttggcacacttatttttgataagaagtgatgttatttgtaatatatagtatctaaaactagtttgtgtttcctaaatatttgttattaattggattaaatcttctattgaaagttacttttgaaagtttagtaacactttttaggagaatgcgagattgtcttttctatatacaaaattagtctactgccctccaaccagagaatgtggtttctgaatgataggaaatggccaactttgcagttttgccttattctgcctcctgcaatggaacatcctttcaggattactggtggaagaggtaatctgtggccactgaattggtgatctagggatcaaacccatatcctgttttagcgatgggagaagaaagagtgagctaaggggcagtataggaaccctgggggttactggaaacgcctgcatctaggattgatttgtcagtaaakgctggaaaagtagcttaattctgtgtttcagggttaggctgaggctgctgatacacatttgtcttggtcaagactggttgaggaagtgggatttgatttagtctgtaggaggtggtagtgttggcatcagtggatttagctattaggagctaggggaagtagacacaatggaatgaggttgaagctcacacatttaatatgaaactcagtaggcatataggggccttgaaaagcagctctgagagtggaggaaggatgagccttgggtgctggaagtagcatgtgtgaagcacatctgtaggatttccttagtgtgagtcaacagtgtcatacagctgctctgggacacattaagagagaagtaagcaaaatggatcatatttagatattagagtgaccaagatgaggaagagatgtaaaaccaggtcatatgaaggattgttaatggggctacatgtatttatttagcccagcaaagaagggactagtgtgttttgtgtgtgttggttggggtaggagggaaggggagtggtttggtagaaaaatcacagatggtaacttcccaaagagatttaaagggctaacatgttaaatgttaatttgattctttatagtggaggaggaaaatgcatggtgattgggaagccaaaaagagacgtatttctggtaaatattgaggaagaaagttagaattatctcattggaaatggtctgtctgggactaagtattcaaagtagactggagtgacactggctgggtagagagagtgttgaagtatcatggggtgcctggatggtttaggtgagtgtctcaggcataagcaggcagcctgtagatggtgagtaggtggaggagctgtgctttgagctcttttcacatgtcagggagtttgtgctgagscacctgcwgcttgcctagttggttcccatggtattaggtgtagtggctttagccatggataagagtttttccaccaggttaactacttgtatggagacaatctgagatgttagaatgaagagataatgggagtatccgctttcatagaataggcaccataagacagcccccacagacagtctctccatcatttcccataccagtgatgtttgtctctggtacttcaaaccagacaaacaagagagtagttttctgttggttggggcgctctacaggcttctctgcccatccagtcttctaactccactctgctctaaatcatttccctggtccyattatataagctttatatagggggcttggtggttaagggccagactgcttggggtttgaatctcacttagtagctgtgtgaccttggcaggtcccctgagcccaatgtgcttcaattcactaatctgtagaatggagataattacaattactgtaacactcacctcatagggctgttatgaagtttaaattagtatatataaggtacttagaagagggtctggacattttaagtgctatatacatttttattattaacataattaatatggcatttacataagcttgtttccaggataaggggggaaggacatcgtatggagggcaacattgaagatggaggggtaagccttggagaagaaccaaggtacccttttcctgacttggggtgaaagaaaggaagggtgggccaagaaaggcaggatgagagatgaagagaaggtgggtgaggccatgtttgaatgttctctacttactctgtaaattagcgacctctccgtatggtcagagtgggagggtagagtggggattgaagaagggtaggaagggactggaatagagctagtgaagatgagaaaaaagcaatggtaaacaatcaggtagcccaggggaggttggaaaccctgctgygaaatggagccagtcaggaaggctgaaaggtttctctgacagccctcagcagtccaccaaagctggagatgagggttgatgagttgaggcaagggtgaggagaggttgggtgattgcagtgaaagatcaagggggcagaggaactggtggcagatacctatgggggcaggggaactggtggcagttacctatgagaccgtaactgaaaaattgtaatgtatatacctcagatatcagctgggacccttttgccttgctttgacccagtttcataacttactgtacacagattagaataccatctgcctatcaaaagaatgagataggtctatgtatcttgaaaagatgtctgtgatagagtattaaggaaaaagagcctgttgcagaagacaatgatcagtgtgattctatttttatagaaagaaacataggaaagtcctggaacaatatacatataccaaatgcttaacagtaattacttttagcggggatcgggatggatggggaggcggagaaaggaaattaactttttgtaacacacagtatttaaagggaaaagtgtgttgggattatgggtgatttttatattattcttgtgcttttgtttatatctcagactgtctgtaatatacatatgttgtgtctataaacagaaataaattaatgtttaaaaatatggaaagcatctacatgtacaagagatcattgcttattgtatctcagtaagtggtttttatatatttagaaaaatagagtgagtcatcacaaggaataatattcagccttatcagcaattaaaattcatattcagacaacctgtaggaactatatacacccgttaggccagccaaaagaatgacaaatgtgatatcattatgtgtcagtaagagtggtgtaaagattgggacagcgatatttggacattattggtagctgtttgaatgggttattttttctcctggaaaacaattggtcaataaatgtaacaacagctataatatgattcatatttttgacctgtataattctacttttaggaatattttcaaagtaataatgcccgaggaaaccaaacaaccaaccaaacaaaaaacccaggaaataaatgttctcaaagaagggaatgtcaaagcaacttatataatattaacccatttaattctatggtaggatgataaaaatgacaagtacgtggactttgtcaatagaagacttttagaagatttttttttttttttttttgagaccgagtctcactctgttgcctaggctggagtgcaatggcatgatctcagctcactgcaacctctgcctcccaggttcaagcaattctccttccttagcctcctgagtagctgggactacaggcatgcaccagcacacccggctaagttttgtatttttagtagagatggggttttgccatgttggccaggctggtctcgaactcctgacctcaagtgatctgcttgccttggcctcccaaagtgctgggattacaggtgtgagccactgcacctgattaatatatgacttttaattgaaaatatatgatacgaaacataaaaataaacatttaagatagatttttatcaactatgttatatatatatattcgtatattggcgcatatatactaacaaccatctgaagggaaatagaatatgtgctgtaacttacctttattagataattttctactttctattaaattgcctttattcctaaagaaaggggagccataattaaggcaattttattatatcattctcttatttaaagatattttaatccattaacataatgatggactttttgagtaatttaaatgaatagtaacaataattcatgatttgtctcatttttcagaggtgtgagtgttccactgtgacaataaagattttttgttttttttaaaaaataaagaacatttttgacttctagggttaggtaaaaatacctttgatgaagttgcataatgatcctatctttcacaaatcaaaagaattccattttagtttttgcattttaaataaaaaataatcaatctgaccttatcccattgatcccactaatgataaaatactctcaaagatgttttattagtattgttaggaaaaactttccctggttctagtcattccaaatgcattgaccacactttttaggtcttttttctgtctctttttgattctcagtttgaacttcattcattttcttcatcatttgaagtctctactatttctatccacattctttctcttttcagtttcctggaaaccactgagcttggccttgtttggtgaactgcattgtcattattgcatcaaaatgtttagcactctaagccctgttgctgagcattgaggataagaatgtggctgacaaaggatgataaatcctctcattytgattcttatttcgacatgctcttgtcatttaacctgatataagcatatatgaaccccagtcagaagactggagtgttccttctgcttagagaatggggtggaaagtctaccttcaattgttacacatgctatagattcagaattcttgaatgtgacagctaaaggggcttggaggtcattgggccagttccatggattagaaaccaaagtcttgagcagctaaatgatttttcagaaataatcagaaggccaactcttctgacacctcagcctgtgaacatttcaataaatccaacctctctaagtcacgtccgtatagttcagccaatttttagctaagatttgtggccacccacaaatgtaggctttattctaaaacctttaagctgttaccaaccggatatacatcttttccacattcaacactactccaaacagacctgacatgtttgtggttaaataggaagaccaactagtgtgctttggcattcgtacattaatgaaggtccgaattggaaaaatagttatactttggtgtctttgtttagaactgcagaaattattttaatctttttttcacttgtaacaggttttagaaatgtggataaaataataacactgccacatacaattggtatttagagtatacaacttttgttctttctgtaggtggtggcaggtgtgtgtaatgatgcaaaacatttggttgtaaactttggagagtgagatttgtacattaacagagaaacgttaaaaaatttgttctcttaatcacaggcccattttgaaacaagcaagtagaacataaaattttcagaattatatatttctacatcatttaatgcagaaaccttaacaaaactccttgcaatggaatattatcatttaatagttgagaatgtagtacagttataggtatttcgctgatgatcatgaattatcctgcaatgaataaatgacccagtaaccttttaaaagttattgactacadcaatataatttatgagaaatttaaaacataattagctggagttctttgagaggaaaatgtttttatttatttatttattattttttaaaattttactttaagttctgggatacatgtgcagaaagtgcaggttgttacataggtatacatgtgccatggtggtttgctacacctatcaacccatcatctaggttttaagccctgcatggattagatatttctcctaatgtttgagatgaaaatgttaaggatagttggatatttttccattaacttactttgtttcaactatcatttataatcaakttataaatatattagtaggtttcagtttcaaatttattttggaacaagagaggttataaatatactttgtattctacctatactgtaaacattttaaaaattattaaagatgtttggttctggattatggtttttcacatgtgttatgataatgcagatgatatgttatagaaggtgtaggcattgtgctgtttctgaataataatgtgccatatcttgagaggcaccttaaaaatgacaattatgagctgggcacggtggctcacgcctgtaatcccagcactttgggaggctgaggtgggtggatcacctgaggttgggagttcgagaccagcctgaccactatggcaaaacctcatcgctactaaaaatacaaaattagccgggtgtggtggtgcatgcctgtaatcccagttattcgggagggtgaggcaggagaactgcttgaacccgggagggggaggttgcagtgagccgaaatcgtgccattgcattccagcctgggcaacaagaatgaaactccatctaaaaaaaaaaaaaaaaagacaattatgatagtaactttgttttataatattacttatttttccttaaattcttattgttgagcagaggctctagaaataggtaatacgactagttaggttttaacataacttaccttttgctttctgaattggtttttaaagttcattggtagaggccatgtgctgtaggtgtgattacatggaacaagtacaggtacttgcttcaagaaataaataaatgtgaatataattaagtataattatataaaataattattgtaaaaattataatatgtgatacacactcacaccatatttaaacagtatagcattgaggtaaaagaaaaatgtatacataaacattatactgattttagaggttgaaatgaagcctgttatttggatgttgacccagggtagtaacatgccacatgggactgtttacagcccctgtgcaaatctctggacgggagagttctagttctagctatatggcagactagatgttaagggagaccgtgcttgggaaagcaagcctgaacatgctagataaaatattttttaaaaagtagttttgaagagaaaatccacctagctcaagagtatttggtagggaaagcaggtttaaaataaaaagacaacccaccccctgcccttttgcttccctcccatcagtctggttgacaggaagaaaccacaccatcaacaccaacaagtttctgtgttccttttacagcaaaagggactttttatataaccaaatgtggtgttttagtgactttttgataatgtacagttttttgtgaatttaaatttatttctttctatatttttaggaccaatctcatttttaataaggttaaaaagaaaaaagtctagcgaaaaaactcctgtttttgccatgtgatgttccacaagtgcagctgtagaaaagtgcttgtcagttgttgaataaaaaaaccacatttgatagaaaaaaaaaaaaaaaaagtagttttaaaagcatggctgagctggcagaaatgtaagggaattccttggagggtaggaatgacaagacactatgtgtcaggaggggtaagtgaccattggaacaagcattggtccccgtggtatctgttaacctctaaaggcctaaagtgtgggttttaaccaggcatgtgtagggagcacaggaaacagmgcccaagacagggtaaaggtcaagtcagagctcccacatagagtcagcacaccaaatggttaaccccgagtggaaacactaggaagaatctgctctggagagggcatggtggggacatatataactgtctctgctttggttgtgggaggaatggaaaagagaagtcccccatgagagttaccaacgataagcctgcatgaaggtaggctytgggtttgagttcataccacctgtagggccaagttgaatgttcagttgaaaatggtcttggattggcagtaatcccagctcctggtagaaggaaagggaaatctctctggaagaacacaataatttaaacgtagaccttaataaattcccacaaataaaactgaagggccttgaatccacggtrgaggactcctcccatccccaacacataaagaaataaactatcatgagcaatcattaattgaaaaaacacactatagagtcagttccacgtagactgcagagtttggagtggtctatttcagaatgtaaaatatgtctgtttaatatatttaaagaaataaaatgagctttgagaatatgacaaagatttgaaatgaaaccagatagaatttgtagaaatgaaaatataaygttaagtggacattcttggagttagaccttccttgatcctttaaacaggatcctggcmcttacatctattttcccttcatcaytctatagcttttttaaagctttgcaccatccctctagtgagaacaacatcagtttttcaaaccagtcagagaaaagttgttatatgtttctctagaatagcacgttagcctctgagacctggggcagaaggaagaaaaagagatacattataatcacacacaacctacatgtgcaagaatattatttttttgccaataaggtggatttttttccaactttttttttgcccttcttattgcccttcttagcttctgctctttgttccttagaatgttaattcttatcaccccaactttttacattgaacagtttattaattggaatacatgctatgtttactaaataagtgtgctccctgatccattaaaaaattttttttaagacagggtctcactttgtcacccaggctggagtgcagtggtgcaatcttgactcaccgcaacccctgccccttgggctcaagtgatccttccacctcagccccccaaatagctgggactacaggcacgcaccaccatgcccagctaatttttgtattttttgtagaggtgaggtctcactatgttgcccaggttggtcttgaactcgtgggctcaagcagtctgcctgtctcggcctccccaagtgctgggattacatgagtgagccactgcatccaatcaaagctgtattttaaatgggaactcacctggaatggcacaaagattctgtgtcccaatttttgggttcaggaaatctattcatcctttgcagatgctcaagaatcgttgtgtaactggattcttctgctgaatttatatggggacctatgggctgcatagtggagtagtgaaagccttgtatagacactggggtgggcaatctttcctctgtgctcaaggccataggacatcccttcatatgtttgtagtaattttctctggagctcaaartggaaagcaatgggctgattattattttgacagtcataatttgtgaccagactttaaaaaaacattgtggtcaatgatgttgcacaattactttttgtctgtcacawaracaaaacaaatccagatttaattcartgcaaacaaataaataaaatgctctgctaagagtatagagtcaagcttttgatctagtgggagaggctgagactgatcgaaaatataaggcagaaataaatgacatgagagaaatagaaataaagtgctrtatttgatcaaaatagagaacagttatagcagagcgatttggaaaggctttgtggaaaatgtgaartcagaattgarccttgaggaatgagtagggtttcatttggtatagatgggggtgggtgttacagaaagaagacactttgtggaaaagggccagcttttggaaagcttgggccattacagggaacagaattgatcagtaacatttatgarttaatcatagaaagttctgactttttgccaatgccataaagatatatgacattttagaaacttgaattttgctgaaccaagaacttgaatcaggctttctgcagggctcttgtttgggagtgaatcacgtagtgagtgagtgagtgctcccagctgagggcctggcatcctcaggcagtgcagctctcccattctcagcttggcatggtgtaggccttaatacttgtgaactactgaagctatgtttctatgtcttttaaaaaaatatcttctagtggyagtgattgaaaaacagacagtggttcttattagcaacaacagtgcttcagaaatttgagtggaatgctgaatttggtattggatcagatgggtgacaggagtgtggaattttgcagatgactcaggaagaaactcgttttcacattggaggtctgctttcatccactcyggatgacaggaaatagaaggaagtaaaattataaaagtagagtgaggccatgttgaatagcaggctgtgactggtggataaagttttctaagcagctatttgatttaatatgaactaaacttttagaaaagatattactggcaggttgattatacttttactatcaacaaagatacatgctgaaagttgttgtaagaactattcaaaaaagtggacgttcaataaaatgaaatgatccacataatagacattatattctcaaagtttccattctcccaactttgtatccaacattaagattgtgaattttgttggatttttctttaatccccttatccctaggcatttattcgtatctctaacaaaattgcaataatatttgtgaaaatatagctatggtacacattaacaactgcaaatccatttaccgttcttccttactgataaaattctagttaaaaatgctgtctcagactcccttgtaactagggtgaccacataagttagttctggccagtcagataaaagcrgaagtctcctgataaaaagaaaaaccgctgacatgtgccttttgcccttcatcttttcccttcttagttggagcatagatacactgcctgaacattcaggaggcatcttgagaccacaagggcaggtcggaaagacagaggaggctagggcagttgtcccatcataaagctattgcwtcacctcttatctgtttacctctgaccaatttcttaagttggaaaataaaccaaccttggttatgccaggcaggtcattgggtttcttttatgaaagcaatcctaactgatacagtaggccacttttgggcaggtataaaatggttaacattcctcctggtgcactgggagaattcagggaatgaatgagttttgcaagggaattgtggtggcactttagtgtgtttgccctgtgggaagcgagtttgaaccccaaactgaaagttacgccatccaccagcattggcaaactataacgccactccactgctcaagtgtatgtggcacaaaggggcagaacaccgctggggaaaacactgatcacgaggagtgcagagtgctcagattaaagtagagctaaagcttctagtaagcacagacgttaattttggggaaaaggagtaactagtggcaggtgttttaccgagtgtggtagagggagcaaatctcttgagtaatgccactgatgaagacctattatttaaagagaatactgagtatttgcagagttacagaaatggcagtaagaatctcgacatgatgaactagcattccagaccagcaccatccaacagaaacacaatgcagccacataagtaattttaaatcttctgctagtcacatcaaaaaggcaaaaagaagcagatgaaattatatttaactcactatagtcaaacatcattgtgacatgtaattaatataaacattattaattgtatattatatatatatatacaattaatattttatatatatatatatttgaaatccagtgtgttttgtacactttcaacacatcttgatttggactcagccacctttcaaggtctccattgccccatgtggctagtgactattgacagggcagtttcagagtagaaaaaggtgatttatgtagcactcagatacattggtttatttttttttttaaagtaaacatttccccaacattctaattttctaggggtatagaagaaacaggcattagtaagattctaggagagtctaaaaatagtgaagagagaggtcccatagaagtgtctagctgtgtgtttttaaagtgagtctgacatgggttgttagatttgatctaaaaaatgatggccaagaaatgaaaattgaaataaaagatttattgaaaccatatgtgtaatcttggaaaagaaagaatacgctcaatttcacatcttggacatattgagaagtaggagaagtgtgtctttgtagaattattcacaatgtctatctaaaatgatggaaactttcttgttttattatttttctgttataggcttttcttaacttgggagtgacgagcgaagacgaatttgggaagcacagggcagagtgtcttacttcattcttatatgctgctgagcttgatgtcgactcagtttgtatttgattcctgaagttagaatatctcagaaatctttctttgggcagtatttgctaatgtaattattatttatcccagttcattccatacattaagtattctggaagggyatttaactcttcacattcttattggccaaccagtatctaatacatggaatgaggtttcaggccctgcctccactgaggcgcttcccactgggaagtactagagaatatttttaaagagtctctgyggacacasagcaagtwttaggtttttttgtttttgtttttgtttggtatatctagaaacacactttgtgaatgtgaaaggttctcttgtacccaactagaaataatcactgactgcctctgaagataatgatggagaatttgttraaagatttctctttaattataaagtggctatgcaaatgtgattacagtttaaatttattttcgtagtgaaaatagcttttgggggcattcaggcattctagaaaaatataaagaagaaaagaaaaattatgcatacaagcatagttaacacttggtcatgatcctgtctgaggttttccctattcacacataccccaaatgcttacctycccccatcccwacacacacacacacacacacacacacacacacacacacacacacacacacacacagacaccccttccccctcctcctttcctctcttcttcaatctccttccctctcctctccttccttcctcctttttttgtctttttacaaaccaggatcatattctacatacattttatagcctgctttttcacttaacaatacattatggtactatatgagtgtgtctattgaatgaggcctttctctgttcatttctagtaatgtccaatattgttattataaaccatgacagagtgagcatttgtttaattattgtcttaggatatattcttaagtggaaktgctgagagtgtatgtgtagagtttggctgtgtgttgccaaattgtcctccagagaggttgtgtaatttattcttgcactaagaatattctagagtgctatacctatagtgttagtattctttttctgccaatctcagagtttaaaaatgatatagttgctttaatttatatttttttggttcctagtaaatttggacatgttttcagttgtttattggcagtttgtgtttcttcttcagtgcattgcccatttgtatcttttttcatttatttattttattaaggtattcttttcrttttgtattggaaagctgtctttatatatttaaaacatatactctttgtcacatatgttacagattttactacctctaaagtgttaattttatttactgttctacaatattgaaaagttttgcaaggtgctatttttctytcttattttcatatggagtcatttgtgagaaatatatgctgggtattgcagcctgctttttgtttcttgaagtgatccatcaaaagcatttatatactttcatgtataagccctgcatcatctctagagtgtgttttgagtaagtaatgtcaatgaaatcaccatctaattatgttcttgcgaaagcgcctgctactacctttgaagtttgctgctaatctcttcttaccttcatttcttagtatctaaggtttagataagcagtgacaattaaaaacatagaggaatgtaatttttttcttgagtgagtctacttttaatatttgaattgaatgttagcaagaagtagtaagctcactggtttaatttttatttattctatctctacgttgtgtgcaaacacacatgatcaacatcaatggcctaagattatccttcagaaaattttcttagcaactcaaacaatgtcccgtagtcagtgggctcctaacagtgtattaagatttaactatctgtcaaaaagcaggaatttgcatagtgtgggaagtctacccattgtcatacttctgcatatgaaagtaatatggtaatattgaatttgactgtgaaaaatagtaacattaaatttgtgtccataagaatttaaaattatataggggacacaaataaatataactcatgggagtatataaacaataatttaaaggctttgaagggtaaagtgtgtaaagtagaatgtgatactttggcaagaaaactttataggcagagtgtgagttatcatttagagagaaggagcagagtgaggcaagcagaagaggaacagttgggtactgggtgccacggggtacagatggggattggcagccatggaggggaggctgacagagaacaccaaaggcaattaaacaccaaaggcaatgaccagaagtgtattttgatgtagaggtcaaggactaatcccaggtaggcagctagtaccttttcaaaatggtgggcatggcatgcctattgcatgcagtttaagaaaataggtgaaatgctggcatatgcaaatgttagggaagtacaacctacataaaagcaagacagagctctaaaaccctattgttctatgattccgtttgctgggaaaatgtaaaccctactgacagcacatctctgttacagatgtatgggcagataaatgggctaagaaagagattatgtgattgattatgacctttctatattgtacctgacttacattaagtatgtttttaatacttaaaactagttkactaaaaatgcctttaaaaatgagtctttatatatatatatcttttttttattttttattttatttgtttgtttattttttttgagacggagtctcactggctggagtgtagtggcgtgatctcggctcactgcaacctccacctcccaggtttaagcgattctcctgcctcggcctcctgagtagctgggattagaggcacccaccaccatacccagctgatttttgtatttttagtagagacggcgttccccatgttggccaggctggtctcaaactccttacctcaagtgatccacctgccttcgcctcccaaagtgctgggattacaggtgtgagccaccatgaccggccaaaaatgagtcataatataattcaaactttgcacgtaaatatgtataaagtcatgaacttacatagtgactgaggattttgtgtatataatttgagtcttttaaaagttgactttgttttataatgcttgctggttttagccatctattttaaaccatatgttccctttagacaaatttcataattcttaaaactttgatattctgatttctatattcttgatactgagttagggaattcctagtgataactcatagtaaattagtaaatgcaattagatttcaaggtctccatggctatgatggttacatactaaaatccttgaattagagtggccaaaaaaaaaaaataaatctcttggtatcatttgcagagaataattattcctttatttatatagtgcatcatagtttgcaaagtgcttgttactgcagtttttaaatttatttgacaaataatagttgaatatatttatagggtacagtgtggtcttttgatatgtatatatattgtagaaagattaaatcaagctgataaatatrtatccatcacttcaccttcttatcattttttttkgtgatgagaatatttaaaatctattcttctrtgttccttcagtttttgtttcatcttcatgaaaaccttagaggcaggtggcatagctatcactacctctattgttacagataaggacaccagacatagggctttggtgacttgtccataacccacatctgacttccaggagagttctttaaacacacacagcctctatcactattatttgattacaactcctcagttagatgatacctgaaagcagttttcttgattttcttctcctttgtatatagtattctattttgggccttagcagagttgatattcaaatacaatatttgaatgaattcttttactgagaaaggtagtaatatagtccaccttaaatagattgctaaaatacttaaatcttattctggctgatgttttggaaaaattggatatagggacaggtcaacaaccatgcgttcagcttgattccttcgcagagacttattgtagcagtcaaacacagcgaataaggtgggcagacaaatcttttaattggcccatgatcatggagtgtgcctcagtcattaaataaatctgcaagggcacaagaagtggttgcttcaaatcatttttatactgtttttgtggcttatatacttggctgttcaggagctaccagaccataaaatccagccagtgagagcattggaagtcacggagctcaaaggttgattacgtggtgtgaaactctattgttttgtgcatgtgttaaataattgctgtcagtgcaagactgttaaaaattcccgactagtaataacatgaatgcactttatggcttcaaaaggagataaaagaaatttcttagtcagcactttggcggcatcacagctaatgtcagttttgttattgtgaggactttacttttggcagatgctctcccttctggcagcagagctctaattaccatataaattaagctgggaagtgagcggagggcatgcaactcagccccttctgccttgtacccaggtttccagggctgcagtgccaggcaggcgtagcgtgggctgacgccatggrgagggctccactccccttctcccctttcttcccattcagatccattagagggacattaagcggcttagctgctgtgcaaacacaaagatcattcttttttcttcttcttttctttctttctttctttcttttttttttaaacctagggtcttctctctaatagcattccaggaattagcctaatccatcctgctttaattcataggcactaattatatttcagcatacattcttacacactaaattataagtatccttactttaatcagttgtaactggtccttaaattgagggtttagtactctccttttatcggataacaggctttgctgtgttatgtgatgggattaaactgtttatttaggatgtagaattgaagacgtggatgatgtgttattttttttccyaaagtgctctgtattttcttcagccagagtgtatttcagaacttcataatgaccttttataatttgtaaaatggtgtctaatgtttaggtccttttgggatgtgaactgacaagcacaatttgtagaaacataattataatgcaggtgaataatcgtttatagttgcaaagcatttcacacataagctattctgtttggtatttaagtagccctccaggtgggtaactgaaggattcctgtgaggtggtcactgaaggccacatagttggtagtgcagctggtgtggcgtacaagtctcatctccctctgggggttctttccttccacctcacactgcttattgactggagttccccctacattacaaagcacctaataagatgatcttttcctatcagcattaaaaatttttttttcgactttgtagaaaataatcsttttgcagcacttaaagagaatcacttgcgggcattctgtaaaattttacattttactgacagcacaaaacaggaaattgttttttctttttggtgagtaattgctagtctagcttttaaaattctctatctatcactcgctctctatctatctatctatctaccccctcacagggctttaagcctcttgaaagaagtayaaagaagatagactgatgactgtccccctggtaactggcacttcagagagggtgagagaattcacagataattctcttttctgagctaggaaggagtcacattagttgagagactttatcactttcagtccagtacttccccagccccatgaaaaaaagtgtacccatcaaacartccccttctgccatctttatcttatcaggatctctcttctttaatagatgagactctttggaaaggactttaattggctgatgccacagactcatcccggaacctaacttcttgaagaagaacattctgccttagtttcaggcaggacgactgcgtcactgtacactgtccagaggtgactggctgagggaaagaagtggctgaaatctgctgtgttccatttgatgaatggtgcttgctggmacactgcttcttcttacacaggaggctccagtcactggccaagccttgcagtggggcgactttcatctggggccactgccctgttgctggcactcagaacaggagcagttgcatccccatctacttagtcactaaagacagacatttcacttctttttttcttttcttttctaaattgtgaggaatgtccaggcacttgctctttaggtggacatggaaagtcacccttccccaaagactggacttaaccctattaattatgcaaatatagtgcaaatgagtaaccatgattctgggagaagagtgacaggaaattggtggcgagacaaagtctcacagtgctgattgcctgtataggggccaaggaacttcctggaggaaaggcagtccaactctagctcctttctcttttttsgctcagttttactcgaacctctctgatggattgatgttgtcccagcagaggtcccttggaaagaaaggactccaaggggcccaaagggaaactcactatggagaaaggagaatgttgaactggctagcattagggcctttctaggctcatgaaggagggcttgtggctgagcctgggtttctggcacagtatcgatcctttgacagtgtatatgagttaaggtaaagcagcartcccctgggatcccaagtgtgaggcatcacagttgtctttgcaggkatctggaacaccagggtttgtggcagcaatggacaaaagtaacaactctatggttttaccaggagctgcagcagctagaaatgtggactcatcttggactcatcaggctttctattctgtttcgacctggtatttggaaccaggacagacctcagcatttttcaacaatttggggtagggctgtggagcagcttcaggagggagatactggaattgttgctaataacatagactaatggggtctcaaaaccaatgaactgggaaaagaagagattggactatatttttaccccacagttatgaagggagtcatataagtgtattcttcctccttaatgtctttcaaatcctttatctctgtcttaccacattaactsctccttctgcaactagtctcctcagtccatttccacactgctgcaagaatgatctttccagaatgcaaatatgatatgtcactcccctgattaacatcctataatggccctgtaaccatttaagatgaatccagattccctggctggctgtacgcttttcagtctcatctctcgccatagctcccagtccacccagcgtgcccaccactgtgaactacttgctgttccctaacatacaaaccttctttatgccactgaatctttgcacatgttattcttccctgtttttcactttctcattcttaaaggcttattcaaatatcttcccctttatggtagaaaaactccactccatatcatckgaatcccaacattaaagcctaatacatgggtactgaccttctacctaaaaggctggttttgaatgagtgattttcagtatgagaaatgaatgactcaagaaaagccrtatcagaagaagaaaggtagaaaatgataatggactcaaatgattctccatttgcttctaacattttctttttgaggacttcagtgatttatgccatttgtgtggacatttagataactaatcttactattattataaatacagtaatttgattaagtatgtgtgatattgtgatataataagaaatacatatttagtctttgtccccagttcctggcacagaattcctaaaacctttgtaatatcctgagtgagaggggtgataggagcaacttttgttataatagttggtcttggtcttcggttcctgacacaagactttctaagacccttggactctctggagtgaaaagagtgtcttgtttgctaatgagatgactggtgactggaggctcctagataatttcaggatgaaggctggtcactggaaagaccaragcatgattagaaggttggaactttcagtccaccctagatgtccagggaggggagagggtctggagattaagctcatcaccaatgaccaaagaattaatcaatcatgcctatataatgaagctttcataaacacccctaaatcatgggttttggagagcttttgggttggtatacatgtagaggtgctgggagggtggggtgcacagagaggacaatgacattctgtgctccttccacgtayatctccctatgcatctgttccgtttggctgttcctcagtagtatcctttatagtaaagcagtaatagtaagttaactattttcctgagttctgggagtcattctagttgttgaacctgaagagtggatcatgggaacctctgatttataattagtcagtcagagagtccaggtcagagaggcctgggatgtatctacctgacatcttcatatgtcaaataactcatccaaactagttaatgccactgaaaattcttggtgaaacagacctctagaaaatacacttccccaattttaaattgttcttagtaattcactaaaatttagcctatgaaaatttttccagtggtgggctctacttagcaggcacaaaactggagaaggacaccacctcacccacaggtgttaggcaaagagattgggtgctgggtcagagccacatgaagcagggttttagagggcataggcctgtatgtatttggacactcaatgtggaacagggctgtgcttctgcataggacttagaatctggaataaaaatagatatttttctctgcagtcctatacctttgctacccagttttaaaagtttgtggctttctagaaatcatagtacagatggtccctgatttattatggtcaatttaatgatttttcaactttatgatggtgcaraagccatatgcattcagcagaaaccttaactcgaatacctataccaacattcttcttttcactttaggtacagctttcaagaaattacatgagatattcaacacttgattataaaataggctttgtgttagatgacttttcccaactgtaggctaatataagtgttctgagcatgtttaaggtaggctggactaaactatgatgttcagtaggttaggtgtattaagtaaatggatttttggcttactgtattttcaacttacaatgggtttatcaggatgtaagcccattgtaagttgaggagcatctgtattctgatcattgtcatctccctgaagttgtggtttcttttaggtgtgtattttgtgaatgcatacgattgcatcgactggtctgattttrtcagcagtgactagtctgtctacttctactttgtattcagagasattacctataagcagagttggtagcttcctaccaatatagttccatggatgcttggcaggccccttagcctaataatatgcctctcttctgattcctagtgcttgaagttctttggcttggtttggttccaaattttgggagttagagattcctttaagaatctcattaaggctgtgaacctctttcctggaaaaatgctcatatagatgtacataaaaatgtgttcttgaactctaaaattaagaactcctgtgttaggtagaggtaaagtctttccacagttagagaagaggcttaaaatgtaaatcaggcaaggcaagaggatacattcattaaacaagcattgattaagggcttaatgtttacaaacaccatgggtaggttttgggcatacagattaagacctggtcttctttcttgacaaacttttagcttggtagaggaggccctcatgtagacagagagttacaatgtgaggtattcaggcctgaaaaagaggtggatacaaagtgccagggaaccagatgggaggtagggaccaactctgcaagtgactggctcatgtttaccttagaatagaaatggctgattctagacgcttgcctcagtcagtttagaaaggtgaaagctgggtgcggtggctcacgcctgtaatcccaagactttgggaggccaaggcgggtggatcacctgagggcaggagtttgagaccagcctggccaacatggtgaaaccccatttctactaaaaatacaaaattagctgggtgtggtggcacatgcctgtaatcttagctacttgggaggctgaagcaggagaattgcttgaacccaggaggcagaggttgcactgagccaagatcacgctattgcactcccactccagcctgggcaacaagagcaaaactctgtctcaaaaaaaaaaaaaaaaaaaaaaaaaaaaagaaaagaaaagaaagaaagaaaggtgaaagggcattgggtgtcaaaagcaggagtgttattgagtaagaggctgcaaagcagggaaggacacagattggagagaaaaggagagattgagattgccaaggagaaacctcacatttaaaaggtttacttgggacccagccatttgtagctacctgaaactgggatgatattttgcaaatagatacagacaagtaggcagaactgtctgccccattctcctgccaacaacaaacaaaacataaaacataattccaaataagggaaatgcccattactcaractttccctttgaatctaataatgtcacccaagtcttgaggaatttgctaattgtttgtagatcctacaaggtcataatctagacctgttttaaaaaatcttttaaaacttcaatatrtttatttgaaagggatgaagaaatgatatacattctacccagtctgcaggattacttgacacttgccgtcataggctgggactcaagaagtattagaggccaccatttgttttttcagttagtcacagcctttgctcacagggcttttgaaattattttaattcagttacacatatagttgaagctacaaatttatctcagttctacattgtaatactggaacaatgcattgccaaggggcgataaagtcagaataccaatttatattgacagtttggtgagatattcttctgtgattatacaccaaagccttagatgtagaaattaatgggaaaagtttttaattgaaaatgtattttctcattttttaaatttattttttgttaaagtgaggcacctgggtttgaattttatactgctaatactttgggaaggccatagtggaggtggaaatatggttttgagatgaagcagtgtgaaggtgccacctagtggtcacataatcacgtctgtgttctctttcttgccagtggaaattgggtacccgtggtgggtttcctagagaatccccttataggtggtgaattcggttagcctattgctgtccttgataggataaagtttttacttttactttgtggtcactgaaattatcatcctccaaatttgttatttgaaattagttttgttaactggacagctcttgttaccctttttgctaatatttttagctaattatgtcagcaaaaacttgggttaaatgttaaaattatagtgtartcatagtttcccattccattggaatggtctgacatgtaatgtacagagagcatgcagaatgtctggagtgtatcgtgggacacagctaaagcctgggtgatggccagctgctgtgaggtttcattaaaggcctttcttgttgttttgggattaatctctctttagtagaatgctgtagaagaaaaaagatcaatagaaaaactcatcttttgtataaaaatttttttttcagatgagatgtgttcagtaagcacatacctcattagagagatggcaatggatggctgactacagtcatttcttttctttacccttaaacyacatgtaacccagaattgaaacatatacttgtattgaggttttccaaaacaattagtgatagagatcttaagaaggaccagaattcctggagggtgttgtatgttttgttttctcagtgcaagacatctttgaggtttcctttgccatcaaaggctttctatgtgtgtttgytggggatggcggggggatttataggaaaggactttcactgagatataaaataattttccccaggaggatttttactttgctagtcttgttttggtatctattttgggcaatatttacattaaaaacttaacatctggtaagtactaacattttatctttatcacacatgaacaatttttttttgtcatggaaatcctcatggtggaattaactaaaacattatagaaagttcaggagggctcttcagaacaacacaaactttaactaaaaactttccctaaagatgctcttggaatttgcaaatgcagcccagatagcacaccagtcatttagattttaaagtatgtgctgcatacccaaccttgtcctaggtggacattgctgagaaaaatacacaaaaatagtgtgatttgtaggagtctgggttctcaaggtcctcagaagaggcagtactgaggcaagtacggagccagattgcctgtgtttgagtccctgctctgccctggactagctgtgtgaccttggagaagttacttgaccctctatgccccagtttcttcatctgggagaggggatactaataacttgctttgcagggttgagtggaaagcacttagaacagtgtcaggatatatggcaggaactccatcaatacaagtcagctatttccatcctcaccacatggtaaagcccaggcaccacacacaggaggacagtttaacactgtatttgattaagaaatgttaaggccacttactagaggagttcataaaagagaaagcagtgtaggctggggtatttaggaaaagacattctattttaggatttgacattctaaaataaaatttatttttaaagcagctttctctatttggttttcaattaaggagatcaattcattaggattcttggtgctatttccttctatagggttaaggaaaaagagtaagatttcccttggtgcgtcattcactttttattcattgagcagctatttatggactatgtgctctatgccaagcattgagtttgagtgagcgaatgagacaggcaggaatcacagctgtagtgtctgttctccagccttttaataatgttccscatgtgcctcagtgacctttccagattccttatatttggtttattttaaattttatttttaaaaattgtttatgatgaaaaatttcagacacacatgtgtctgttcctttgccaataccacactgtctttattgctgttgctttatattaaattttaaaatcagcttatatgatttttccaatcttatttttcctttatcaaaattgttttggttattccagttcttctgkcttttcatataaattttagaatcagcttgtctgtacctacagaaaatcatgctgggatttttattgggattgcataaatttatagataagtttggtgagaacagatggctttattatgccgaattgtccaattcatcaacatggtatgcctctgtatttatttagtcttctttcatttctttcagcagcattttgtcatcttcagcatgtagatcctgtatgtgctttttgagacctgtacttaagtataamttgtaacactgtaagtggtattttttcttggtttctaatatgtgtgttttttcttttggtttctatgtatacaagaagtgtatatatagaaaaatggttaatttttgtgttgaactttatcctgtgaacttgctaaaatgacttattagttctagaaattattttccccttgattccttgggattttctccatagccagtcatgttgtctgtgaataggaacaacttaatttatttcaaatctgcatgccttttatttcttttccttgagtttttttcttgcattggctagaacttctagtacaatgtcaagtaggtgtggtgggagtggacatttttgccttgtttctggtcttagggggaaagcattcaatctttcaccattaagtattatgttagacgtaggtgttatcagaatgaagaaggtcccttctattcctaatttgctgagagtttttttttttaaatcatgaatgtatgttgamttttgtcaaatgcttttctgcattgattgatgatgactgtttttccttttaatctgataatctggtggattacatcggttgttttttgagtactcatccagtcttgcattcccatgacaaagcccacttggtcatggtttgtatcaagttttgaagttccagctggaaatctctaataagggaccagccagcagagaacaagtaggcttgtgtttggaccagtgttttggaaacagttggctcactgggctagtgaccaccctgttaacttctgctgacctgttttccaagaacccacctggtaccaacatgcctttactgccagtgtattttgtttccacccttcttttgacttatatttattgttattctctttccctttctgtactggaccaggaacttccatcaactggaatcatctctgggcatcttcgtcttccatttgtgttttaatttatagcaagagagtttgggaataatcgtattttaagaaaccaacatttatttaaatataaacacatgtgattagagtattaaaatttaaatgctattaaaagtttttgcaatttttgtcatttcatgaggcaagaaaagaaaatatacgggtgtcttgttatatgtagtcttctaagatctgattttaaattgcaatttattttggaaggtagtggaaacaaaccagaaagtaatgtagatgtttgcttgtggttaacataatttgcctgcctcctcagaggctaaattccaaggaattttgttttctgtattcttaagtctagagacacaatggtccagagatccctgtgaaagggagccctcatccggggagccccagcttgcacagtcaccccctcaccccttcctggggakcagtgagaatgccgtgggctgtgcctgcactgagaatgctgcttttctgtgaaaacacagtcaagtgcacatgataggttttagttcccaagcagtgttaaaagcaaatgtgtggggttttatatttccagctgcttttttttttccaaagtaaaatatgtaggttttggtttgcagcaggccacatttcttctaataaaaacagttagaacaaaatgtgttttataagcatataaaaatgtcagaccataatgattttagtgttgcatatttaaaaatggtcagtaatatttaagacataagtatctgcaaagaaagtgaattatggaaagtaaattacagtatatcatttgtataaaggagaaggtggttggaracttgtccaggaactatattgagaccattttatttgcatttctatataatatgcatgcctttcagctttcmgttaaattttggcccccaaattattaaacttttatacttgcaactgggccccaacatttaaaaaaaatcctgtttgtgtctggacacacaattcattttgtgaaaaagcaccttcattctgtggactcattagagaaagcatctcagtaggtcctggtgccaaaatcagttgtgcttccttctgaaccattcacttattattatctgatggacactctgagctcctttttgccttgtctgctaggaagcttagaaaaaaaattcagggtatctgtaacaaggctacagaacctgagcccatgtgttttgcacactgactgtacatctggaatcattttcatcttatttctttcacctttactttcctttttgctttcaatttttttcacttaactctccttctgtgttatactgtagttgttgttataagctgctttaaatccatattggaataatatagttggaaatagatttttaaaaattggtatgtttcttttattattttatctctataattacatttctctagcactttgacacttttaatcataacttacaattgcattctcataaaaaataaaattccaagcaggaaaatttctgatacccattatgacatgttttaaaaaatctttattgtctctttagatgataaaagtaatactggatgattataaaaatttcaaaccttataaaaacatataatgtagaaaataaaggtcctctataatctcctcctgctgaaaaaaaacaaaaaacaaaaaaccaaagccaaaaaactataaaccttttggtgtataactttatggcatgactttaagttgcattgtattggagtggcagtgggaatgatttctttttcccctgtgaatcttggctgtataactctttcttcatttctgtgctatgatgcaattttttttttcttcttcacagtcctgaagatatgccagttaaatctgggggacataaaactcaacgttcttggaatgctttgtagaagggggtcgtggctggtctccatcccaggcaaatggaatttattgtgtatgtggctgtggctcacagcctgaccatggcatcagcatcagataggcctatgttcaggccctagtagctgaatgactctgagaaagttatcttttctccataaggcctggctttctgaggataggaataattgcttgaaactgttactgtcttgagcaaatgagagagtttatataaagctcttagcacagtgtctggtatgtagtaaatgccaaataaatgttagctattgtattattttgactaataattgttatttatagagaaaactcaagtaatcatggtacaaacaagatagatatttatttccctactatctacatggctagaatgaaggtccaggcctgactgtggttctacagttaccaaggacccaggctccttgtaccttgatgctcatgtatctactatttcatggcctaagatggctctgaccatttcaatcagattctaactagggcaaagatcatgactgagaagttgtgcgtaatatgtatactcacatcccattggccaaatcttagtcatrtgaccatacacagcagcaaggaaggctgggaaatgagtcttgagttaagtgactgtatgggcaactagaaattatgataccatgtcaaaagaaaacagacattgggaggcaactcacagtccctgccaccccatctatagcattgtctgtcagatgctctgaataaatacactctaagaactggttcctgctctattatctatgcatttatcagatacttttgtaaacttgtttatattctcatcttttgttggtttttgagatagtgattgctagatgtttattaatagaattttttttcttacattattattattttttttgagacagagtcttgctatgttttaagatctccccatggtctagaatttcaggcctattctttgcatttccccagttctatcactggcatgttttaagaggtgcactttcttcactgaaattagttaagtactgtgggagcttgctcaagagttcactacttcagattaatgttgtatagacttcagttacgtggttataaacgttcaaatgaatgctaagtttcaggcctgaaaaagctgaaggtttataatctataaataatatatttggtaccttgtggctatttcaaatagtaatgttaaaatttgcatttgtgacaagtggaaaattatgtagctagggagatgcctgtgatgacgttgtttgtgataatgttgttttccccccttaatcaattaatactttttttgcattgaataatcattaaaatgctttagcataaatattcctgtcagtaactgcaatattcttgcatatagtagtaaattctcctgtttgatcaggttatctttacatgaggatttttgttttttgttttattttgttttcagagacagggtttcattctgctgcccaggccagagtgcagtggcctgatcatagctcactgtaacctcaagctccttggctcaaatgatcttcccacctcagcctcccaaaatgctgggatgacaggcgcgagccaccatacctggcccagaactcttatttttaagttagattccaaggttgtctcggctgaatagtagctgagcctatgaccagaatttgggtattctcttcccctgtcagtttgtcggcgcaacaggtcagacaaatgcacaaggccttacaatatttgtcttgatgtctttggcttgtaaagctagattttaagatwttcagggttccttattccttagccgttagcgtttttggacttcttggctactgtaataattattctgaaccattctccatctttcttaaaagtttaatataggttatctgagaatagaacttcctaagaattcataaaaggcaaatttagcttgttttaattaacaaagagaaaaactgattcaaagacactaaacagcttagtaaactctgctgaagaatgaacctgtgtatatggatagctgaacacccagacaagatccattcttttcaattctgttttgagacctttgtagtagggactttccctggattaaagaaaaaagataacaacaataacaaaacaatacccaaagaattaaaaaacctaaaaaccttttgctggcctatcagtgaatcaattctccactgtttaattttagtagcttttgtggtttggtttgtatggactatacagggaagcagactsaggctatgtgatttcagattgttttccaatagggatggaatgttttcatcagatgagcccagaattctgatacagttattgactttagggagtgataacgtaaaacagcattaaaaaaggaaaataccatacccttgttaagaattagtagtaggattttatttttagaaagtaaaatttggaaacaactgtatttgttttctagtgtatattattttaaaatattttagaatatttttgtaaggtatgtttcccgattacattactctaaatacgaaygtttttatatttccaataaaatattcactaatatttacctttccaatgagatattttacttgcatgactatttttaaagtatgtgctcattttggtggagttgctcttgtggtggttaaaccatatttgtgtattttccttttccttatgaaggtctcatttctgaattataagactaaatatcaaatgcttttttgtggttgtcggatagtttctagatagagcacatacgcaaatggagtatgtttattaattaaaattatttatatttcatttttaataaaattttagttacttttgtaaattttaaagtatatcagctaagttctatttattagcaaaatatgttaacaatttggtgtattttcacactttttttcctacagatataaatatactcatgcatatgtatataatacattagaatctaggtgtatatatgtattaaatatactggacatattatgttacattatgaaaattttccttgtcaataattatacttcgtaaacagacttttttttttttttgagacgaattctcgctctgtcactaggctgtagtgcagtggtgcgatcttggctcacggcaacctccaactccctggttcaagtgattctcctgcctcagcctcccgagtaactgggactacaggcatacaccaccacacccagccaatttttgtatttttagtagcgacggggtttcaccatgttggccaggatggtctccatctcttgacctcgtgatctgcctgcctcggcctcccaaagtgctgggccaccacgcccggtcgtaaacacacttttaaataactgcctagtactacgttccttgtgtgatttatgacattttatcatttctctgtgattgaacatttagattttgtgctattagatataatactctaacaaacatcctgtatatgtgtctttgtgtctctggttatttccttcagataaattcctaggggtagaaatactggtttaaaggggtgtgaaaataattttaaaagtgcttggtatataataccaagttcattcattcagtcaaaaaatattttctaagcaccagaattgaatcacacccttgggatacaacaaggaataagacagtccctgttcttaactcacagcccagttgggaggacagaaacatatatggggaagctcaagcctgttctctccagaaagctcatatgaattcatatgtcaccaacattgtcaatacatgcaagtggttttggaatgtgtatgtttgttcttttgaaatctactgatttcatcatggaatacttttctgaaaagaaaaatatttttattttggttattgcatttaatgaatcacatacgtaatggtttttgacattattgatccaaaaaacctaattcatttcgatatccttatttctgtaacaaggaatttgtctacctttgtaccatattctcatttccatagttttatgggggcttccttaactgccctctcctagtgtcttgatactttctgccactcacaaatagaacactactctgacacttgcaacagttaattaagaactcaactcatattgtttaaaactatcttaccactattttgttctttatcaaaggcagaaaagacactaattttatgcgtattctttatcagtgtggataagtcatgtaagaatggaatctaaatacctatagtaagtgaaaactcatggtaatcctgttacatttaattttacagattctccagcatctgctatgtacttccttaatatttaggacaggaagagcagattttccagttttcaggacaataggctgagtggctacatctctatatatgtataactactatactaaatatctggctattaaagacagttgtttattatcagaatatgctaatgacatttaggaggggaaaaaactcatttttagtatattctgagagttgggaaggcaaatgtgcctttcacggagcactgagctgctccgtgaacacacagtcttcaggaatatatccagagcacacagtcttcaggaataattattctattcactgctcaataggtttctcacatgtgaaggctgccaggctcctctggcttctaatttaggagctaaagagatttccttactgggcccaaaaattatctttaagcaaatgtatgaccttattcactcaaaaatggtcacagatggacactgtattgtggcaagatgaatgatgtgactgagctgttttccagagtgtgctttttcaggataatacacctagtatttttctggtccactagtttctcaagactctttatgactgagtgtatgaggtatgatattcattttttttttttttttttttgagatggagtctcactctgtcacccaggctgaagtgcagtggcgcgattttggctcactgcaacctccgccttccgggttcacgccattcttctgcctcagcctttcaagtagctggaactacaggcacacactgccacgcacggctatttttttttttttgtatttttagtagagacagggtttcaccgtgtagcccaggctggtctcgaactcctgagctcaggcaatccacctgcctcagccttccaaagtgctaggatattcattcttaagtgagcaggcaaactattcctaataaataatgagagagggtgtaatatctactgctgtacagttgtggttttatctatttgcatctcacttcatcttgatgaaatgcagaactttatcacatgaaataagtgaaggagactgcatatgacaccatggaaattctggaggtttgtacttttaagatcagtttttattgaggtagggatttcagtttgattgttacgttgatccctggtttaatatatccttacattttatatttaagtttatatttgataaaagagtatcttggtattggtcatctttcaggagttaatttttcagtctgtattatgctgccaagatctatctatatttttgtatgcagtggtgcacccttttttaggactgtataacattccatagtgagaatgtacctaaatttatttctgcattttctcaratagacatttgggttattttcagattttcgttatgaatgctactgtgataaacattcttgtacatgttatctgctctacatgtacaaaatttcctctagttttcacagaggaatggcatttcacagaggaatggcacagaggaatgtatatatacagatatagagtatctgaatgttataagataatgcaataatgccttccaaagtagttgtaccagtttacattcctaccagcaatatttaagaaatctggttcatccatattctcttgaaacactggctactatccgacttaaaaatttttgccaattatgtgagtttataattgatgtgcatttccctgatcactaatgaggtcaaatatttattcaaatacttatgtctaatatattccaccccccctttaaaaaaaaagcctattcatgtcttttgcccagttttttttgaattgtctgagtttttcttgttattatagaagttctttatatattcttgattctaatcttttggtggttatacagatgggagctatcctctcccagtttgtagctttttttcactttttataaggtgacttttgatggtcgtatgtccttgtttttaaaagagtcaaatttactaatactgtatcttgttttataatgggtacttttgtgtctttaaaaaatacttttttatcagattcagaaagaagtccttaaaacatattttccactaaacattttaaagatatgcttctgatattttaagtccttaatccatctggagttaatttttgtgtaatgtaaaatggaggttcagttttcatttttattcacataaactcaccatctctgtcatatattaaagttatgcatatgtgtgggatttttttttttctgggccctcttctactccataggtcaatatgtctctccctgtccagagttagattgtcttagccttgtaagaaatgctgatatctgatagggtgcaggtcccctccttgcttttcgttttcaraagtatcttggctgttttaccatgtgaattttaaaatcaccttctcaagttccatgaacgacccatgtacgattttgactagaattgtacttaattttggccggatgcagtggctcacgcctgtaatcctagcactttgggaggccgaggcgggcggatcacaaggtcaggagatcaagaccatcctggctaacayggtgaaaccctgtctctactaaaactacaaaaaattagctgggtgtggtggtgggtgcctgtagtcccagctacttggtaggctgaggcaggagaatggcatgaacccgggaggcggagcttgcagtgagccgagatcgcgccactgcactccagcytgggcgacagagcgagactcygtctcagaaaaaaraaaaaaaattaaatcgggtcgggttaaggatgttcccttctctatacttaatttactaaagtttatatcagggatttatataaaattttattaaatgcttttatgaatctatttatatgacatcctttttctcctttaaayttttaatgtgttaaaattaaaactaaaactaaaaaaatgcttttaagatatatacaaaatatatgatatatatatagaaaaataagccaattattattattcatgatagcagttaatgcaggtgggttgaagagaaacacttgataggtgtaaatttttaatgttctagttcttgtgtcaggtggtgggttcatgagggtgtatcgtattatctaaaacatacaaatacatgcataaaatataaatgattaaatataaaggcaggccatgcatggaccattaaggagagataaatgtatgtgttacgagccaggctcaatggctcatcttcgtaatcccagtgctttgggaggctgtggcaggaggattgcttgaggacgggagtctgagacaaggctaggcaaacaaagcgagacctcgtctctaccagaaataaaaaaaaataaccaggtgtggtggcgtgtgcctgtggtcccagctacttgggaggctgaggcaggaggattctttgagcccaggagtttgaggctgcagtgagctatgattgggtcactgtattctagcctggatgaccaagtgagaccctggctcttaaacaaaaagcatatgtgttacgaactaaggattatgattaatctaactttgtagttaaaaaaggaaatttgatatttgcttttatgagactgtgttgcgtttactcctaggttagtaaaaagagaattttaaaaaatgtccgtatttgttcttcattgttattcttaaagtttctctttttcagaaaccttttgggcagtttttggttgtgagacttgatgtcatgactgacatatgcgttagagtccatacgttctaggactgacaagttccgtgattatcctgtggtctcagttgtttgatcttaaaattaccagatgattaatggccctcattttagattgacactttgtgcggaatgttctgtagaaggcctgaccatttcttctggttttttaggccacatagttctgtattgagcatgccatgagtttccatcctaccccatctcatccatctgattccatcatgtagtggttttgtatgaggcttctagcttgttgggaggacacttggaacagattacagtgattatgaacatttggaatgaaacagacttagattctaattttggctcttctccttaccagctatgtggtcttcagaaattttaataactaccgtgagttatctgaaaaatctgtgtgatattacctctgaggttgttgtgttaaagtgtatctttattactattattattatatcgccatcaaatataattaatttttgcatttccaagtatactggatgcactttcaagccactgatctgattttcccttgagtgtactcaaggtgccaattgctttaattcctaagtgttataaagaaccgcagtgccaaaatattcttacctcttagttctcaaccactgactcttctatcttgtctgtactattcctggagagaagggagagacagtcaatagtgttgctcacagccaagccctttctaagcatagctgacagatgtaggtgtttgggctgatcacaatgttgaggacgacagtaatcacagcaatcgcctcttcatggagcactgctaaggcagccgctgtgctgaatgccctaccctcagcatcttgctggattctcaccgaattccctaaagcagatcttcatcttgacgccttcatcttgacacagggaagctgagcttggacagattcagcaactagcccagtgtcatacaattagtaattggcaaaatcaggaggtagtcgctagtctccttgactccaaaacccacagtcataaccgctgcttatgcaaatgctattcccccaggtctttatctcttcctatattttctggakgcaggaaagtttgtggaacctgtatctggtgagacctggtgggtaggtgactctagttggattctctstgctctttgggaaggctagctccctgctgaggcaacaggttctggaaactttgggggctatttggttattttgcactgaaaattaaatctaaaatgatttaatgatgagaatggtaactttgagagatttttgcattattcactttggagcaggaatayttagatacgtgggcttcatgactgtattttgggtttttaagtcagaaaactaggaaggtttataaaaacctttggaaaatatctgttgcatgctaaactaaagtgagagcttaataaaaatatgcattaatkcaggactccactgccctcagactaagcacaagagatctctgttgaaccttgggaaaaataaacttactcccttggcatttatgagggtggcactaaaatttggtggttgcgcccaggagtggggtagtagcatagaatgaaaacagtctgcaggagccttcaggttttttaaaatataaccaaattaaacattaacatagtcttcatataattagtctctgattccctcattccacacagttggttttctttttaaaaaaaatcaacataaaaagatagtttacttttctccttttatcaagtatttaattcatcataatgaactaaaggataaaataataaaattttctgtttaaaattgtttgggagtgatggaaaacgtgaaaaaaaattattttcttctctggaacaccaaaaaattgacaaataaattttaggaagaattgttaaattttgccttttgcccttctgctagttccctaccttaatccagttaatataaaatgctcaaaaagcgattatcattcatctttcaacttgatgaacaagtattttctttgcaaatgaagtatgtcctgtaaatgattacacattaataaaaacaagaatcaacctgatttgttttaacacctctatttctctgcaggaggtagcatttttctgtcagtttgtcaagtgttattttttcagcctccctctggcctgagtggtatatatgtggtttggttttgaatttagtgaagaatatgactgaattctaaaatgaaaaatagtatcatacttctcagattttgcttataaaaatgttgcgtaagtgcttacgacacctttagaagtttgtgactctccagaatttctgtggcattcctaaacactcagtatttacaatgaatgttaagtgattggtaacatttgaatgacatgcagtataacatggcagccctattgggctttccatttggcagtcttagtaagacagcagttgaccaaaacctggcagctgtttctgcctatgaaataagtagggttcaacattccaggctgacctttcttcagtattcttttggacaccattaagaaaataatattgaggctgcagtgagctatgatcgcaccactgcactccagcctgggctacagagcgagactctgtctctaaaaaaagaaaaagaaaaagacaaaagagagaaaataatcatgaatcttttgtttgcatctaatatatggttcttttcatttatttttaatatgtaggagtatattttttgccatttcttaagtgtagggatcttttggcagaatttgtttcctgcattcctgtttctgttcaccaagcaagataaccactatcggaatagctctgcctacccagacattgactggcacatagttggtgctcactaaataatatttgaatgaatacattctggacgttgaatgaaaggaccttttgggctctatgcatatctrattcagtggtcatattatttaggggtttagaatgaccatttcacttgttatcaccactatccatgtaatgttttaaaacttatcctcacttggatagcttaaaattacagtctttaaacattacctccagatttagataaaagtaaaattgtagtgttggctataagcaagcagagaaatatattaatttccagtttccgggagggttggaagaaatacttttccagaacgagcatgattccactctgatatgagaactaaattaagtgacactagttgtataaagctttggcagtgggcctaatatcccttgttggttttatatgcatgctgctggctttgctggcaaaaatgctggttgttaatttattgatgccaagcacttatagaaccagctttgtgtaacacattaaaaactagactgaaatgtatttgttgtcactgaaatgacactctaattatattagatgtcccaatttagttttatcctttaatttttagcctcataactttcttccaaagttatctgggataaaaacttgaatgttcaaacttggcatataattaaattgagattaaaaaaggctatcaactaggacttgatttgtttaaaatatgaaataaagatatctttctgttaattaatagaacaacttcaaatcaagttactcaacaggcctgttcttggcacttcaaatatgtaattaagttttatgatgacctagttaatatctccaaagtaagaaagcacagtgtcatggtttgggttctttagaagcactgccaagatagaatttggggtacaggatgtttattaggaatcattacttgtaaaaggaagggggaggaagcagttttgggtagagagaggagctgaactgccatgcaggcctggcaagccttgtgaatgcagcaagggtttctagtcagtggcggcctgtgtaggctgaagtggacagcccttctgtcacccttgttcagggactgaatatgggccaccttggaaagtgggagagctcaggcaagtagcactctgcagctgaggctggccctaaggttgctgcctcctgaaggctgtctgctgaccacccactccacagctgggcacaaaggcctttcttgaagggcatggagtggcacctctctgtgtctactgcttagaactctcattactaacaataatactcataattcatatacttatatcattatcttcatctgaccaacgaaaaaatagaagcagaatactttgcttaagatcttatggttaattctgggccacactagaaagaataacctgtgtcttattcctagctttcagcaaactaacatcatgctgcagtggacgtatttattatttttaaatgggtggccagtcaatatatgtgaagaaaaagcgaggcgaaggaattgtagctacttgagaactagtgtggtaagcaagcaaggaaaggctgggtttagattccaactgacctgatctcccagttcatgttctctctggctctgtgaccagacaagtgacacggtcactctgacctctagggagctgatctggcaataaaaggaatgaagttggcatgtcatttaaatagtgtagatgaaacatagtatggcacctggtgttcatagcaggaaacacaatataggctaattttcttaaatacccaaaagaagtcaagctgcaaaatgctggttagagacatgaaaatttcaacttgaagacagagagaatttttctccctagtatttttcctttgtatcctcttattcctttagtgtcgacatattaagatatgagttgatagatttttgttctggagaaattgcttctgcaaggtgggtccactccagacagacctggggaggggacttcacaaaaaaggcgaggaagaaggaagaagcatggaatgaagaagattaactgaatcaacaaatattcatggaatgcttattacgggccaggtttttttttttttttggaaatttaatgatatagttcattagaagatcatcaaaagtactgtatctgagatcattaaaaacggcccacttctctcttttccattgccaccctcttggtttaggctaccattattatcctaagtttactgcaataggccagccactgttttcctcctgtctgctgtaggtttattttcaaccccgttcttcactctacagacattctggtcatgttattctctgcttctcaggactttaataaagcctgaaagactagacatgaactgtggcctagcacccaccagcctcaactttcactagttacattactagacaccaaccctcaacacctgccttttcaaactcactaattcctctgacaggctttgcccctcttgcttcaggcctttgcctaaattgatttctaattttggaatgtcctttccctttccttttatgcctggttaacttccacttggtgtaaacatttctccctttgggaaagctttccctgatccctrgaatagattgggtctctctctctcactctcccgctaagactgcctcctagaactgctcatgggaggtaataatgtgttcctttgtgtgattgtctgtttccctcagcaagcttcagctccagaagggcagtgactgggtctgtttcggcttacagttgccaagcacggtcctgacacagagtagggatctgataagtctttttgaataaagggcttaaaagggtcacacaatcctcttctgataagcctatgctttccatctcactcctgggggcatctaaggatagacagagaccggtgtaaatcccacttaagtcaagctctacatgtgctaccagagactaagaaccaggcctttactctgatgtctacacttaaattctttttttaagctttgtactcttcatgatattatagtgtatgctgttgtgtcatgttaaaaaaaactcatggtacttttgatttattaaaaaaattattttctttaatcaagtcattgagttatgagaagtgataacctttaaatgtaatatcagttttctaatgcagcagtttatttggagggggaagggaaagtcaagcactcgtccatgtttgtcctcagagctctcctgatcaatggtttttccttgaaccactaggccatcttttcacagcgcccactgtcttgtgatagtaaggaagagctgagaagcagatttagggtggagctgaagaatggtaatctctagagtttgcttacaagagcagatgtaaacctcacagtcataagtgtgcttcttggctattttatgctggtatgagttcaggctggcctactttaaaatggacatctatttttataggaaactcatggaatgtctggaattctgcttagaaaaaggaatctgcatcctgctgtgaaggagcaaagtacttgctttttgttagttgtggtcttaagacttcaattccaaaggcatcctaaaaattggacttgattgactctgaagttcagtgctgccgctaagaaaacacgagaacacttagatgtggagcagctgaaaatgagggactctgtatagtttgaaaaattaaaaaatttgggttcattcactttgatagtgtgatttaactggttattttgtcattctgttttattttgaaactatttactttatgaagctttccatatgaatatttattttcactatgaaaaaatttaaacaattgggagtttagttattacctctgtgacattctagtacttcctataaataagtgcctgaacgaatggatgaaaaaatagttcataatcattcatgcaaataacaatattgaaatcataataggaataactttatttggaaccttttcttatctttttcatgtcactgttaaaactacttcttgtaaattgcggacttatagataatgttagtctttccaagtcttgaatatgccattctgccatatctgctagccagaaactcggctggctagatttttagtcacacacaaaggtttatcttattttgtttttcagcatagttcaccattttcactttaaggaaacacagaatgacagatcgacatagttgattaacgcagagtttcttgcttcactgtttataccctttattattaaccagaggctccaaattgctgatgccgtattttatttaatttttaagtttactggggttaataagtaagtgagattcttctaacagtttcactttccacattgtgaatataatctctctgggaaatataagaatccaagaaaaaaaggaaattaggtgtttttcttgcttgatcattatcttgtaagaatctacagagaaaagcagctcttgtactctgagggagttttcttcaagtggcttttgttcagctctctgtggtatagcccagaagaaaacctgtttgttcttttaatagctccacccacccctgcacttttattcagtataattaattaaaactttactcttcttttactaatagacaaaattatcaactacttccataataataaaaatcttgaaatctatggatgtgggttggtgggaaatgaaagctctttttggtgttggtaagataaagagtagttaattgactttgccactgccttagtctgtgaccttggggaaaaaccattttccgttttctcattacaaacttagactatctttccattaaattagtgttaagtggtaccctgcttgtctacttcatgactaaataacttctgcaagtaaagaaaagtaatattttgttatttattaaataggtattttatcttacatatttcttttgaaaaagtaggggatgagttagaaatcaattcataaagtagtttggactttctcctcagtacagttaaagaaactctcttgagctcattcaggcattgatttaggatctaataaccgataaataaggcagtcgttcctcttaagtaccttgttttatagtgtggaatgagaatcggagttaggaagaatgtatataaaaatgtctcttctgtgttgtaggagggattcaaatgttatgggagcccaaaagatgtagtaattaattttccctggatgcagctggggtcatgctaatgaatgaagctttcgatgggagtggtgggagaaggggaaggcttaatagaagataggacttgcaacaaatatttaaggaatttttatttcacagctccaaaaatggacacccttgcatgtgttagacagccaggtgaacaagataatgtctgtgctctcatggagcttatattctagtgggaggaaatagctacattaaaaaattaggtagtatttttacagttagagaggagggagatcacttccaggcatccctgcactttcttccctaggatgggtcttttgtgctttgaggaaggtcgacagcacatgtaggggagcttagtattgtttggagagagggacatctctccctggtaataggagggggcaaagggacactggaaatggatgctccaaggtttgtaacttgatggtggggattgggggagctcttacctaaagggttttgttttcccagtgaaatgtaaggtcatcatctgagattggggtcaggtgtgtgtgttggggtggttgaaggagagaagagcaggtattggggtggcgataatgaatctaaaataaaatacattcgcttgcttatgtgatttttctctatgaatattcagctccttggctacaggttgattgctggattttgctgtagtcctaaaggaatgagctttggcttggctgtaaataaatatgatgaatggatggattctagaccaattttatataggtctgagggaacttaaatttttcttttaaaaaccccttaaaatgtgctcatttagccaaaattttagcagatttcttaattctaattcttttcaagcataaagaattttgcaatttgacattaaaaatatgactcactcacttttcaattgacttatcaattcattagttgcttttctaagtagaataaattaccttaggtgaaacagctattgcagaatatttttagttgttgaaaactaacataattttagtagtattaaaaaaacctgctttcttgccagtgctgtctaaatgtgaagacccttcccccacccaccctggctggttatgctgcgggatgtactgctctctgcatttgtttcttttaacagccctttaatgttttcaattcaaaaagcttttagttaccattaggaatggatccaaaatcagtgacagaaattaataaacaataccttggagcaatgctttgttacattccattgcacaatatctatctgcatgaaattcttttcttgccgatgaagtagagtttaaatagagcataggatcactgaataatgcctgtaagaaacattttaaaaacctagttgtccctttgagacttttgtctatttccttttttatctccccttggacagtattttatcstggaacttaattctgcaaccccttttgtttcacaccttatttttctcaatacgttgcacattgttacttctgcccaagttaccttcaatgaaaatggtttagtccattttcattcctaaccttatattataaggctgtattatgaktgtgccaagtacagttcctattgttttgatttgaatataactgcagctaccatagaggtctaagggaattttcattaccttccctttactccatgttggaattaaatcggactgggtattgagttggatatatttaccgtagatttgaatacacatagacagatatagaggttatttgtatctgtttagatacaattaagatttatatactatttatatttatatcttatgttctctggggagtacatttcttcccttgtgatatcaattatttgtggtgtacttagaaattcaacgttggcgaatctgtagattttgttgaaaacatatacacaagtgtcagtgggtttaataatgtgcgctactcgttttcaagtaggaaaaagtcgaattaaattttgtcactattatatggtatttagaggatttgaaaacaacaataatagataacaataataaacaacaatagaccagtaagggattttttattttgcacattatgaatcttgttattttgggcagaattaattttttcagaagaaaattttaaacaaggaagcttgtttgagtttagcaaggttgctgtctaagattatgctttgaatatgtcattttgggtttttgctagtttttttgccagtgagaaaatgcatagaatatacaggacagtaatgctttagctgtattttgatttatggtctcttattttatgacattatattcgtttatatatgcaattagaagtgaattgtttgcctttcctgagtgctatttaataggattcacacttgcattctgttaccaaattaatggactttcttttaaagttaatacaaagcattaattrtagtctttttttttttttcartgacttagtgggtttttcttaaccttwcagtctagtgttggatagtaagataatcatccctatccagctgaggcagaaggaagtcgatttgatttctcagtactgttgagtgtggaaggctagagaagacctcactgctgattaatgtatccacctcattatttttcattgagcaacattgtgcaaattaattgagagttgcagggcctgtgactacatatccttaatttccagaacatctgttacttcaaaacatcttacctgctaaatctttccgcctccttttttgggtagataatggaactataaaagaactcttctaaagaactcttctgggtgctgggttttcaacttctctaaactttatacttgtagctaaactttaaaactttataattttggggggcttgattacatttattttaggtatggcacatctagactcctgctaaccagtataactttattaattaatattttaaaataatacaacttgcctagttttttgcttgggtgcctttgaataatgatcttcctcccctcctcacagccctttcccccactccmactatagccagaaagagaggtgaaagcagttgaacattagaaaagaagtcttttaatgtggtagttaactgtatttctgaaaactagatactgccctgcttctagttagtcctgtgactcattcatttgtgttatagttctcttctgggggtgatctaataatttttcaaagacattctggcctgtccaagaatataacctttacaatgtttatgctgtattagaaggtgttaatggaatgcaggagagcaggctcctgaatggctgattaactaatatttttatatcctcaagtaatgttaaaaccatgcagtcttagtggaaraaaagagtgacttccagctgggcagaactctacttgatatgacccaaaaattaatatgtgtggttaggaagctgtatctcttatagaggcagttttactctggtgtatgacttgagggaaagaataaggtaataaagttaattagttctgcaatctataaccaaacccatagtgctttgggactagattgtcatattttcagcattttgggcaaaatgaatttccactcgtactgtccagaaaaatacctggtcatctttgaattcaaggtgaatgaaccaaatccatttggaattattttctaattttcatataattcatattttttcttaatgtaatcatgttattaggtcctagtataaaaaatgatccaagtaataagattgtacaaaataatctgggattaatttaagtggtaaacttttacattagctaagctaggctcagatgagtcaaaatttgtagcagatgctctgcttcccaattatctgtccagatctattgtatacagaaagccatctcatcatttggatgtgacgtaagtagaagttaaccctgttctatatattgaaatagagtttgttaagaaaataaatgggagaaaaaattgccagggaaatatgtagctccttaatattttgaagtccctagtttgcataccaacaatctagtgtgtttttccactagagacgtcaaaagctgttcaaatggttaattttctaattattgcatttatttattgatttatttatttattttattggagacgcagtctctctctgttgctcaggctggagtgcagtggtgtgatcttggctcactgaaacctccatccctgggttcaagtgattcttctgcctcggcctcctgagtagcttggattacaggcgtgcgccaccatttccaactaatttttgtagttttagtagagatggggtttcaccattttgaccaggctgatctcaaactcctgacctcaggtaatccacctgcctcaacctcccaaagtgctgggaaaatcacaggtgtgagccaccatgcccagccaattattgctttaagattaaggtgtctacttcacataagaaaattcactaaactttagcaggaagatattaaaaatttagataatactaatttccagttttctttttctaaataaataaaatgttactctaaataatcttttgttttaaccaagtaagttcttacttatgtactttatcttttggacttttatcagccatttttcatttaagctagaaagtgcattaatgttactgaaatctgccaaaagttacttgctgattgaagaaatctaattgtaagatttataatcaagaaattgatccattgacttatattcaattaaaactgttacaacatcataaatactcagtgatctctcctccccctacccttttctgataattcaattcagctaacctttcttgagccttatytgaatgtcgtgtgggctagagaatatataaaaactgcctgcatttactgagtgcttctgtctgggaggagattgttcttcctctctctaggcatggggacagaactcaaggacatgttgcccctttcttcaccctctctagcctcacctagaaggtggggctgctaatccactggttgaaactacgggcaacagtgtgctacgttttacttactacgttgtcaaggcagaaatacaggcccctccttctctctttcctctctcaatcctagggcatgctggtcattcttgcccctggagttagttgraggttggccatttttctgttttcccatggatgggtactggttttgtgaggatgggagaagggatagaagtaaaaaagaagtcacactaagtcttgtgtttatttcatattttgaaatgatccttggacttagagatactgcatatttagaaaacatttcagaagttcttgctgtcataacagtacccaatgacactgaattttctacattattacgttccaattttagaagcaaaattgcaataaaaattccagaatgaacatgttatagtgatatacacactgacaaatctctcatatttattcctgtaattatttttatttattatatatgaggaaattaaccagacacaaataaaaacaggcaaaaagaggccaaggaagttcaggaaggatttgaaaagccattgctttttttttttttttttaaaataacagctttattgagatataattcaaatacagtgaagttcactttttaaaaagtgtgcaattcagtgttttttttttttttgaggaggagtcttgctctgtcactcaggctggagtgcagtggcacgatctcggctcactgcaagctccgcctcctgggttcacgccattctcctgcctcagcctcctgagtagctgggactacaggcgcccgccaccacgcctggctaatttttcgtatttttagtagagacggggtttcaccatgttagccaggatggtctcgatctcctgacctcttgatccgccagcctcagcctcccaaagtgctgggattacaggtgtgagccaccgcgtccagcccagtgttttttactgtactcacagagggtacatccttcactactatcaaatactggaatactttttttaccctcaaaagaaaccttatatccattagcagtcactccccatttcatggcataaccactgatttttttctgcctctatggattttcatagcctggacatttcatatacatggaattatacaatatgtggtctttggtgtttagtttctttcactaaacataatattttcaaagttcatcagttctgtagcatgtattagtacttcattcctttttattgccaaataatatttcattgtatggatataccacattttgtttactcattagtcacttggacgtttggattctttccactttttggcgattatgaataatgctgctatgaacattggtatactaattttcatgtggacatgtttttagttatcttgggtgtatacctaggggtggagtttctgggtcatacggcagctcaatgttttgctttttgaagaatccattgacttttaatacaacttctaaataggaagcagtcaaatatatgcaagattttggaattagatcattcaggatgagctacgtattgctatgtctatcttaaaaatcttatcttagtacaacattcttattttgtaattatagagaatttaggcaaacttaagttatctttattaaagaaatagattatcatgtctgtttaggccagttgcggtggctcacgcctgtaatcccagcactttgggaggctgaggtgggcggatcaccggagatcaggagtttgagaccagcctggccaagctggtgaaaacccgtctctgctaaaaatacaaaaattagcttggcatggtggcaggcacctgtaatcccagctactcaggaggctgaggcagaagaattacttgaacccaggaagcggttgcagtgagctgagatcgcgccactayactccagcctgggtgacagcgagactccatctcaaaaaaaaaaaaaaaaaaaaatcrtgtctgcttaggttgaaagataagtcaaatttccttatataatattggttaatttgcattgattattcatatttagttgcctaagatggtaacctgaaaactaatgttaatggattcttcattttttaaaggacaagctaaaaaacacagaataaatattaaaarttgtggaaagatagtcacccattttattttatgttaaaagtacacagttaatactcttgttaagttgcaaattaagttagtgtcagagcgtttttgtattggccatccatcacaggccctactatatatgctgttctcgaaggaatggcccaaaccttgaggcatttttagaattttttgttgatgacttctttcctgtgtatttgtacagtcatcccagtctttagtaactttctttttaccctgaattcatgatttttgacatcagtccacattgcgggctataattttttattaatattgattttatgatcagagtgtagagactttggttgttttcatttttatgtcctccaggataaaacaatggtggcatatcctgggtgctaccaatgtgtttgttttatgaataagtgaaaggatgaatggaatttggcactgtaccatattaatttcaagaaggaggaatggtggggtaacattttatttgctatttttataaataatatttaagcctcctcaaaaatgggaasttcactactgctttaaaggtgtgccaagtttttctccaagaacagaagaaacggaaaaatcaagtaaaattttttgcttaagacaatagaaataaacatgttgtttttgttggagagtgtttttgggtcataatatcaatctagcatggtgaccatgtggatcaaatatgatgtgtgtgaagtcagtttgtaaattgtgtaatcttgtccctgattttttctttgaacttctttccaaattgaagacatgaagtccttggtatgaaatagatctacacaggaagacttagttgattctttctattgatcctgagctggattactgcttccctcttttcacttaagtgaggtctctcacatggagagtgagccttgtctcagagggtagcaaaggttctgaggtgtggtgtcctccatcttccctgggaaatgcccggtctttgagacttgtgttagcacattgcagagagtttgtggaagggtcccaggtgctgctttccaaagaaggtgctgttttagctggctataagcattatcaatgaagtttgtagcttttaattggtgaacagatctgggagccacaaggcctgggctcagtttgcctttgtcagcaacacacacgggccctcaacctgtctacttttcctcctctgcaaatgatggcatgaaatggaggcacacatgatcctctgagtttgagtagttaagaataaatgattgycttgttcttataaacattttttgatttttttctcttttaaaatattaatagttcagaacccttccaaaaaatgtcacttactttagtaaacttctgttgtcttttgcatattaatgcaagtccacaagattgtgttagtgagaactcatgggtaacagagtgctttccacataattgttttgattcttacaaaaactgtatggggtaggttattctgctgactttatagatgaagaaattgaggctcatattgatcaagcaatttccctaagtctccagctagtaagtggcagagtcagagtgtgaacccaggtcttttgcttgaagtgccacactctcagacaatcgttagttttagaggaaggaggttggaagacctagaggtgtcgaaaagccagaaagaggacaagatttagaacaatattacctgggtttgtaacttcgttttggttttactttcattggcgctataggtataaggaatattgtacacctttaaataacactatgataataacaacttaactttgtaaattgtttacaaatggcccatgcaatactcaaggctgagaagcatggtattaaagcattatgctattgaagccttttttcttccttacattcttatgtcaactgtgaccacaaacttaattggcttcacagcctccactcactccctaccccagtccagtctgcttggtgtcgacaaacatctttttagggttcaaacctattcatgtcttcccctctctgtgtacagatgttttcatctggcattcagmgccctttgaaatacacacagctgccctttcagcctcatctaatcaatagttgccattctagttatgtgattytatattgaattcttcctgaacacttcttttaatcatttgttaaatgtattaattttctctgtctgtatgcaacagaaatggttgcatttagtgccttggtgagtgatccttgttcttggaacagtggaaagatccagagcaacctgcttgagattctgtgtcctatcctaagatcatttcaaaatatatcatagtcttcctctaggttgacccacgcaccttcctcccagtagggcatctgaataaggaggatggggtttctctaggttggttcataaaaagtagctgcataccagcaactagtattttaaataaggataccgaaacttgagagtttaagaaacttatccaaggtttcataggttttgagttttggagccatgattttcagagcctcagtcgttacaacactgaactttgtagtgggcattcaataaatgtttgctggatgaatgaatgaatgaatgaatggattgttagtcttattagaatgttgaatcagcagaagaattgattgggtgattgcatctgcacagaagagttacattttgaggcttgtttttctgaaaaatattctaggatgaaaatgtccttttgatataataggtctctagttcagtacatttgcacataaaagctaacagctactggaggagggggatggtgtatatccatggagacccttaagaaatccctgtaagtttacatttcttttccagaaaggattgttctcatatgacaaagtctatgatagattttaaatctcttttcatatagtattccttctcaccattgccaataaggagaaaacagatactgggaaaacttcagtttgagggaacacaaaagacatggaatttccttgggatttttctctaagttttatcaacttccataccctaataaactttggttgatgaaagtgatgagaaatagagaatgccagctcaagcaatagcacataattayaaatattttgatgtttttaactgattattggagaaaccatgtttttatcagctggtgtgtctttttccagaagacacgtgatttcatgatttgcctttaagcctctgggcagacaaacctccctttaaaggaaaggaatttacatgatcagaagatagaccagttgctttcttgccattcatcatttaccatacttggggtcgcagaattttgtttcctgtttagtccatgagcacatgagagccattgggtcacaggtcttcctgactgatgtggttgtccttgtgaactagctccagccagccagtagtcctgcaactgctgaaaaacgaatatacgtgttatatctgagagaatatatcctcttgcttcctcttaaaacttctgaaggggttgtctttcctctgactgggcagactgaattggatttattgtctctcaaagagctctagcagtttttctataaatgatccatttaaaatttctgctgagttgcaatatttcaaacatttagtacacaggtatcacataaggatgttttggtcattgaagtactgcatatacgacggtggtcccataagattataatggagatgaaaagtttctatcacctagtgactaggtagctgttgtaacatcacagcacaacaggttactcacatgtttgtggtgaagctggtgtaaacaaacctactgtgctgtcattcgtataaaagtatggcacatacaattatgcatagtaygtacttgacagtgataataaatgactatattactggtttatggatttcctatactatacttttaatcattattttagagtcttttacttattaaaaaaataaattaactgcaaagcaacctcgagcagttccttcaggaggaattccagaagaagacattgttgtcgtaggagatgacagctctaggcttgttactgcccctgaagaccttccagtgggacaagatgtagagtggaagacagtgatgttggtgaccctgaccctgtgtaggcctaggctaatgtgtgtgtttctatttagtttttaacagtaccatttaaaagtaaaaaaaataaaataaaaatagtgtattagtctgtttcatgctgctgatgaaggcatacctgagactgggcaatttacaaaagaaagaggtttaattggacttatagttccacatggctggggaagcctcacagtcatggcagaaggcaaggaggagcaagtctcatcttacgtggatggcagcaagcaaagagaaagggcttgtgcaaggaaattcccccttttaaagctatcagatctcttgagactcattcactgttatgagaacatcatgggaaagacctgaccccatgattcaattatctcccacccggtccctcccacaacaggtgggarttaggggagctacaagatgaaatttgggcaggaacatagagccaaactgtatcaaatggaaaaaagtttattgaattaggatataaagaaagaaagtttttttgtacagctaatgtgtttgtgttttaaactaaatgttattaccaagacagtaaaaaagttttaaaaaatttaaaagtttagaaggtaaaaaagttatgttaagctgaggttaattcactattgaaaaaagaaatatttaaaaaataaatttagtgtggcctaagtgtacagtgtttataaaatatacattagtatatagtaatgtcctgggccttgactttcactcaccactcacccagagcaagttccattcatggtaagtgccctaatcagtaatcaggcataccatttttcgtttttgggtttttttttttttttttttgagacaaagtctggctccgtcacacaggctacggtgcactggcgtggtctccactcactgtaacctctgcctcccaggctcaagacatccttccacctcagcctcccaagtagctgggactacaggcacacaccaccacgcctgagtaatttttgtattttttgtagagacagagttttgccatgttgcttaggctgatctcaaactcatgagctcaagcggtccacccacctcaacctcccaaagtgctgggattacaggcatgagccactgtattcagcctgcataccgttaaaaaaatatttttaactgtaccttttctgtgtttagatatacaaatatttaccattttgttgtaatttcctacagtaatcaatgcagtaacatgctgtacgggtttgtagcctaggagcaataggccataccatatagcctaggtgtatagtaggctacaccatctaggtttgtgtataacaaatgaaataagaaagacttagaaaaaagtgtttgagaaatgtcacagataagattactttgtgtttgcttttgaagttattgaaattatatccagtagaaaggaagcctgcttagataagtaggatccaagattaagaaaaaaaatggaaagaaatgtttaggtagatgaaatcttttgattaatcacccgaaatgtgcaaaatctayagcaaatttttatttcaacagctcttagtcctatatatataagttgaacttgcttctataaatacagatgcaagttcaaaatataactaacaaagtactgctctgaatgtagcaaatgtttagaattcacttttaatcaaaacatcacttcttgctctcttaataaatgtactggaaagcatttatctaagtaaatgagttgaagttgtattccaaaggactgagaattaaacttcattcttgaatagcactagcattcttttttaaaatggtaatatttagcccgatcctccccttcagacttaactttacagaaagcaacagtgtgggctctgaggctgagctggaagggaactatggaggtcatctattctaatagtttctcaacccactcagagtcacacagctggttattgacatttatgggagtgtaacttatgcctgctgcctaggaagaaaaacatctcttccattcacccctttatttgtcctccaatctgtgtgtcaagaattgagctgactgctttaatgtggctttgtctaatttcatcttaacttctttccccatttaattgcattaagctttctttgatgatgtgaattgggggagatagatacgtagtggttgaaaggaggaatctattaaaggcaaaagagaccacacgattttmtgggcttttccaacttgtatctaacaatttgtataggttgacttagaacagtgcagaaagaattggctttcaaatcgaagtgaggtaatctccagaggtttaatagaattctttctaactgtcctttttataacaataacactagtcaaacgataatcatagtaacaacaaccataagcaaaaaagcaataacagtcacacaatgatgtgttaagtgttttgaatacattatttttttgaacacccaggacaactctatgaaataagccccattttacagatgagaaaactgaggcttagagaagtaacttgcccaaagtcacacacctgctstgaggaggaaataatgcacttttcattcattagmgctttcaccagatgtcatatttatctattttttacagatggttaaaagaataatatggaaatttgagttgcttgtcattttgcattaaacattgtgtgaaaatcacatcaatgtcacaaaatttattggaataatggaatagagattgttttgacattcatcatttccagagtcttagaattgtgatgatctttttccagtgggctctggaagcttaagaaatttaagatttgttaacttaggaaaccctacattataaaacaaattggttggttggttgttcatccactagaacctgaagtataactagatatggagacacatgacagctgtttttcatgggttcatgtccatgggttcatgcccaccctcccatcagatgacttcctctctctgtggcccatgccctctgggactccatctgaccagttactggctgcacttgggaaacgaaggagcactgcaggtgtggctgttgctgtgattgccgagtcattcccttccctgtcaagtaaagcctgtgttaactcaaagccaaatgacaggaaacctaaattaataggaattgtttttattcgaaggaggaaaatcataagaaaacaagctattattayattagtaagaaagcagagcacagagacttccgaagaatgttctgggggtgatatctgattgtttagctcttacctttataggattgtacagtgaatacttatttaagaatcacaacgctgagatgctgtacgatagaccgtcagaactgggaagttcccttcttgttcagatgaggacgctgaggccagggaggtggtctacataaagtcgttttcaaaagtggtgctgttgtctttttgccatttcaacctgtctcagccatcaaagatccattgattgtactgcttactaaggcagggaggtaaataaatacatattagaaaactttccccaagggttgagacagtattttttggtttactctttacttttagtcataagggaggacttaatattttgggtatttgaaaaggacaaagatgtatagaaagaagacagagaagtaacaggatgataccatatagccagcaatgtgattaagtgataaattgtgtggtaccaattttaaataatagtaggcaacatttcccaaataagattgtcctgggatttcagcaattatactgtaaaatttttatggccaaggaattttgtgaaattctgaatattatataaccctcttaggaattcacaactgatggtagcttattaaagcctctgagaattccatagtagagaaacctgtccaactgagtttgaaccagagtttccaaatttatttgaaacagaatgtctgaaagtattctagaaaagtgctgtgtgagttcaggttgcgaatgctgatgtggggaatcccgaggataaggacgctgagtggggaatcagcacagctgaagagagctttgtggaggacttggcatttgagccaggccagcaggaacaaaagtgtggggccagaaatgagcacgaggcctgacactcagctggcactcaataagtgtttactgagtaggtatgtgagtgaaaacatgatttctatggaaggcaatcgggatattggcttaattagaatgaaaaggttggggaacgtggaaataaagttgaagaggcagattcttctgattagagagggtcaagctgagtgttcaggacttgatccgacagggaacgctttgttggttcctgggcagaggacgacggcagagtagaaaaagtgtctgggaagaatagcctgagagtggtgtagagtcaggcagggatggaaaagaccaaagtacagtgaagagcaaggagccttagaaaatgatgctaacctctgtctgggtagtagtaggtcacatattgatttttatatgtgcctagataaatgcaaaagcaagagatctttttaaatataagaagtaagctagagtaaattccatctcagtcatttctggtatcttgaaaaacaaagggatagtaaagtattatcagaataggtgggacaaatgttcttggagattgaaaacttgaagcatttctactcggaaacttatagtgtctttatgactaaaatatatttgacccttatgcttgcaggatgtgaaatttaggataaattactctgtcaggaaacattaccagctagagttcctggagtgggagccacactggctttacaggtgtttttggtcttttcatattgcaaaacagtttatgtgaataaacataatttatccttatacatcttattccagctgaaaactcttaagactcttaagtccctcctcttaaagaagactgaaatcgtgtccagtcaaatgtgtaggtgtttatggtactcagcttttgagctattggttgtttccgtttgcttagttctcttccactcactcttaggctggataaagatttccattcctttttgggtgaaatattttccataagttacaaaaaacccaaataaaaaaaaaaaactttgcacaagaaatcccagtctgaaatagctttcctttttaaataatgatataaaataaagatagaacacatgataattatagtcattattacttggtggcttgaatgctcagattatttgaaggggtcatctttaaaatgcctgcctctttattctgtgatttactgactcttgacctttataattcagtttataattaagactttcccaagaagtctccctgataggccccaaactaccaattacatcacacatttcaccatttccaacctacctttacttttgggcaccaatgttagtatcttatttacatcactataattttaaaaatctgtttaacttacttcttctgagttactcctgggttcttaactgctatacttgtgttttcttttcctaacaaggtggggtcttggaaagcattggtctgtgtcagtggttcccaaccacggcagatgagaatcacctggagaacttttaagaacttacgatgcgtatgtctcaccttctaaggttatgatctagtttgtggaaccactggtctacatcaaacccaagttaagcaaacattatatattgttagtgagtagtacaaaaccttcaattctatggacatttggcaaatatcttatattaaggtagagactaaaattaaaatttagaattctagaaaatttcaagctgccagtacaatctcaagtttctctaatttttctttttttttttttggtagcaattttatactagattctttttttttctttttttttttattatactttaagttttagggtacatgtgcacattgtgcaggttagttacatatgtatacatgtgccatgcttgtgcgctgcacccactaactcgtcatctagccttaggtatatctcccaatgctatccctccccgctccccccaccccaccacagtccccagagtgtgatattccccttcatgtgtccatgttatactagattcttgtgtgcattaaataccagtgactaacttacttttgattaaagggcaaagcgtagtgatattaatttatttttggatttcagacattctatgtcatgcagtatttttcccaatataacagtttaatatctatttgtccttatgcagtagattttgttagaacatttaaacatagaccttttggaaaattgaccttaagaagtcttttttttttaatgccttccctctcctattcatggtacatgtgtgttttcattctattaagtgataattttttgaatggctgttctgaagctttaagtgtaaatttttttcctatgtcctgagactgttagaaaacaccaaaatctgagtaacataccagtgatgtcatggggtagaaaagatgtggaaagggtagcacaagtctcttctgggtgtaggtttggcatgcccagggccagaagggacagaggtggatacctgagccctaccataaggcagagtctcatatgtcaagtggaataaaccccagatgatgcatccacagggcttttgtttttgtatctcttttttttgaccaccaaaaaaaccacttttttaaaattatatatatttraagtatacaacatgatgttttgatatacattgtgaaatggttattatagtcaagcaaattaacacattcatttcacatagttaccctctttgcgtatgtgtggaaagaacacgtaaaatctactctttttgcaagaatctcaaataaaaggcagtattactaactatagtcctcatgttgtatgttagacctccagacttgttcatcttacatgtctgcaactttgtatccttttatgtatatctccccatttcctaccagtctcaccacatccctggtaacaactacttctatcacccctggtaacaaccactttattctatcttcatgtattcaactttgtttttctttttttagattccatatataaatgaaataatgcagtatttttctttctgtgtctggtttatttcacttagcataatgtcatccatgttcattcgtgtggcaaatggcaggatctccttttttaaggctaaataatatttctctgtatgtgtgtrtatcacagtttctgtatccattcatccatcaacagacatttcagttgtttcagtatcttgactattgtgaataatgctgcaatgaacaaggaaatgtggatacctttatgaagttaagtggtgatttcatttccattagactttttttttttttttaagagacagtgtgtcacagtgtcactctgtatcccatgctggaatgcagtggtgcaatcatagctcactgtaaagctcaaactcctgggctcaagtactcctcccatctcagtctccagggtagctgggactacaggcacacatcaccaaacgcagccttttttttttttttttttttttttttttgtagagatgaggtctcgctatgttacgcaggcctgtctcgaactcctggcctcaagcaatcctcctgcctcagcttctcagagtgctgggattacggcccaaaccagtagtgttaggagatctcttgggtgtcgatttttctggtgggaaacctctgtggccccagcacctttgcccgagttcttgtcctgcatccaggaaaaatgaggtacacagacaagtgaagggtgaagaagcagagttttatttagtgttagaacagctcaaaggagtgagtagctcctctctactggcaggtcatctctgcagctctcagcagtgagggtactcctctctgcagctggtcttcccatcgtctccagctatcagcagacagggtagtcttctctgcaccttgtggtctgctcccattctctctgccctcttcgtccttagccatcctctgccctgctctggctgagtacagagcttttatggagttcagagaggacagagtgcatgccagttggtccatgggcaagccaaagaggcaccatgagtctcctctcccgtccacaggactggcagcccggcccccagtgttcaggccagggacggcctgaaagtggggccttactggggaccctgcccccttccrccccggactctgtctgcctcctgctgccgttcatggccctggggctcggccccaaccccgctccgagattggagctggggactgggagcggagagaggccaggcagtgggagcagacacccctgagccttcagggacaggggcagggaaccttcctggggtgcccgagggtgcaggctgcagagacgccctgcacgtgggagggcagcagcagctgcagccaggagctccggcctggccaactcggaagaggcagggctcccgcttgtccccggctcctgcctgcttcccaactgggagttccagatctgcagccaccagtgccgtggctccagctgcacccaggagggcagatcctgactgttcctggctcccccaagagcacaagggaggcttggattcacagctgtagtttaggtggcctgtagcctcacccaggagggcgaggctcctgcttgctcactagagcaggaggcctgggtctgtagctgcagtttgggtggctgcagaggcacgtagctctctttccaactcagaagaggcagggctcccactggctccatggagtgtgcagccccagccacgcctccctgctgcagctgacatgatggcagcagccactgtatcagtagttctatttttaattcctttaggatccttcatactgttttccacaatggctgtaccaatctacatttccactaagaatgtagaaagtttctcttttctccatgccctcatcaatacttgttatctcgtctttttgataacagttatactaacaggcatgaggtgatatctcattgtggttttgatttgcatttctctaataattagtgattttgagcactttttcacatagctgttggccattgttatgtcttctttggataaatgtttttatatctcttaatgacagctttgttctgaaaagtttcttttgactataactgcctgatgattgttcagctcacttatatgtggatgagaaatggaatgataccattttacatcagcaatttgaaaacttgaattaaatcattttattttctcaacctttgatggcagccggccttggaatttcctgaacaatgagatgccagctataaaacaggtttacctttagttacaaattcaaaaaatcctcttggctaagtttttttttttcagtacttgcctgtaaatcatagtgctgaaaagtgcttttgaacattgtgtatctagatactgctcctcatccatggtggagatgctyatttgtcccagcttctgaatttgaaactactttggcagaagttctcatgagttcttggagaccataaagcaaatcatgggcaattaaaacaaaggtctctcccctcgtgtctcagatgcacacctgaaaagaatcatcctggcaggtttgactgataaatgggctggaaaggggatgcatggcagcctggttcagcaggatgccttgactggtggcgataacacagggtctggggtgacctgtccccgggaaacgaaaggtcttctcatttgcagtcattaatcacctcaggaacagccgttttaaatgctcaagcctaattgatacggacatggcacactcggccgggcagctggaagttaatgcattttcctgtagcgaggggargtgttcgggacagtcgcaggcattcagctgtgatgagcatgaaatttcaggagggaggtgtgtttggaaggatcgagcctataggcgaaatttcagaaattgagtttttaaaatactaaaagcctgatgagaaatctcaaagtgtaactgggtgtctgacagaatattttaagtgatagagagtttcagctaaggaaaattactgtcaccaaggtttgttactcataaacctcatgacgttaggtcctttgtaggcttataaactatgtagggtacattcagatgttattttaatttatggttggcacacttccttagcattgcagaattttccagtcataccaaaactaaactggaaggttgaaaaatgtgattgatactaagttttgaagctgagattcaatttgagtaccttgcttatgaaataatatatgctgaagagtaaactgcaaaggcacttttgttatggatgtagcaacttgcaggcaacctcagaaataaagaccagacttgatgttcccacttatttgggtaacacctactgtttttttacaaaaagaaagaagtacattgtctcaatttccccagatayatctagragctccagaataaattcaggcaatttgagactcacaagtattaaccagtctctaatgggtagttggcaggcttatttctgatcagaaaacactctatattatttgtttctccatcttttatttttgttttatcttttctctgacaactccttttaggtacctcaggatttggtaatgcccgcattaacctagctgggaaactccagataagaacatcatttggaataggtctagtcaggctttgtgtgcacaaatattttctagaattactctcaacacttaaaaactcatttttcattttctctaacaatttcagttttgaaaccgtaagaaggaaacaaacttcttgtgatacatcatttcattcttgtctactcatcttttaaatgttttcctaaacatataagcaatgttgaaataaaatagcagccacttcatatgttggatcttcctttttttccttttatctttcccactttttattgaacttaattctgctctgccagtgcctaaaaatgatgttattattcggccacatttttaacctcaggtgcaaaggattaattatactgctacaggattttctctgaaggcagagtctgaataggaatttattgattcaaatgtatggctaccacctaataatgaagtgcttcgaggactgaacaattgtgtcaagaaactgtctccattagaggaattttattttctctctaaaactcctgggaaaaaattatagtacaacattgttttagagatatgctcaatgatggtggatgaacacaatgacaataaccagtgagtttatacactttgccataggaatcaacttatatataatgttagagtccccagtggagcttcatggatgtcatcttgtgatactgaccactacttagcaaaacagacaaacaaaacaaaacaaacaaaaaaactttgaaagtttgttttgtatcttccttgaaaaaaggtttcaggttttcgtacttttactgagacattttcccctaagaaatgaaaaatgagtttataactttgatcttgtaagctgagtcacagcaggcctgaatatgaagcagctgaaaacacgtgtgtgcattcctaccccatgcagcattctttattctgcagatccctgtcactaaagaattcagttaaatacaaagaccctcaggtagaaacaggctgctaagagccgcccccaagtctgtgagtgagctggagacagccactcatgtatgtcagccctgctggaaaggccattagtaaatgcctagcactccaggctaggaaatggtttcttggaccagaagcaggttaaaaataattaaataaaaaacaggggtgggagaggggaaacttgcgttaagactcttcggtcccattaaaattagcaagcatgcttagggctttattcattgtgatgactggatctacagggaaggtcttttgtcctatggcattcttttttgcaccatgaatacttgcagtattatataattgtgatattataataatatgagtcatagatagtatctgtgactcatttcagtttcattaactcttgacaagtagaacgttcaaactggaggctttatagcaaaatatcaaatgtcaggtcaaaaaatgaaggttgatttcaagagtcccaacccacatcctattcttgtgactgcaatttgcatttctataatacactataatcaaggactgctcaataattttataaatattactaatattatgaaggcttatagactgctgtaaatttacacagcagctgggtaatctgtttagagctctggtgttttccgtttttacgtttgctggttgctgcaaagctctaggatatgggtagtgaggcttacgttatagtcttgcgcggttttgttatgacataggaaggagagcagattttggccttaaatcatrtaaatggtaaagtggcaaccagagacttgaagctatgactcatagttcatgcaatgaacctctgaaacatttcatcaggtaaaccaggaaaacgactttcactggaaagtcagaacatcaagtcggttttacatcatttttatgcatcatattttattatatttgtcatagtgcttatttgctttcaaataccataaaccctgttaattatagtcaataaacagtttcgaggatttttttgcttacttatacagctggttactatgcgatgagaggcaaatgacaggcatccagggaagtcgtgtgtttttacccaytggtgaaattgacrgtcaccagccacccatgttgattctaaaatgagggcctgaactttgcttttgtgctctagtggtgggtaatatgctgacaccacagctcagatgtagagaacaattyttgctttcctctctctggagaatgacaggaattaaaaaaacattttttttttcagtttgaattaggcatagaaaaattttgtatttgtaatgtgttagcttccttatgcattcccttctatggctatttgaagcatctttgtctccaaagatttccaggtgtctaatagatctttatattcagtaacaaatcatttctgtccatgagccttttgggatgtataagttagtattctttgcagtatgttaaagcaaactaaatatggcctgagaaggactctgtacttttatatttgagtgcttgtggtgaactgtaacctagcttaaaggcagatgagattgaaaacctaatttagtagtatgcacctgtaacaatagccaagtcttggccaatcccagtggccagaggccagatttcaacctttcatacactgctcaatgttcaaacgatgttcaaataaggcatatacactgacctgtaaccaaccggcagttctgtactctccttccaatttctgtatgtcatttccattttttttttttttttgtctgtaaatcttcttctaccacgtggttgcactggagtctttgtgaatctgctgtgattctgggggctgcccaattcgcgaattattcattgctcaaactcctttaaatttaattcagctgaagttcttcttttatcacgtaccccagaactctgtggaacaaaagaagttttctttccgctgcgacccggggcaaggcactcagaacctctgggaaattactcatcagtgaattaaggaggttgaattagatggttcatgtgtaaggctttctgattctgtgacattaccacaggtcccaaacataatgcagccagatgagacctcattgaatgttatcaggataatggagcaaggaggagaccactaattatgcccagagaaaatgatgtctctggaggctgctgtggctattccagttgaagaaattctaataggttaaagatgagaattttcaaggtgtcatgaacaatggataactgcttacaggaatttccagagattaagtgacaattctctgtctattttatgctttcatctctcctcttttctcacctttcagcctctccctgttaattgacattatttggggtcctaagcgtgttttagtgtatgttatgtacatacatggggttaacacaagtattcatttaattattgttttacacgttaagtatttatttatttcatcaacaaatatttactgagcatcttctctttgctgggtaccctgttaggtgctaggattacaataatacaaagacaaacttggctcttgtacaaatgagacttacagtctagtgggaataaaatactatatttgttgttttgagatgaatttgaaatgactaaacttttataactaagttactctgcttatttgtgggctttcatttttttccttttacagattgttaagaatttatatgaaaaaatagtccccgttcttccctgttgtacatttttgggtatccagagtgtgctactggatactcaaccctttacagtatgttcttatttgcatttgtgattttaaacagtaaaaatgctctccatatactgctgtatactttatggtagaatccaaagaactctttggaagacagaaggtttctgagagtcacaggactcatgagaaaccctagcatattcacttgtgttgcagagttcctatacaaaatatattgtatgtagttcctgactgtagccttttaaagaaacataattgtggagttttgtataccaacttcgaatccattttcgttgttactgcttttatcgccttgaactaaaattgtttgtttcaattacagaccaagcttgtggtttcctagattgcttttcacttgctggcaagggcttgcaaagaagacctacaagagccatgttaaaaacgcttgaaaaaaaaggtagtcagaggaacaaggaaaatgctgcttctgcttcatcacctccagtgctcagtcatttctcttaaattcctctggactccccacaggccttctagctttggcaatgaccactatctctgtagcctcagaaaaaagcaaaatggtgaactttggtctttggtgttagttgggaaccaagagaattcagtaaatttttaacctctatgtaaaagccatttgctcttttttctctttgttttcttttattgcttttagtattacttctgatttcatgatatatctccgatatcatagactacatttcaaatctaaatgtatacctttatatttttcttaatataaagcactgggtcttaaataagtattagcttttatacttagmaataagaaaaaaaggaattttgaagtttaaagtttctattgaaatggagcaaatttgctaggcaaaaccrccccccaccacacacacacatgcacacacacacgcgcacacacacatgcacccacacacgcacccacatgtgcatgaaataggaaaatagtatagtctctttggttccctgtttgcctccttgttattaccttcttttcccctttcttctttttcactcttccttatggcccatctaagcacattttgttaagttatttgtcttctagatgttgtcaaaacacacacagtgaaatggatgcatatatccaaatgttaacaaatggataaattaaaatacttatataatactctgaagattgtagcaagagagaagactacatacctgcttaagatgagaaatcgccgtgtgtttctatagcttccagatcctcttttttaacaaggagaaagaacttccctgctcctcaccaatggcaaagcgtctaaaatcactgagtactcactaattcctctgaccactcacatatctcctgtcattctcctagaattgaatttctggttctccagtgttgctccattggctctcctcttagttgcactttttggagggcagattgctttaacatgctttgctataatgtactctaaacatgcttaacgggaagtgtgaaatcaggttattataagaatttttctgttctttgatgctcaaatccattctaattggtagcaaatgttctcttgtcagtccttgtagaattttaaaatattcttgggaaatcctaacagatattataaatactttttctgaatcagccttattgagggcagaaaaaagaatgagggatcaagagtattatttccagattctctaatttgcatggtgaaactcaagggagtcttttctctttacttgctttctttttattcactataaaatatcactaactgccatagatgcaaaacacctacaaataaatgaaacttttgcaacattctgtttttcccttagcatgaaaattttccaactttggctcacataaaaattcatcttctttttctgtaatgatgcttccccaaaataccaagaagatacctacaggggtatttgtctttttttttttcctggttgccttacatatgatttctcttcccttgtttgggaagttccccagtttgtgaatcttagcaggattcagagcttgcctctcatcattgaatctaggaagttccactattcagtatcacagccaccttggctacaggacatgtgctagacctagcctatcaggaatacccactcggtactaatggacagactacagagaatgggtgatggtctactcaatgtgtacagtgatgatagaaacatcagtttactgaagtggcagtggtggcagttccagtagtcgcatcctgtctctgcttctgatgttggtgtagttagctcagctagctagctgagtggtccagtggaaggagcagccttaaattctgtggcatgattttggttgtgattgggtagcctactgttgttcctgattgttttccagtaccttccatagccttctcartgattatgtgggaatatccaccatcgtttcaattaattcartttctgcttaaagcagccagtcttagttttgttatttctgttatttgcaagtaagaacctagattgatagggagtttgaaaccaggaatggttccgggaaatagaaccacagaaaaattgggggaagctgggattggtttgtctgggttagttggagctgaaggtagtgaaaaatccagctgcataagggataagactgacaccccataacatttggtggaaaattagcaaataaatcatctgtgaacttctagaatgagttgctaattgaaagaaaaccttttgggaaccaagcagggacttccatgcaacaattgcataggaatgaggacttgaaaaactgggctggtgtgatggctgcatgtaacggtggcagacagcttaaagaaagggaatataagctcagattcctaaatattcttacctaaggatggattgaaaaatagggactttctacgagtacactaaaagaatctcttttgtactatatataaatattacaaatttattttgtaactctttcagggttaaaaagtcaaaagccaaatgcagtaatgcaagttgtcaactaaggatgtcatttgaattcacagctaggtcccttattttggtatttggtttgggtatttagagaaagagtgggactctgggaactagaacaggggatatggtaggatttggtgaattcagggcaccccgaatccctaaagtccatcaatccacccttgccagttagagcagccctgtgaccttctctgatgaggctattcgtgtcttgatggaattttctgccatctgaaggagttgcattacaaaggtaggtcagttctccttctgccctactcccagatgtgtaactaaacttagatcccagaatgcctcaagacaccaatgacaaagtcaaaggtaggaggtgatagcttatggtgctaaaaakttgcaagactttcccaattgatactggaaaatattctgggggaatatgtatgataatggattttgaaagttttaggtcaaatagagaaaaataccactttagatggcttgaatttattgctataagagcacttaaccagaggttctgaattcagtgtactagcataaatagatggcattgatctatttatgttttcttgactggttgaccaaaactgggactgtggcaccaatgagctgctagaaattctgtcacgtactactataagagcaagaagtccaagcacttagggagataatattgttggaggggatatatcatrggtatggagagctgtattccaattgttttccttgagagggtcctgatgagatgctcttcaacaagagcctaagagatacagtgaggagggaccaactggcttcattggaaaaaaaaaatttggctgttctctgtagacctctgatgcttgtgaagtatggtaccrttgaaatgggactccctaatcttactagggatattaggatcctggggtaatagagcttaagcagcagcaccttaccatcagaaagcaaggtgggtaggcagcatggcttccataataggcagcaggatgggtatttaatcrggatgaccaggaatctttgggaatggctactgataatgggattcctgtgactgaaatgcataggtgcttagctatgccacctgatttttacaaccaaaaaactctgggtcttctggcaaatggaggcttgatttaagctattacaataggaaatcatagcccccatcygattgttcccagacaggtcagttcataagcccaacatcccttacatggaactaaggtcaagaacttgctagatccggccctttgaaagagtgtacttactagagtaattggrgaaatggaaatatggagagattactggaacatgtgtcctsttcaggataaagtttctagtaactcaatacatgccttgatctttggtatgcatgtatctatctggcaaatggattttttttttttttgagacagagtctctctctgtcgccaggatggagtgcagtggcatgatctcagctcactgcaacctccgactccctggttcaagcgattctcctgcctcagcctcccaagtagctgggattataggcatgcaccaccatgctccagctaatttttgtatttttagtagagagggggtttcaccatgttggccaggatggtttcratcttctgaccttgtgatccgcccgcctcggcttcccaaagtgctgggattacaggygtgagctaccgcacccagcccaaatgctttttttactaaaggcacataagcagagaataaacagtttgcttgtacctcataggggcagcagaataacttcattgccttgcttttaggcctctrtcttctttttggctctgtgttaccattttgtctgcaaggtttcacacagggcaccatgttagtccaatatattgtgacattgtgctcataggatcctgggagtaagatacattaggtaccactgatgtcttggtgtaagatgcacatgtactagtggaaaggagacatggcgtccgcatgacagtgaagcttcattctctatgcctcaccattttcacagtaatgatcactgtgttttagatactttattttgttctgagaagtagctctaaacaggycacatgctagtgtggtgaagacaatgaagaaaggggaaaatggtttgagaaagttgcagttcttggccaaaaaatgaaattgctggataaatcaaagtagaaagttacattgacaaatagggctgagttatgaaatgtataatatgctctatccaggtgttgccagatgaagagtgttcagctgtgttatacagtgctgagaggtccagtaagatggagactgagaatgaacagctgctgtagaaatgtgcagggcattggtgtgatagacaagagcagttttaacggagtggtggactaaaccctgtttgggttgagtttaagagacaatagaaggagagggatttggtgatagtaagaccaattattttaagaaattttattgtaaagaaagtaagagaaatgcagtggtgggcagagagaggaacgggatcaaaagagggcttttccttaatattggagaatagcagctttttgtatactcatgggaaaaatccagtagagagggggaaagcagtgacgcaaaagagagtggggagattgccaaagcgatgaccttgagtaggcaagacaaggtggtctcttgtgtgcaggtagaggggacagccatcaagaggagcacagggagtccgtttagtgacatgagggatggtggggcactgggtacaggtgctggtagatgggtggtggagcttgtggaagaactgagggcctatatgtaagtttctgtatctgcaaatttggaggctgtgagaatctttagatcgtttaggaatgttgttggtttactctgctgttggagttttttcacctattgtccagtgtgtatgacagcaaagtctggtgtttcattttacatgaagatgatataatcagcgtctattacaacattttaatatttagcacttaaatatgaactataggttgaaataaattagaataatagtatgtgatggcttcagttttgaaacggaatgtttaaatccctaatgaatcttcaaatttatatatttattcaattaactacgtctaaagattttcctctccactggcttcacagtccatattgcaagttttagtgtagaagttagttataatacagtaattatactgtgcattaataggttcatggtaatttataaatgcaaaattgattttaacgggtcagtcatgaagaagtcacctggcttaattaactgttgaattcagttaagaaatgcattttacgaataaaaaaaactagattaagttaattaattgtttggacatttaaaaagtatagccaggccgagtgcagtggctcacacctgtaatcccagcactttgggaggcagaggcaggcagattgcgaggtgaggagatcgagaccatcctggccaacatggtgaaaccccgtctctactaaaaatacaaaaattagctggacgcaatggtgcgtgcctatagtcccagctacttgggatgctgaggtaggagaatggttgaacccgggagggggaggttgtagtgagccgagatcgcaccactgcactccagcctggcgatagcaagattccatctcaaaaaaaaaaaaaaaaaaaagaagtatagcctatgtggggaagattttggacattaaaaatgataattataggagtgaaatttatgtctagcaaagggaagtacaattctgagtccatatctctgtgttttcatttttatgctccttgtatttcgacctatcacccttcaattaattcttattacccgatttgagagaaattgtgtttttgccctgcctacttgaagttaaaacattaatttgaaattagattaaaaggaaataaaggctgctcattattttgtctgacttccaaagacagttatttatttatttttttttgagacagagtctcactctgtcaccaggttggagtgcagtggccgatctcggctcactgcaacctctgactccctggttcaagcgattctcctgcctcagactcctgagtagctgggattacaggcacacgtcaccatgcccagctaagttttgtatttttagtagacacagagttgcaccatgttgaccaggatggtctcgatctcctgacctcgtgatccaccctcctcggcctcccaaagtgctgggatcacaggcttgagccaccatgcctggccaagacagttatttctatattacaaaatcagaagttgccgggcgcagtggctcacgcctgtaatcccagcactttggagaggctgaggtgggaggattgcttgagctcaggagttcaagaccagcttgggcaacatggcaaaacctcatctctacaaaaaaattaaaaaattagccgggcatggtggtgcgtatctgtagtcccagctacttgggaggctaggtgggaraataacttgagcccagcaggtggagattgtagtgagccaagattgagccactgcactccagcctgggtgacagagtcggaccctgtctcaacaacaacaacaacaaagaaaatcagaaggtataaaaatttgaagatttaaaacaaattttcagccaaaatattttagcatatttaattaggtgatgtttccgacaaccaccacattgaacatctattgtactcgtcagtctttatataatccataattccattctaaataagtgactcagcaccaccatctagtgcagaggccagagcttgtgctagctcattggaaatcaaaggagaaaatattaacatgacatgattagaaaaygttcacatgaaagatgggggctcttttttggtttgctgatttgaaatatttatttaaataaagtaaataaggagagctttccctgtaaatacttatgaacagaaatggttttctgccatgtttgtgaggctttctattaatatatatgtacttgaataggtttctataattaaacctaaccacaatcaaagactgtgattattattcagttctattttcacagcagaccaaattaaacctctatgtcagacttgtagtgaatatcacagcagtaggcccagaatgcaggctttttattrcgcttgggcatttttgcaaatctgaagcattttttccatggtgagtggacatgaagtctgggaagaggtgtcttcgttacttcgcctctgcctgtaggtggggtgagtcattgcctatacagggtgatatggagaatactttcagcacccttcctttcaaccagtttgtctgtctgtctgcccttgctgggatctgaggtttctcacattggggagctctccaggagttaaagcattgctatctgctgtgcccaaatcataaacaaaggttcattaattgcttaaaccattgtcatacaaagtcatgtggggagtgcgcgctctggaaggaacaagacatcggggagagaagaggagttgggcctaggatgggccatggcctaggaccactggtcagtaaggggacagactaagagcactgagtttttaggggtgcgatgtcactgcagagggtggaggagcacccaaagaaagcatcatgtagtcaacaaagctttgccatgtgtgcatcttataccaaggctctgtgctaggtatgggaacacagagatgaggaggacctggtgccagcccgaggagcttacatccagcagggaaagtagatgcagagggtactgggatgrcacagcctgatgccccaggtttgggagacacagagggcagccgccacccactggtgagggattcttgtttatacacttgcctcagatttatgagttgagaggggctccccttactaggctgctctgtggtatcacattttcagatgccggatagagtgtggagggggcatgttatggtaccatgctgctgccaggtgctccccctcgaaaaaggagtttaactaactcttstaagcatstgtctgaagacaattagtgtgaaaaggccctaactttatagtctggcttcattttttttattagttctgggccctggaccattcaatttctctgaggcttagtttccttatctgttcaatgtggagaatgattttccaattttccccactaggtagttggaagaggtaaatggaataaatactgtatgtggtgcatagtagatggtccagggctatcagccctgttcmctccatgccccacccccagtgcaactgactaatgacctgggctggtctggatacccacctaatawgggacccgctgacagggagggaggtggacggattcatctctttcttaaagtttcttgctctgtgtgaaagggaaactatttaaatgtgtcatttaagagagggtatgcatcaagctatttagattcttctgaatttggattcagttcactacacagcttttttggtttgctctctagataatttaactttcataatttggatcatagcacaacttggaacttcttattcacaatatagtatccttattctcagcagtagcatgatttcacgttcagattggcaaatgtaaaaggacagttcactgagcaaatatattaatatggagcttcatgtttatgtaatgacgttgggctttgtgtgctctacagaatgtacaggggtaattagatatttcagatacgtgtctagacagggcagagcttcaggagcacttgctcaaccctgggaaatgctacaagtcacccatttgtgaccagaaaaagctctctgtgattaacaagttaaatgtggagttaactgtatggcactagatttatacccaagaggaaaatcagatctgatgaaatttgtcaggactgaccatttgtcgaaccagactaggcctaactttgcccagtgtggcctgatttgagggtgctcaaagtgatatctttcaaatatctttctatcatccagctatggggcttggattctattcttagaatcacctcttcaggttaagtcattctgattcaacgaggctcctataaaatgtgagtttgttccttgagagagttgtacattgacctagattgcttagactcagggacagtagtgaggaagcacacctcaggatttgatgtgagggcaacaggaaatgagtaaacatttgaaatagagtttgcttcctgaggagggtgtgcgcaggcagagagsgctgaggggcagcctgaggagtaagagaaaaactgactaatggggcacgtgcccctgtgcgtggaacatgggatgaacctggcttagcttcagccctgcgcttgaagagactcacctggtgccctgactgggattattttaaccaaatgtaaaagtatctagaagccagcccctttctggttactttgtggttactrcatacagtactttctgatgctgaagacttaatartgtcagccttgaagtgtaaaccttccgagggcgatgatagatgatagagaatcacatgccartctttacctcttgggtgccctctcccagcatctcatggcctctgtagcaccccctccccagcgccaggaatctacaagagtacacatgacagcttactcattgtgaattgctagttgtgagatcgtccataaagctccattcctggtatccaagagagatcttcaaaagtaggggccagttgaacttggaaagtacaggcttcagtgtacagcttccaagagaggccatctggctgctgctgctgctgccagcttccagacggaagctgagatttrctattgatgttccagcattgatygagctcctgcctcgtctgcatcaggcatggtcctygcagcttcacgcaggtatttcatgctattgcaaattgttgcttgttagtattcctcccaactagttgtttggagtcagctagttgttagtatttttactctactgactagaaatctgagactttgaaaggttaagtgatttgcccaataccaaacagctggggaatgagagagccggaatctaaagttagaaatgtcagcctccccctgctaasttctgctgttggtaagggtatttcctctccctctggggctttctattgctttcagagagagagtttgcaagctgaaggaacacttaacttgagaggctttcccaaatggagtataaaatgccacgaggaaataacttaaagatagggtgctggagatgcgtctaagatgtgaaggaatgtcacacatgtgcatggctcacctcgcacctcattttgattcctcagtggcttttagggtcttctcctgcctcactccttttagccccctggcctggtcttacactctgcccatccagaatgaaagcaggcctcctacgtcttcgcagtggacatgcattggcactgaacaacatgccgtgacctcttttatacctcatgcttgtcattctttctgtttatctcgacactccaacctaagctgtgaccttggctttctctccctggctccaattcatattctccctctagtggtgctgcctctggctgccctaggtaaatcctaggcctccaaaggattttctcctttgactcttgccttcttggacagtactctgctgctctcgtcccagatatgccagtagaaaccacctattaatccatgagccccaaggatcctgaagcatcactttgcctcctatctcctatggcgttgacagtgytggccataaccctgcagtacctgcacccagccagtgccagcatgtgagccttgttgacagtctgcagaggctggttggagctgctaaccctgtgcttccaggcccacgctgtttggttyggttcgagttgcccttcagagccctgcccagccctgacttggaagctgttgcttattgtgtcttagtgtggagcagtggggcctgaggcaaaagtatattgctgctgcttcattagtgaaagcatcaccagagaaacagaagtggggaacaagagaagtgaagcaaagaaagagagtaaatataagagctgtatcattgacctgactactgcttgctagcaagtacagctgattgatcttgtgggacatatgcagagagatgccatgtgggtgacttgtgggacacatgcagagagatgccatgtgggtgacttgtgggacatatgcagagagataccatgtgggtgacttgtgggacatatkcagagagmtgccatgtgggtgactgcacttcagggagtctttctgggggaaagtaactccttcactgccttccctctccccttggtcaaagtctgccccaaggggcatgaattctcttgcacttctggtttgtacaagcctagaagtggccagctgatcatcccacaccttattagcaactcacacctcatcagcaatagacaagaaatcctgggaaggagccaagaggggcttgctgtacccatgggtgacttgaggggccatggcagtggcatcagaagtgacatccaggtctacacctgtgagagcagcacaggccatgttagatctgctcagcctggcagcaggcaagtgctcagcccggcagcaggcaagtgcacaggtctggatgatgggtaatctgaatccagtcacgttgagcagtgtaatgtcagtgcagcctggccgtttgacttgtgtatgctgctgggaaacttcttgggcatgtaaggaaatactcagttttcttttccagttcccagggttgagcatctttttgaggggtctctcttatatgggtggggcctagctgagtgttctctgtgattggggtgaggggggaagggtccagatagtgctacactagtgagatgcttctcacaataagaggcagaggagctgctggtgatcgtggcactgatcaagtattaagggctcatgtctctggaaagcagaagtcctggtacctgaagccttgtctaactgtattcatccattttcacactgctgtaaaaatactacgtaatttataaagaaaagaggtttaattgactcccagttccgaatggctggggaggccttaggaaacttaggatcatggcggaaggcagaggcacatcttacatggcagcaggcaagagagagagcacacgggggaaactgtcacttttaaaaccatcagatcttgtgagaactttctcactatcacaagaacagcatgggggaaaccacccctgtgttccaatcacctcccactagatccctccctcagcacatgaggattrcaatttgagataagatttgggtggggacacagagccaaaccatatcgctgacctaygggcagactgtgcaaggccaggtactaccttccaggccatgccacatctccaccttctttcagcaccagtacaaggtggagggttttggatacactcccctgacctggccttaaatgaaccsctgtttgggaagatcctttacagacacagcacctccatcttcaggccagctcaacacagaagacacatgttgaagatcccagagacagagttctgaggataccttctcttcaattgtgaagtttagatgatatcaagcaaagtatttraagttctagagacycctgtgggcatacataagttctttaggtttcatttataccagatttctccaatgtgactcatctatcagctgatttcctgcaagagggtgaggtttaatctggatccattggaggttaaggtatttaaatagctaatggcctccttgactactgaccccatcacaaccttccttgacccaacttatctctacacagtaaaaataggcatcatcaaactgagagtacagaaggccttcacccatgcaaatgatactcataactaataatagccaataaacagtcttgccaagcagtgggagctagctgctctaaagtaacaaactggatctacttcccggagtagggggtggagtaggttccagttccctcggagcatgagaactactcaatcaggggcccctttttaggctctttatgcaaatctgtgcacctcatctcctggccaggcttttttagctgggagtttggggcagaggtgccaggccccctccagctgtagagctgggccccagacttgtttcgggaaaggaagtgatagacatgtgataacagggccattccggcgacttgctcagaacaaagggcatctgatccaagtggacttgctstctctactgctagaaaacagctactgttggcaatcctcaaatggtaattgtcccacaaaatgaaaacataagagtccattttcaccagtcaccctgttagaaagcaaagtcaccctgttagaaagcacagtctggctctcctgccgagcacctccacacttttctgcttatgtccccggcaagccatgtttctagccctttttcaaatagtaggacttgagaatcctacctcctgcttctagctccctcgatccatgctcatccctaacttacacactggggtcccgctggcagcccacctctctcattctggtacatagaaacagaaagcttggatccttgaagccatggagccagcccgggcacctgggccacgggagacgagccatcacagaatgcccagggccacagcagcctctcaccaggcaaacccataaggcaagccctgcctcacccggctgtttggggaagatgggtagcctaggcatgggtggggtctgattctgcacggtgactttgccatgccaggccccacataaaaagggcttcccacaccaccacaacgttcatgacctcgcttcagagctgtttgccgtgacctacttcacactcagtattattctgtccactgagcctcctggctgctgacctgggagctgactcactttcctgtttacagccttgcctcaaccctcactcttgatggtggtttacatagtttctctggcaatgatatttgcttcctttttgactagagttcagattctcttctggccagacagcctctgactattctggtgaaaaatatgccagattgtccctggcccccaggaccctttgtccttggtttggcttcttaagagcagtctacctgccggacttgcctttatatgattggggtagcctcagtgtaagagaggaaggtgggagaatggaaaagggagggaaggagctaggagaggaaggaagaacaagcccttttctcctatgaatccttagcgccattgatacagacattaaaatgaayaccaattatttttcccccttgatttttagatgtgtttaatccaaaagagctatagcaagtgatgtgagcctattgtgagcattcagactcratagtgctgttctgtagcctaactggagtgcctttatttttctatgcacaggtaggtattttctgacaactagttctacatttatatctcaaataactcttcagtgagtacccagatttaatgagatcagtgaagtttggaaacacttccatcattaatcttgtagttgactatagaactaaattaagtggcaggttccttctgatggttacgtacttcatagtaattatagttcaaaaatatgatatttttgaatccctgttctgttgataccttcttgtttgggaaatcaccttacccacagccctgccaaaaccttgggcttggatggttgtgtttctaccatgtgaccctcagttcagatgtttggaccagtggtggacacttgaacctgacacaggcagtccatcaacctggccagtgaccaaccaggttatcttgcttgaaaatttaagcaaaagaatatagagagctaaaggacatagtcagttgttggtgggtgtgatactcttacagagtcagttcatgctacataggcaagctgaggttgtgagaaagcagaaaccatcaataagcagagaaagctggtttgcagagaagaggatgcatcaggcaggcagtgagtgaagagatgacatggacccagaaagacagatggggcacatgactggtgcctggtggtttctcagctctagactctgaaaggccagtctatactcttatttcctgcttgtcgttgtccatgaaatgacttctttgatcttacagcaaacctcaaccctaccacctctttttttgacataagggtttctgttccttatagccaaaaaaccttgactaaaatagactactacggaggtgttgccagtagtggttgcaatagagagctataaacttatatcttcgtcattaagcaaacggtggaatgttttttagttgcttatttggaagtagaactaggtgtcattaaaatctgtgtacatccatattctccttgttaatcatttagaacattctagctttccacccttttctcacttgtgataatggtattggtttcatagggtgggtctttaggagtgctgtttgggggaaataaaaaacacccgaagtaagcttacatcaaaggacaagattgcttctgctggtttataatgggtagactttctgattatctgcaccagggacataatcttgattgccttgtcaagaaatccattgcccaattaactggagatttttatggctggagaaactccggatatatagcataggaggtggggcagggatgagagtgaggtaatccacagtctgtgttccatctccagcaattacaagttgcattcctcatcaaatttagcttctacatcaaactggcatttatctgggtggagatgtgtaaacagtgggtatcctgggaatggagctgtggctgggtttttttttttaatgagctaaaagagagggcactatatatgtttgcataaaacatacactgtgtacatttgcataaaacgtacacacaaaagccaatctgggcaataaagtcccaagttaagtaaactgttctgcggggagagtttctgtatctgatagaatggacagaaaaatgagcagcagttgggaaaaggacacttggagggtggtagagggagaactcatttacagcgagtggcagtgtagccatgtggctagacacttaggttctggacccagactacctggattcaaatttcaagtccacggtttagaagctatatgaccttggagaggttacttcatttcttagtgcttcagtttcttcatctgcaaagtggaaataacaatagtttctacctaataggtttattgcaaaattaaaggaatcaatacatgtattatgcctagagcagagtctagtctgcttagtgaatgctacctatttattattattctgtaagacataacctagtgtgccaaccagatgcaagatgcagcagaactaaaactgcatgtgtattctattcttttcctgatgaaaaatccaatagatttactcttttactatgaaatgtgtgtgtattggctgaaacgagaaagaagattcataaaagagctactaaaatgaaggtgggaagagaggggctttcatatacagagtgaaaagagattgggttctggcctggaaaaatgaggactgagatgcactatgttgagttttatgaaggataggaatagtatgaataataacttgtttatggaatactgggaaattagagctggcacgaaagatgaatactttgaggtgaatacttgaacagatggttdcttgacagtgcctgcacagtgagtggttcagttatggtgcttattagctcagaatttttgagagcaatctggaaaaaggctgtgggttagatgattccttaactattgagggcagttagggatgtttgtgatggagccctagtttagttcagttcagtatttgtaaataaattatatcaatatagtrccttaaaaaatggtttaagcactctaatcattcaattctcatgatagtcattgactgagctttgactgtgggcaagactctgctgggaatcaaaagatgagaaagatgggtcgtgttgaagtttccaatctgtattgcacccagaagcaaattaaattaatttgagggcttaatgtatttcatttgctcttacttatattttgaggccagagaatttttagttattttataagagttcgggattgatattgtgaaggagctaaataaataaaagttctctttttgctattattttgttttcataactctacccaggctacactctaaagtgagtagaaaagtttattttaaaatttatttttatttttagtgtagttgttcataaaaagcaattttagagttagaatttaatgtagagattatcttctaaagttcctcattttacagataaaggagatgagcccctgagaactcaggtgacatgctcaaggcagcaaagcttggatrgaagcccaggttctagtcttctgtgttttctttcctatccagctgcttcccccaggaggatcagggtaattgtagtccagcttatttctgtgtacacacaagctgaaatgtgtaatgttttatctcatagtgcccagaagcaatttaccatgaagccagtgaagattcagctcagggcctctcacttataggagctttggggtgggaagaggaagccaggttgcaatcagcaaacatttctgtaagcacgtctggtcaatgacctaaagagatactgtaagaaatggactcaaccctccccaagaccccagtaatttgttgtgatctttttcacattctaaaataaaagaaactcgcttttgtacctaattttgaatttgtaattttgtattttttttttttttttttaagaaatgcccttctcttgcttcaagattatataaatttytggctctgtgaaacatgggtcagcttctgatgtccaaacatacaatcacctgggaatttcatttaaatattttaaattttatttctaagtgcatttttattaaaaaatttgggctgggcatggtggctcacgcctgtaatcttaacaatttgggaggccgaggtgggtggatcacttgaggtcagaagttcaagaccagcctgaccaacatggtaaaaccctgtctccactaaaaatataaatatatatatatatatatatattagccaggtgtggtggtgggtgcctataattccagctaccggggaggctgagacacgagactcgcttgaacccaggaagcagaggttgcagtgagccacgattgcgccactgcactccagcctgcgcgacagagcaagactccatgtcaaaaaaaaaagaatacatttaaattacttttatttttatatttaattttaacttttgttatagtaataaagaaaaaattgtgttaaaatgttttaaataaaaatggcagccccttgcctcagccttccctaccccttgatattttctccagttaactgcttttaaatcttttgtgtttttcctaattttacctctatattatttattaataacttactttcttaattgattagttttagacattatatattgggttgctgtaatggtaggcaataatttaactaataaagtgcaaacaccccttgtttctcgtcacatttccccaaaatagttaagtcacaatttttgcttaccttagtcatcagtatttatattatcattgactgtgtaaatattattcacagcagaagcaattattagcctatggcatcctttctcatgtaactttttgtttgtcctagacttcataattatcttagtttcttttgcctaattttctgtgtatatgtcactgcttttccttttttttgtaaaactttttgttttccccagagttcataattgctttgattttccttctgcttcattttctgtgtatttagccaaatacatcatcagaactgccaaacatctatcatatcaatattacttttggaaatggtcaagcatattggataatctaccaatcctccctcctacccttttttccctagagacctcctcctgctctaatatggactgattttttttctagtgtctaaaaatttcatcataataaggctttgatgaggatgtttggtaaggatgacactcagcgggctctttctaaatcgtagggaattgtctacacattatatgtaattttacataagcaaagtttgaaartgtgttttaggtatctaatgtcatagaaggacttccttcattttctacttgactaggtttccatagtagggtggagataatgctcctgattctggatacagatggataaaatactatatctggattcctgaaatgcctagtgactaaaagtagaatttgctaatacataattctaatcctatttcttgccatatatattaaccttagggtcagtcacctgaattttgaattccaaatctcaaatcctatttcttgacatgtatattaaccttagggtcagtcacctgaattttgaattccaaataattactaagaatatatttccagacaatttcttattatcctcatactcatagtgacacttgccactgtaaaaactagttttaatataggtaagttaaacataattttaaacaatattttttaaacatggcacaaaattgttttacatattagtatttattagttgcattagaagctttacctaatagtggagaattaactatactagtatcagtaatagctttttatttcagtactttacatatgcagaatatttagttattttttactrtgtaccttcagagtaggccaataacattattttactttgctgaagtagaaattaaagtcattgaaattcatgattaagttttcttatggggacttcttgttctcagataattcatccccctgtaaaggaggattagtcttttcctaggtaatccacatgtaaaccatggaagacactgattttttggggaagtagacatttttttttcagtgtgtttcactatattttaatctcattcctttttgagattgttgcaactcaaatgttatggtattcagctgaagtcttgtgggacatggctctctactttcatttgatttttaaaaatttatttcctgagaatattgctgaaagaaaaaaaatgtttttaaatatttaaggtcttggttgaaacacttagccctggtaacctttacaagcagagattaagtatgcatgatcaaatcattctccccaaatrcaccgcctctggaatgcccctggcctctgcctagacctgtagctttgcagcaacgacacatygcaggatgcaccacccttcacccttccttttctgtcttcagcagtattgtccactgatagttgtggacagacatgggagtgctgaatccccagaggtaggggtagtctgccttgtatgccaatttttttcccagtaaggaattggatggtggtgggattcatgctgagggatgggtggggtcagagaaacaccaaccaaagattttgccaggattatgacatttcccctacagttttggatactttacaatgaattatttttctatttttatgtgttgtgtaaggggttacttgcatttatatttgtattactggatgcctaccaaaaataaatgtgtttactcagtcaactgactatgtaatcttttggtttgtttcatcagttagagtccacatcaygtctctctgaagaacagttaaagtgtyttctggatgaatgcatacttaaacaaaaatccatcattaaactttcttcagaaagaaaaaaggaagacattgaggacgtaacacctgtgttcccccagctttccaggtccatcatctctaaattgctaaatgaatcagaaacaaaggtccagaaaactgaggtagaagatgcagatatgcttgagagtgaagaatgtgaagcttctaaaggctactatctcactaaagccttgactggacataacatgtcagaagctcttgtcactgaagcagagaatatgaaatgccttcaattttccaaggacgttattattagtgacacaaaagactattttatgtcgaagactcttgscattgggagactgaaaaggccctccttcttagatgatccactgtatggtatcagtgtgagcctttcatcagaagaccaacatctgaaactcagttctccagagaatacaatagcaggtgaggcttggcgaacatgtgttttggtaaataattcttaaaagcacctcaatataaaggtattatggtttaaattagagtcgggtaagaaggtatgtttgtaagtcacaggtagcgtcaataagagtatgcaaacataaaacctatttcccaatgctcttatgaaatcaaagttgaggttagtactctatgaaatacgttattcttgatggtaattaattgtgtcatccagaaaataatgttggtttcacaggaaaagagaaattagtttgaatggagagaaatactttgaatagatttgcttagtatttcaacttcaaactttagtattttcaaactttagtgatgaaaatttgttctaaggaatgaatttaaaatgtaaaacttgtaactcattgtggttatattagtttctgtatgcaaacctcctctcctgagccactcctatgttctcaggtgtttcgtcacgatctagtgtttcatcttgcaatggtcatggtacaggatacaacaataactagttttcgacacaaacaaatattcaattatttatgttagaaatctgtgtaacaattggtgaatctatttaaatagattcaatttttacctctattgtagattactctaaaatatattggctattacatttctatctattaatctattccttattaaatctataatccattaactctgaactgagtcagatttcggttttgacttccatttccttagtcacccaggagcaaaatctgagtcatcactgaattacttctctttcttgcttcccacttccagtgttcaggtgttgtttgttctattcctgcggtgtctctcatgcccatcccttcctttctcttcctacaacttcaactggaccaatgccataacccttctcccagacctccctgcctcaagtctctcttctcttcctaccattgttgacaaccactaaacgaatttccttaaagcacagctttgataaccacacttccttctatggctctccaatgcctgttgatcaaaatcagaattccttaacttgttcagtgtctccatgatctgacctgaagttcttttcctaatcaatctctaagtagtcacctaaatgttattcagtgtgtagctaatctggtctaatgatttcggtgatttcctagcttctgctgttgttcaggccctcttcttcccagaaatgttcaggtaccccttcaatggtatttgaattccaaccttatcctctctgattgtagccttccctggtcccctctgttaagttttctgtcttctgtgaatgtccaagcactttggtttcctataggatcacatacacactcaccttctcttccttaaaactgcataacatttttaaaaacagagactctatcttgcaattcattgttacattttccatggtgtctaaagtgctgccttaagccaagtgcctgtttaataaataaaagaatttaaatgtataaccagttttagaataaaacactgaaaatatggttcacatttmttctttacattaccaatgaaagtaggtaatgttgcttaagaattatgtaagtcacacattctatataaatatttggattttttgtttcttacatgaaatttcgcaagctgtaatttttaaattaatattttttagattggcataattatatacatttgtggggtaaagtatgatgatttgatgtatgtatacaatgtgagatgagtaaattaagctaatttacattatctatcacctcacttaccatttttttgtggtaagacacttgaaatttactcttagttattttgaaacatacaatatgtgattaatgactgtagttaccctgctgtgcaattcatctcaaaatttattcttcctaagtgaaaactggtaccctttagccaacaactctccattccctttttccccctcttcatcccccagccactggtaactgccattctactctccacttccatgagtttgacttttttttttttttttgtatttttagtagagatggagtttcactgtgttagccaggatggtcttgatctcacctcktgatctgcccacctcggcctcccaaagtactgggattacaggcgtgagccaccacacccagtctctttcatcttttgataatagttgttataacaggtgtgatgtagcatctcgttttgattttaatttacattttcttaatgattaatgatgctaagtattttttcatgaacctgttggccatttttatgtcttcttttgggaaatgtctgttcaggtcttttgcctattttttaatttttttttttttttttgctattgagttgtttgagttccttatatattttggatattaaccccttatcagatgtgtagtttgaaaatattttctcctacttcacagattgtctctttactttgttcattgttttctttgctgtgcagacactttttggtttgatataatcacatttgtctatttttgcctgtgccttcaaggtcgtattaaaaaaaagtcactgctcagaccaatgtcatggagcatttcccctgttttattctagtagttttacagttttgggtcttatatttgtgtctttaatccattttgagttgatttttatacatggagtgagataaggatcaaattttattattctgcatatggatattcagttttcccaacaccattccccattgtgcattcttgacatctttgtcaaaaatcaattgaccataaatgcatgagtttattactgggctttctgtcctgttctgttgattgacttatctgtttttatgccagtagcatgttgttgcaattataattgtgttatactttgaaatcaaggagtgtgatacctccagcttcttttttggtcaagatttctttggctattcagggtctattgtggttccatacagatttaaggattgtttcttttatatttctgtgaaaatgacattggatttttgataggaattgcattaaatctatagatgactttggatagtgtgaacattttaaccattaattctttcagtccatgaatatggtacatcttctttttttttttttttttttgagatggagtcttgccctgtcacccaggctggagtgcaatggcatgatcttggctcactgcaacctccgcctcctgggttcaggcgattctcctgcctcagcctcccgagtagccaaaattacaggtgcgtgccaccacgcccggctaattttttctatctttagtagagacgagatttcaccatgtgggccaggctgggaacatgggacatcttttaattgatttgctttttcttcactttctttcatcagtgttctatagttgtcaatatatagttctttcacctccttggttaattttttttattagagacaattgttaatgggattgttttcttaatttcctatttagatagtttgttcttaatgtatagaaatgctcctgatttttgtatgttgattttatatcctgtaactttactgatttttttttgtcacttctgacagttttttggtggagtctttagcrttttctatatacaagatcatgtcatcagcaaagagagatagtttcatttcttcatttcctattaggatgccttttatttgtttttcttgcgtaactctggccaggacattaagtactatgttgaaaaaaagtggtgagagtgggcatccttgtggaaaagctttctacttttcaccgttgagtatgatgttagttacagatttatcttatatggcctttattatgtactttacctctatacctaatctgttgagaatttttatcatgaaatggtgttgaattttgtcaaatgctttttcttcatctattgagattatcatatggtttttatccttcattttattaatgtggtatatcccacttattaatttgcatatgctgaaccatccttgcataccagggataaagcccatttgatcatgtgaatgattcttttaattgcttttgaattcggtttgctagtactttgttgaggattttcacatctgtgtttatcagggatattggcctgcaatttttttttcttgtggtattcttctctggctttggtatctgggtaatgctggtcttgtaaaatgagttcagaaggctttcttccacttcagttttttggaagagtttgagaagcactggtattagttcttctttaaatgtttggtagaattcagtagtaaagccatctggccctgggcctttttttgataggaggctttttattactgagtcaacctccttgctcattagtggtctgttcagatttttgtttctttatgattcagccttggcaggatgtatgtgtccaggaatctgttcacatctaggttatccaataaaatatctaggttattatatgttggcatataattttacataattaccctttgtatttctttggtatcagttgtaatgtctcctctttcatttcattttcgttttgttttaaataagcagaagttttgagcttaaagactttaaaaagtatttgttattgctttctaatcgcacaacaaatgtaaatttgttgaaggctatttgaaacatacagaaaagtgtagaagataaaatcattgtccagacctattcattgttaatattaacattcatcttttttctagttgtgtattttaaattgtcttcatattcttcttataatatattctgatatttttttcttttatattttgagcattctgtgttattaaatattcttctaaatcattcattatgatggctgcaatgtatcttatgatgtatcataatttaagcatttctttatttttggtcrtttatattaagactttttgtataagctaaaactatcatgagacaaaaatatggtcataatcattatcttcccattacatgatggtgtgatgagttcagaggatttgatttatttgagtttkctttctttcttttcctagttagtctagctaagggtttgtcaattttgtttatcttttcaaaaagccaattcttagttttgttgattttttctattgttgctagtctccattttgtttattttggctctaatatttgttattttctttcttctgctaactttggacttagttggttctttttctagttttttgaggtttaacattagattgtttatttgagattttttctttgataataagcatttattgttttatatttcccacttagaactgcttttgtcagcatcccattagttttgatatgttgtgtttccatttttgtttgtctcaaaatatagtttgatttccttttttcccccctctgacctattgtttgtttaggagcatgttgtttaatttccacatatttgtgaattcaccaagatttcttgttatagatttctagtttcatgccactgtgatcagaaaagatacttgatatgattaaaatcctcttgagttcattaagacttgttttgtggcctatcctggagaatgtcccatgtgtgcttgagaagaatgtgtattttcttgctgtagggtgtgatgttttgtatatgaatgtgaggtccatttgatttaaagtgtaattcaagtccaatgttttcttattgattttctgtctagatgatctcttcatcattgaaagtggggtattgaggtcccctactcttatactattgcagtctatctctcagatcatgtaataattgctttatgtatttaggtgttccagtgttgggtgtgtatatgtttacaattatgtcctcttaatgaaatgatccctttatcattatataatgaccttctttgtctctttgtgtagcttttgacttaaagtctattttgtctgatataagtatagctaacccctgctctcttttggttttcatttgcatggagtaacttttccatcccttcactttgtccatgtattttcttactagtaaagtgagtctctcacaggtagcatatagttggccttttattactattttttcaacccattcagccactctatgtgttttgactagcgactttaatccatttacattcaaggtaattgctgataggtaaggacatgctactgccattttgtaatttgcttctggttgttttgtagagctgttgtttctttcttcctctcttgctactttcctttgtggtttgataattttctgtgatggtatgctttgaatcttttccttttatattttgtgcaactattacaggtttttrtttgtgtttaccatcaggtttatataaaacatcttgtacaggctgggcatggttgtgcatacctgtagtcccatctacttggaaggatgaagtgggaagatcacttcagccaaggagtttgagccctgcctgggcaatatagcaagactccatctccttaaaaaataaaaaaaaacaacaacaaaatatcttattataacaggctattttaagctgataacttttatcacatataaaatctcaatactttaacgccctccccccgacaacttttatgatttagatgtaaattttacatctttttgtaatttggattcctttaacaatttattatagctgcatttgtttttaatagttttgttttttaactctcataatacagagaaaattcctttacacatcatccttacagtattattctgaatatgactatgtcttacttacaccatttagtgctttttgcttttataagttttatgtatcaattaggagccttttatttcagcttagctccctttagcatttcctgttaggcaggcctagtggtgataaacttacttagtttttgtttgtttgggaaagtttttatttatcccttatttctgaggaatagctttgctgagttaagtattcttggttgccagttttgtttttcttctacactttgattatattatcccacccttttatggcttgcagggattctgctgagaaatctgctggttgctgttttgggactcccttgaatattatacattcctgatctcttactgctttcaggattctttgtctttgttttattttaattttaatttaattttattttaaggcagagtcttgctctgtcacccagactagactgcagtggcatgatcctggctcactgcagcctctgcctcctgggttcaagcgattctcctgcctcagcctcctgagtagctgagactgcaggcacgcaccaccatgcccagcaaatttttgtatttttagcagagatggggtttcaccatattggccaggctgacatcgtgatctgcccgcctcgacctcccaaagtgctgggattacaggcatgagccactgcgcctgaccgtctttgttttttaatagtttgattatgatttgtcttggtgcactcatctttggcttgaatttaattggagatctctgagctttctatacctggatgttgtcatatttccrcaaattttggaaactttcagccatattttcttaaatatattttctgggcctttttctttatcatatctttcttagaattttattataagaaagttagttttcttgatggtgtcccatagatttatgtaggctttcttcattcttttttcatagctctacatttttttcagggtccattattggggctttattagtttctttttgttgtgtcacatttccctgattctttctaaaccttgttgtctacacatttgaggaaatggccacctcttttggccttgaaggttttctttcacagtggtagaccttcactagttagtttagcatttgattatggataggccagctggtaacaaccccagacaggtacaccttgctgttggtgttgctgttgggccagcctgctggctgttctttgaggtcaagtggaacttctggctgtgctctgtggtctgatgagacagatcactagctggactccacagttaaggtggagctactggctgggctctgtaatagcctctgattgcacagggttgcatgttgttttccctggctgggaagtactgctgtttttaatctgtagctgggcaggtctgtgtgctgggctcagcgactgggtgaggtttctgctgttgtgctcagccattcaggatgggccaggctatcgtctagagaaacacatggatgcaggcttccctcagggaagccttaagcaaagcactgaggctttgtggggtcaccatgcagctgctggggttgggtggggccaggtacttttgtccatagatattcattcattgacctgcacttgcctcctagcctggcaagccttaagcagaacatgaaggcttggtagggttaggctagttggctgctggggttgggtggggcccgttgctaccctccttaggtaatcactgacctgcccttgctgcctggcctggggaaggcttaaggagagcaccagagctaggtggggaagctggctagggaatgaagcctggcagatcagttgactatacttcctgcaggacagtgctaatgctgttggccagtttctctggtggagtgcctccattggctagaatgcagagccactgcaagatccatgtgctcgtttctgtgagtctcacttttgttctttgtttctggctgatcctaggtggtctagccctgcctgtactcccagtgtttcccgggagataataatgagtgggcttcctgctcagggtcccagaatgttggggaagctgaatgtttgcctctctcttttcccactgtagaaactctgggcccaggggaatcttctgtgtgtggtgctgtgctggcttgaggtgtggcagggtttgggggagtggtgatgtggtcaaagtgaaaccattcctctattccacttaccccttgaatgaggcttttttcagttatgtggtccaagggggtgtctcagcttttcacgttcagggagttcaggagtattaatgaagatattcttgtctgtaaatagttggttggatttttgttgggggtatgggagctgagcaacacccattctgccatcttcctgastagaacttccagctgtaatgtttttatttagcagcagagttcacttacaaatgcaattcagttagatgggtgtggtttgctttcttcacaccaaagatcttcakttaataaatgaactgtgaaaactttgttctactctgaaattgmagtatattgtccttctttttggataaagtgtttttattagaaagtatctgaatctcctctgacttctgaaatcaaacttacaaaattggatgcaatcatttcttgtgtatgggatctcattcccatggagtccatatataggggggtttagaaaagtaatttgctaagatatgactttatttttatgtgaacatgagtcacactgatgcatatctgtcactgggtagagcatgacaagatggaatgaattggaacttaatgtgacttaatggaaagaagctatggagacatagaacatggctctgattataccagataatgttaatatgcaattataacaattaaccctgtgactatgattaaggtgtcttaggtgtgaatatgtgaaccatattttactttctgtttattacataataagctctaaggaataggtcttacattattactttgagcatgttagaatatctgaagttggagttttactaacctcattatttataattattaaaatagcttgctgatcaattttattctaaaatactaaattgtccattatgyrctttctacaaaagtgtgcatcaaaactgaatgctgtgtcagttttcttgacaaaaagccctttgaagacataactaatgaggagttgctgcgtgtttggctgttacatttctgttctacctccttctcaggaaatagatacacaagagtgtgattcggattagatttctggaagcagacaggaagaaaataagaaaagccatttattgttttctctttcaatagcaagtattactgatacgtagttgtcttttccttgatgtgctgaggtctgttccaactatttcaattgtgcttctaaaaggcagagtcagataaggcttcaaaactaaaaccaaactcagtgaccttgaagaccaatttaaatggtggtattgaaaaataaggatttgcctatcagttgtattaaaaattttcaatgtgaaacacattatcaatgtttgtgctttaagcttcatggtaaccagtattatttgaatttttgaatacaaggttcagtaaattcagcattgtactcactagttactggggttttacgggacaaataactagcactcttctcttccccacccaggtcagaaccgactgagagagagatagattctgacaaatggagatcaaggaggttcgctttattgctaatgaaatgtagaggattgtcatgatccgggtgggcagccagacaggcttccaatgctatgcctttaaaataaacgtactcacccagtcactggcagagatggaaaatctcaggcatcatctgtggagacctgtccatgtaaaaccaatagggtggaggagcgaagcatggagccttggggagcagggtcaggtgggagctgggtgctgactcctgaggaggcaggggctgagctgagcatgccatttcatctcccaaacttagcttcccacggacagtgtggagggtgtgaagtgaggccaggatgcttccactgcaagttcctccttgtgggagcatgaggagagtggggattaagtgttgtcaggtcacacttaacctcagagacaatcctgaatgtactggcacttccgaagcaaaaaggatcaggtctgtgagttagtctagtatttaatcaaattatctaatactgagttgctttctaggtaatcaaagcaaaagccacctatgcttgtatagtattctcccttcctactaagcatttgagctaattattaacagaaattcataaaataaagatgaacatggtattagcaaataacaaacatagtaaaatagggcaaaaacggacacaaaatcagttgtgcagtaaaaaatggggacagaactgcactaattctttaagaaaaacaaagtggaatttctcgttggacctgttgagtgaacagtattcttgaaaaattgtataagttagcagggaggaagggatagggagttattggttaaaggatacaaaattatagctttataggaggaataagttctaatagtctatagcactgtagggtgactatagtcaacaataatatatattttcagatagctagaagagaaggttttgaatgttcttaacacagagaattgataaatgaggtgatgggtatgcaatttacctgatttgaccactagacattgtatgtattaaaatatcactgtgtatcccatagatatgtacaattgtgtgtcagtttaaaagcctatagtaaatgcaacaagagtcatgtaagttttgttttctttttaaaataatacccctaaatgaaaactatagtggccaactgtcttggattgctcagaagtgtcctggttttaccattgaatgttccatgttccaggaaatcctcagtctctagcaaactggaatggttggtcactctaaattgaaactgtgaacataaaaccaaagagcagattagttactcaaaggaccaaattaagggagtccaagtaagtagcagaatcccaagctagaacctagattagcagagggagggtggcctaccacccaccagtgggaagtggcctagtggttaggaacatgggttctgggtagggaagacctgggtttgaatccttgctctgctgctagatggagatcttaggtaagttagttaatttctctctctctcctctacaccttggtttccttgtctatcatataagatggcttaataccctgtagggttgtaatgaggatcaaatgagaacattcaaataaaatgattagctctgggactggacttggttggcttacatggcgtttaacattgaacattgtcaggagatttttccataaaaggctagatttctgacatttctgacaaatcagcaagttctaccaccacccacgggagctgagtagcagatgctccccttagaaggcatgtgtattctccaagaggacacagcccccacctagccctctctacttcatgggcttggtcctttggagacattgaatttccattccatgttgtaagtctcctctgcttgtagtgcaatccaaccactgggagcttgttagagatgcagggcccctaagggcccacccacaacctaaggcatgagaattttcattttaataagatccctggtgatacttcccggcaataaagtttgagaagccctgttacaaactgcagagcattattcctaaccacagtgagtatcaagatcatctggggagttttttgcttgtttgttttctagctgtgtccaaggacctatccagacttgctgaaatcagagttcctgggatggaatgtccaggctgctaaattaatgctagggacaggatttcactgtgaacacttgagaactatagatttcagtttagatgaaagaaagctaagtatgttatcttattgggatcctcagataaaaaaaaagttctactaataatgacgactatataatctgaatatacttgaggctgaaattttgcccattgattgtaacttgctggatgaggcctggttgccggcagattgacttttggtaagggtgttgcagtggtttgaagtgggtgtgtgttggtatatgtccttagtcataccacctgaacagtttcaagggaactagattgtttgagaaaattttctttgttatagtatagtcttactggtttgcaggagagcggtgagattctagaaacagtgaccctattagctgatcttttccattaaaaatattttggattgctcttagggaagtccttaactcatcattgccttaatagttttctgtttgtctcaaacagggtgtgccttcagacctcatagttactatttgttaaattacttttccaaggctacacgttgcttcttcaatgcccttagtgacttaacctccctttgtctagtcaaaccaatgctcttccagagtttatttggtcaaaatatcagagatgccatattagaaatttctaatgtgaattcattttttaatataaaaccttagtgtatagtaagtttatatttggttaatttacatcttcaatttactttcaactaattttctttaattcttcttgaggtagacttttcatataaatatttgctgttgatcattttctctatcattttagcagtataaaatgaacaaaggcatgcttgagagttttgatatttaattgtaatgtccttatcactttatcagttattggaaacttctggttctgttgcttcattcaaattgggtaaagtaaaaagttactgaagatccgctattgtgactgtaaactaggtctatggactagtggtgtcagcatcaactggaagcttgttagaaatgtagagtctcagccgggcactgtggctcacgcctgtaatcccagcactttgggaggcccaggcgggcagatcaccagaggttgggagtttgagacaagcctaaccaacacggagaaaccccatctgtactaaaaatacaaaattagccgggtatggtggtgcatgcctataatcccagctacttgggaggctgaggcaggagaatcgcttgaactcgggaggtggaggttgcggtgaactgagatcatgacattgcactccagcctgggcaacaacaacaacaaaaagaaatgtagagtgccaggcccactgcagacctactgaatcagagcctgaattttaagataccccgcaggtgatttgtgtgcatgttamagagtgagaagctccggactaaatggtttactacttacttctactttaggattatcaaaaataaatggtggtagtgaaaataatgtacagaaagtaccttttttcccatctgctgaatgtctgcttttttcttcttaaatttctttttaacgaagatactgctgcatccacattgtcttgtgatctctccagccatccatcttgtcattcttttgggcaaccttcctcttagagcaagcatgccctgggaccctcccttgagttctctactctttcttcgttaatattttgtttggagacacatataaccagtatggaactatctatgctttgcatacttttgattgcccagtctctctacttccgtctgccttgagccggcctggcatttaagctatactgagtctgttccttagccagtgctgcctcttacctctggctgcatgttagaatcacctggtgagatttaaaacagattagcagcttggttccatcccagatgaattaagtcaatttctaggggtgggttctggcagcagtcatttaagtcagtttctgagatcagggtctgggtgattctgctgtgcagccatgctttaaaaccccaaggctccatgctattcattcatcatccatctgccatccattcattcatcgatttaccccacaaacatttcatgagattctcctgtgtattagatgcttttctaagttccaagagtttttcacctcagcactgttagcattttgagttggacatttgaagggctgtcttgtgcattgtcgggtgtttaatggaatccctggcttttactgacttgatgtcagtagtgtcctctgcagttatgacagacaaacatgtctccagacattgcaaaaaatgttctttgggggcaaaatttcccccagttgaggaccgttgttctaggtatattgatgaaaaattttttgttactcaatctagttctattgatgaaaatttttaagtgcctaaagacagacacttaattacagtagggtgggacaaacatagtaagagcttcaggacaaagtacatagacaacactatagagggatgggaggtggcatttaagttgtgcctccaaggatgaatggttatttgctgggtgggcaaaaagaacactccatagtgagagaatagcacttacgaaggcgtggaattatgtcccatcatctcccacctcatgcatgggggtattgtgatccacttttcattcatcccacctgcctctacatcctgtttaatatttcttctccatgtgttgacagtaccactacatttatcactttgctctgaaactgcaagtcatctgcccttcattacaaggttgagtctttttttaataagaactttattgagatataattcatatatttgtattagtttcctatggttgtcacaacaacttaccatgacagaaatttattctctcacagttttggaggccagaagtttgaaatcaaggtgtcaccaaggccacacgccacctggaggccctaggagagaacgctagaacgcttccatgcttcttccagcttctcctggctatrggcattcctggctttgtggccacgtcactccagtctctgcctccgtcttcacattgcctccctccatctgtgtgtgttaatctccctctgtcttttttgtataacaacacttcttattgaatatagggcccacccagagaatccaggatgatcttcttatctcgagaagcttaatttaattgcatctagaaagacccctttcacaggttgcagggatgaggatgtgagttttggggagccactgttcaccagcttcctacaattcatcccattaaaagtgtgcaattcaattgtttgtagtatatttacagagttgtacctccatcaccactatcaattttttattttttccacccccgacaacgcaacattttgggtattagtaatcacttcccattttccccaaccccagccctaggcaatcaccagtctttctgtctctgtgaatttgcctagtctgaacatttcatataaatggaatcatacggcatatggccttttgtgactggcttcttacattatgtcttcaagattyatccatgttgtagcatgtatccatactccactcttttctattgttgaataagtctcaattatatggatatatcacattttgcttatccattcatcatttgatggacatttgggttgtttccactttttggctattacatataatgttgatatgaacgcttgtgtacaagtttttgtatggatgtatgctttcatttctcttgggcttatacctagaagtggaattgccaggtctatggtaaccttctcaggaactgccagactgtttctaaagctactgcaccattttccattcctgccagtcgtgcatgaaggttccagtttctcctgtttctctttgtctttttaaaatttagttctattgtcaattctgcattttctgataaccttctcaccaagggtagaaaaatatttccattccttttctgttaatgtcacaattttttttctcacttcaagaaatgaaaggcgatcagctcttatctattctacatataacatttacttttggtctcactgtacttcccagaaacttagtagaaagcaaaatattaacttctgtgtgtgtctccacatccataatcattttagctccaaaacctgtagtgttctccctgagctgtaagctcaatgagagtaggcgccctgatctttctatttttctcgtaaactttgtctgcagctcgtggtgactgttcagtaagtattaaatgagagtgtgattattgcctcatgtgtaaagggatttaatattttataggctgagttgtttttcttaattatgcatacatttctgaatctctaataactgtggttattgtttttatgtgcagatgagcaggagactaaagatgcagcagaagaatgtaaagaaccctaatcaaggacttgctgggtgtgcttttcagaaagttggtaatgaagttaaattaaatttcttattgaattatttgaattcaatgaatgcactgcagagactattctttattgattttgacatttggagtcgctctttgtggattatatttccttgatatttttgagacttggggtgtaattgttcagtggtttttgctcattaaaatttctgggaccattgtttataaatttattgctaatcttacagtattaggattcattataaaaaccaacattttaatgtatacgtgttagggtaaaactcgttgaagtgctgtgattgtcctgtattcaattttgtatgtttcacctctactgtgattcagacagatcatggtggtcactgggaatttttgctgtggccctgcttttccttcttcccacttgtctcatgtctgtgaaactggtacaacctgccataagatgaaatgaattgtctcaacaaagcaatattagaagagcctttactatcttattggtgatgacacgtttcttaagtaggagtttgagtgaattatttgatatattactttgttaataatagttaacaatagtttcttattttctttcagagtttgggccttttagattgcatcaaataaagatgagctactttaaaagacagtctgcggtactatttgaagagagatggtttagttacaagtcagtaacttagattcatgagaaaattttgtgttgacattccataagatgagttggcattagaattggaagtccagtttatttctgaatcaaaaaatgagcgggctattgtgctgcctttaataaaatttgagtgatgtatacataacattgtttttgctggcacatgttcatccactgatactgaataacattaatgattgtttatatggaatttccttgactttttaaaatgaggaattctatagctactattttcagaggtattgataggcagtttctttttccagacactatttcagtttactatttgttcatttaaaatagcaattgttcatgctgatgtcaatgtgctacgtataatttatcttgatgccaagagttttgctgtgggatggaagtataagttaaaagttgtgattttagattctcataggaatgccatgaggcacactctgtgttttagggtttgggtgggaagaatcagagggcaaaggtgatatgggtgagaatttgttgtggggcagagaggggccagtgttgtccgtcagcgtttcagaggagttcagctttctaaatctatgcttttctggtatttgatgtttgtatgtatgagagagagagagagagagagaaagaaggaggagggaggggaggggagggtaggaaggaaaaaggggagggaagagggagacagaaagaaacacagagtaaaattatttctagacttgcactgcaaagggcttatgactttatagtttgcttctgccaatgatatttgggacatagtgagcctttctgttatttaggtaagggggaagaaaatagagttattttaagtaatgaattctgccataaaagaggtgggaccattcacagcatgtcaactgaaggtaactctaacaaggactggtaactaagtctgtaacgtaattcaacacaaagcttccggattttttttaaaaagtcaccctgatttagatagaaagtgttattaaaaatagatgtttttattttggatttccctttagggcttagtgtttgtccggaacaaggtgaaaccccgtctttactaaaaatacagaattagccaggcttggtggcgggcgcttgtagtcccagctacttgggaggctgaggcaggagggagaattgcttgaaccggggaggcagaggttgcagtgagccgagattgtgtcactgcactccagcctgggcgacagagcaagacttcatctcaaaaataaaaagaaaaagaaattatagaagagagagagagccaatttatttaaggaatgaattcaggagcttaatactggaggcttttctacatgtgactctttagaaaaaaaaaaactgctggcaccacctttattgtatgtacattcttataagacctggagtttattgctcttcactcgagctctcccacaacacatgacaataaactgttggaggaggaaaaaagctatcatctcgatgacataattttaatttttaacaagtcctttatttcagtacaacctgattatttgaaggtcagtcttagggtgaaactggaacatgcctggaagaaaagctcctctttccagtcactttttctgtcttatcttggtattttcaatcagttttgcttcactatccaagaatgaattagaattatctcccagcacttcaaacgttgaactcttctgataatgaatgatggtatttaattctttgccatttcaaagaattatttccttcacatcagttttcctaactccacagctattatcaacactttctagttcctgcttcttcaccttggtactataaaatgatttggcaatttacatttgtatgtgatcatggctactcagaaagatgagtatttatagaatgagagtgaaaatcaacaaggaagattttatctcacccagccagtcctttctagtgtttaatagacctcaaagccagacctttaacctactcataaaatttcttctttgatctgttttcattaaaactggaaattaactggtcagtattccacattcataattagcccatccaaaaatcaaggtctgcttattggtacacttgggccttttcttcacatgataatttgtatttagacacacacgcatttatggattccttccaaattttacattttttagtcttcttttttgattaaacttattattccttcttcaagaggaggtatctgtaatgcttggctcaacattgcaaggacagctcctccctcatccacatttacttccgaagtgtctccacaacatgcaatcgtgttgcccacccaaggcatcattcgtgggtcagaaaatgtcgctgtgagagttgcgtgtgcttcagtgtttttccctttgttttcatactgcactttgaaaaggattcaatgacatctaatgaccttaataagaaattttattcttatgggggcccttgacttagggataatttctcttttatatgtttttgatatggcaggctaatgtatcattttgttcttttattccacaaacgcagcaaattctaagcctaggcctgagcaactcagtctttctcaatcacatacaaactgtgaatgttgctatgacttactgtaatttatttttgtatatgctatattgatttatgaatggtatttacgcatatacttcatgacataaagccagtagagaacaaataagcatggatacagtaagtataaatataaatttccatatgatttattgttgttccttgtacataagaaacagtaatatacaacttacactgctttagaatgtaaaatggataaaaatgtgtacaaaaaaaagcacattcctagaaaaaggtattggcaaatagtaaaaatgggaggtcaaaagcaaaaaaaaaaaaaaaaaaaaacaaaacaaaaaaaagaaaaaaccaacaattcttcaattcagtgtgcaaacattatataaaaatagaaatactaactctacaggcagtatttcctgataaattatttaaatagcatatctacacaatctgagatatctattccaatggcaatgagaaaataatttataaaaataaagcaatggtataccagatgatagaaaaaaaacataactttcagaaattgtatttaacatttcaatgctatttccttattgggaatacttctctgcagagtttttatgctatgtacaacactgactttttaggtactacagtagctttaagtttgttagacacttaaactctttccgcttgatccaaaaattctttactcagtcacacaacaaatgaggtaatatttgtatgtaagtttcaccttttgtcatttttttctcttttggaaaaatgaaagaaaaaagtgtatatgctttccttctccctggaaatatgcacaagggatggggtaaaacagtattgaagacctcatggctttctttgcaatttaaaacatttgcaaatggataaccaactaattccacttgaaaagataaaacagagaaaaaaagaatcccataacatccactctgagcacaaggggcagagcagcttattagactgattttccttgtgctgttcttgcaagagatttgctgataaatgtcaactacttgctctcaaacactttccgtatgaagcctaaatttccaggcagaacagagttaataaataatctgtatttacaatcttacagtcacgaagactctcaacaaagatgacatggatagtctttacgcttcttcctgttccatgaataatccttcagccagatcttccagaataagtaaaaaataaatattttacatcgtaaagcatttaaaaaaaatctacattccaaaagagagaattagaaaactccatgataattcaggaaaaaagagaaaaggaatgttttagttaggttgataataattttgtgccattgtaaccataaaaatataagcacggctgcccctcctttgggaggcagctggtgctcactgagatggtaggttttcctattttcctgctacatctgcacaagctacatctagaatgaagccaccaatttcaatgtgaccaggcaatggcagccagcactgccttacactggtttgattctgattccctaattctggccactgcaggtgatgagtaagggtggggatcagggaggaagtccagaagccagtctttgtctccctttcctgcttctatttaagtgcctatttacatgggttaatcagctaacgccagtcagcatcatgaaatccagcaatagtctttcaatcccctgaaaatgacttagtaccgaacatgtaacagttcctccatattttcttcatacaatcgtctcgggtatgcgccctccccttagtgctttggcctctgctccccgtgttcctgaaggaggatgtcagggtggttttgtttgctaattctagtgagtcctcccttctctgacatgcctgaaaatgcttttgagtccactgctcagagatggcctcacaatagcaccctgctctgtgacaaaggcagagtggaatgggcaccttcctaactgaagcaagtagatgctttttcaaaaggaaaccaaagcaattgtttatatgcttggaagatgtcttattcattggaggctgaatgctgagtctgtttttgaaaactgcattttcttgaggcaggtcgcacgttctaggagtccacactgatgcaagcacagaaaagaaggaagccaaggagaagtgatcctgggggttttctcaagcccatagttccagaaggtgcaataccagcattggtttatgatcagtctttcaatcaacaatttgatgattagggatctgttaaataaacaaatataaataaatatacaaatgaaaactaattcataaaagcatagacatcttagttaataagttaaccacataggaatagctctacttttctaatgacaaaagcctaattttaaggttgttcaagcacattagcatttaattttattagctgacattgatgctaggagaccgacacagcgtgaaccttccagaacatatattatgctttccaaaggctttcaatgttaacagtttagggagtcttattttaaaaatttggactcaaaaattacattaataatttagatttttttgagtaaaatcaaccatctttctctactgtcattgatcttttaggtatctggccttggcccagtaaatatatattaagcacttattttgtggtagagccagtgttggactcagcgagcttaagtaatgactaagtaaaaaagaatgaggaaaaaaaatgctaagtttaatagtgaacattaatttaacatgccaatatgaaagcaacattcctctcccttctttgtatacagggaaaagttgggaatgctaactcgtgctgtgatggcatgcataaaacaataagcagtaagatatataaatatataattgtaaagaacagtattattaatgaagtccaaattatataggagcttttctgcagcttacctttgcactgtgtatgaggagcacagagattgctaagcaaactaatattatagctaaggactcaggaactcataagccacagtgcctaggcattattccatttttgtccttgtgtcctcaaaagcaaaatagaaataaccctgtctccaaaacagtctttacactggactcccccataaccgtcatccttgatattagtctgaaatagagatgtccagtgtacattcatggtgatgttgctcttacctctacattcgtatttcaggtcagagaagaacaccatttcttgagagaagacaaacaaccctagtctaccaccagcataggttttatcatagatgggtcctgagtcagccatgattttcttcccttcatacatcaccactctgcagggaaaaaaaatcttgtttagtgacaatgctatttaatactttttgtctttttgtccctcagtgtgactgtaagtgaaagtgaatcagtatgatcgtacctaa

SEQ ID NO: 17992 - DNA, 15493 bp, Homo sapiens
ctgggagggtcttttttcctctgagaatgctaagtaaactgtgtgctgtcagcctttgttttgacttcaactcatcacatgaggtcatgtgtggaatttttctcttgtggcatcatgttaatactcaaaaaagttttggattctggaacatttacgattttgaattttcagattaaggatgttcaacctatataaccatttattttgcatgcagttttgtgagtatgaaatttgggaagggctctgctagacagtttgtctgcctggctttctgtcgggtaatgagatctggaacatgcacttcccaggtggtgtctttcctcacagtctctcaaatgctctggagcttttcttgttctatacctagcactggagcccctagggccccttcatgtggcttggacttctcatagcatgggggctctcagaatagttgcacttcgccgaagtgggaagtagatgttaccaggccaaacaagggctgcacctgaaaaagcgcaatgtcactattaccatattctattggtcaaagcagtcacagggcccaggttcaaaggagagtgacaagatcacattgcagaagagcactaggatcaggaggatattgtggctgcttttggaacatacaatctgccacaagctataatttatttatttttttgagacagggtctcgctctgttgcccaggctggagtgcagtggtgcgatctcagctcactgcaacctctgcctcccaggttcaagcaattctcctgccttagcttcccaagtagttgggactacaggcatgcgccaccacccccagctaatttttgtatttttagtagagacaaggttttgctatgttggccaggctggtctcgaactcctgacctcaggtgatccacccgcctcggcctcccaaagtgctgaaattacaggtgtgagccaccgtgcctggccacaacctataatcatatccttataaatgtattacgtagaaataatccaaggaatatataagaacagaaaagttcgtctcaactttagtagggaaaaaatttggaaaaaacctacatgtctcctgatagataaatagctaagtaaattatcacataccaactaacaggaatatgaagctgtagtaattaagatgattatgaaacaatttgaatgaaagttggtataaatggagaaaaagtaaaattaagaagcacatacactgtgatgataattatgtaaaagcctgtatgcatctggacaaagtctggaaggaaatcagtggaaatggagataattgcattgaggtggtaagattatgtaagccttagattttcttctttattgttatagcatcacaaaaaataaaaatgagaagaaaagaagagaattacaattttaatggtcagtgctcaatacttggtaggtacatgtactaagtgcagggaaggcaaaggggacactcattacactctaattcactcagattcagagaaacttccaggccagaggagccacagatatttataattaataacctgttttgaccccttatctttggaatgctgattaacatgaagcaataattactattaatatattagtctttcaatattgctgagactattcataagactgaaaaccctttaaaaagctcccacgacggccgggcgcggtggctcacgcctgtaatcccagcactttgggaggccgaggcgggcggatcacgaggtcaggagatcgagaccacggtgaaaccccgtctctactaaaaatacaaaaaattagccgggcgcagtggcgggcgcctgtagtcccagctactcgggaggctgaggcaggagaacggcgtgaacccggaaggcggagcttgcagtgagcggagatcgcgccacagcactcccgcctgggcgacagaacgagactccgtcccaaaaaaaaaaaaaaaaaaaaaaagctcccacgacacataaacataaggtgatattttaatctttatcataatgaatttatccaatccagggtttctaaaattgtcagtggtaatttggcctgggaatttatcctagaatactctgacgagaactagattaattctggtctcccacttcacagtgttctgtttgccttgggactcattgtaggtaaaaaggatgtggagtctggaatagtctatgcttatgaaaccgcaagcaaaattcctagagtggccctgaattcaacccatcttcctgggactatgacactcatggctatgggtgaaaccaacctttgaacagtcattgcattccagtactcccataacttgctagtcattgcatttttttcaaggcctcttttgaagagttattaaggaaggtaaaagtgcataaaggtcaaagtcttaagaaagtctgattaaataattgcaaaaacaattttttttttttgaggcaaagtcttgctttgttgcccaggctggagtgaagtggcatgatctcggctcactacaacctccgcctcccaggttcaagcgattctcctgcctcagactcctgagtagctgggattacaggcatctgccaccatgcctggctacagaaatgtttttttaaaaaaagaacatatcatgagttggcatagccactaattatgttaacatagttaataactggggaaaacctgaatgagggaagtgtttagattacatcttggtaaattattttgatttggttcaattgccttttgggaagttaaaaaaagggaaggggctatctactggttgccaaaaaaattactgatattcttagacttgtcaaaagacaaagttacaacaagtttagtttaaatatctcagttgggctgggtgcggtggctcatgcctgtaatcccagcactttgggaggctgaggcgggtaaatcacttgaggttaggagttcaataccagcctggccaacatggtgaaatcctgtctctactaaaaatacaaaaattagccgggcatggtggtgtgcacctgtagttctagctacttggcaggctgaggtggaagaatcccttgaacccaggagttggaggttgcagtgagctgagatctcaccactacactatagcctgggcaacagagtgtgactctgccaaaaaaaaaaaaaaaaaaaaatctcaattggctttatttgcaattctagaaacaggtaacactttgttccacaaaacagaatcatgagctgagcagaaggcattggcttcacagagcaagaaggaatgaagaaagaagcaggctgggtgcagtggctcacacctgtaatcccagcactttaggaggcccagaagggtggatcacttgaggtcacgagttcaagatcagcctgggcaacatgctgaaactccatctctactaaaaaatacaaaaattagccgggtgtggtggcccatgcctgtaatcccagctacccgggaagctgaggtgggaggatcatggtggaccagcccatgaggtggaggttgcagtgaactgagatggcaccactgtactcctgcctggacgacagagcgagactctgtctcaggaaaaaaaaaaaaaaaagaagaagcaaagattatgtccattgtttcaaagtgacttttcttgtaagatgagacaaggagatagaacaacagaaaaataactgattagttaacatcaggcttcttggggctactttttctgtgtgtgaaaggattaaagcagagggaaactcattatcgtgactcttgaagattaagtgacctgtttgggaatttggctatctctctctcctgctttctcttgagacaggaataatacagggtggttgcaagagaacagaaaattccaggcagcagtttcacatgcctagcaaaatgaaactgttgaaatagctccataaactggggactgataagaccatgaaaaacaggatgtgggccaagctggctaaaaccaactggacccaacagagagcaggatttgacctaggtttctcctaggacctcattattcacccattaataaacaaatcgcacacccacctacactgtgacaagaacactgtatttggtgttaaaatgggcagcatcacagttctgagaaatcttcacctttttccaggaatcttcatgaatagtccaccccttgggtaaagaaacccatataagaaaccccaagcccctttgtgcagctctctcatgagtatgcccatgctcccctttcttgagtgtgtatttttactttgcaataaatctccgtactttcacgattttctgactcatccttgaattccttctcatcatggtatcaagaacctgcacactggcctgggtcagggtttcatcagtgtttgggaacttcccccagcccactggtctcactctgaagatcagataacaacttattgaagtttggtgacagaactttagcatgggtgactccattttgatttttggttttgtctgttggagcatagtacagaaacttaatccaaaaaaacaacctcctatactttttattcaacagaatcaacatttcaggtttcttttttaacctgaaattggtgtttcatttaataaatgcttacctagtagttactcggtggcattatcctgtactttacagacattaactaatttagttatcaataacccattgagtagaaaaaacagtttttcctctgctctcacaccagtctcacagaagacttctgtgaccaaatgtgtgggagtttctctccaccagcaagaaataaaaaaaattagggggaagggcaagggggtgcacctatggtcccagctagggatgctgaggtgggattacctcttgagcctgagaggttgataggctgcagtaagccttgatcatgccactgcactccagcctgggtgacagagcaagaccctgtctaagaaaaattctgcaatggacactagctgggtggtggtggtggcagcagggggtggggggggcaggtcctctaattcaatccgattctcatactatctacttgggtagtgtcagatgccataggttgaggactcagtcccacttccaatgcaattgcaagccccaggttgttttgtctgtgcttctgacctaccaactataaatcacggttccatgacccccttcttgggggatttatttgctagagctgctcacagagctcagggaaatacatatctacatttatcagttcattataaagaatattattggcaggtgcctgtgatcccagttactcaggaggctgagacaggagaaacgcttgaacagggaggcagaggttgcagtgagccaagattgtgccattgcactccagcctggatgacagagtgaggctctgtataaaataaaataaagtaaagtaaaaaggctgggcacggtggctcacgtctgtaaacccagaactttgagaggccaaggtgggcggatcatgaggtcaagagatcaagaccatcctggccaacatggtgaaaccccatctctacaaaaaatacaaaaattagctgggcatggtggcacgtgcctgtagtcccagttactcaggaggctgaggcaggagaaccgtttgaaccagggagctggaggttgcagtgagccaagatcgcgccactgcgctccagcttggtgatagagcaagactccgtctcaaaaatatatatatattgtaaaggatacttgaaaggatgcatagggcaaggtatgggaaggggcatagagcttccatgccctatgtggggtgagaggcaccctccaggaacctccatgtgttcagctatccagaagctcccccagccagacctttggggtttttatggaggcttcattatgtaggcatgattgattaaatcactggccgtcaggattaacttaaccttcagccccttccccttcccagaagttggatagggctgaaaatcataactctctgattttgtcttggtctttcacgtgcccaacctccatcctgaagccacctaggggctgccagccatcagtcaactcattaggttacaaaaagacacttatcacttgggagattccaaagattttatgccaggagatggtaggaagaccaaataaatatttcacaatatcacatccctaatgtaggtcctattatcaccattctcattttgcaggtgaggagactgaagcatgagattaagaaatcaagaccgccttccccctgtagggscggccggcgagtcccagtgagagcggagggtgccagaggtagggggccgagaaacaaagttccyggggctccctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgagrtggcaaagcagtatatagagaaaagtcttttggttccagaccatgtgatcacacgcctaatgatgtcygagttggagaataggcgtggmcagcactggctccttgatggttttcctaggacattaggacaagccgargccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgaygtcactggtgaaccrttagtccagcaggaggatgataaacccgaagcagttgctgccaggctaagacagtacaaagacgcggcaaagccagtcattgaattatacaagagccraggagtgctccaccaattttccggaacrgagacgaacaaaatctggccctacgtttacacacttttctcaaacaagatcacacctattcagtccaaagaagcatattgaccctgcccaawggaagaaccaggaagatgtggtcattcattcaatagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaagggtggtcacctacacatgtttaaggtgtctctgcacatgtctcaagcccatcacaagaaagcaagtacagtgtggatttcaaatggtgtgtaacttcagctccagctggtttttgacagctgttgctgtggtaatattttttacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctggtcttgagtgactgtgtccacagttcatttttttccggtaggaataactccttttctacatccacactccatagagtctctccttttcagayatcctgggatgaaagaatttggcttttttttttttttttttttgacatctgttttcactcttaggcttttaaacaatagttattgctcttatccctctcagattctaataactgagagtgatggggctatattgaatctctgtatgcactgagaactgagctatgaagaggatcttattaaactgctggtctgactttatggattgacactgttcmtttcttttattgtgaaaaaaaaaaaaaaccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttatttttttttctgttccaaagattcatcctatggggtggccataaagtctagaattagatactaatattttgtcattcattataacatatcaataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagargcctattttaacactttagtggtgttgaaacacattacttactttctgaagatgtcccagtgaatcctctgtcaattcactgccatatgtaatctatatgataaggaatgcatcttccaagtactgcccaaacycttgccagctcctctcccattgtcccttcatgtgaatatttcttggctaccttagtggaaatatagatcagtcttctccccatccatcctctcaaacataatgagattgtttactttttagatttatgcagtgaaaatgcccagtcaggtctgaatcgtcartgcattatattgacyctgagcactttagaatttagagttgcaattgaatgccagctgtggagatggggtgcatatcagatatataaataaagctcaggtttgctagggaaccaggtatagagaaaaataagtctgatatgaggaaaattgcacaatttagagtagttatgccrtagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtaygggaagtggcctgatgcctgcttccatacttcactcctccatccatccttccctccctyttcccctccagctaaatggacaattctagccaacattgagtcactcaataagtctcaacagtgggtgtgtttgctgagattgtccagcagttgagcagtttggtctcacctccctcgctagttgagaccaaaaagagacaaataactttttcatggtctttgaaacataatgcttatttcgtggtcaatggctttaaaaaaatctgtttcttgttttcttcaacaaactcactagttttcccttaaatgatattgtaaaaattaaagtaatcttgaaaatgttttgacaaaagtaaaattaaagggacaaaaaaaaaaaagaaatcaagaccactagtgagtaagcagcccaggtaggactcaaacccagacaggcagcctccagagtcctgtacttaactgctatactatgctgtctggttaagagaatagatctttctttctttctttctctttctttcttttcttttctttctttctttctctttctttcttctttccctctttctctccttccttccgtctttccttcttttcttttcttttctttctctctttctttcctttctttctttttctttctttccctctttcttttctttcctttctctctctctctcttttctttctttcttttgacagtgtctaacgctgtcaccctagctggagtgcatggtgttcatagttcactgtagctttgaattcctgggctccagcaatcttactgcctcagcctccaaagtagctgggagtacaggcatacgctaccacacccgactaatttgaaaaaatttttttgtagagaagtagtctcttttttttcttttttgtagagatggggtcttttttttttcttttcttttctttatttttttgagacggagtgtcgctctgtcacccaggctggagtgcagtggtgcaatctcggctcactgcaagctctgcctcctgggttcacaccattctcctgcctcagcctcctgagtatctgggactataggtgcctaccaccatgcccggctaattttttgtatttttagtagagatggggtttcaccgtgttagccaggatggcctcgatctcctcatctcgtgatctgcccacctcagcctcccaaagtgctgggatcacaggcgtgagccaccacgcccggccagagatggggtcttgccatgttgcccaggttggtcttaaacttctggactcaagcaatctggccaccttggcctcccaaagtgctgggattacaggtgtgagccaccttacccagcttggaaatttcattataacacatatatctacaaagagtttgtataacaaaatatttccatatctaggtgtatgctttttgatcaagttgctgcaaagactcctatactcaaaatagttcataagccctctctactctagtttgtacaactctgcattaggaaagatgctatagtttgcaatacagctgagccatttagagtatttcttttttctcagctgccagatagtcatacaataggtaaaatatactgaaccttggcatggtgtgcttgccagtttcattgattacctccacctcccttgaccccatgaaacactcctggtatgcaggccccagtatagttccttgaatctaggctggccttgtgactctattaaccaataaaatatggcagaagtgatgctgtgctaagtccaggcttaagtattggaaagactggtatcttccacattttgctcttgggaaccctgacctgcacttaagaagtccaactaccttgctgtacagaccacatgcagatgccatgtgaagagggatgtggagcggggagcccaggcctgctcttcccaggggcagagaagtcagggtttgaggaatgggggaagagaatctggtaggttcgggttgggagtacagggtagtagctggttaccaaccttttcagaagaattttaatattttaacattgagtgcaacaatagcagtacaaaccagttgaaaagtagccatggctttagcaagtaggctatcaagatattactccttttctgaattcagagaggttattttcaaaagcagagaagttggatttcagttttgctgtttcttgtcctgtaatcaacttgctatattcctagaccttggataaaattaaccaacctatctgttaaacatgggaatgtggtttatatgttcagtttagggtaattttaatacaacaaacaattcaagtattacatggaaataatctcaaaaatttagattcctatatagttcaatttgaaaacattttatattactactaaatattatctaagctatgtgactataagtaagacctatttttttatttttattaaaaaaattttttttgtagggatagggtcacccaagctggtcttgaactcctgggctcaagtgaacctcccacctaggcctcctaaagtgctgggattacatgcatgacccaccgtgcctgaccagtaagacttttaatattaccgactgtatgttatgtgatattaaggggttcattttttgtagatgtgacactggaattctgattgtgccttgaaaagacaaaaagagttttatctcctagatatacgtattacagtattttctcatggaatgacctgatgtgatatctgacagttgatttttttttttttttttttgagacagagtcttgctctgttccccaggctggagttcagtggcaccatcctggctcactgcaacctctacctcccaggttcaagtgattctcctgcctcagccttccgagtagctgggattacagttgcctgccaccatgcccagctaatttttgtatttttagtagaaacagggtttcaccatattggccaggctggtcttgaactcctgacctcaagtgatctgcccaccttgggctcccaaagcgctgggagtacaagcatgagccatcatgcctggcctgacagttgattttttaatttatttttctaatttaatttttaaaattttaatttattatttatttatttatttttgagacggagtcttgctctgtcgcccaggctggagggcagtggcacaatctcagctcactgcaagctccgcctcctgggttcacaccattctcctgcctcagcctcctgagtagctgggaccacaggttccagccaccacgcccggctaattttttgcatttttagtagagatggggtttcactgtgttagccaggatggtctcgatctcctgacctcatgatctgcccgccttggcctcccaaagtgctgggattacaggcatgagccactgtgcccagcctatttttaatttttttattattttttatttttttgaaacggagtctcgttctatagtccaggttggaatgtagtggcacaatcttggcccactgcaacctctgcctcttgggttcaagcaattctcctgcctcagcctcctgagaagctgggattagaggtgcacaccaccatgcctggtgaatttttgtattttagtagagacagggtttcaccatgttggccaggctggtctccaactcttgaccttaagtgatccccctgccttgacctcccaaagtcctgggattacaggcatgagccaccatgccctgaccaacagttgattttaaataatctagtgtgcagggggtgagagcagaggggttgtaaatgaaatagattggccatatgttgataaatgttgccatatgttgataaatgttgaatctgggtaatagatacatgggtgctcattattctattctttctattttgtgtgtgtttggaaatttctataacaaaaagtttaagaaaaaagctcaatagttattcgagatttgttcaaaacagacatgagattgcaattgttttctacctttcacttgctttagggttgcttttcttgaaaggattttgtgaaattgtatgttttaatacgaatataaaaagtagtgtgtatttaaccataacctcttttatagtagcttctgggtgcctcctatacacttccaatcttagcaacaagaataaataattccctctaatttggcctcaacactcaactgctgtcacattaattgctacgtttgtgtagctaatgcctgcctgtagccagtgataacattttaaaatacattacaagatggacaatattttagtgcctaaattcagatattaaccttataagctttccattttttggtaactttttaaaagttaaacattttaaattctgttattgtcttatttctttattataatctggccgtatgttatcttagaggcatctccagaactcactttttacccaacaatgttgacaaggtggctccaccatattttaaaatttctagctataccttatatagtatatatccctaagtaagatattcttcactcactcttttcactggtatttataatggattcagtttatagataactataatagatttgtagaaagggaatttataaaaaggcttaagtgggtattgtaagcttgaattttatgttctttttttaattttatgttcttaataacttaaaatttcaaaactgatgtctgagggttacctattattttctctattcatttctatttttcatttttatgtattttcatttttttttttttgagacaaagtctaactgtgacacccaggctggagtgcagtggaacaatcatggctcactgcagctttgatcttccaggctcaagcaaccctcctgttagaagtaaaatgttgtgtttttttttatttttttattttattattattatactttaagttttagggtacatgtgcacaatgtgcaggttagttacatatgtatacatgtgccatgctggtgtgctgcacccattaactcgtcatttagcattaggtatatctcctaatgctatccctccccccgccaaaaatgtttatttagaaatagaatgcttgttccttggtaccacaaggaaaaatcagcatttagacaaaaagttttctcagcaaggcaattttaccttctgcagaaagggtgctcctcacagatggaacaatggtgagaccacacccgaacaaaggagggaagcaattttattccttacacagcttgtccctgctaatgtgtcctgtctccattggctggagctggacctcacaatctaaattaaacctgactggctaataacttaaaactttcctaaataggtaaaagcaaaggagaacaaagaaaaagaggaagttgcttatgaaaggaaacaaatatcttggttaaagtacaaagacatagaatgtactcattcccttatatctagcagctacataggatagggcttaaccaagagttattagcataaagcaaggaggcttgagggaagttactctttaaaagaaactattacttctaacacttatgatttattctttaacaagaagggaaattttgaagagaaaactttttactttctacacatcccatctcagcctcccaagcagctgggactacaggcacatggcaccaaatctggctggattttgtattttttgttgagacaggttctcactatgttgcccaggctggtctcaaactcctagcctcaagtgatcctctcacatcagcctcccaaagtgctgggattataggcatgagcccctgcacccaatctctactaatttttaaaggctaaaatatgctattatttttgtgattttttagtagtcatttaaaaatttttcttattgaattaattaaataatttttagaaatggagtttgctatgttgccaggctgctctgaaactcctggccccaagtgatgctctggcctcagcctcctgagttgctgggattacatgcatgagccaccatgcccaactcagaagtctatttcatatcacacgtatgataataatttaatcacaaaggaccgtacatttaataatgtttataagagctaaggagatcaagcaaagatgtgtgaaatgagtcaaaccttcaatcctctcagtctggtatttactagtgtaagaaaaaaattaaaatgtataacttgaattacagttgactcttgaacataggcgttaggggcaccgacacttcctcaagtagaaaatttgcatttaacttttgactcccccagaatttaactactaataacctactgtacagcacaagccttatggataatataaacagttgattaacacatattttgtatgttatatgtgttatgtattgtattcttaaagtaagctaagtaaaagaaaatgtgaagaaaatcataaggaagagaaagtatgtttactgttt

SEQ ID NO: 17993 - DNA, 21498 bp, Homo sapiens
ctgggctatgcagcgagactccgtctcaaaaaaaaaaaaaaaaaaaggtaccagtgtgtagtaacattgtgggtgagaatctttgctctttatacataactgtttaagtttcagttttgtttttgcttttactgttttagctgaagcacacttggccgatgttaagctaaattatcagtagatggcaccacagtcttagttagctgaagatttctgggttttgcagggagtgaggattctagtgtcagttgtcggatgtttaggtgtgactcagtgacctatgcttaaaagtttgcccggttactaactgagggagcaacaagtacaaactgcagatagggaattgaaaaaaggaaacacacaaatttacacagacacggtgcccatagatttgttgcaagggcagtttggtagagagaagctagaaggaagctgaagctccagaaaacccaaaactacaaacttccttcaaaagtctagggagaggccgggtgcggtggctcaggcctgtaatcccagcactttgggaggccgaagtgggtggatcacttgaggccagaagtttgagaccagcctggccaacatggcgaaacctgtctctactgaaaatacaaaaaattagctgggtgtggtggcgggtgcctgtaatcccagctattggggaggctgaggtgggagaatcacttgaacctgggaggcagaggttgcagtgagctgagatagcgctactgcactccatcctgggtgacagagtgaaactctgtctcaaaaaaaataaagaagacaaataatagcaagtgttggctaggatgtggagcaattggagatctcatacaatgatggtggaaatgtaaaatgacacaactattttgttttattttatttctgagacagagcctcaccctgtcgtccaggctggagtgtggttgcacgatctcagctcactgcaacctccacctcccgggttcaagtgattcttctgtctcagcctcctgagtaactgggattacaggcacacgccaccatgtccgactaatttttgtatttttagtagagacacggtttcaccatgttggccaggctgttcttgaactcctgacctcaggtgatcctcccaccttggcctcccaaagtgctgggattacaggcatgagccatggtgcccagcaggcacaaccattttagaaaaagtttgcagttaatcatacacctactatatgatctagccactgcactcctaggtatttatgcaaaggaaagaaagcctaagtctgtacaaagacttgtacacaaatgttcaaaacagctttatttgtaatagtaaaagaaagaaagaactcaaatgttcatcaacatgtaaatggataaacatgggagcttatctatatgtacaatgaaacactacttagcaatataaaggaatgaattattgatgcaggaaacatggatgaataaaaataattactaatgaaagaaataagacaaaaaccgtataaactctatacaattgcatgcatatgaaaatctagaaaaagcaaagtaatctgtagcgacagaaagccaagaatggttgtggtagaagggagaaggactggacgggtgccgtggctcatgcctgtaaacccagcacttcgggaggctgaggtgggcagatcacttgaggtcaggaattagagaccagcctggctaacatggtgaaacgctgtctctactaaaaatataaaaattagccaggtgtggtggttcacgcctgtaatcccaggtactcgggaggctgaggcatgagaattgcttgaacccgggaggagaaggttgcagtgagccaagatcgcgccactgcactccagcctgggcgacagagtgagactctgtctcatgaaacaaacaaacaaacaaaaaaacagaacaaaaagataaaaaaaaaaaagtaggggaagaactggagggaggaattacacaggagcactgaatatattcactatcttgattttggtgatggtttcatgagtatatactgtaaaggaacataaaaactctcaaaacccccaaactcattatgccaaagggaaaattaagcctgcttacttcacaaccttgtgtcaaagcgctatacattagccagatccctacaaaaggaaaaggtctcaggcatttccagataactgccctcacaaatcgcgcctaagaaaattctttcctggctcctaaacctttcaaggtgtataataaatcttcccataaacaaggacatgtcaactgtcactttaagtctgtgacttaagtctaactccttgtccaggaacctaaagtctggtaaatttcacaccgactgtgtcaattataagccttatcttcccaagtgcaaaaacaaagatgacatccattattcttctacctatcctgagaagtctgaataatgaattcttcctttactccctattttcgaatgtttgccttatctcatgtatagcatagatgtactgggcactaattaaaatctcacaagaatgtcatcatttgcttcacgcctatctcccttttcctgcatgtcttttctcttaaagaaatgtgtaaataccgagtctcctgaagcctttcccaaggagcacgggccacagactcatgtttctgtgactcagggttttcctgggcacacctttaagctctggctcaataaacctggattgattgagattcttgcctcagtctctcatttgggttgacaatacatatgtcaggacattagactgtactctgtaaacatgcaaagttgccaatgtgaagtcaaatatacctcaataaagctgttaaaagtaaattttttaaatgagatactgatatgtaatgtttgttattttactcatgtatttatttgccttttctttcatttaacagagtttattgagtgtctgtgccagaggctaaaagaggtatgacatggtctgctttcaagtctaggcagtgacggttctgcttgatatgcttgttgtacatgcccataggaagctaagaaaataggaagattagcgtgtaggctggcatgttggggaaggcttttcagaggaccttaacgttgaactgagttctgaaggacgagtaggtggtttggacagtgaggagcggttagcagtggcagctttctgtcttcaacaaggcctagggatgagagaacaaggcgctgtgggaggaaaacaaattgcagcagagaggggagaagaggagtgttttgaaaagaggcaggataggttaagtcgggactgatcagcatgggccaggaaagctgtggtcaggaatccggctgtaccattgaaggtctggggagctagagcaggttttaagcaagggagaacacagatagcctgctgatgaacagcacaggccaatcgagtggagcaagagaaaccatcttgcccttagattggctagcattacggttaaacgagtgtatttaattagtctccaagtcctgctaatagctcatccttaatcattttcaaatgttccaattctttccatccctatcgcagttaccttagttctgtctccattattgtttgcttggattaccataatatcctccaatggcggtttccttgtcttcagtcttgccccgcctttaactctttgctacctgcagcataaaacatttttctaaaattcaagtttgatcctctcacctttaactgaaaacctgatctgctgctcatcaacactatctctgtgtttctaataatgatcatcactgtaatagcatacttagcaagcatttactacatgccaggaactgggctaaacaagatgtgcttttatcttattaaatcttcctaaaacattattactatcatcactattttacagatgaagaaactgattattaagaaggtttagcaatgtgtccaagatcatacagttaataagtgtaattgaataacttgttgaaaaaccaaaaaacccttaaagacaaagttgtgtagggaatagaattttttacttgcacctgcaagagggaccgattattagagaactggctttgtaaacaaaaatgtagggcaggtatttaaagtaaaaaaatcacaaggatagacaacagctcaaattgttatcagttcacaagtctgcttggatgtatgtgggtcaattttgttaaaatctagacggtcctttctattaagacattacaatgcatcaacaccaaacaacagaaaagaaaatccatatatccctgtttttcatgctttgtctgggactaaaggaagggcaggccttttctagactatggaatctaagtttcagaaaaaaatcatttaagctgcaatataaagaataatcttggccggtcgcagtggctcacacctgtaatcccaacactttgggaggccgaggtgggcggatcacgaggtcaaaagttgggcaccagcctgaccaacatggtgaaaccccgtctctactaaaaacacaaaaattagctgggtgtggtggtgtgcgcctataatcccagctactggggaagctgaggcaggagaatggcttgaacccaggaggcagaggttacaatgagccgagatcatgccactgcactccagcctgggcgacagagcaagacttcatctcaaaaaaaaaaaaaaaaaaaaaagaatagttttaaggaaggcagaattagagatagacaagttataggaacccaggcaagccattataatgccaaactaaggcaatggcaggagggatagaaagaactggaccagttttaaatccattatgggacaggaaaggcatgttgcagtcccttcagccaagttgcaagttttgaatgagttatccaaacattattaaatgcatcttcagtgatgactaccaagcttttttccaggaaccaaccctcttttgtaaaaatgttaggttagcctgttcgttctggtttcttgggcagtgactgggatgttcaaactattaattgggatagaacaccgaagctggttaaaaacaatatttcttatagaaattgatcttgaacatggatcaaggttcactgctagcaggagaatcggagagtgtgtggtaatgaaaagttatagttgagaaaacaagcgtttacatcagcaactaattaagaaaaaagcagctcataagtggatgaatgcagttcataaacacattatatcagttattacacaggaaatctaaggcagaatactgtgaaatgcaaggtgtatagcttatcaacaagaatgtagcaaatacaccattcaactaagaaagaaatgataaggctgcatctggggctgttgactggaagcacaaagtttcctttccttgtagtagttcctaaagattccagtttacatggaaagacagaaagctgtcacacccatggcaggagcgcagaacccaagcgacaaattctaattttgaacaggcaggtgccagtgcatttctcaaactgcaaactaaaatgcagaaacacgattttcctgtttcttagttttggaccgttttcccccctctagcacgccagagcaggttttaattgttgtcaggtcagatggtgagttaactttgagtgttgagttgaggggccagtgggatgtgggtccagttgaaaggtggatatatgtagatccagactcgagtgatataggctgcaaataaattgctagtgaatttatgaattattagaaaagaaaggacattcattatgatttaatcgcagttgaatgtaggcagcacagagggcttatactgtgtcttttttttttttttttttaaatatacggtgtctattttgctcaccactctatgcccggtgcctggaagtgcgactggcacatagtaggtgttgcatagtttcagaatgaactttttaggaatcaaaattctacaaacattgcacacagatttaacgttcccttattttccaggtgaggtcagggcgccctttggtttcgcgcttctgtccctttaagaaagtggaggagaaagaaagcgctgctgggaaaaagggcggggccgcgaggggccgccgtccgtcccgccccctgccgggccgcggcgctctgctagagcgtggctcagttttggtagcgggaccccggaaatgtaaagcatgagcgggaacagtcgccagggcgagtgacaggcgagccctatgctttacttccgagggcggtgtcagcaaagctaggtaaggagacagggaggacggtgcctgcccctttaagatcgactccaccccgcctctggaggaaaatgacgccgccgtctacccgttgtggaacgtaactcttttcatcccatcagctctccttctcattaagagaaataccaagtggtcaccacagtcacatacttcataacccatgcctcatcggtgctgggacgggagagggaagcgccgatctaaatgacatggggtccaaatcccaaataatctctatttgctctgcgttacctttaaacttaggctgcgttgtgtgattcaagtgacagcctagtactgcttaacaattagtctagtgggataccaggccctgagagacccctacgatcccaggacactgatgtggggtaactaacacccactggaagtctacgctgagttcacaggctatgtatgacctgacatgcattttgacctgccctgtgttttgatatttgaatgagttgctgatgtttacaagccgaagctggccgggcgtggtggctcgcgcctgtaatcccagcactttgggaggtcgaggcaggaggatcgcttcaggtcaggagttccagaccagtctggccaacatggcgaaacctcgtctctactaaaaaaaaaaaaaaaaaaaatacaaaaattagccgggcgtggtggcacgcccctgtaatcccaggactcgggaggctgaggtaggagaatcgcttgaacctgggagtcggaggttgcagtgagccgagatcacgccactgcactccagcctgggcaacagagactctgtctcaaaaaaaaaaaaaaaaaaaaaaaaaaaggtggaagctaatgtgtcaatatctagatttttttgatgattttgagaaatcggaggatctggcagcatgtcctgcctagcctttttgaactgtttgaaaacagtctccagcttgccacagcccctctgttattttacagccagcctgcatcactcatttatgatgtccagccccttgtggggatttggatttttgacccctaaatactttagtggatttaagaccatttaaaacatttatgcagaagagatccgaggtccccaaacaactgggtgtataagttgtgtttaagttgttcctcattctcatttattctaatccgggtgtttttctatatatatatatttttaaacaaatcttagtgatcaattgcacaggtgtttttctgttggagcaaatcttttcagtttaggcttggtaaaatcgaaccatcagatacttttacagaaagagatttaggagttgatgttcttttattacaattaaatgcatacagtatttttaaaggaaaaaacctgaatcttgattgcattgttttatgatacaacaatctttaatgaaatagagtagtcaatataatttgtattaatatatctctgcccacagacaattataaattcattaacccccagaactcttggctagacttcataaaggcaaaaactgtgtttgccctgttaactgctttatcccaccactagaatataagcttcctgaagacagaagacttctgttattttgttcacagttaccaagcatgcctactttgttaaatttatgaaagaactttaaaggtacagttggcccacaatataacaatatagcaatataaaattacaacaataaaaataacacaaaaatagtgtaacaactacttatatagcatttacgttgtattaagtattatgagtcatccagagatgatttaaagtaaagtataccacagcatatgcctagtttatatacaaatatgatgccattttatataagggacttgagtatcctctgattgtggtatcctggaagcaggggataccggaaccaatcacttgaggatactgaaggatgactgtatggctgatttcctgtaagaggcattttcttgaggattctttcaaaatcaaatgcttgtatatttgttgtgttaaattactaaaaggattctcttgtgaaaagtatcatttaaaaagattggattttcccaattgatgcaccaaagctttcatctgaaatgaacttgcacatgtgaatcatcagatacagtaatatacactgtaatattttatttcttttttttttttatgagacggagttttgctcttgttgcccaggctggaatgcaatggtgcgatctcggcacactgcaacctccgcctcccgggttcaagcaattctcaagtagtgagattacaggtacccgccaccacgcctggctaattttttgtatttttagtagagacagggtttcaccatgatggccacactggtcttgaacacctgacctcgtgatccacccgccttggcctcccaaagtgcagggattacaggcgtgagccaccgcgcccggccaatattttcttattatgtaataggatctagaaatgttgctcttcctcacaattctcagtattacttttcttttttttttcagagtcagaggttccggttgagatcaagttgggagacacacccttgttcattctccttgagaagcagctatwatcaacagaacattgacagaacctgtgtttggggaaaggactgatggctttgagtctaggttggaaagcacacaggaaccactgtggtctcctcttgcaggctctgcgaagcagtggtcttctcttgtttccctgtggccagtgtccctggagaggagctggaagctttttggaccctgagataaaggctttcctggaggagaacactgaagtcaccagcagtggtagcctcacccctgaaatccagttgmggcttttgacccccagatgcaaattctggtgggagagagctgacctgtggccccacagtgatccttactggkcaatctactggccaggaggccaagccctgtctaggtactaccctaatgaaacctttaaggcgctayagatctttgctgttttcagttccctccaacctctacaaaaaaccagagcaatgctaggcgtggtggctcatgcctgtagtctcagtactttgggaggctgaggctgtaagctgtgatcctgccactgcactctcgcctggcctgtctcaaaaacaaaacagaaacyggcaaaactcagtcttgttgttttcttttttctttctttctttyttttttttttttttggtagagacaggatcttgctatgttgtccaggctggtcttaaacatctggcctcctcaacctccccaagtgctggtattacagacatgagcctctgagcctagcctcaggttagccatattttttgttgccttgttgcgtaatttcccattctaacccaagcttatcaagctattttcccaagtaactgtctccccaagagaaatcctagagtcagctgtcaagaccctggatagctataagtgatccagaaatctcacctgttaggaggttcatagttcatagcgcatgaccattgcagagttcctagatggaagctaaacacccagtcctttcgctctcctttaattcagtgaatgtcgctccataaacctcacattccttccagagttgcttattttcccataaaacaggagctgtgagtgagtgggctgttcaaagtttccctcttctgttgggtgcagtgcctgtaatcccagtgctttaggaagccagtgcaggaggacagcttgaagtcaagagtttgagaccagcgtaggcaacatagtgatacccctatctctacaaaaaaaaaatttttttttttttgagacagagtctcactctgtcacccaggctggagtgcagtggtgtgatctcggctcactgcaagccccgcctcccgggttcacgccattctcctgcctcaccctcctgagtagctgggactacaggctcatgccaccatgcccggctaatttttgtatttttagtagagatggggtttcaccatgttgatcaggctggtctcgaacttctgacctcgtgatccgccctcctcggcctcccaaagtgctgggattacaggcgtgagccaccgcgcctggcttaattttgtatttttagtagagacagggtttcaccatgttgaccaggctggtctcgaacccctgacctcaagtgatccgccagcctcggcctcccaaagtgctgggattacaggcatgagccatcgtgcctggcagtagcagctatttagacagggcatgtatgcctctactttgccatagtgttaactggttgatgtcaagtcccaggttcttagtgccatcaacaaagaattggacatgacacatacaagtagcaaggcagcaaacagtttgttaagcagaatgcaatcagcaacgratcaggctgacctgcgagtggtatcagccccagtttgttatagttcatggccttttatatgttttttcctcacttgcttaaccttactttgtttttcgtaagtgaattgctcatcctggcctttccctcattgtgcctaaaccrcactttatttctcataagctaattgtgcatccttgcttaaccttattttatcttttctgacaaaattgctcatctttacttttagttcttgtaaccaaattgctactgcaacccctttccacttattttccttatcttgcatgttctaactcattgcttactcccgtatctcttactgcttactgtcttatttcatatgtcctgtttctgctatcttgtatgctttgcttttggtattgcttcagctagcctatgtccaacgggtccccttcacccctgacttcctctgccattctcctgcctcagtagtacccactgttccttattactccaatccgaagatcaagagtcagctgaaatttgttatttcagcgtttctccatccctcttcgcttktttggtaactatttagctccagtccaaattccttggttgaattggactttgagttttaccagagaggtcattatactacatttcaagcagcaggaaaatcactctatgatggagtcaagaggagacagtgactcttggattgagtttactaattttagtctttgttttagcagtattttgtcagtcttaattcgtggtgctcggtagtttctggaacatactaagtattcaatactttgtcagccgaaatgagagactgaggcatgagtctcaaccagtcaaggtttgttaagcccaagaaaaatgcaagtcacagaaaagtttgtggcctgtgctcttctaagaggtttttaggaggcacagtatttatacatttctttttctttctttttttttttttttttgagatggagttttgctcttgttgcccaggctggagtgcaatggcacaatcttggcagactgcagccttcccctcccgggttcaaacaattctctgcctcagcctcccgagtagctgggattacaggcatgtaccaccacgcctggctaattttgtatttttagtagagacggggtttcaccctgttggccaggctggtctcgaactcctgacctcaggtgatccacccaccttgcctcctaaagtgctgggattacaggcgtgagccaccacacctggccatttatacatttcttttctttctttctttttttttttttttgagacagagtcttactctgtcacccaggctggagtgcaatggcttgatctctactcactgcagcctctgcctcctgggttcaagcaattctcctgcctcagcctcccgagtagctgggattgcaggtgcccgccaccacacctggctaatttttgtatttttagtagagatgggatttcaccatgttggccagactggtctcgaactcctgacctcaggtgatccacctgctcagcctcccaaagtgctgggattacaggcaggagccactgtgcccagcctacaacttttttttgaaaaaaattgacttgaatagcataatcagtcagttgtgtggtactgtgcttcacacctgctgaagagaaagaccaaatgactaggtcctttcttctgccacctctgcccagctctggagatggactttttgtgtcactctagtcagaccaaacttgccaaggttggaccaagttctgctacttttcactatttcttttgtccagtcaacctaaagacatctcttttctttcttttccttttcttttcttttttctttttttgcatacctcttatttgctgagaccagctcggctggggagaccctaacccagtgacactagaggaattaaagatacacacacagaaatgtagaggtgtgaagtgggaaatcaggcgtctcacagccttcagacctgagagccccgaacagagatttacccacatgtttattaacagcaagccagtcattagcattgtttctatagatattagattaactaaaagtatcccttatgggaaatgaagggatgggctgaaataaagggatgggttgggttagttatctgcagcaggagcatgtccttaaggcacagatcgcccatgctattgtttgtggtttaagaacgcctttaagcagttctctgccctgggcaggccaggtgttccttgccctcattccggtaaacccacagccttccagcgtgggtgttatggccatcatgaacatgtcacagtgctgcagagattttgtttatagccagttttggggccagtttatggccagattttggggggcctgttcccaacatttatttttcctcatctctctgagacatgtttctcctttttaatttaggtatcttttggataatcctgatgttgtcagaggaaaatctgtattagatcttgggagtggatgtggagctacagctattgctgctaagatgagtggggcatcaaggatcttggccaatgacatagaccctagtaaggattcatattttaaaatatttaaggctcatcttttttttttctctgggataaatatgtacacatgctcagtgtggtagcttatcgttatatgtattttgtgattggacattgtgaatctctgtgcactgggacattatctgtaggaatcccctgaggtctgagtagatggtgcatttttcccaagaggatttgtgtctgccagacatccagagtaagcacttatgttaatttatgggctaggaatttcctgaaatatgtaaatagtgtttatttgaccccaaacccaagtgagtattgacctgtctttgagggttatttttattccattagaacccaggctgagacaggtaagtttttatttgatctgattttcttctggtctaccctttcactgagaatatagtccttgaaaacctttattttattttatttatttatttattttgagacagagtctccctctgtcacccaggctggagtgcagtagcacaatctcagctcactgcaagctccgcctcccgggttcacaccattctcctgcctcagcctcctgagtagctgggactataggtgcctgccaccatgcctggctaatttttttttttttgcatttttagtagagatggggtttcaccgtgttaktcaggatggtctcaatctcctgacctcgtgatctgcccgtcttggcctcccaaagtgctaggattacaggcatgagccaccgcgcctggctgaaaacctttattttataaaggagtctcagttctttttttttctttttttttttttgatacagagtctcactctattgcccaggctggagtgcagtggcacggtcttggctcactgcaacctccacctcgtgggttcaagtgattctcctgcctcagcctcccgagtagctgggattacaggcatgcaccaccatgcccagctaatttttgtatttttattagagacagggtttgaccatgttggccaggctggtcttgaactcctgacctcaggtgatccacccgcctcggcctcccaaagtactgggattataggcgtgagccactgcgcccagccaaggggtctcagttctaatttattgccatgctcaatcaagcccaagtctcgtttccctgtccacagtaaaaaaacaaaatcttttggttaatgaaatcagcaaatattcctaaaagtcccagcatttctaggtgttttgaattgtttgttttcaggatatccagtcatgtatttggaaattgtggtatagcttatattgggataacctttatacttctctactttaaaaaacaactttcatcaaaaaggaagaaaaatatattgttagcagatcttctaaattatttaatcaacatggaattataacagcctagcatataccaattcattttgtgctttttttttttttaagttgcaggaatggctattacactaaattgtgaattgaacagactgaatccttttcctattttaatccaaaacattttgaatttggaacaagataagtgggaccttgttgttcttggcgatatgttttatgatgaagaccttgcagatagtcttcatcagtggctgaagaagtgcttctggacctatagaactcgagtactgattggtgaccctgggcggccccagttcagtggacacagcattcagcatcacctgcacaaagtggtagaatattcacttttggagtctactaggcaggaaaacagtggactgacaacaagcacagtgtggggttttcagccttgagttgtcaaagtgcttccaagtatgaatatagtaatgtttggatctgactctaaaagttttctctataggagatactctccagtttaatgaaygtaattcttgttaaatggaaaatcttgtttttaaaatatgaaggtttagagttttgtttacttttgtcatgtaactggttctgtatttctatgcrtgccaattatacacatctctatctgcatttttttttctattttaaccgctgaaggaatatgattatacaatgccatactcaatggtggcagcatttaatttaagtaatggagaagaattaaacattgtagctggatctgtttctgtagtygaggacaactgtgatgtaactttgaattaaacaaacaaaacaaaacagaagaagactatatatatattttttctttttttagagacagtctcactttgctcccaggmtggaatgcagtggctattcagaggcttaatcattgggcactgcagccttgaactctgggcttttttttttttttgagatggagtctcagctctgtcgtccaggctggagtgcagtgactcatgtctcggctcactgtagcctccacctcccccaatcaagcgattgtcctgtctcagcctccagagtagctgggattttaggtgtgcaccaccatgcctggctaatttttgtatttttagtagagacggggttttgccatgttggccaggccggtctcaaactcctgacctcaggtgatccacccgccttggcctcccaaagtgctaggattacaggtgtgagccaccacgccagcctgacgatgttttttacttctatcacttccttttgattttttcttatagcttctatctctgcttacgtcacccatcattcttgcgtgttgtatgcttttcgcattagagccctttgcatgttaatcagttattttaaatttatgatctggtaattctaaaatgtctgccataactgagtctggttctgatgcttgttttcttttcagactgtttttttgtcttttagcatgccttgtaattttttgttgatagctagacatgatgtattgcataaataaacaagtaaactaaggtagcatgaggttttaaaatctgggtagggctactgtttgctgtagagtagatattacaggctaaattttcctctagtgtcctggctattgtctcctctgttatctttgagtttccctagagattccttcttatatagagtctgaagcttgcagtttttttcacctgtaattccctgttattatacagtagcctaactgatgtgataaggtatgggagaaggtatgttctatagtcctgtgattaagtctcagtcagttaagtcagcctgtgcccctgctgtgaccttcacaagtgctttcagcttttcttttgtcactttggtgagacaggaaggctagaggcagctggagttgggtgcttcctttcccccaggtcaacgaggctctggtaaaatagtttcccttgagaactggcttttgttaaggagaactgaacacttgggcatatttcaaaatggttactttccctatcctcataccagaagaggggatttttctctgatcctcaccctgagaacctggtaggtatcctggaggtaaaactatgaaagtgtggtgtctcccctaggagtgggccccctggagtttgtttgttttaatttaacaaagtttaattgagcaaagaacaatctgtgaattgggcagctcccaaaagcagaataggttcagagtgactgcagggttgccacacctggttagataacgtttatggacagattcctagagcttttgattcttttttttttttttttgaggcagagtttcactcttattgcccaggctggagtgcaatggcgtgatcttggctcactgcaacctccacctcctgggttaaagtgattctcctgcctcagcctcctgagtagctgggattacaggtatacaccaccaaacccagctgggattacaggcatgcaccaccatgcccagctaatttttgtatttttagtaaagacagggcttcgccatgttggccaggctggtctcgaactcctgacctcaggtgatccacctgcctcagcctccccaagtgctgggattacacgtgtgagccactgtgccaggctggagcttttgattcttaagtccatccacatggagcctccagcaactcaggaattacagcataaatgttcctattggtactggctccagcaacaggcttctgctccctgtaagctatggttctttgtatttgcgtttctaatttgtgaggcattctctctttaaccttaattctctaatggatctaagtgttgttgacttttcagtttattgagcttttttcttattgtgaggatgggaatgatgacttccaatctctttatattagaaaatataaatcagactagagactggaaatttttgttgttgttgttgggtgttttgttttgtttgtttttagacaggtcttgctctctcatccaggctggagttcagcaatgcgaccgtgctcactgcagcctcgactttctaggctcaggtaatcctcccacttcagcctccttagtagctaggactgtaggcatgcaccaccatgatgcctggctagtttttttattttgtattttttgtagacatggagtcttgctacattggccaggctgggtattactgggtatttctttctttcctcctttatttctttccatatttacttattcaatgaatatttgagtgcttattatataccaggcactgttctaggcactggggatatggggatacagcaatgaaaaaaaaagataaatactttgtccttatgaaatttgtattctagagtagggagacataatgaacaaatgaaaacaggcatcagatggtgataggtagtaaggagaaaaagaagtaagggtaatagggaatactgggtactggatggggtacagatattttaaacagagtggtgagaaatagttaatacagctagcaacataaaaaaggagaaatatcaaactgcaaactgttttaggaagataaatccttcatagacccaaagaagctcacaatttagatgtcgaaactagtttctgcaaaaaggggaaaatgtgattgacttggttaaatattcagtattaaattttattgaatttgtctttagaaaaatttcatagttagaacaggccttacccattttgcacatatatacatatgcaccacctttgcagtggcaacatatatatccacactataaacataccacatttataaatcttgtaaggacaagaaatggagttgaataagtaccccccaacatatacaagaaagttagcatacttaccccgtttttcactacatcagaggcaaaataagaaatcttttaagaaaatctcaagactggctcatggcaaaatgaatatgctaaatttgggggttggtttaagcgtggtatgtgtcaggtaattttgtgattaccaaaaagttttcacttgaaaactaagacctttgctgtttatttcacaatgtgaaatcaataaacctgaggatacaagtctctgtagtgatattctgtatttactcatttttacacatttttgaatgcaattttgctaaggaaggaaagcttacagatgcataaaatgtaactgggaagagtagccataaaaatcaatgaatggatgtggctgggcaagagcctctgtaatactaatacgctgaatggctaataagtcacttcatttcggtgaaacaaatacctaaattctttgaagaattaacaggcttgatgttcaggtctgcttttggcaaatgggcatttaaatactccaagaaggtaagagccagaaaataggaaggtaactatgcttttagaaatatgtttacttagattctcccaaggtttatacttacaggtaaacttagaacaatagctcaaatacctacataggagaaggaaatctcaagggaaaacagttaattttaaagttatttaagaaacagaatccaacaccatagatcagagttcatgctaggattatcatttcaaaaataatgactcatccaacagatatagaataatagcactttaaagatgtttaagagtaaagcacaaaccatgtatataccaagacttagctaattctctgagagttataacttaagacaataaaataattaaaaatagtgttaacattaagtagaatgcaaatctctatagatggtttcctgggaaagtagttttgataagctttcctagcattgatcatcttcaaaaaagcatcaataaacagtccatgtcacttgctttagtttgtttgggcctactaattgctccaacacttctcgggaatgatctataaaagaaaacaatgacaatatattaattgacaataaaaaatgtttaatgtttcctcatgtctaactggaggtgatgttaattattatacagttatttaaaggattaaaggaggtgatctataaagcacaatatacaactaactcactaataattaattaatggtagccctcactattattaggtgtagtgcacctatcatggtattacttgtttaaaaaaaaaaaacaggcatttgttgttttctctgtaatttcatcataattccaccaaccagagtaatggtctaatttcaccattaacctgtgttaatggttaataacttttttcaggatcttagccggaaatagatgattcactaaagtggggtgactgaacagcatttaatgaagggaatatttaccaaaaaagtaggattaaagaaagccaataggtacggtaaaccaccttgggaagctgcaacacacccaaagggttagaggaggtagtagtcaccgaacgtgacaagttgacctgtagctgaacatttttccatgtctgtataatactactataaagcatgattttaaatagataaccattatataaatacactgtaatttaaccaatctatattattggacatttagatgttttcagtttttcacaatgtacagtcgtgattttgatatggtttccatcctagttttaggatgtcttttaaaaatctgaattaaagcaaaaatactgataaaattttgttagtttaaatattactcataagtttaataaacttgtttccatagatacaacctatgttttatgtacaacatatctctaacctagtcttggaaatcctgtaatttggtggttcctagacagatttcacagaccagtagaaaaaaaaaaaaagatgggcccaacatatacagtgacaaaattttattttaagtttaacaaaattaagcaaaaataccaaggtttattgccagcaagagaaccagagagtgtatagaaatgaaaagttattatcattgggaaaacaaaggtttacaattttttaaaaaagcagctagtaagataaatgcagttttattcatggtcataaaaatattattggttattgtagaggaaatctcaatcaaagatgggttcaaattatgttgaaagtaaaagaatggacaaagacataccatttaaatggcaaccatgacaaagctgggtggctatagaagaagggggaaacactttccaactctttctgtgaggccagtgttaccctgataccaaagccagacaaagacatcacatgaaaaagaaaactgcagacaaggatcttttattaatgtagactaaaaaatgctcaacaaaacaccagcacaccaaatccagccactagaagaaaggattacataccatgaccaactgagatttatcataggaatgcaaggttactttaacatctgaaaatcaattagtataatatactgtgttaatgtcctattgctgctgtaacaaattaccacaaatttagtggcttaaagcaacaaatttgttattgtacagttttgaaggtcagaattccaaaatgggtctcactgggctaaaatcaggtgtgggcaggtctgcgttactttttagaggaaagtcttatctttttttttttttggaggctctacaggggaatctacttcctttacttttctagcttctagaaactaccacattccttgcattccttcctgcttatttaaagtgaacaacattgggctgggtgcggtggctcacgcctgcaatcccagcactttgggaggctgaggcgggcagatcatgaggtcaggagtttgagaccagcctggccaacatagtgaaacccccatctctactaaaaatacaaaaattagccgagcactgtggcatgcacctgtagtcccagctacctgggaggctgaggtgggagaattgcttgaaccagggaggcggagattgcagtaagccaagaccatgccatcgtactcttgcctgggtgacagagtgagactccatctcaaaaaaaaaaaaaagtgggcatcattgagcacagtccttctcaagctgccatctctatggtcctctctccttctacttttaaggacccttatgattattttgggcctacatagataatacagaatgatctccctacttaaaaatcaactgattagcaactttaattccattggcaaccttatgtaacataacatactcacattttgggcattagaacgtggatatcattgggtgggtgagagcattattcagcttaccacctacaccattctaat

SEQ ID NO: 17994 - DNA, 70210 bp, Homo sapiens
  misc_feature (1)...(70210): n = A,T,C or G, or insertion/deletion polymorphism (see Tables 1-2)
cagaaataccaggcatttgattccattgcaataaccagtaattgtgagttaggaattacataactttctaaaaataaaaataacaagtgaagctaatcaaaaaaagatggtggtttaagctgtcattgcgctggctcccagcatcttagtgaaagaccacaattgtcatccctctcactgttatgaaactataataggctgggcacagtggctcgcgcctgtaatcccagcactttgggaggctgaggcgggaggatcacctgaggtcaggagttgaagaccagcctggccaacatggtgaaaccccatctctaccaaaaatacaaaaaaaattagctgggcttggtggtgggctcctataatcccagctacttgggaggctgaggcaggagaatcacatgaacccaggaggcggagattgcagtgagccaagatcacaccactgcactctagcctgggcgagagtgtgagactgtctcaaaaaaaaaagaaaaaaaggaaactataataattattattttggctcagatgaagctattcttattaattttcaaaatgtttttgatatttaatccctttaccaaaaaaatcagtaatctgttgatgagttacttattttctaatttctctccttctctactctaggctctgagaagctgacttttattgatcgcataaacggggatgctttgagctctaacttctggttggctgaagcaatgacagccgacagcaggacatcaaaaaggggatgaagaatggagcttgaagggtattcctgtagccccttcctggctggatcacaacaggctggctaggttgccttatcaaactgaaaccgcctttgcaaaattatcactgagacggtgaaagagttttaacttaaccgactccatcttgcttctaacctccttgttcgttcagcataggctgaactaactttgagagaaacttatagtttaaaacaaagatgataacagccctttcccaaagcacacctccttcttgcctggggactagattccctttgtaggactaacattagctacaagattagaaattatggtttaagagtcatgcaactggaggcttcaagattttcttcaaatatctcagtgcttgagatattttccagaccctgcaattgccggatcagctggcaccacccagatggataaactggctaatctgatcttgtggctcccacccaggaagtgactcagcacaagaagacagcttcaactccctatgatttcatttccgtcctgaccaatcagcactcccgggtcactggcttcccccaacccaccaatttatccttaaagattctgctcctggctgggcgtggtgactcgcacctgtaatcccagcacttttggaggttgaggtgggtggatcacccgaggtcaggagttcgagaccagcctgaccaacatagtgaaaccccgtctctattaaaaatacaaaattagccgggcgtggtggcacatgcctgtaatctcagctacttggtaggctgaggcaggagaatcacttgaacccaggaggcagaggttgcagtgagccaagacagcgccactgcactccagcctgggtgacagagcaagactctgaaaaaaaaacacaaacaaaaaaaaactctgctccccaaatgcttggggagactgatttgagtaataataaaactgtctcccgcacagctggctctgtgtgaattactctttctctattgtaattcccccgtcttgatgaatcagttctttctaggcagggggcaaggtgaaccccttaggcggttacaaattcaaaggccacagttcctttcaggtggcttcacctgtggtcactctggcaaggttttggttttgccctccaggaccagaagaggtaaggtcttcctgctattgtagcgctatggtattgaactacctttacccttgctctgccctaactctgtccacacctttgggaacagctcctttattaacatctccttgcttctcctgtttgaacttgcccaactcttaacctgcttggatcctgagtcatccattgtatgactcagactcctgagaatttgaaagtcacagatctctaacctagaaacaaagcaagtgtttctagccaatgggaaatttcaacaatgtataacaatccatgagcatgggcactgttatttccaatttggagtgtgatattataaaacaagctatgaaaagaaactaaataaaaagacgtgttattttctcaaaggacacttggagagttaagagcaatcctatttgaaaataacctacacatggtaggataataaagtaggggctcacttggcttagctccgttctgttcttgcgaaagcacacattcatataaataagatatacttgttttatatatatttattgtattttaaaacatgggtccacatacagctcatatattacattatgaattaacagcatgatttaagaaaagtaattttgttaattatttttataaaacaaacccagaggccgggtacggtggctcacgcctgtaatcccagcactttgggaggtcgaggtaggtggatcacaaggtcaggagttcgacaccagcctagccaatatggtgaaacctcgtctctactaaaaatacaaaaaaaaaaaaattagcctggcatggtggcacatgcctgtaatcccagctacttgggaggctgaggcgggagaattgcttgaatccgagaggcagaggttgcagtgagccgagattgcgccactgcactccagcctggagtaaagtaaaacaaacccacagcaacaatctatgataacgtttactttgtatggtagctatggtaggaagtggaggagattctgagctagaggaaactatattaaagtgggcacagcaaacagagaggagaaaaggaaaatatcttgcccttagcctaaccctgcctacaaatcacttaccatacactagaaaagactttcattcccaataactttgcattcaaagataaaccatgaatagcgggaacctcctaaaagccttgactaacgggaaatcctaaaagctttgcctccagagataagccacaaaaacaagaacatcctgttttccttaccacaaaacaggaacatcttgttcttatccaattggaatgaactgccatatctgagctataaatatctgccatttcatctgagctataaattcctctattctatttagcgagccactctctgaaagtctgattttcttgaactgcaagtaaaaatgtctctctgtgctcatatttgtctttgatttttattttgacatagggttcctgaactgatttttggggggggaaatcctgaagttggacgcacccagggctggcttcatgggtgggcaaaatgtgcagtcacacgggccccactctgggtttagtgctctgctatcaccatcttaaaattcgtaatttctttgttttttttgaggtagagtctcactcttgttgcccaggctggagtacagtggtgtgatctcggctcagtgcaacctccgcctcctgggttcaagcaattctcctgcctcagcctcctgagtagctgggattacaggcacctgccaccacgcccagctaatttttttgtacttttagtagagtttctccatattgcccaggctggtctcgaactcctaacctcagctgatccgcccaccttggcctcccaaagtgctgggattacaggcgtgaggcatgtgcattttagctttctagatcaggtgagggcacatggacaaatggctcaagggtcaaatccagtccactgtctgtttttgtatagcttgcaacttaaggatggcttttacatttttcagtggctgaaaaagatcaaaagatgagtatttcatgacagttgaaaattacataaaattcaaacttcagtgtttaggataaggttttattggaacagagacccacccattcatactgtctatggctaattttaagatacaagttgaatagctgtgaccaagccagcatgacccacaaaacctaaaatatttcttgtttggctctgggaagctaaaagacaacaaagaaagaattctccaaagatactgagtttctttgggagtgaacaaaaagaattataatccaagatgtacagctatggcaagccacgggtctggagaagggaagaatagggggaagattttactggtaaaggagggaagttcacataaactcttggaaacaaagttgattggttcccaaggctcaaatcaagaattggagtccgttcattggtggaggtcctgctgctgggccaaacgtcctttcgacagtatcttatctgaactgctgcagttttaaagaatatttagcaataaatcttgtcatagaaatgtgcgcatatttgcaaaacaagcaagttgtgcaaaacattaaatgcatgaaagatgtgaagaaattgtgggttttttggtttattttttaaagtccttgaggcagttctttctttctttttttttttttttgagacggagtcttgctctgtcgcccaggctggagtgcagtggcacgatctcggctcactataacctcctccgagttcaagcgattctcctgcctcagcctcctcagtagctgggattacaggcgcccgccaccacacccagtttttttttctttttttttttgtatttttagtagagacgggaatttcaccacgttggccaggctggtctcaaactcctgacctcgtgatccgcccgcctcggcctcccaaagtactaggattacaggtgtgagccaccgcgtctggccttgagacagttcttatctcagacatacaagcatgagtttccttcctttctggtctctaggctccaatttgtctgggtctgacaatagttacttctcctggaatctgcaactttcagagcactttatggaaaaagtcggccaacccctgccctacactcactcttgatcactctccagtgtagccatcccaaactatttgcagaccacccttttctctctgatctgtatcccacccccccaaccatgggtgcttccatagaactaaccccatctaagcatttaacagttattctaattgcccttttacttgtctgacccaagtgttcgccactcaatcctcagcacccagcacgatccctagccctcgttcagcgcttaataaatccatgttgattcaatgtgtagcatcctgaacaggcaacagcagtgggttccaactttcaaggagcttaaaaaaggaactcagcatacaaacaacagactaatctacaaggaagaatgaggggggtggagggagcactaaaaagcagcaagtactctgcagcagaaccaaagataaaattccacctaaaggtgccctttcttcaggatccttcctaatttgaatacaggttcccttctcctccatgacgaaattcttagtgaggttacttgttggtacgcagtgtcctcatctgtaaaataaggctaaataattacgatttcaccggattataatgaatatggttaagtattgaactaaggcctagaaagcacgtagctcagtgcacgcttcctagaaagtgctcagtaaactcggatcctctaacacgctccgtttgatgttaatggagtccgtatccgagcgggtctccagtgtgcatcgccaagggtatggcccagcatccaacgcatccttttagtaagagtagcgacttctcagcgctcccttcgccccaggagagttctcggctcgcggcgtcgcggcggggctgcgcgctgggctgaactcccaagaaacctcctgcagctgaaccggagcagacgcccgccaggtgaaagaactacaattcccgtcacgttgcatccgagtttagggcctctttatagtttatcacacccagcctcttccgcgcagccctcagtggctccgccccaaagggggctctcttctttccttgtggagtccgaagcgtggccacgccccggtcaccggaaaaatccgtgtgacgtcacaaaaacctacgcgtcgcgcggtgggcgggagttggcggacggtccctggctgggttctggaggccctgggaccgcggaagaggcttcagacgctgcagcgatgcctcgcccacggcgggtcagtcagctcctggatctgtgagtctaccctgtcccgcctcccttcgcgccgccccagcacctcctccaaacggccaggccctgcgctgctcttcctccccgcccctttcccaccccccccgccgacctctgaagaggccccgcgtgtgtttctgtccctgggttcctgatctgtcgtttcctggctgaggacagttgtgcaaagtgggtctcttggcgggcttgcccctccaacactccgctgcgcgatgagcgtccattcctccgtcagccttgacagctcggcgccccggctgttactggcagtggcctctctcttagcagctaaaagccttggtagaaaaaaacacaacgctagatgaggttctcaaaagcttctagcagaattccacccctgtaactggaataaacattgacagaccctgggataaaggtaacaaagtggttaagaccacggatccctggctgagattgctgggttcagcccccggctctgccattcaccagccacgtgaccatggaccggtaacgtaacctctccctgtgcctaggttctttatctataaaatttttgtgataatagcacccatcacatggagttgtcctgagggataaatttaaaacatgtaaaacccttataaggatgcccagcaaataataaacaccactaagtgttattgttattattatttcctaccagaaattgtacggaaatggaagttacaagggcaattgcgtctctccaggagctttcagtccgttaatattgccatgtaaaaaacagacatcttaaggataaggagaacaatctccttaatctactgaaggctttctgaaacaatggcatctgatattttacattaaacttgggaggccgaggtgggagaactgcttgagctgaggagttcgagaccagcctgggcaacgtggcgaaaccccgcctctactaaagatacaaaaattatctgggcacggtggttcacgcctgtaatcccagcactttgggaggccgaggcacttgagatcaggagagttggagaccagcctagccagcacggcaaaaccgcggcatgtactaaaaatacaaaaattagccaggagtagtagtggcgccggtagtcccagctactctggaggctgaggcaggagaatcgcctcaacccaggaggcagaggttgcagtgagctgagatcgcgccactgcacgcctaggctgctaggcgacagagcgagactgtctcaaaaaaataaaataaataactataatatatgtagaataatatcacaagcgggagagtaacaaacttttgaaatttctaataaggaaaagaataggagaaagctttgtcaagggggttatttttgaacattggtagtatctgacggttgcaaatgggaggaaatgtatcgtagagagtgaaataaaaagagtaaaggtttgacaggcaggaaaggtagaaatatgagagaagaccagaaagtagcgctccaatgtgaatggaagatacaatatgaatagcacagtagtgagacataaagccaggtcattgggaatagaatcttagggaccaggatgaagtaagagcatttcctctttcagtcatggggagctatcaaaggttttagaactgtactgtgagcagagagagatttgaattaggcagaagttggaaatagggagacacttagaagactgttacaaaatcttaagaggtgaagagcccaaaccaggagacacatgaagatgttctttgcagaattatttctggtggcatggagctggaatgggagagttaccatggaatattatgcagctgttagaaaagcaaagggtaggccaggcatggtggctcacacctgtaatcccaacattttgggaccctgaggagggtggattgcttgaggccaggagttggagaccagtctaggcaacatggcaaaaccatgtctctaccaaaaataaaaagttagccaatctcataacctggtctcaaaataaataaataaatgaaagaaaagcaaagagtagattcatttggatagaattttaaaacacagtgcttagtgaaaaaaagaggaaacagactaacaatgttaagaaaaattcttcagaacttggggctaagacagggatgactacatgatcttcattgtcatgctagagtgtggtccctaggtaaaggtccatatttgcccttagaacctaattttgtacccttctgggacaaggtacagtctgagactggcagttggtcagcaagctatttctggtttgtaacaaagtaagaagcttgagccaractagtaattaagtgtgtcactaagcacattatttagtccagctgatgaggctttctccatgaaggaaacagggcttggtttatgttcttgcataaactccttatctcctcactgaccagcactttaacactgctttagagaatcctttggatctgggacatgaatagttttgaatagagggaccgaggaaagagaagaattagaaattactcttttagttgggggccgtggctcaygcctgtaaccccagcactttggaaggctgaggcaggtggatcacctgaggtggggagttcgagactagtctgaccaacatggagaaaccctgtctctactaaaaatacaaaattagcyggccgtggtggtgcatgcctgtaatcccagctccttgggaggctgaggtgggagaatcgcttgaacctgggaggcagaggttgcggtgagccgagcttgcaccattgcactccagtttgggcaacaagagcgaaactccgtccccccaaaaaaaaaaaaaaagaaattactcttttagttttagcttcgttgacaggtagaatggtgattagactattatggaggaagaagtgtcttacggggaaaatgaatcagaatatccagtagaaatatcaagcaggcagttagaatataattttgaatctgaaagaaagatcaaggattaggctgggtgcagtggctcatgcctgtaatcccaacactttgggaggccgaggcaggtgaatcacttgaggtcaggagttcgagaccagcctagccaacatggtgaaaccctgtctctaccaaaaatacaaaaaaaattaactgggcatggtggtgcacatgtgtattcccagctacttgggaggctgagacaggagaattgcttgaacccaggaggcggagcttggagtgagccaagatggtgctactgcactccagcctgggcaacagagtgagactccatctctaaataaataaatacataaatacacaaataaaatgaagagagatcaaggattgaaactaagattgggggtataactttgtagatgataggaagccatggttaagtttaaaagagggctatagagagaaaaaaagaaagtcaaggacaaaattttatgtaacacttacattagaagcagtccatgttgccaaaactcttttatttgttagatcaattcaccatatgatgatttggccaaatagtaataggttgtttcttttaagtataaaacgtagagcaactawtattggttgggatatccacccgtctccccaattgttttacagcttttaaagattataagttttagctgacttcttttcattttgtcttragaaatgagactgcctgtgccaactgtggggcctgagaatcaacaccacttatgtcaacctaactttttgctctaggaaatttttgcaaatcagtttatctaaataaacagctatcaggacaaacattttgatttttaggacaaacattatgtttatctggacagattgctcatcaagcctggctttttgtgtccatccgttttaaactaagtcacaaactttgcctaatccttacccattcgccactgtggggggagaagcacccacttaaactggtggcgtttatatcccagaaacttatgtatactcttgcctaacattcctctattgaaatgctaccaaaaccctgtcaagatgatctcccttgctgtagtaaatgtaatacatgatttgacaaatttaatcaatttgtttgaccagcagggtttctggatgggctttgtggccattcaatagtcctcccagaattttaagaactatttgatttgtttctgtcccaactccctgctattgcagctggagggaactggagcagaaagaggaaaccatttactttgggaaacacatggtacagcctctgcactgctgagctcagagaagagcatactaaagggctaagatgaaagagactgagagaaaaaggtggcggtggggggcagagagccatgttgtaggaaaaaggtaacatattgaaatatacctgaaatcttgcataaagcaaaatacagtagtctctccttatgtgctgttttgtttcggcagtttcaggtacctgcagtcaaccatggtaaaaaaatatatatatatgttaaatggaaaattctaggaagaaacaattcataaattttaaattatgcaccattttgagtagcatgatgaaatctcatgccaccctgccctgtctgcccaggatgtgaattctgccttcgttcagcatatccatgctgtccatttagtagccttcttggttatcagagctattgtygcagggctactgcattcacataaccctgatattacttaacaattgcaccagagcacaagagtactgatgctggcatattgttacatgtattttttatttttccacccaatccttgtagatgttgttataactgttctattttattgttgttgttgttcatctcttactgtgcctaatttatatattaaactttaccacaggtatgtctgcatagtaaatgcagggtgtatatataggatttaggattcagtactatccatgatttcaggtgtccacagggagtcttagaatgtttttcccatggataaaggggatctgctatataacaggagtgattgtcagtcacttcaaatgctttacttttctctaatcccctactcacagaggtcatgtgcaagaggaacaagagcatttttataaagtttacacagacttaccttgtttccttgcttgactggtgtgggtcactgtaggggtacttggtgagcagtatcctcaaccaagtggtagttatctttgttatctagggcaggagttggtaacctttctgtgaagggccagagagtaatattttcagctttgtaggctacacaccctctgacacagttactcagctctgccattgtagaacacaagcagccacagacaacacataaagaaatggcagcagcctgaggatgataaggggtgtgaaacatctgttgaataccttgactatcggctcattgttgagcaacctttgcagtaaaagacctatcattgtcagagtgaaagtggtctgctttgggaggccgaggcgggtggatcacgaggtcaggagatcgagaccatcctggctaacatggtgaaaccctgtctctactaaaaatacaaaaaattagccgggcatagtggcgggcgcctgtagtctcagctactcaggaggctgaggcaggagaatggtgtgaacccaggaggcggagcttgcagtgagccgagatcgcagtggtctggaaaaccaaaaacataacacactttgatcagtgtggctggagttggttgatcagactgaaaccatgaaaccataacctgaaaaaatgtcaacaactgtaacacattaacaatagccccaggggtggtgtgtgtgtgcgtgtgtgtttgtgtgtgtgtcagtcaaaggcagtgttccaataaaatttgatttctttcttgttttttgagacgaggtctcactctgttgcccaggctggagtgcagtggcccgatctcagctcactgcaacctctgcctcccaggttcaagtgattctcctgcctcagcctcccaagtagctgggattacaggcatgcactaccacacctggctaattttttgtatttttagtagagacagggtctcaccagcttggccagcctggtcttgagctcctgacttcaggtgatctgcttgcctcagcctcccaaagttctgggattacaggtgtgagccaccgtgccaggcgtaaaacttgatttctgaaaactagcagctggctacatttgtcccacaggtcatagtttgctgacccctgatccaggtttcagtacaacaagagaatccaggtggctgaaccagaattaagtttgaatttcctaagttcccttttgccagactgccacccagagagtgtaccaaccaggctgacttggagtcattgtttggagaaagaaagctgcatatcatgcccaggaattgtcagagtggaatcccagaatatcagactaagtctagcaaaccctccccttttcatcctgatcattatataggaggtggctaggagactatgaaccctttcagggtgccttttttgtgaccaaactaccttactaagatgcatggaccaggagagtgtgaaggaggtagagtcagaaatttcttttagtggattttttaaaagtccgttttacttcttgttggagccaacaccctaaggatgataaggggtgtgaaatatccgttgaataccttgacttattggctcattgttgagcaacctctgcgcagtaaaagacatatcattgtcagagtgaaagtggtctggaaaaccaaaaacataacacattttgatcagtgtgactggcgttggttgaacagactggaacaatgaaaccataacccgaaaaaatgtcaacaactgtaacacattaacaatagccccaggtgtgtgtgtgtgtgtgtgtgtgtgtgtgtgtgtgtgtcaaaggcctgatatagtcaacttgtcagaagtaagagggaccacacaccataaaatacggtctatttcactgagacaaaacaggctgacttttgaaaggaagcacaagaccagcatgcaatggtagcgtcagatacatgtaatctttactctgttcctaggccatgatggcagataatgttgctatgtgcagtgtgttgttacagtgtgcagactgctgatcctggcagcagtggcagcagtctggatggtgtatacttgattagcagcatcattgcagtctattccattagagaatgarccattaccatggacatctgtctgattctctgctgtgatttgttttcacagttcacagtcctaaagaggagtgtctgtaatccgctagtttgttttcttccaagtggcagaccaggtaacattgtcaacagcccaagagtcagtaaaaatataatatgccttgaccaaggacgtgttgtttgttgactaaggcagatattggcaaactttgtaggctccacctgcagtgtcactttagcctctcttccccactgaagactttacccagacctcatcagttgcatttggttgcctttttcccctaagggatcagagaccaaggagcttaatgtgtgcccaagttatgaattatagcaacagccaacaggagactgctgttcaccagctggaagtgtggggaatgcagagtggcagggaggttggctcacagggaatgctgagggtgttgaggatgatatttccctcttgctgtccactcctgtattgatgccaccccagtattgatacctgagcatcagatacccagcttcctcccctgggtacctcccattgagcatccaaacccggaagtccttctttttcttccccagtggaaaccgctacattttactccacggtccttgataatttcggccacccatatgcccagcaccccatcatcctcaccaatcaaatcagactgtcgcaggagccagatatataagcagctggctttgcactgttaggcaaggctctgcattcacttttgttttgagagactgctcacctgtggctcaaccaaataaatgaggctggtctcaaactcctggactcaagagatattcccacrttggcttccaaagtgctgggattatagatatgagccactacacttggcctacaattctgctacaatttgacttctaagtctatacccarttgaattgaaactgggtacycaaatacttgtacatgaatgttcatagcagcattattcacattagccaaaggtagaaaaacccagacagatgtccatcaattgatgaatcaataaacaaaatgtggtatatttgtatagttgaatgttattcagctgtaaaaaggaatgaaatactgatacatactacaatgtggataaaccttgaaaacatgatgctaattgaaggcagccagacacagaggccacatattgtataaatccagataaatcaatagtgacaggaagcaaattggtagttctgaggtattacaacccataattggtatttgtgagaaaaaggaggaatggggattgacttttttttttttttttgagacagagtttcactcatgttgtccaggctggagtgcagtggcacgatctcagctcactgaaacctcttcctccatggttcaagcgattttcctgcctcagcctcccaagtagctgggattacaggcacctgccaccacacccggctaattttgtatttttggtagagatggggttataccatgttggtcaggctggtctcgaactcctgacctcagatgatccacatgcctcagcttcccaaagtactgggattacaggtgggagccaccacacccggcagggactgacttcttaatagagataagttttcttttgggctggtgaaaatgttttagaactagatacaggtggtagttgcacaacattgtaaatgtacaaaatgccactgaagtgcacactgtaaaatgattaatttcatattatctttcatctcaactttttaaaagaaaaaagtaaagcaatgtatgttgacaatgtcaaatgacaacggaatggaaaaattaaatgtagtatattcacacaatgaaatatatatatacacacatacatgtatcatctatatattataacatatattgagaacgaaatgaactgtggccgcatgcaaccacttgaataaattgcacaaacaaaaggttccattgtataactatattgtaattcattctatttactgtggatggtaatttgagttgtttttagttctctctgttacaaacaatgctgctgtgagttttgttgtctacatcttctgactcaaaagtgcaaggttttccagggttgatacctccaactggaattgctagatcttaggatctatacatctttagctttactagataaggccaaacagttttctcagatgcttgtaccaaattacatgcctactctcaatgtttgagagttcctgttgactaccatcttgaccaacatttgatgttctccatacctttctgaagtctttgaagtctctaaagagatagggaggcttgataaaatgctacataagttcttacaatcactagatctacagtgagcaatacaaataacatattgtatattccagaacaaatataattttatatgtgtataattgtatatatttttacttccctaacaaaatgtctaaccttttctctacatttttgaaatttctgaaaaatttgcttttctgatcctagtgatgcttaggaaagattttatatcattaaaaagaaattgggaggtcacttccaagatggctaaatgggaacagctccagtctgcagctcccagcaagattgacgcagaagatgggcgatttctgcatttccaactgaggtacctggttcatctcactgggactggttgaacagtgactgcagcccacggagggcgagctgaagcagggcagggcgtcgcctcacctgggtgcaaggggtcgggggatttccctttcctagtcaagggaagctctgagtgactgtacactcctgcccaaatactgcgcttttcccacggtcttcccaatcagcagaccaggagactgcctcctgtgcctggcttggcaggtcccatacccacggagccttgctcgctgctagcgcagcagtctgagatcgacctgggatgtgggagcttggcggggggaggggcgtctgccattgctgaggcttgagtaggcggttctatgctcacagtgtaaacaaagtggcaaggaagctcacactgggcggagcccactacagctcagcaaggcctactgcctctctagattccacctctggggcagggcatatctgaacaaaaggcagcagacaggtctatagacccaggcaaacagggtctggagtggacctccagtaaactccaacagacctgcagctgaggggcctgtctgttagaaggaaaactaacaaacagaaaggaatagcatcaacattaacaaaaaggacatccacaccaaaaccccatccataggtcaccaacatcaaagaccaaaggtagataaaaccacaaagatggggagaaactagagcagaaagcctgaaaattccaaaaaccagaatgcctattctccagaggaacacaactccttgccagcaagggaacaaaactggacagagaatgagtttgacgagttgacagaagtaggcttcagaaggttggtaataacaaactctccaagctaaagaagcatgttctaacccaacacaaggaagctaagaaccttgataaaaggttacaggaactgctaactagaataaccagtttagagaagaacataaatgacctgatggagctgaaaaacacagcatgagaacttcatgaagcatatacaatatcaatagccaaattgatcaagcagaagaaagaatagcagagattgaagatcaacttactgaaataagaggcaaagacaagattagagaaaaaggaatgaaaacgaacaaagcctccaagaaatatgggactatgtgaaaagaccaaacctacgattgattggtgtacctgaaagtgattgagagaatggaaccacgttggaaaacacacttcaggatattatgcaggagaacttccccaacctagcaagacaggccaacattcaaattcaggttgaacaatgagaacacatggacacagggaggggaacatcacacactggggcctgtcggggggttggggacaaggggagggagagcattaggacaaatacctagtgcatgcagggcttaaaacctagatgacaggttgataggggcagcaaaccaccatggcacatgtatacctatgtaacaaacctgaatgttctgcacatgtatctcagaacttaaagtaaaattaaaaaaaaaaagttaactataaatcttagttaccaagaaatcccagtttctgatactgcctcttgtgaattaaataagactgaattaaattagactgtctgtagacagattagaaggcaccacggaagagtcttgaattaaaacaagtttaaagtagcttgacactagagaagaatttatttaatctttcttcataacgaatgtgtttatccaggaataccatttgacccagcaatcccattactgggtatatacccaaaggaatataaatgattctattacaatgaatgtttgcttattgcacacatatgtttattgcagcactattcacaatagcaaagacatggaaccaactcaaatgctcatcagtgatagactggataaagaaagtgtggtacatataaaccatggaatactatgcagccataaaaagaaatgaaatcacgtcctttgcagggacatggataaagctggaagacatcatcctcagcaaactaacacaggaacagaaaaccaaacaccgcatgtcataagtggagctgaatgatgagaacacatggacacagggaggggaacaacacacaccggggcctgtggttggggggagcaagggaaaggatagcatcaggacaaatagacaatgcatgtggggcttaatacctaggtgtatatcccggaacttaaataaaaatgtaaaaaaaaaaatcagttcctggtggtttgtaagtcaaaaaggaaaggtgaaacaataaacttagtgaattcttgtagaagaaaacataggagaatatcttcatgaacttaggacagggaaagtttatgaacaggacaaaaaatcacctgctgtaatggaaaacactgataaattggactgtattagaatgtacttctcttcagcaaaagacatgattaagaaagtggaaaggcaatccacggaatgggggaatatatttgcaacgtatataacaaacagaaggttcatatccagcatataacaggaattcctatatatcagtaagaaacataattaacccaaaatgaaagagggcaaaatacttgagtagatactccacaaaagaggatatccaaccagacaataaaaagatgaatgtgtacccatattaatcagagattgcaatttaatgccacattgcattgctattatatacccactaaaatgactaaaatttaaaagattaacaatgccaagtgttggcaaggatatggaccacaagaatgctcattcaccaatggtaggattgtgattgggtacaaccactttgaaaaactggcattaagctaaacatatgcctaccctatgagccagcagttccactactagatatatacactcagttgaaacacagatacgtgtgtaccaaaagacatgtctaagaatattcatattgatattcataataataaagagttacaaatgacccaactgtatattcactgtagaataaattggtcaaacaacagaatattatacgttagtgaaaatggacatgaacaacgtgaaaatggaaatgaataatctatagctacatgtaacgatacagataaatttcacaaacataatgttgagcaaaagaaaccatggaaaaatgatggagcaatactgaaatcaaacagaatagtctctaaagtgaaaaacatgaatacggataaagagagacattacttaatgataaaaggaatattccacaagaaaatatcatgaatttgcaactgacaccagtcttacaaaaaggaaacctgtcatgtagtttagtcaaatttagtcacgttaggaaacttaataaactactcttacattttataaatacagaaaacagctcagagtgtggtcaggtggctcagatctagcagagttttccttatcccagtggattttgtagaatacactgccagtctcttgtctttcattcatcatggctacttctgatatccaggtgaaagcactggagaagtgtgcctcaggctaggcttttgaactgattctcagataccatcaaaagaatccatcccagagttccttatttcccctccaaagaagaaagatctttccctggaggaaattcagaataaatcagaagcttcagaagaaagacacaagccctgcgaagctgaggtcttgaagcagcttgctgaaaaatgagagcaggagaaagaagtgcttcagaaatcaataaaagaacagcttcagtgaaatagcagaagagaaactgacccacaaaatggaagctaacaaagagaacaggaaggcgcaaatgactaccacactggagtgtttgcagagaaagataagcacgttgaagaaatgcggaagagcaaagaatccagagatcctggtgatgaggctgaagctgactaatttgttctaagaactgactttctccccgctcttcttcctagatattcagactatactggccagtgtcattttattttttgctcctgacaaatattctagaagctgatgtaggactagataggtaaatccagcctgtacaatgttgttttaggagctaaagggaagaaactgaaagagttttactctttttctaaaatgttggtctttctaacatagctatttttcttgttgcatctttgctacttcagtacacttgggttaatggctagtactgtactggctttgtgaaacatatttgtgaaaagagtatgtagtggcttcttttgaactgtttgatacggaatatttgttcattttttaatcccaattctgtcctaattttaccagatgctactggacttgaatggttaataaaattgcacaatgttgttggtggcagtgacttctttctgttcaggtaataagttaaaaagatcctcctagtttatatttgtttcaggtagagcttttaggtcaatggaaataaccagcatacacattactgcaaagtctctgcttttgagtttcttgctccagagttgtttgtattgtcttctacaatcattgctttgtttcaatgcctggaccctgatcagctgttgctatattctttcaaatgtttatttgcaaacaatcttttttgttctgtgttcctgtttaaaaagcagattaaggccgagcacaaggctcatgcctgtaatcccagcagtttgggaggccaaggtgrgaggctcacttcagcccaggagttcaagaccggcctgggcaacatatagagaccccatctctacaagaaatacagaaaattagctgattgtggtggtgcatgtctgtagtcccaactacttgggaggctgaggtaagaggatcacttgagccttggaggttgaggctgcagtgagctgtgattgtgccactgtactccagcctgggcaacagagtgagaccttgtctcaagataaataaataaaaattttaaaggcagattaaaggcacaaatggtgtttctagagaacaatttagagggaatcttaagatcctagttggagatatctggtggtttgcttgctttatgttacaggtggaggtgtattctaatgctttcctgccgtaaaagctataatttgagaattggaaaatttttkgggcttttttctttacccccgactcatagtacagctttgagaatataataatattaaaaaagctttccatgctgctgtagcaactcctgtgaaatgatttaagggaactttatttatattttaaaaatcaataatttatttatagatatatgtattagtattaaaagtataattaaataatggacaggaactatttttaaaactttatggtagtaattgtctctacaaacagagatacatagagtaaaccagtcgcgtatataaaagtggctttaattttatcagaaaattttttttttctttttttgagacaaggtctagctctctcacccaggctggagtgcagtggtacaatcacagcttactgcagcctcacctcctggactcaaacaatcctcccacctcagcacccccgcaccccaggtagctgggactacaagtgaatgccactacacccagctaatttttgtattatttgtagagacagggttttgccatgtttcccaggctggtcttgaactcctgggctcaagtgagcctcctgtctcagtctcccaaagtgctgggattatagacataagccaccatgctcagccttaatcagaaatgttttatgtcttgagatgtctgacacaaatatgataaaagagtaacaaaattctaggtttgaggtacatagatrtatatcaccctgttttatatttctgtatttttgaaattttttattataaracaacaagcaaaaacttgcagaaatgaaaagaagacttgattttaaattacaaatatcataaactagaaattccacatttagtagaaaaataagaatatagtagaattagataatactgtaaataaacatatatacattaaacatatttatgtgcaaacacatatacatacatggagagagatacttatacatacatatatatataacacacagagagaacattacatctctcacgtagataatatacattctctgaatatatagagcatgtatttggccacaacaaagagctcttacaaatttgtcaacaaataacaaaatggtcctcaaaaaactaaaaatggaactaccctatgattcagcaatttcaccactgggtaaatatccaaaagaaaataaataaatatataaaagagatatctgcactcccatgtttattgcagcactatttgtaataaccaaaatatgggccgagcatggtggctcacacctgtaatcccaacactttgggaggccgaggcgtgtggatcacgaggtcaggagtttgagaccatcctggctaacatggtgaaaccccgtctctactaaaaaagaaaaaattagctgagtgtggtggcatgcacctgtagtcccagctacttgggaggctgaggcaggggaattgcttgaacccggaaggcagaggttgcagtgagctgagattgtgccactgcactccagcctggcaacagagcaagactctgtctcaaaaaaataaaaataaccaaaatatggaatcaacctaagtgcccatcaatggatgaatgaataaagaaaatgtgrtataatacatatatatgatggaatattattcagccattaaaaaataatgaaatctgctgggtacggtggctcatgcctgtattcccaacactttgggaggccaaggcaggcagatcacgaggtcaagagttcaagaccagtctggccaacatggtgaaaccctgtctctactaagaatacaaaaattagccgggcatggtggcatgtgcctgtaatcccagctatttgggaggccaaggaaggagaattgcttgaacctgggtggcagaggttgcagtgagccgacattgcaccactgcactctagcctgggcgacagagcaagactccatcttgaaaaaaaataataataaaataaaataataatgaaatcttagtcaagtgtggtaagcatgcctctagaagctgaggcaggaggatctcttgagcctaggaggttaaggctgcagtgagctgtgattgcaccattgcaccccaacctaggcaacagagcaagaccccatctcgggagagagggaggtagggaaggagggagggagggaggaagggagggaggggggaatgaatgaattctgtcatatgcagcaacatggatggaactggaggtcattttgttaagtaagccagacacagaaagacaaatgtcacatgttctcattcatatgtgggaactaaaaaaaagtggatatcatgaagatagagagtagatgggtggctaacagaggctgggaagggcaggggatggcggcatagagagaggttgattaatgggtataaatacacaaataaaaaatagtgttcaatagatgggtagggtgactatagttaataataatctattatacacttcaaaatggttagaagagaataatttgaatgttcctagcataaacaaaagataaatatttaaggtgatggataacccagttaccctgatttgatctttacacattatatgaatgtatcaaattatcacatgtaccctgaaaatatgtacatctattatgtatcagtttttaaaaataacaaaacaggcaaaggatatgtatagattgtttatggaaaagcatatccagatagccagcaagctcatgcaaggatgttgtttattggtaattagagaaatacaagttaaagtaatagtgagacatcattttcacctgttaggccttccaacatttaagagtaggtgatcttgaaaacagtgctgagtgaaaaactaaacaaatctatgacaagtcccatgtttataaattagaaatgcatgcatacaataaacatgttaaaaggmaatatacaatgaaaggatacacattaaacatgagaatggtttcctagaggggtggggaatgggagtgggaaatggagataacaaagaaatggaaagaataaataaaattaaaattaaatataaaataaataaatagggctgggtgcggtggctcatgcctgtaatcccaagtgaggagtttggaccatcctggccaatatggtgaaaccccatctctattaaaaatacaaaaattagccaggcatggtggcacacgcctatagtctcagctacttgggaggctgaggcagaagaattgcttgaacctgggaggcagaggttgcagtgagctgagatcatgccactgcactccagcctgggtgacagagtgagactctgtctcaaaaaataaataaactagccatgatatctattgctggaaggatgtagagggaaaggagctttctgacactactaatagaaatatgaagtgttttccagactttctgaaaaataatctgacaacatatcctagaaatagtggtaatgcttgtcagcatacaagtcactaaatagatcatccgtactgtgaaatatgatgtgaccattaagggagaatcagtactgtgtcggatgccttgaagggatttcataagatactgaatgaaagacagtgtataaaagtaagtgtactgtggtgccgttttaggaaacaatgacccctcccccacacaagcctttaaatgtgtgtgtgtgtgtgtgtgtgtgtgtgtgtgtgtgkacaagaacagagaaaaataagaaagaatatatgctacattggtgtagagagctaatggagggggaaggacaagagaggaaactgtgtaggaaaccaaaagaggaaaaagaaaaaattaacattgcactaaaaaattaatcacaggtatatgatcacattcactcatgaatgtaaaattttgtatatatggggatatttgtagacagaaattaataagatttgtatttgtttctttaaagtatgagtttttcagatggttggaatttcaggacacagataagatatgttggtcataagattcttggttgttgcctgataactctactttctgcctatacaaccctggcactgagtttgatatctctgtgatttgtaatatttgctgaatctttgtggttatggttctttctctagtgatttcattatccacatagttttcaagaaaaatagtaaaaacaagtttgctggattaacagataaaacttttcaattagtgggtcccaatataaagcttatttaggagtatgtgtcttagaaattagacacttaggaaaaacattcttgttggtcatttaaaatgcattttgataaatgaggtatgcatagaaaaaaattgtagaggaagagcatcttgtccgtaatttaacacagactaggtttttgaagcttacagagctaaagttgtaaatatagtattaatataaaatgtatatacttttttttgagacaggatcttgctctgttgcccaggctggagcgtagtggcacaatcacagctcactgcagtctcgaccttctgggcccaagcgatcctcccacctcagcctcccaagtagctgggactacaggctcacatcaccatgctcagctaatttttgtattttttttctttttttgtagagacagggtttcactatgttgttcaggctggtctcaaactcctgagctcaagccatcctcctgcctgggcttcccaaagtgttgggattacaggcgtgagccaccacacccagccaaaatgtacacacttttatgaaagggctaagtgctaacaaatagcattaagacaagtgttaggaatcagtacaggcccagtgtgatttactatattgtatttgtatttcagatgcctttggtgcttcatgaagaatatttccagatatctcacagacattaagcctttgcctcccaacataaaagacagactgattaaaataatgagtatgcagggacagataacagattcaaatataagtgaggtaagagtatgaataactgtaaagcaagcatattatattttctgtttagatatggttttagatttttggaacaatggtatatggtaagactggtaatcatttttaatttttttttttttatacagggtcatgctccgttgcccaggctggagtacagtggtgcaatctcagctcactgcaacctccgctgcctggacttaggtgatccctcttcagcctcctgagtagttgggactataggtgtacaccaccatgcctggctaatttttgcattttttgtagagacagggtttcaccatgttgcccaggctggtctcgaactccggagctcaagtgatccatccgcctcagcctctcaaaatgctgggattacaggtgtgagccaccatgcctggcccacattttagaatattataaagtataagggtttgtttttttccctccagataaccaaaatgtccatatgyaattatcagaggaacctgcccccaatatttcaatgtaggttctttctatttttcctaagtgtcggctggtctgagaaataaagagaaagagtacaaagagaggaattttacagctgggccgccgggggtgacatcacatatcggtaggactgtgatgcccacctgagccacaaaaccagcaagtttttattaaggatttcaaaaggggaggaatgtacgaacagggagtaggtcacatgctttaaagggcaaaaagcagagcaaagatcacatgcttctgaggaaacagggcaaggacaaaatcagaactcctgataagggtctatgttcagcagtgcacgtattgtcttgataaacatcttaacagaaaacggttcgagagcagagaaccagtctgacctcaaatttaccagggctggggtttcccaatcctagtaagcctgagggtactgcaggagaccagggcgtatctcagtccttatctcaaccgcataggacagacactcccataggacagacactcccagagtggccatttatagacctccccccaggaatgcaattctttccctagggtcttaatattccttgctaggaaaagaatttagcaatatctctcctacttgcacgtctgtttataggctctctgcaagaagaaaaatatggctctttttgcctgaccccgcaggcagtcagaccttatggtcgtcttcccttgttcgctaaaattgctgttattctgttctttttcaaggtgcactgatttcatattgttcaaacacatgttttacaatcaatttgtacagttaatgcaatcatcacagtggtccagaggtgacgtacatcctcagtttatgaagataataggattaagagattaaaataaagacaggcataagaaattatgaaagcattatttgggaagtgataaatgtccatgaaatcttcacaatttatgttcctctgccatggctccagctggtccctccatttggggtccctgacttcccgcaacatgtaatagttcctaaaacatcttctaccattgtctcagttacttctcttgtgtcaaccagagtcgtggagactgaaaatccaagcaaaaaggtttattggtggttttagaattgaattcaaggaacacagattccagaggcatctgaaatcatgtcctaactatttaattcatatgtcctaagagatatatgaggtcttttaaagagaaaggtgggagagggttatcaaacaattcattagttagaataagggtttctaggcagaagtccttgattcaggggtttggaaaaagttcagtcatcagcatagcatagtcttttcagaagtggcagcaatttcatctgcagcatcagcaagtacgttctacagtcaagcagttgcagaatgacattcaggaacaaaatggtgttgttctggtcagctcccattagccttccatacacacttgtcttcatggtacctgtacccttgacctccgtgttttcaaaaagtttaaaactttttgatcaagactcacaataagaaatatacgttacattgtgactgtagtacacaaaccacacttaggtgtaacagtataatgtatagtacattttggtcttttctatttaattttattctatttagtcttattttactgaaaaaatattgatcacagtctgctaaactgattttgtaatccattcatggataatgaccagtagttaaaaaatcactcttctcatctatactgttcttttttcaactgctatatttttcatatttaatatttccaattcacctttttatggtttcttgttttatcttattaatcttttcttatttcttttagcatattattatgcttattaatatatttggcctctctgttctaattcctctgctcctgatggaatcagtaatctttgtttttcttttgaaatagtggtgctctctagatgtcttgttttggcctgtgaacatatctctgtatactctctggtagtggtaagagtaaaggaggccagacccaagtctgtttcggccctactaagctgacatagggggtggaggcctggagaggggctggagtgatgagctccaaggcagagagccccaagcactagaaaaagatrgttaatcactctttgttctgctaaacagcccgtgagattagggcttaaccttcagcctctgattttaaaggttattaaatagcagagtagataatttccttcgatactactcctgtgttatcttttgtatttttgctatttgtgtttcaaaaagtgaaaatgctagttagtagtttctacactacttacatttaaatattgtctttgggtttgcagccaccaccactctgcagccatcaccatctagtctgcagagactagaactgccaattgctgttgggggtgagcggcatctatccaggctggtgggatggtggtaaaagaatttaccaagacagttgtaggtaaagaaaggcagatttttttttttttttttttttttttgagacggagtcttgctgtttcacccaggctggagcgcagtggcatgatcttggctcactgcaacctctgcctcccaggttcacgccattctcctgcctcagcctcctgagtagctgggactacaggcgcccgccaccacacccagctaattttttgtatttttagtagagacggggtttcaccatgttagccaggatggtctcgatctcctgaccttgtgatctgcccgcctcagcctcccaaagtgctgggattacaggcgtgagccaccgcgcccggccaagaaaggcagatttattagagaaaatatgaaaatacattgcaagggagcaacgggcagaaccagcaagagaggacccaactgccaggagacaaaggcttgctggggattttatagaatggaacttgggctgattgacagcaccaaggtaggagggaactaacttgcatccttctgtcagccgaggtgtttgatgatagatcaaagtgtttggtgataagcaggaggtttatgagttttgtatgttgtctgcacaggagggctatatgttctgggccataaagaaaggcagacctatagcttatctgcttcttctttttgtttatatgttctggaccatgaagaaaggcagacctgtagcttatttgctttccccttgtcctgccagcctgactccttttccctaattaggactccacaattgctctgacttcacttcaccttctgcctaaagcctgtaatcaaaaggaagcaaggtctgatgatagcactccagcatatgtttttctgtggtttttgcttgtttgttgttttttttttgagacagggtctcactctgtcacccagggtagagtgcataatcatggctcactgcagcctcaacctcctgggctcaggtgatcctcccacctcagcctcctgagtagctaggactacaggcacccactaccacatccagctaatttttgtattttttttagagacagggtttcaccatgttgcccaggctggtcttgamcctctgggctcaagcaatctgcccaccttggcctcccaaagatctaggattataagtgtgagccacagtgcccagcctacatgctagagcatgtgactaaccctgtgactttacattggaattgcactttaacctgtttttaatgtttcttctgcattaacctgatatatctttattataatgctttattttcttcatgttagcttgcatttgaacatagataccttagtggtgtagtttgcttggctctgtggaagtagaataatatctccacgttcttattgttgatggttctgttgaagtatgtaatgttatatgtgactcatagatgaaccataatgacactgtagaaaaatggtggttttcttcacttttccaccatccacatttcttactatccctttagcttatccttcagtgacttaggtttttgtttgatggcaatccttaccattttttaagcctaattttagctgaatttaaaaggaggggtgaagagggtgaatgagatagaaaaacaagacatgatttttctgggtactctccctctagtctccatccttaacaagagtcttgcttatgacattattcaaaaagccagatacaacatccattacaaagtgacacacatctttggatggctgtttttgaagtatttcataaatctttttatactctctggatggagaaggcctttttaaacatgatactaaagttggaaaccaagaaaaaaagttggatggatttgattacataaaaatacagacttccttatggcaagaagaaaaaaaaaaaagaaacaaagtcaaaaacttggaaaaatatttacagtatgtatgaaaatctaggggcttttttatcttgacaatataaagaatccctccaagccaataagaaaaaacaaaacaaccaaataaaaaaccagaagaatcaggaaatactcagaggaaaaaatacaaatctccaataacatatcaaaggatatttaaccttactagtcatcaaagtgacagtttgcctttcagtttggcagagactttaaaaaaatcccaaaacccaatgttagcaatagtgtggagaaactgtcacttttatctcctgctagtgagagtgtaaattgatttaaaaaaaccttttagacggacagtttggcattattaaaaattctaaagatttgcttattattaattcaacaatttacttcctgtagaaatctcaggaagataatagaaaagtacacacatatattcattataatatcatttatgataataagcatagttatatatagcatatgttataagcaagacacctttatttctcacaacatatcctgttttagtaataaggctagtaaagcacagagagaaaactgagcttgatggcaatcatagggttccaggttgggcagtctgcttgcaaagcacatgttcttaatcacggcataatattgcctacctaaagcaacctaaatgttcaactcaagtgtttgccagtgtaggatgcatttaataagttatgatacttgcagaaaatggaataatatacaaccacaatctattgattttataaaaagtgctcatcttatatgtgatctgatcctgttgttcttcaaagcgttttttaaactcaaaaaacatcaaaatgaatatatacagccataaaatcatgtcctttacagcaacatggatgcagctggaggccgttatcctaatgaataaatgcagacacagaaaaccaaatactgcatgttctcacttataagtgggagccaatcgctgggtgcacacagacataaagatgggaaaaatacacactggggacttcaaaagggaggaaggaggaagggaagcaaggattgaaaaactacctgtcaagtactgtgttcactcttkgggtgatgggttcaattgaagcctaaacttcagcatcatgcagtatatccctgtaactaacctgcacatgtaccccctgaatctaacagttttaaaaagctaatataattttatctctgggtattggtattatgggtaattttagttatagaggttaaaaggttaggctttggaattaaaaggacctgggttccaatcccagctccactccttttggctatgttctttatgttggctacttaagctctcagggtcttaattcccgatttgtaaaatggcaatgaccaatcccttgggggcgggcagkggggtggtgggcagtggaaagagagagagagagaatattaaataacataatgtaggccaggcacagtggctcacgcctgtaatcccagcactttgggaggccaaggcgggcagatcacctgaagccgggagtttgagaccagcctgaccaacatggagaaaccacatctctactaaaaaatacaaaattagccaggcgtggtggtgcatgcctgtaatcccagctactgggaggctgaggcaggagaatcgcttgaacccgggaggcggaggttgcagtgagccgagatcacgccattgcactccagcctgggcaacaagagtgaaattccatctcaaaaataaaataaaataaaaaataatataatgtatatgacagtacccttcctggtaagcatctaataaatagaaatcattattcttataacttattataatttttctaaattgtctgagtgttttacaataataataccttattttattttcagaaaggtaaagccatttctattttggaaaaaaaataaagaacasaaaaatacaggaaagagctcagaatgcttaggaattaatctattatttgtcaacctcaagaaaacacccaataatactggggtattttattagctcccaaaaataatgatatagaaggtaaatgttctagataagcagtactagtgctctgtaagcacttggtacacaagtgattaaagactcatacttcctaagcacagaggcccatagggagagtctctaatgccagcagctaccagaagattattactcactgccacattggttaagcttctcaggtctatggatccttcccctgaattagccatctcaacagtgctttgtgtcccaagaaggactttgccagcactgaaagctgcacctcctgctggaagtagaagtggttttctcctgctttgtgtgtctgtctgcacatggatatgcttctgtattctttgctgtattttacatcagccacttgtctgttatgaccaccaaaacactgaatatggaataaatatttgtatttatagaaagaaataattttttcaaaatcacttatttgttatagattttacatcctgaagtccaaactctagatctacggagctgcgatatatcagatgctgctctcctgcacctgtctaactgtagaaaactgaagaaattaaatttaaatgcttcaaaagggaaccgagtttctgtaacttcagaaggtatgtttattaacactgagtacattggtagattactattcactatctggtaaaattgtggagtaagggagaaaatacgtcaaaagagagtatgaagaagtcagagaaatatgaattatatttatcagtaaaaacattcagactaagaaaataatccaagttagaattcttgcttataatcagtgctcaaagttaagaaagacactgggtaagtcactaccttgtattttaaacatatgtaaaataaacatgggccaggctaggtggcttatgacagtcattccagcacttttttagctgggaggccggcagactgcttgagccaaggagttcgatgccagcctggccagcatgatgaaccgcccccgacccctacctcatctctacaaaaaatacaaaagttagccaggcatggtggtgcaccctgtagtcccagctacttaggaggtggaggcacgagaatcccttgagcctgggaggtagcagttgcaatgagctgagattgcaccactactccagcctgggtgacatasggagactctatcagaaagaaataaaaaatagggccaggtgcggtggctcatgcctgtaatcccagcactctgggaggccgaggcaggtggatcacctgaggtcaggagttcgagaccagcctgaccaacatggagaaaccctgtctctactaaaaatacaaaattagccaggcgtggtggtgcatgcctgtaatcccagctacttgggaggctgaggtaggagaatcgcttgaacctaggaggtggaggttgcattgagctgagattgtgccattgcactccagcctgggcaatgagagcaaaactctctcaaaaataaacaacaacaacaacaaaaaattggccaggcgtgttggctcacgcctgtaatcccagcactttgggaggcctaggcgggtggatcacgaggtcaggagatcgagaccatcctggctaacatggtgaaaccccgtctctactaaaactacaaaaaattagccgggcatggtgacacgtgcctgtagtcccagctactcgggaggctgaggtaggagaatcgcttgaactggggaggtggaggttgcagtgagccgagattgcgccactgcactccagcctgagcaacagagcaagactccgtctcaaaaaaataaataaaattaaaattaaaactaaaaaaaaaacaaaacatggatacatacgtctgtattttaaatattttgcctggtatagtggaagaagaaatgaccagttcatattttgttaaggcttttttgatgccatattacaaaagaattaatcatcagattaaatttactaggtactctcctatcagtttgtgtaatgcatagctttttatagctagacaaactgcattgttcagtgtcactattacatgagttagtgaatctttaccttttttcctctctatagacctctttttttcaatatttggtttgcattaatacttatttttatttatttatttaagacagtgtcttgatctgtcacccaagctggaatgcagtggcacaatcttggctcactgtagcctcagcctcccaggctcaagcgatcctcccacctcagcctcccaagtagctgggaccgcagatgtgcaccaccacccactgcgaattttttatttttagtagagacgaggtctcactaggttgcccaggctttttttttttttttaaatataagaaagagggacttttttggcctcttagaattctggaaaactgtgtgggtagttgagtatattttgcagtcatcttggttagcgagttaggatattcataatattgcaaacacgcataagttttaatatgtttacataaataataactcacaaaaaagaacttctccaataaaaccacatttctctacactcacaccacacttctgacagcaaatgtgtggggttttttcacaccaaacaattctccaactctctggacaccagctgggtgcgctacaatttaattcaattctgacactatctacctggagttagcctcagatcccacaagttaagggctcagtcccacaagactatccccacttcagatgccaattgcaaggccaggcctctggtacatatgactgaccaactataaatggagggtttccatgacctcctcctccattcaataatttgtcagaatggctcacaaaactcagggaaacacttttgttacatttaccagtttattctaagagattataaaggatacagatgaacagcaagatgaagagtacatagggtgaggtctggaagcgcaggagcccctgtccccatggagttgggatacactgccctcccagcatgtggatgcattcaccaacccagaagctcatcaagtcttcttgttcaagaggttttttgtttgttttttcttcttcctttttcttttcttttctttctttttttttttttttttttttttttttgagacagagtctcaccatattgcccaggcttgagtgtagtggtgccatctcggctcactgcatcctccacctctgggttcaagtgattctgattctcctgcctcagcctccggagtagctgggattacaggcatgtaacaccatgcccagctaatttttgtatttttagtagagacagggtttcaccatgttggccaggctgctctcaaactcctgagctcaagtaatctgcccgcctcggcctcccaaagtgctgagattacaggtgtgaaccaccacacccgkcccaagagtttttatagagcttaatccccatcccctattccctgccgtccctgacccccacctcgccaaaggtctgtggactgagctgaatgttctaaccctctactcacttgatttttctggagacaggccccaaccttaggctatctaggggtcacatgctgtcacctcattagcttaaactcaggtatgatcaaaaggggcttattatgactaacaaaaggcactccggtcactcaggaaattataaggcttttcggagctctgtgtcagggactgggaacaaagatcaaatacagttcttattgtatcacaacttccatgctggacactgataaataaaataactggtcttaagaaaaaaaaaaagttctttcttaagatatggaaaacagtaaaaatgacctacccatgaatttaccatcttcccttctgtgtattttgcccataaaggtatcttttaacagtgctaccatgtttgtttatgaccaaagggcccaggatccccgaagtactcttttatttatgtgcacccatctccaatgggcacttatatcagcttaactggatttaaagacttctcttttttgaccctcaggaaaatgtaagattggtccaggctaacagaaggagcatggtggtagaaaataaattcacttttgagaacagagtcaaagtggagcgagagagaacacataggcatagctataaatttctaaccgcaagcatgaagatcatgactgaaaccatttgggcagtttaacttttggtttgcctccaaagtccactagaaaagtaatttgattacttgaaaatttttgttttaaccaaaaggagaatcgcctactatttcactatctaattgggttctgaatgacttttgcctatttcctaaaaggaattcaacctgtggacaataaagccttgccattaattgcagatactacagmctgtgtagagaattcctgaaacattccaaaagagttctgaataatgacagcatcactggaaaatcagtatttcctcacaggtggactactttgaaaagggctaacactgaactggtgattgctaaaatgaaaatcagtcacatttctcatgtatacatatacacacatatagctcattgatatataattatattttcccccaggaataaaagctgtggcttcatcttgttcatacctacacgaagcttctttgaaaagatgctgcaatctcactgacgaaggagtcgttgctcttgcactcaattgccagctgctaaagatcatcgatttaggtggctgcttaagtattactgatgtgtccttacatgcattaggaaaaaactgcccatttttgcagtgtgtcgacttttcagctactcaggtaaatgacatataggctacaaacatatagactatgtgtttaccaaatgtattttcatgactaatgagaacatatcataaggagttcattttgtttttgttgaaactattgaccacttcatgctttttgtggttaagtaattgagatatatattggcatattcctctcaattaagtagcaagggtgaaaggtatatatggctaaaacacatgtttgatgaatgggaggcattaagactatatctaaataatgaatacattttggaaaattctacttccgttgtctggattcatggactgtgtttctttttccctttgcttaggtatctgacagtggtgtgattgcacttgttagtggaccttgtgcgaagaaattagaggtaattttaaarcaattataaagatggtggtgattaaatttttatattcttagaaattatgtttaaaacctascrgataaccaatgctttatcaattacgtattttagggactttgttggtgggtgttctatctctttattgccagagtaaataaaaattgttaggatataaaataaaggtgctttaaaataaaaactcattttacttccaataaaaggccttatttcccagaagttttagcttctaacagatttaagaatcatcttattatggatgaagattatgaatgtttatcagtgtaaagtgatattatttataataggatttcaggtcttaatgatatttctaccaggagtattaattctcttgacatcctgtcatcctatttttcttgatagccacattgtacgatcatttaaaaaagtttttttttttttttgagacggagtctcccactgttgcccaggctggagtgcagtggcataatctcggctcactggaacctccacctcccaggttcaagcacttctcgtgcctcagcctcccaagcagctaggattacagatgtgtgccaccgactaatttttgtatttttagtagagacggggtttcaccatgttggccaggctggtctcgaactcccgacctcaggtgatccgaccgcctcggcctctcatagtactgggattacaggagtgagccactgcacccggcctaaaaaagatcttaaatttgtgttcatcctttgaattgaatcactaatgcacttgtaacctatttctaaatatattaagaagccttttatcccaggattttggtttctgtcttccccagttgacaagtggtttaatataactatgctatttaacagtaagctacatcaaatcctttttggaagtaggcaggctgtaaattaattataaaaatgttagtaaaaataactattttaatagggcacagtggtgcattcctgtagtcccagctactcagggaggctgaggcaggaggatcccttgaacccaagagttggagtccagcctggcaacatagtgagaacttatatcttaaataaataaataaataaatacttttttattttaattttaattaattaattwatttatttattttgagacggagtcttgctctgtcgcccaggctggagtgcagtggtgtgatctcagctcactgcaacttccatgtcccaagttcaagcgattctccagcctcagtctcctgagtagctgggactgcaggcatgtgccaccacatccagctaatttttatattagagacagggttttgccatgttggctaggctggtctcagacttctgacctcaggtgatccgcccccctcgacctcccaaagtgctgggattgcaggtgtgagccaccgtgccctgccataaatacattttttaaaaagccaactattgtaatggaatgacaatgccacgtttttgccaaaatatttatccttgagttattgcccaaagagattcttttttgtgattttatatatctgggtcttggtagcatatatattttttaaatattttattaagaaattaccatattaggttgggcatggtggctcacgcctataatcccagcactttgggaggccgagacaggtggatcacctgaggccaggagttcaagaccagcctggccaacatggagaaaccccatctctactaaaaatacaaaaaattagctgggcatggtggcaggtacctgtaatcccagctacttgggagcctgagataggagaatcacttgaacctgggaggtgggaggttgcagtgagccgagactgcgctattgcattccagcctgggcaacaagagcgaaactccatctcaaaaaaaaaaaaaaaagaaagaaagaaagaaagaaattactatatttattattataccaagttttgaattccaaattgcatcctaaatgcaggagcagtaatttttggtattttaagtgcaaacatttgtcgagcacttactgttatgccaggctgtatactaactgccttatattcactaggttatgtaatgcttacaacattatcttgtaattactataattttaaataaagttctcagttaaattagtttatcaccttcaaataaaaccaccaagaaattagttgttatgcatgatagtaaatatactgacctatttacctcaacattataaaattaagagcaccaacctaagtagaatgagaaaaaaatgcaataaccagtgtgttggtgattatagtgccatatcattacattttttattttttcagttttccaaagattattccaaagtgccaaaacattttaatggaaatgtctctaaaatttattagaacttaatgccttacttaaacaaagtagggtgaatatactttttaaaaaaattgttttgttttgttttgttttgtagagacagggtctttttatgttgcccaggctggtctcaaactcctggcctcagtgatcctcctgtcttgacttcctaaagtgctagaactataggtgtgagccacatgcttggcctgagtgaatatactttaacctttggtttatagcatcctctgactcaaactgaaggacaaacttaaattttgttttttgagacagggtcttgttctgtcacccagggtggagtacagtggcacratcatggcttacagcagccttgactgccctggctcaagcaatcctcccacctcagcttcctaaatagctggggctacaggtatgtgcccccactcctggctacttttttattttttgtagagatgggtcttgccatgttgcccaggatgatcttgaactcctggactcaagcagttctcctgccttggcttcccaaagtgctggaattacaggtataagccaccatgtctggccttaattttttttttttttttttttgagacagagtttcgctcttgtggcccaggctggagtgcaatagtgtgatctcagctcactgcaacctccgtctcccaggtacaagcaattcttctgcctcagcctcccaagtagctgggattataggcagctgccaccatgcccagctaatttttgtatttttagtagagccagggtttcaccatgttggccaggctggtctcaaacacctgatttcaggtgatccaccctccttggccccccaaagtgctgggattacaggtgtgagccaccgcacccagccctaatttttttttttttttactaactactctcataggtaatgcggaggcctacctttcatcacattttaatctgttgcttttaatttrttccattctgggaaattaaattattaatgttgctaaattatttataatttggaaatcaatttgattaaaggtctaaggacctttcctaaagattgacaagaggctgaatgtggtggctcacttctgtaatttcagcactttgggaggctaaagcaagtggatcccttgagctcaggatttcaagaacatcctgggcaacacagtgaaaccttgtctctatgaaaaatacaggctgggtgcggtggctcacacctgtaatcccagcactttgggaggctgaggtgggcagatcacctgaggttgggagtttgagaccagcctgaccaacatggagaaaccccgtctctactaaaaatacaaaattagctgggtgtggtggcgcatgcctgtaatcccaactacttaggaggctgaggcaggagaattgcttgaacccaagaggcagaggttgtggtgagctgagatcacaccattgcactccaccctgggcaacaagagcaaaactccatctaaaaaaaaaaagaaaaaagaaaaatacaaacattggctggacatggtggcttacgcctgtaatcccagcactttgggaggccgaggcaggtggatcacatgaagctgggagttcagagacgagcctgaccaacatggagaaacctcatctctactaaaaatacaaaattagctgggcatggtggtgcatgcctgtaatcccagctactcaggaggctgaggcttgaacctgggaggtggaggatgcagtgagctaagatcacgcaattgcactccagcctgggcaacaagagcgaaactccatctcaaaaaaaaaattaaccagaggtggtggtgcatgcctgtactcccagctgctcaggagtctggagtggggagatcaattgatctccttcaacttgggaggttgaagctacggtgaactgtgtttgcactactgcactccagcttggggaacagagtgagaccgtgtctcaaaaaaattataaaattaaagaaaaaaagatcaacaagcacttagtacaaacttatgttacagcatttagcaaatatcatgatcgtttctgaaatctctgttgatcattgtgttcatcattttgttcattttatcctcagcttttaatacaattctagatatgtggtagtacctcaataaatgttatcacattcttagccttatattacagtcatttcataagtttctttaatccttataattaaaatttaatttgctgtataaaatttcatttattaataaatatttattaagcatttactgttctagatcctggcatatcagagaacagactgtccgtataatgtaacatacttgttttttattgttggtaattcagattgtttctggtttttagctattagaaataattatatattgggacagtcacttttccttccgttgctataatgaattcccaaaaatggaacaaatggattaataggtatgaatatttttttaacagtcctaaattgttttccataaaagttatgctatgagtatgcaatttcagtaagaccctaatctgccagaaatattttcttttttttaatgccttaatttaatatgttttttttcgtttgtttttttttttgagacagagtctcactttgtcactcaggctggtatgcagtgatctcggctcactgcaacctccacctccygggttcaagcgattcttctgcctcagcttcccaagtagctgggactacaggtgcacaccaccacgcccagctaatttttgtatttttagtagagacagggtttcactatgttggccaggctggtctcgaactcctgacctcaggtgatctgcccgccttggcctcccaaagtgctggatttgttctttttctaaaataatgttacagctgggtgcagtggctcacacctgtaatcccaacactttgagaggctgannnnnnnnnnnnnnnnnnnnaggctgaggcgggtggatcacttgaggtcagagtttgaggccagcctgaccaacatggtgaaaccctgtctctactaaaaatacaaaaattagccaggcatatttgcacatgcctgtaatcccagctacttgggaggctgaggcagaagaatcacttgagccctggaggcagaggttgcaatgagccgagactgctccattgcactccagcctgggcaacaagaatgaaactctgtctcaaaaaaataaataaagtaaaataaaataaaataatgttacatctaaagccctgctcaattattctccctttctgccttcagaagtaaccactatcctaaatatgattatgtatctctccttgcatgtttggataccttttcttttttttcttcctgtggaccctgctcagacagaaatggatactttttctattatgtacaaatctataaataagatatagccttgttttatatgctttcaaattttacataatagcttcataatatatgtccctttacaatttgttattcaaaattatgttttctgaaatttttcaggtataattgaggtataatttacatacaagaaaattcactcatattatgtgcatagttggataaattttggtaattgttatacagccatataaccaccaccacaattgatgtatagaacattttcatcaccctaaaaagttgtctgtgttctctgtggttttattttgtttttttgtctctggtcctttgtagttgatccccttctgtgaccctctcttaggcaaccactgatttactttgtcattgttttggcttttctataattgtatataaattcaattttatatacatataattttatataatggaattctgcagaatataatatactattttggtttttatttctttattttacttccttcacttagcatagtgtttgtgagattgatccatgttattgcatatgttaatatttcattcctttttttttttttttgagacggagtcttgctctatcacccaggctggagtgcagtggcatgatctcggctcactgcaacctccatctcccaggttcaagtgattctcctgcctcagcctcccaagtagtggggactacaggcatgttccaccatgcccagctaatttttttgtatttttagtagagacggggggtttcaccatgttagccaggatggtctcggtctcctgacctcatgatccacccaccctggcctcccaaagtgctgggattacaggcatgagccaccacactcagcccctttttattgctaagtagtgttccatagtatggatatgccataatttatttataattttaccatttgatgcaaagataaatagctgggaattaaatgtaaacagcttttgcacagcaaaaggaatagtcagcagagtaaacagataacccacagaatgggagaaaatcttcacaatctatacatctgacaaaggactaatatccagaatctagaacaaactcaaacaaattagcaagaaaaaagcaaacagtcccatcaaacagtgggctaaggacatgaatagacaattctcaaaagaagatatacaaatggccaacaaacatgaaaaaatgctcaacatcatttgtgattacggaaatgcaaagcaaaaccacaatgcgataccacctgactcctgcaagaatggccataataaaaaaaataaaaaaataatagatgttggtgtggatgtggtgaacagggaacacttctacactgctggtgggaatgtaaactagtacaaccactattgaaaacagtgtggaaattctttaaataactaaaagtagaagtaccatttgatccagcaatcccactactgggtgtctacccagagaaaaaagtcattatacgaaaaagatacttgtacacacatgtttatagcagcacaatttgcaattgcaaaaatgtggaaccaatgcaaatgcccatcaatcaacgagtggatacagaaactgtggtatatgtatacaatggaatactactcagccataaaaaggaatgaattaatggcattcacagcaacctggatgggattggagattattcttctaagtgaagtaactcaggaatggaaaggcaaacatcatacgttctcactcataagtaggagctaaattatgaggatgcaaatgcataagaatgacataatggactttggggactcagggggaaagggtgggaaggaggtgaggggtaaaagactaaaaatcgggttcagtgtatactgcttggttgatggttgcaccaaaatctcacaaatgaccactaaagaacttacttatgtaaccaaataccacctgttccccaaaaacctatggaaatttttaaaaaatttaaaaataattttatcatttgatggacatttgggttccaattttggactgctgcagacatttgcatacaaacctctgtgtagacatatgtttttatttttcttgggtaaatgcctacgagtgaaattgctgggtcatatagcaaatacatgtttagctttataagatactaccatactgtttgccaaagggtctgaactaacatgtttgagatttatgtctattaatacaagtagatatttttcattttagctgttttctataaagcattgattttcccgttctccactttttttactattacaagtaatactgcaaagggcatatttataaattgtttccttgtgcacatgtagaagagattctctgtagatcaacaattggaattgctgagttctggggcatactcatcttcagctttaatagctattacacattactttataaaatggttgggcatttaactttttaagctgctccttccaaattacttcagacttatattggtcttttctatatactttttttttgcaagtagatatctggttctttttgtatcagaatgtttctcaaaattgttcatactgttattatagatctttgttttcatttgactttattttctttatttttgcataggagattcatatgggacattgtgtaaatctgactgatggggctgtcgaagctgtccttacttactgtcctcaaatacgtatattactcttccatggatgccccttgataacaggttagtgcaatagattgcttgggttcaaattctggcttcatcttttactgtgtgaccttgagtacattacttaacccatttcattattcagtttcctcatctgtaaaacaggcataatgagagtacctacctcatagacttagtcatgattatctgacaattctttattttattttattttatttwaattttttgggagacggagtcttgctctgtcacccaagctggagtgcaatggtgcaatctcagctcactgcaacctccacctcctgggttaaagcaattctcctgcctcagcctcctgagtagctgggactacaggtgcacgccaccatgccaggctaattttttttgtatttttagcagagacgggatttccccgtgttgcccaggctggtctctaactcctgagctcaggcaatccgcctgccttggcctcccaaagtgctaggattacagacgttagctgccgcgcccggcctctgacaattccttatgtggtggccttgcacatagtaagagctcaataaatgttagtcatgataacgataaatgaaggtggtaatggtggccagtgctcaataaatgttacctatgaagaagattatgatggcagcagtggttgtgttcatgatattgaacatgatgctttatgtaaacaataagaaaatttcaagtttataatattacatctatcaaatacactaaatgacttgttaactattatcaaactgtagacattaggatcagaatagccgggcgtggtggctcatgcctataatcccattactttgggaggccaaggcgggtggatcacctgaggttgggagttcgagaccagcctgaccaacatgaagataccccatctctactaaaattacaaaattagccaggtgtggtggtgcgcacctgtaatcccagctactcgggagattgaggacggagaatcacttgaactcgggaggtggaggttgcagtgagctgagatcacgccattgcattccagcctgggcaacaagagcgaaactccgtctcaaacaaacaaacaaaaagtcagaaaaatttggactcttaggctaatgtggctcttcactggaggagaacaaaacagcagtagcccattttgcctgtataagagccatggtatatatcctcctaccctagaaaccatggcaccctttcatattacccctataataggtccacaccgtaayataaactggatctaacttgtaaatcagtagttatgcccagtccttccagctcatttttcttattacagtctaaataattattccaattattcttttttttttttttgrgacagaatctcgctctgtcacccgccgaggctggagtgcagtggtgcaatcttggctcactgcaacctctgccttccaggttcaagtgattctcctgcctcagcctcccaagtagctgggactacaggcgcatgccaccacatccaactaatttttgtatttttagtagagacggggtatcaccatactggtcaggccaggctcctgacctcatgatccacccaccccagcctcccaaagtgctgggatcacaggcgtgagccaccatgcccagccagtctaaacaattattctgtaggttaagctattatcctggaagtccctttgacaacttctcttttatttttaggaagtccctttgacarcttctcttttttatttttaggttgccagccttaaccaaggctgtaaccatagattgtatctgggtatcagtgacatctgtagtgaagattagatctttatgcaaagacatttcttaagaaactagagccagtaaggacactggtggccgggtgcagtggtttatgcctgtaatcccagcactgtgggaggctaaggtgggtggatcacttaagcctgggaggtcgaagctgcagtgagccatgatcaccccactgcaccccagtctgggtaacagagtgagaccctgtgtcaaaaaaagaaaaagaaaaaagaaaaaaagaaactgttaactggggttagctgcacagaaagttgtgaaggaacaagagtaggaaaaaaaatgtcattgtatacccttttgtatcttttgaattttatatcatgtggattatttttaaactattaaaaattaattggttggacgtggtggctgtcagcacacagatgatccctgacttaaaatgatcaatttacagtttttcgactttacaatggtgcaaaagccatatgcattcagtagaagccatacttcaagaacctgtgcaagcatttttttcactttcagtataatattcaatagattacatgagacagtcaacactttattaaaaaataggctttgtgtcggaaaattttgcccatctgtaggctaatttaagtgttctgagcatgtaggctaggctaagctatgttgttcagtaagttaggtatattgaacacattttcgactttgtgtattttcgacttatgagtttgtcagggtgtaaccccatcataaattgagaagcatctgtagagagaagcaataaataccaattttcttttttctttttttgaggcagaatctcactctgtcacccaggctggagtgcagaggcatgatcttggctcactgcaacctccacctcctgggttcaagtgcttctcctgcctcagcctcccaagtagctgggattacaggcttgcaccaccctacccagctaatttttgtattttagtagagacagggtttcaccatgttggccaggctggtcttgaactcctgacctcaggtgatccacctggctcagtctcccaaagtgctgggattacaggcatgaatcaccatgcctggcctaaataccagttttcaagtctggaaaatatactggagtggttaatcagattttcaaaccaaggagtcttttgagataaattatgtcattatggagatcactagtaaccaaagatatgttaacagatcatggatttaagataaatgcctagttgatgtgatttcagacaccaggaaagcttaatgacactaaatgattaatgagtgcaatgagcttaatcacactaaatgattgcaatgagctgagatcacgtcattgcactccagcttgggcaacaagagtgaaactccgtttccaaaaaaaaaaaaataataacaaatgcggttgagcattccttttttctttctttctttctttttttttttttttttgataatgagtcttgctctgtcgcccaggctggagtgcagtggtgcaatcttgactcactgcaacctccgcctcccaggttcaagtgattctcctgcctcagcctcccaagtagctgggattacagacgcccgccaccaggtctggctaatttttgtatttttagtagaaatggtgtttcaccatgttggccaggctgttgtcgaactcctgacctcaggtgatctgcccgccttggmctcccaaagttctgggattacaagcgtgagctaccacgcccagctgtttgagcgttctatagtggaaaaaatgtgaaagtcatggtattaactaaattttcatttaagagtgtgggaagaatgatccttcaatggacagctttggagggaccaagggagacaaaagtagaattgctgttaatgttgaaccttaagagccatctttgttcaacatacaaattaaaataccattataggccaggcgaagtggctcacgcctgtaatcccaacactttgggaggctgaggtgggcagaccacttgaggtcaggagttcaagaccaacctggccaacatggtgaaaccctgtgtctactaaaaatacaaaaattagttgagtgtggggctgggtgcctgtaatcccagctacttgggaggctgaggcaggagaatagcttgaacctggaaggcagaggttacagtgagccaagatctcctcactgcactcmagcctgggcaagagtgggcaggactctatctcaaaaaaaaaaaaaaaacaattatggaaaacaaaatttataaaaatctaaaagatatgtgatataaatgtaactcacttaagaagcatcttagattttgtattccccgtatgtttcagagcaattctattggttttaccttcgtatttttatgttggtgatgagaaaacacttaaccatttgtaggtttcagtaattgaaataatactttctggtagtatttttcaaatagaccccaggacccatttacattcttaaaaattattgaggatcccaggccgggcgcggtggctcacgccggtaatcccagcactttgcgaggccaaggcaggtggatcacaaggtcaggagatcgagatcatcctggctaacayggtgaaaccctgtccgtactaaaaatacaaaaaaattagccgggcatggtggcgggcgcctgtagtcccagctattcaggaggctgaggcaggagaatggcatgaacttgggaggccgagcttgcagtgagccaagatcgcacaacggcactccagcctgggcaatagagtgagactccatctcaaaaaaaaaaaaaaaatcactgaggatccccaaagagtttttgtttatgtatatttgttaaattaaaatttctattaaaacagataaattttaatagacattcattttttaaaaatcgtaaatctattacctagaaaagagatatattttcattcagatcatcacttttcagatcattgtggatactcttctttgataccccaaaactcagcaagtggtaatttcttatgggttgttgcaatgtggaacttgaaaacatatcaatgaactttgcgtacattttgttatgatgcacttttcatacatttgtgttatgatgcactagtctgtcttgaattttgagttgatctttaccaatgcatgattttgtaacatcatgcattggcagttcggaaaatattggttctctgagttatatagatcttttaaatattgacacattttattatccaaaacaaaaatcagttgttaayataataactgatgtcattagaaaggtcctggatagctttcaagatcacagtggcagctacgaggcttccaaaattcacttgaaagctaaagctttatcactgacaacaaattctgtcatttgttttctttgaaatgacagcctcatttcttctattttcatgaaatagtctgccaagtactcaaataagaataaccttacactgtagtcattgtattagtccgttttcacactgctgatacagacatacccaagactgggtaacttataaagaaaaagaggtttaatggactcacagttccacgtggctggggaagcctcacaatcatggctgaaggcgaaaggcacgtcttacagggtggcaggcaagagagaatgagagccaagagaaggggtttccccttttaaaaccatcagatctcatgagacttatttactatcataagaacagcacaggaaagacttgcccccatgattcaattacctcccaccgggtccctctcacgacacatgggaattgtgggagctacaattcaagatgagatttgggtggygacacagtcaaaccatatcaatcattcttttaaaaagtaaaaatggtgttccatgaraaaagtaactagttcagttcacaaccctgaaagggtctcagactacagaatatgcagactacactttgggaaccactgctttatggtaaagaaaaattatcagtcaacttcaacatttgcagcaagaatagcatatcattttctggccaggtgyggtagctcacgcctgtagtcctgcactttgggaggccaaggcaggcagatcacttgagattaggagtttgagaccagcctggccaatatggtgaaaccccctctctactaaaaatacaaaaattagctgggcatggtggcgcacgcctgtaatcccagctactctgatggctgacgcatgaggatcacttgagcctggggggcagaggttgcaattagccaagattgtgccactgcactccagcctgagtgacaaggtgagacactgtctcaaaaaaaaaaaaaaaaagaatagcatacccctttcaaatcacttcttatatttttgtgtggctgccagaagtagtggaagtagacattgaaatggcaggagttcaaaatatttggaataaaaatatttttgatctggaagatcacagttggtaaatgctggactaggtgttaccgttacatgatctaaaaatgacctttggggccctgtgttgtttacttcttcacagcaaccaggactgttagctcaaaagcccatcatcaccaaatcaaatgtttacacatccaattgtttaagtatagcctaaataaccaaattattagccatctatctagagcccacctgctttacataccctgcaaactacactcaacgtctactatccatagataaaaaccccaggctataaaagaccccaaatcactgctgccctttggagctctgtaacccagagacacccccccacccgccccgccgatcttgctgctaaacaacgtcatgacacatacaccctctctctagtcctccaggaattctcttaccctcccccttctgagtagtggccgccctacactgtcgctgcctttggaaggtctcatgctgtgagggacttcccggcatacaaacctgtcaaagcgctgtccaaagagagcttgttgtgtcccactgccaccttgtggtcacatctttttctttgttctgccctgaaatccttcagattcactgcagttacatggtgtgccataacataaaacaaaaagtgtttatatgtccaaaaagtttgtgaagggcaacatgccactattatgaatgttaatttgtcaaaggctctgagaaatactatagctaagaaactgtttaacttcgtttgtccaagcatttccaaatttctagcacagaacacttttttgattaccctagccaactccatcacattttaaaatgttatttttctgatccctgatttcacagaataggaaagtgagatattgaaatgttatttgtgtcagggtgcggtggctcatgcctgtaatcccagcactttgggaggccaaggtgggtggatcgcttgaatgcaggagtttgacaccagcctgggcaacatagagaaaccctgcttctataaaaaattgttttaattagctgggcatggtggtgcacacctatagtcccagctactcgggaggctgaggtgggaggatcgcttgaggccccaggggtttgaaatcagcctgcacaacattaactgagacttgctgtctaataaaataataatagtgctaagactaaaactaaaatcttaagatacagtaaaacgaacgctgatcccatccacgccatctctccagaacatcgaataaatcacttaactcttatggatctcgactttgccttgtgcataatggccaattatcataacattgagagatctaatattaataataatgcaagaggccgggcatggtggctcacgcctgtaatcccagaactttgggaggccgaggcaggtggatcacctgaggtcaggactatgagaccagcctgaccaacatggtgaaaccctgtctctactaaaaatacaaaaattagccaggcatgatgatgtatgcctgtaattccagctactcaggaggctaaggcaggagaattgcttgaacgcaggaggcagaggttgcagtgagccaaggtcatgccactatactccagcctgagcaacaagagcgaaacttcgtctcaaaaaaaataaataaaaataataatgcaagagttcatacaatatattctaccttgagtcatcacatcaaaaaaaataaattttttaaatagttcatataaaatggcttttattaataaactaaagagaaaaaagctgaagaaattttaactacccagatcacttctactcttcccacttaaccatcagtacccctaaatcttctataatgatatatttttgctaacatcattgaatggaagtaaagtgggctaacatgttcaccttatatttgatttttaatttcttctttttccaaggaagataaatgctggttgtgtttgtgggggttttttgtttgatacatggaaggcctttcttctttcgtgacaccttatataacatgattcctcttatatattcatatggttgctcacatatgagtatttaagaccataaaatttatattatatagaaagtatttactatacttgcatatgcatgtgcaattataatattgttaccctcaaagcaacctgactcccagattagcactgctcactgtaatttcccatcagatctcctgaattaacctattttctcgactatgtttctaagtatttataaaatttcttaaccttagttagaataaaacataacttcacattatgaattaggacttgaaactgttagaagtactctgagttggtttctgcagaagagataaaaactaagctgctattagaaatatgaaaattatggttttggctgtgtatggtggctcacgcctgtaatcccagccctgtgggggggccgaggcaggcggatcacctgaggtcaggagtttgagaccagcttggccaacatggtgaaaccccgtctctactaaaaatacagaaatgagtcgggcgtggtgacgggtgcctataatcccaggtatttgggaggctgagacaggagaattgcttgaacccgggaggcggaggttgcagtgagccaagatcacaccactacactccagcctgggcaacaaagagcaaaactccatctcaaaagaaaagaaaaaaaaagaaaatgagttgctacaagagctttgaaaannnnnnnnnnnnnnnnnnnnattgggacagtcacttttccttccgttgctataatgaattcccaaaaatggaacaaatggattaataggtatgaatatttttttaacagtcctaaattgttttccataaaagttatgctatgagtatgcaatttcagtaagaccctaatctgccagaaatattttcttttttttaatgccttaatttaatatgttttttttcgtttgttttttttttttgagacagagtctcactttgtcactcaggctggtatgcagtgatctcggctcactgcaacctccacctcccgggttcaagcgattctcctgtctcagcctcctgagttgggatcacaagcgggtgccaccacacccggctaattttttgtatttttagtagagacagggtttcaccattttggccagcctagtctcgaactcctgacctcaggtgatctgcccacctcagcctcccaaagtactgagattacaggtgtgagccaccaagcctgtcctaaaacttactaaagcattttaattcaattaggtcttcaatgattatcagtaagttcacctcacatacctttgctaatctcctacagcagacatgcattgccgtttctcatagttatctaagcatgtttgacagtattcaaagacatggaggattttagaagggcaataaagcagttagagagtccttatgttttaccctgagaggcaggagaatccaacaggaaatctgccactttcaatttagtcgacttgaattttaatcttatctgaggatttgttttaacctgatttaaaggcaagttcttttttttgaaatggagtctcactctgttgcccaggctggagtgcagtggcaccatctcagtttactgcaacctccgcctcccaggttcaagcgattctcctgcctcagcctcctgaatagctgggattaaaggtgtgtgccaccatgcctggctaatttttttgtatttttttagtagagatagggtttcaccatgttgaccaggctggtcttgaactcctgacctcaggtgagccacctgcctcggcctcccaaagtgctgggattacaggtgtgagccaccacacccagccagcaagttctttacttagattctggataatgtagatgtcaggatttaccacaaagagccaaaacagtattttaaatttttatttatttatttatttataaatagagacggggtttcgccatgttggtcagactgtctcgaactcttgggctcaagagatccacccacgttggcctctcaaagtgctgggattacaggcgtgagctgccatgcccagccaaaacagtattttaagacccaagtggtttgcttcagggtttccctttaattaaagctggttccttgcttaaaggagaactcatttttttatttcatatttgtcttartcctgtattattctgtttcctcattattcattcattcattactaatcctacatgacatgtttatttttgccagatcactgtaatgaaacattaggactttgatcattatttgtaaaaatgtgttcagccatacttttttcactgtgtgttctctaaaaatgtctaaattacatttcctttgaacatttgaaaaaaatactttgttaaaagtttgtattctttggccgggcacggtggtggctcacgcctgtaatcccagcactttgggaggccaaggtgggcggatcataaggtcaggagttcgagaccagcctggccaatatggtgaaaccccatctctactaaaaatacaaaaattagccgggtgtggtggtgggcacctgtagtcccagctactcgggagactgaggcaggagagtcacttgaacccaggagacggaggttgcagtgagctgagatgacaccattgcactccagcctaggcgacagagtgagactctgtctcaacataaaaaaaaaaaaaagtttgtatttcccatagtttcttcttcttcttggtgttccaagtgctcctgccatgaatctttcaaaaaatgctctccatctatattgtcatagatttttacagaggtggtcaacagttccttagaggttgggaggcagaaaggtatacctttcctcacccatcataagggtcaaggctgacagtcctatacgaaaagggaggttaataagagaaaggcgtaacaggtttatttggtcaaagatttataagagacttcagaaatgaagagccaaacacccagggaaaactgcttgtttttatgcttatgaagcatggacagccatgtagagatgtgactggaaaagagaatgaactaatagtaagagtggagaaacccagcaaggcctgttcagattcttcttggcctttctgtgtgaccttcctttttccagggtatagggcggggccactctggaatgagggccttatgatctcctatctgacaagggtacatcagagaatttctttatggccagctcctaggcagaaaggctggggaagtttagagtaatatttgtaggttttatgtcttcctttggggaaaagggttctagtttctgtgacccaccttggggaagaggaatcctggtttctgtgactcacttgcggagaatgaagggtaagagataggagggcaggagaaggtcagagaccttggttctgaggtggattctgaggccttccaatgtcctttagttcaaagtactcagcatgccaaagtgccatactttggggaatccttttctgagccccaacaaggtcatctatacaactccctcattttaaagataagggaacagagatacaattgatttaagtggcttgccccacatcttagaaatagttgatagaactggaagtaaaacctaagtcatctgaaccacaatctataattccttcctgagcctttaatgtaaagtggcttaactgttactaggatagagaaacaaataggaaggtgacatcaagcatcagtcgggtgattagcataaatgacccgttagccctttttcagtctggagagtatgtgattctttttctttttcttttttttgagacggagtctcgctcagtcacccaggctggagtgcagtggcgcgatctcggctcactgcaagctccgcctcccaggttcacgccattctcctgcctcagcctcccgagtagttgggactacaggtgcacgccactacgcccagctaatttttttgtattttttagtagaggcggggtttcaccatgttagccaggatagtctcgatctcctgacctcgtgatccgcccgtctcgtcctcccaaagtgctgggattacaggtgtgagccgccgcgcccggccaagagagtatgtgtttctataaaatgttctgccaagagattatgaaatacttagcgaccccatagtttttccctgtagcataataaaggcattgaatattcttatttaaacccacagtcctaaatactctatcttcatgggaagaagctgcctaaggagactgtaatataacactgccatctggcatcaaaaatttttaattacataaaaatgttacatgcttactattggagggaaaagcatcttcctataatgtgcaatagtgaattcaaaacagaatagtgacaaatgtagacagaagacaaattttatatatgtttgataacatattcacaacttggaaaaatgccaaaatgattgtagacacaccagctaaaatgaaattgggaagtgttggccaggcgcggtggctcacacctgtaattgcagcactttgggaggccaaggcgggcagatttcgaggtcaggagatcgagaccatcctggctaacatggtgaaaccccatcttttactccattacagaaaaattagctgggggggccaaattctggctaatttttgcatttttagtagagacggggtttcgccatgttgcccaggctagtctcaaactcctgaactcaagcgatccacctgccttggcctcccaaagtgctgagattacaggtgtgagccaccttaccaggccccatcttattgatttctgcaaaaaataaaaagccagcttgtattttgatatgaatttcattgaatctataggtaatttgggaaatattgctatcttaataatattaagccttctggtttggatttctttatttaggtctttaatttctttcaataaagtcttatagttttcagagtataagtttttcactttcatttgatttattcctaagtattctattctttttgatggtaacataaatggagttattttctagttcatttttggattattcattgttgatgtatagaaatacatttgatttttatatattgttcttgtaccttgctgaactcatttattctatttttttagtgaattccttgggatattgtatacacagtataacatctacaaatagatagttttacttcttccttctaacctgaatgccttttctttttcttgcctaatttccatggctggaacctctggtacatgccatttctatgttggatagaaatggcaagagtggacatcctggcgggtaacggtggctcacgcctgtaaccccagcactttgggaggccaaggcaggtggatcaggtctcaaactgctgaggtcaggagttcaagaccagcctggccagcatggttaaaccccgtctccactaaaaatacaaaaaattagctgggcgtggttgcgggcgcctgtaatcccagctactcgggaggctgaggcaggagaatcacttgagcctggaagccagggttgcagtgagccaagatcacatcattgaactccagcctgggcaaagggtgagactctgtctcaaaaaaaaaaaaaagtgtggatatccttgtcttgatcctagggagaaaacatttaatttttcactattagctataggtttttcttgtttgtttttgagacagggtcttgctctgttgctcaggctggagtgcagtggtgtgaacacactcactgcaacctctgcctcccaggctcaattggatcctcctacctcagcctcccaagtaattgggactacaggcatgtgccaccacactcagctaatttttaaatttctttcgcagagacagggtctcactatatttcccaggctggtcttgaactcctgggctcaagtgatcctcccaccttggcctcccaaaatgctgggattacagacatgagccactgcatcctgccatctatgggtttttcatagacgccctttatcaggttgaggaagttatcttctattcctagttggttgaatgagcattggtttttgtcaactggtgtttctttttttttttttttgacactgggtcttgctgtgttgcccaggctggagtacagtggcaccatctcagctcactgcaatctctgcctcctggattcaagcgattcccctgcctcggtctcctgagtagctgggattacaagcacccaccaccatgcatggctaatttttttttttgtatttttagtagagacggggttttcccatcttagccaggctggtcttgaactcttgacctcaggtgatccgccctcagcctcccaaagtgctggaattacaggcatgagccaccgtacccagccaattggtgtttctttgtctattgagatgatcatgtggttttagttctttgttctattagaatggtgtaggtggtaagctgaataatgctctcacccacccaatgatatccacgttctaatgcccaaaatgtgagtatgttatgttacataaggttgccaatggaattaaagttgctaatcagttgatttttaagtagggagatcattctgtattatctatgtaggcccaaaataatcataagggtccttaaaagtagaaggagagaggaccatagagatggcagcttgagaaggactgtgctcaatgatgcccacttttttttttttttgagatggagtctcactctgtcacccaggcaagagtacgatggcatggtcttggcttactgcaatctccgcctccctggttcaagcaattctcccacctcagcctcccaggtagctgggactacaggtgcatgccacagtgctcggctaatttttgtatttttagtagagatgggggtttcactatgttggccaggctggtctcaaactcctgacctcatgatctgcccgcctcagcctcccaaagtgctgggattgcaggcgtgagccaccgcacccagcccaatgttgttcactttaaataagcaggaaggaatgcaaggaatgtggtagtttctagaagctagaaaagtaaaggaagtagattcccctgtagagcctccaaaaaaaaaaaaagataagactttcctctaaaaagtaacgcagacctgcccacacctgattttagcccagtgagacccattttggaattctgaccttcaaaactgtacaataacaaatttgttgctttaagccactaaatttgtggtaatttgttacagcagcaataggacattaacacagtatattatactaattgattttcagatgttaaagtaaccttgcattcctatgataaatctcagttggtcatggtatgtaatcctttcttctagtggctggatttggtgtgctggtgttttgttgagcattttttagtctacattaataaaagatccttgtctgcagttttctttttcatgtgatgtctttgtctggctttggtatcagggtaacactggcctcacagaaagagttggaaagtgtttcccccttcttctatagccacccagctttgtcatggttgccatttaaatggtatgtctttgtccattcttttactttcaacataatttgaaccyatctttgattgagatttcctctacaataaccaataatatttttatgaccatgaataaaactgcatttatcttactagctgcttttttaaaaaattgtaaacctttgttttcccaatgataataacttttcatttctatacactctctggttctcttgctggcaataaaccttggtatttttgcttaattttgttaaacttaaaataaaattttgtcactgtatatgttgggcccatctttttttttttttctactggtctgtgaaatctgtctaggaaccaccaaattacaggatttccaagactaggttagagatatgttgtacataaaacataggttgtatctatggaaacaagtttattaaacttatgagtaatatttaaactaacaaaattttatcagtatttttgctttaattcagatttttaaaagacatcctaaaactaggatggaaaccatatcaaaatcacgactgtacattgtgaaaaactgaaaacatctaaatgtccaataatatagattggttaaattacagtgtatttatataatggttatctatttaaaatcatgctttatagtagtattatacagacatggaaaaatgttcagctacaggtcaacttgtcacgttcggtgactactacctcctytaaccctttgggtgtgttgcagcttcccaaggtggtttaccgtacctattggctttctttaatcctacttttttggtaaatattcccttcattaaatgctgttcagtcaccccactttagtgaatcatctatttccggctaagatcctgaaaaaagttattaaccattaacacaggttaatggtgaaattagaccattactctggttggtggaattatgatgaaattacagagaaaacaacaaatgcctgttttttttttttaaacaagtaataccatgataggtgcactacacctaataatagtgagggctaccattaattaattattagtgagttagttgtatattgtgctttatagatcacctcctttaatcctttaaataactgtataataattaacatcacctccagttagacatgaggaaacattaaacattttttattgtcaattaatatattgtcattrttttcttttatagatcattcccgagaagtgttggagcaattagtaggcccaaacaaactaaagcaagtgacatggactgtttattgatgcttttttgaagatgatcaatgctaggaaagcttatcaaaactactttcccaggaaaccatctatagagatttgcattctacttaatgttaacactatttttaattattttattgtsttaagttataactctcagagaattagctaagtcttggtatatacatggtttgtgctttactcttaaacatctttaaagtgctattattctatatctgttggatgagtcattatttttgaaatgataatcctagcatgaactctgatctrtggtgttggattctgtttcttaaataactttaaaattaactgttttcccttgagatttccttctcctatgtaggtatttgagctattgttctaagtttacctgtaagtataaaccttgggagaatctaagtaaacatatttctaaaagcatagttaccttcctattttctggctcttaccttcttggagtatttaaatgcccatttgccaaaagcagacctgaacatcaagcctgttaattcttcaaagaatttaggtatttgtttcaccgaaatgaagtgacttattagccattcagcgtattagtattacagaggctcttgcccagccacatccattcattgatttttatggctactcttcccagttacattttatgcatctgtaagctttccttccttagcaaaattgcattcaaaaatgkgtaaaaatgagtaaatacagaatatcactacagagacttgtatcctcaggtttattgatttcacattgtgaaataaacagcaaaggtcttagttttcaagtgraaactttttggtaatcacaaaattacctgacacataccacgcttaaaccaacccccaaatttagcatattcattttgccatgagccagtcttgagattttcttaaaagatttcttattttgcctctgatgtagtgaaaaacggggtaagtatgctaactttcttgtatatgttggggggtacttattcaaytccatttcttgtccttacaagatttataaatgtggtatgtttatagtgtggatatatatgttgccactgcaaaggtggtgcatatgtatatatgtgcaaaatgggtaaggcctgttctaactatgaaatttttctaaagacaaattcaataaaatttaatactgaatatttaaccaagtcaatcacattttcccctttttgcagaaactagtttcgacatctaaattgtgagcttctttgggtctatgaaggatttatcttcctaaaacagtttgcagtttgatatttctccttttttatgttgctagctgtattaactatttctcaccactctgtttaaaatatctgtaccccatccagtacccagtattccctattacccttacttctttttctccttactacctatcaccatctgatgcctgttttcatttgttcattatgtctccctactctagaatacaaatttcataaggacaaagtatttatctttttttttcattgctgtatccccatatccccagtgcctagaacagtgcctggtatataataagcactcaaatattcattgaataagtaaatatggaaagaaataaaggaggaaagaaagaaatacccagtaatacccagcctggccaatgtagcaagactccatgtctacaaaaaatacaaaataaaaaaactagccaggcatcatggtggtgcatgcctacagtcctagctactaaggaggctgaagtgggaggattacctgagcctagaaagtcgaggctgcagtgagcacggtcgcattgctgaactccagcctggatgagagagcaagacctgtctaaaaacaaacaaaacaaaacacccaacaacaacaacaaaaatttccagtctctagtctgatttatattttctaatataaagagattggaagtcatcattcccatcctcacaataagaaaaaagctcaataaactgaaaagtcaacaacacttagatccattagagaattaaggttaaagagagaatgcctcacaaattagaaacgcaaatacaaagaaccatagcttacagggagcagaagcctgttgctggagccagtaccaataggaacatttatgctgtaattcctgagttgctggaggctccatgtggatggacttaagaatcaaaagctccagcctggcacagtggctcacacgtgtaatcccagcacttggggaggctgaggcaggtggatcacctgaggtcaggagttcgagaccagcctggccaacatggcgaagccctgtctttactaaaaatacaaaaattagctgggcatggtggtgcatgcctgtaatcccagctgggtttggtggtgtatacctgtaatcccagctactcaggaggctgaggcaggagaatcactttaacccaggaggtggaggttgcagtgagccaagatcacgccattgcactccagcctgggcaataagagtgaaactctgcctcaaaaaaaaaaaaaaaagaatcaaaagctctaggaatctgtccataaacgttatctaaccaggtgtggcaaccctgcagtcactctgaacctattctgcttttgggagctgcccaattcacagattgttctttgctcaattaaactttgttaaattaaaacaaacaaactccagggggcccactcctaggggagacaccacactttcatagttttacctccaggatacctaccaggttctcagggtgaggatcagagaaaaatcccctcttctggtatgaggatagggaaagtaaccattttgaaatatgcccaagtgttcagttctccttaacaaaagccagttctcaagggaaactattttaccagagcctcgttgacctgggggaaaggaagcacccaactccagctgcctctagccttcctgtctcaccaaagtgacaaaagaaaagctgaaagcacttgtgaaggtcacagcaggggcacaggctgacttaactgactgagacttaatcacaggactatagaacataccttctcccataccttatcacatcagttaggctactgtataataacagggaattacaggtgaaaaaaactgcaagcttcagactctatataagaaggaatctctagggaaactcaaagataacagaggagacaatagccaggacactagaggaaaatttagcctgtaatatctactctacagcaaacagtagccctacccagattttaaaacctcatgctaccttagtttacttgtttatttatgcaatacatcatgtctagctatcaacaaaaaattacaaggcatgctaaaagacaaaaaaacagtctgaaaagaaaacaagcatcagaaccagactcagttatggcagacattttagaattaccagatcataaatttaaaataactgattaacatgcaaagggctctaatgcgaaaagcatacaacacgcaagaatgatgggtgacgtaagcagagatagaagctataagaaaaaatcaaaaggaagtgatagaagtaaaaaacatcgtcaggctggcgtggtggctcacacctgtaatcctagcactttgggaggccaaggcgggtggatcacctgaggtcaggagtttgagaccggcctggccaacatggcaaaaccccgtctctactaaaaatacaaaaattagccaggcatggtggtgcacacctaaaatcccagctactctggaggctgagacaggacaatcgcttgattgggggaggtggaggctacagtgagccgagacatgagtcactgcactccagcctggacgacagagctgagactccatctcaaaaaaaaaaaaaagcccagagttcaaggctgcagtgcccaatgattaagcctctgaatagccactgcattccagcctgggagcaaagtgagactgtctctaaaaaaagaaaaaatatatatatagtcttcttctgttttgttttgtttgtttaattcaaagttacatcacagttgtcctcaactacagaaacagatccagctacaatgtttaattcttctccattacttaaattaaatgctgccaccattgagtatggcattgtataatcatattccttcagcggttaaaatagaaaaaaaaatgcagatagagatgtgtataattggcatgcatagaaatacagaaccagttacatgacaaaagtaaacaaaactctaaaccttcatattttaaaaacaagattttccatttaacaagaattacattcattaaactggagagtatctcctatagagaaaacttttagagtcagatccaaacattactatattcatacttggaagcactttgacaactcaaggctgaaaaccccacactgtgcttgttgtcagtccactgttttcctgcctagtagactccaaaagtgaatattctaccactttgtgcaggtgatgctgaatgctgtgtccactgaactggggccgcccagggtcaccaatcagtactcgagttctataggtccagaagcacttcttcagccactgatgaagactatctgcaaggtcttcatcataaaacatatcgccaagaacaacaaggtcccacttatcttgttccaaattcaaaatgttttggattaaaataggaaaaggattcagtctgttcaattcacaatttagtgtaatagccattcctgcaacttaaaaaaaaaaaaagcacaaaatgaattggtatatgctaggctgttataattccatgttgattaaataatttagaagatctgctaacaatatatttttcttcctttttgatgaaagttgttttttaaagtagagaagtataaaggttatcccaatataagctataccacaatttccaaatacatgactggatatcctgaaaacaaacaattcaaaacacctagaaatgctgggacttttaggaatatttgctgatttcattaaccaaaagattttgtttttttactgtggacagggaaacgagacttgggcttgattgagcatggcaataaattagaactgagaccccttggctgggcgcagtggctcacgcctataatcccagtactttgggaggccgaggcgggtggatcacctgaggtcaggagttcaagaccagcctggccaacatggtcaaaccctgtctctaataaaaatacaaaaattagctgggcatggtggtgcatgcctgtaatcccagctactcgggaggctgaggcaggagaatcacttgaacccacgaggtggaggttgcagtgagccaagaccgtgccactgcactccagcctgggcaatagagtgagactctgtatcaaaaaaaaaaaaagaaaaaaaaagaactgagactcctttataaaataaaggttttcagccaggcgcggtggctcatgcctgtaatcctagcactttgggaggccaagacgggcagatcacgaggtcaggagattgagaccatcctgactaacacggtgaaaccccatctctactaaaaatgcaaaaaaaaaaaaattagccaggcatggtggcaggcacctatagtcccagctactcaggaggctgaggcaggagaatggtgtgaacccgggaggcggagcttgcagtgagctgagattgtgctactgcactccagcctgggtgacagagggagactctgtctcaaaataaataaataaataaaataaaataaaggttttcaaggactatattctcagtgaaagggtagaccagaagaaaatcagatcaaataaaaacttacctgtctcagcctgggttctaatggaataaaaataaccctcaaagacaggtcaatactcacttgggtttggggtcaaataaacactatttacatatttcaggaaattcctagcccataaattaacataagtgcttactctggatgtctggcagacacaaatcctcttgggaaaaatgcaccatctactcagacctcaggggattcctacagataatgtcccagtgcacagagattcacaatgtccaatcacaaaatacatataacgataagctaccacactgagcatgtgtacatatttatcccagagaaaaaaaaaagatgagccttaaatattttaaaatatgaatccttactagggtctatgtcattggccaagatccttgatgccccactcatcttagcagcaatagctgtagctccacatccactcccaagatctaatacagattttcctctgacaacatcaggattatccaaaagatacctaaattaaaaaggagaaacatgtctcagagagatgaggaaaaataaatgttgggaacaggccccccaaaatctggccataaactggccccaaaactggctataaacaaaatctctgcagcactgtgacatgttcatgatggccataacacccacgctggaaggctgtgggtttaccggaatgagggcaaggaacacctggcctgcccagggcagagaactgcttaaaggcgttcttaaaccacaaacaatagcatgggcgatctgtgccttaaggacatgctcctgctgcagataactaacccaacccatccctttatttcagcccatcccttcatttcccataagggatacttttagttaatctaatatctatagaaacaatgctaatgactggcttgctgttaataaacatgtgggtaaatctctgttcggggctctcaggtctgaaggctgtgagacgcctgatttcccacttcacacctctacatttctgtgtgtgtatctttaattcctctagtgtcactgggttagggtctccccagccgagctggtctcagcaaataagaggtatgcaaaaaaagaaaaaagaaaagaaaaggaaaagaaagaaaagagatgtctttaggttgactggacaaaagaaatagtgaaaagtagcagaacttggtccaaccttggcaagtttggtctgactagagtgacacaaaaagtccatctccagagctgggcagaggtggcagaagaaaggacctagtcatttggtctttctcttcagcaggtgtgaagcacagtaccacacaactgactgattatgctattcaagtcaatttttttcaaaaaaaagttgtaggctgggcacagtggctcctgcctgtaatcccagcactttgggaggctgagcaggtggatcacctgaggtcaggagttcgagaccagtctggc
